United States Patent 10,563,263 (GENETIC POLYMORPHISMS ASSOCIATED WITH STATIN RESPONSE AND CARDIOVASCULAR DISEASES, METHODS OF DETECTION AND USES THEREOF) - sequence listing, part 2

SEQ ID NO: 185 - DNA, 434458 bp, Homo sapiens
ccaaagccagtcacatggccatcctcagcttcagagaggttgggaaggcattcccactatgtgtctggatgccagcaactcagaaatatttggtgagtgcctctgtggctactggtagtttagttcttatgcctatgttccagttttgtcctctgaaaggccaaatctgaaattcaaaatcttacaaacaggtttatacttgaaaacgggtaaacattctcataacataaagcttaataatattcatgagcttatttttgcaaactctgcatcacaccgaaaagagaagttctctggcttcctcagctcaggggctgtctcattacttggtccctaagaccacagctggggactggttctacctactatggaagtttcaccagccaggacaaaataaaaaagaaaggaaaaaccaggataaatgagcttttgagaaagcaaaattcactgtttttaaggaactgtcctagcttctatcacatatgtattatttttttgaggttaaaagaaggcttttctatatgaaatagtggcgatggtagttggtagaagttttttttttttaaagaaatgtatggctgggtgcggtggctcacgcctgtaatcccagcgctttgggaggctcaggcaggcagatcacccgaggtcaggagttcaagaccagcctggccaacatggtgaaaccctgtctctactaaaaatacaaaattagctggggatggtggcgtgtgcctgtagtcccagctactcgggaggctgaagcaggaaaattgcttgaactcaggaggtagaggttgcagtgagccgagattgagccattgcactccagcctgggcaaaaaagagcaaaactctatcttaaaaaaaaaaaaaagtaaatttacttggcaaaataaaatgttagtgtcattatatatctcaccttcttgttttttcttaaatttttagcaaccagccatgaaacaaaagtttaaaagccactcatctggtttcccctttgttttcaaagaaggaagctagaaaattaagtgatgtatccccaaacacacacatttaattggagaaagaacccctaatcaattcttgaattcaaatttcaaattagctgaatggcatgaacctttcttcccctggaatagccttacagagacctcaccattaacagcatctgcaagagaagattaaagcacacgattactttactcactgtgtaacacatgaggaacatggacgagatgggaaaaaggtgagtggcttaacgtcaagcacttcattaatgagatgaactcctgactttggacagtggtccacttacagacgctgtctttgaaactgcctgcagagcctcctgagatcttctaatatggctgttgaattggggcatttaaaagcttctgatggttgcaatgtgcatcagttttgggggacagggaggtcccctctctctcattaagaagacacaagccaggaatttatactgatcagacaacataaaaatcagctgtgagaggattgggtcagaaaaccaatgaagagaggttggccagaagattaaaaatcagaaaaagaggcttgaaattgctgagctttctaatgataataaggttgccacctattattatggccactcatgttgtccccctgtatatgagagctgtgagagtaacaaagtgttacgtgtcaagggtcacatgtgacaatcaatgtgaaagatggaaagagagggctggtgcctatcacctaggaatgataggtgatatggccgaggtgataaacagtgagaggggggcgagtgtctcttcctcggtggaagttggagtaaatgtagacacggatagagaacaaagtctacttattcaaaaccgagcagccaggggaggagcagtcctcccacagtgaactattgaattgtgaataaatctctgactggagagattctgagtcagggggattagctgttcctatattacatgtggtaaactggcagaaacaggtttaaaccattgagtggtaggtctttaggcagagtaaaattaatgtacccttccttaatggctttggctgtttgaccatgtaaacgcattttgagtatcacatctctagcggaggctaatcactgggaggtaaagatgaccacaagttgcaggcatctcgggatcacaggtctagagcgggagcctgcagcctctctgccagtttcccatgaattatctcactattgtggctttaagacaatatgcactgcaaaaggaaggttatttacattatatatttagcctaacactaggataacatcctttggcatggccactatctgatggtatttgaaactgaaccaacttcctatttccaggcattaacaaatgagagtcttcatgttgtctaatgttatttcctgagtttaagactgatttcttttctccaattcattcacatttctttaaagaaaagatctcctttaaacaattaaatttcccagaattgtttgagcattgttattgttctcaatgagaatatttcctatttaactctagttatgtaacttgatgggaattttcttcagtatctatcattgccatactcagagaatttgcaggacacttgacagataaatcaaccagcctgtcaagagtcagaatcttaatttagatcattcattccaacaagtctctgggcagacaggatgcaaaaatgaataaggcatggcatttgccctcaaacagcttacaatttagaaggggagatgaaaaggaacattgattgtatataaagcatgattgtcatagcccttctcctgtctcatcttcctctgggaataaaattaagggaagggggagagaatattatgcatgaaaacacagcatacttatttgctaagtataagtctcattatatgaatggagagtgacagtttgtactcaggcatcagaaaatgccattttctctagtgagagaacagtatatgattgtgggtaggaatatgggctctatagccagatttcctgggcccaaatccctgctcggccacttactgtgtttgagattttgagtaagttctaaccttctgtgcctcagttacctcgtctagaaatggatatgaaaccaggttattgtaaaggtgaaatacctttaacaagtttaaattgtatagaatagtgtctgtcatgttgtaagtgtccatgagttattattagtaaacttctaagagatttccatattcttaaacacaatttttggtagtgataatattttatttccatttaaatgtggtaaaaaaaaacccatcatatttaccacgcttatgtgtagaggtcagtcgtattaatttattcacactgttgtgcaatggatatttagagcttttttttgagacagagtctgtctctgtcaccaggctggagtgcagtggtgggatctcggctcactgcaacctccgcctcccaggttcaagcaattcccctgcttcagcctcccgagtagctgggactacaggcgcgtgccaccatgcccagctaatttttgtacttttagtagagacggggtctcaccatgttggccaggatagtcttgatctcttgaccttgtgatctgcccgcctcggccttccaaagtgctgggatttcaggcatgagccaccatgccccgccctttagaaccttttattttacaaaactttttaaaaaggatactctgtatcctttaaactacacctcttcattttcccctttcccagtccccagcagccatcagtttactttctgtttctaggaatcttactacttagttacttcatataagtggaatcatatagtatttgttacctggcaaaagagttgtacattttacttcctctgagctcctagattctggctacaatttcatacctctagtatttcatgttcattgactgtgtaaatgtaatctgtagatatgcataatttcaatgcaacagagcaactgctgatcctgctagtgatgcaaagattctaggctatgacctcagattgtgtcagcatggcattactccatttccaatctcatgaagactttggtagtattcacaagaaagagttgtccagtaatttaaatttaaaagattgatagaacaatcatcccttcatcatttgctctttgttatcctctctgtggacaacctttacatgtcttagcagccagaacttagaagcagagggaaactatagatgtcatttgtttatttgcaggcagcaggattcatggtgtctaatcttcaccatgacatttaaagtaggcacatttggggatggctgtccaaagtgatggtctccacttgcccctcattcagggttggtttcctgggggctatgcttgtcttgtgttcctatggggtccacttcttcagttacacttgatgacctgagagagggacccccgacctactgagctcactaggatcttgctcctaaagatccagaatcggctccaagagggtcgagctcttcatgtggctggattacaaacaggtaaacttggaagcaactggaagcagatgtgcagaaaaaagtagggatgagcaagacttccagggtccttctggctttccagagctggctctagtgtttccagaagaccagcttccttatgccttcagactccatgaaatgactcttgtttcctcaccaaaatttgttttacttcagttagagtatattggttttggttagttgcaattaagagtgctaattaatacagcattgtgttggaatgagaaagctgtcaaaaaactaaaggaagactgctatagtacccacaccagagatttggagttgggaggtttaccagtgagggatcaattggagaaggagaaccactataagtattgtggaataaggaatgtattacaggaattagacctcacacaattgtgagaaaagctggagaagcagaagtctaaaaagggagatgaaggatctgagaaaggtgtttaaccagccctgtgtgggtgaatgagttggggcttacagaaaatctgggagctatgtatgtacagctgttggaggaggactgtaaaggggctggtatagacatctacagaaggttgatggttctgtgtctacttcctctgtgaatgtgcagacaagcatctcatagggagcctggggctgctattggtccatagagctagtagttgaggaggagacctgggcatggaatagggagagacagggcaaactggaaaccaccagcacctttgcatctgtctctgactgtctccaaccaacagtaaccttagaacaaaatgactactgctcactgccacctcccaaatattattcttttggccaagtgtagctgggatccattcagggaaggtgattctgcaaaacatagttcccagaataatcaaggtgaaaatagaataatcttgcacacaggtctttgataagactaggaatatataatacataacagctaggaaaaaatatataaattttccccaagtgcttataatgaacaaacatatttgggaaccatatccacctagcctagtcaactaaattaaaagctggagtcatcttagatgctttcctctcaattaccctcaacatctagttaccaagtttcatataattttacttcctaagtgtctcttgaatatggccccattttctccctttttctctcactctctctcctctcattttgacacaaggtcttactttgtcatctaggctggagtgcattggcgtgaacatggcttactgcagcctcaacctcccagactcaagtgatcctcctgcctcagccccccaagtagctggaactacaggtgcatgctaccatacccagctaattttttttttgtagagatagggtttcaccatgtcacccatactggtcttgaactcctagactcaagcgttccacttgtgttggcttcccaaagtgctgggattacaggtgtgagccaccgcgctcagccagccatatcttctctatccttgttacaaatgcttatggtgtcttacctggaactcctacctgtttcctaatcagtctttctgcatctaccacaaatctgtccatactaccactacagaagggggtcccaaccctcactgtgctttagaatcacctggagggcttaaaaaaatccattgcctgggccccactctagaccatatatcggaccctctcacagcaaccttctatggtaccaccattacctttgttttgcagatgagcagactgagacttagcagagggttaaataacttctcaaagtccacagctaagaagtagtggagcttggatatagtgccgttatctgagtgcagagcgtatcctcctaaccacatagtatgatgccttccagactatgccacagggctaatgagatggttggtaggaccagtagtggaggtatggaacacaattagaagtacagaattgaggggaaaagaatgggaatggttttcaatttggttggtttgaatggattcttagacaaccaagtggtgctgttgagggggcagttggaaatacaatgaagctcagtctaatttagggctagtgagggatggacaggaggaaatggatacaaaagacaattctgaggtggaaaggacaggatccaatggctgaatgaaagggcgaaggtgagcggggatgtaggattggctgggaggagaagaagagagtaaagctatcttgaagaaaatttaatacaggaagggcagcagttttgggaatgtgctagagaggactatgagaataattttggtgatattaactttgagaacccagcagaatctgtaagttggaaatatgaatctggagtttgggagagaggttgcagtcagggattctgattgaggttgcatcgggtggttgaaaccctggaagtggatgagagggatgagtaaggtcaagtatgagggatgctcaagaagagaagcaagccatggattaaattctggggagatccaagataaggggtggggagaaggggagaaactaatgaaggggacccaaagaaaggagtgagcaagtgggaggaggacaggaagacagatagatagatagacagatagatagagaagacagaagagaaagagagagagaggagaaagagagaaacggagagagataaagagaggagaaagagatagagagaagaaaaagatagagaaagaggcaaaagagagaaagaagagaaagatttattttaaggaattggctcacttgattttaaggtctagcaagtttgaaatttgaagggcaggctgctaggctaaaaattcaggcaggatttgaagcttctctctctctgtttctctctctctttaggcagggtctcactctattagcctggtctcactctattaggctggagggaagtggtgcaatcactgctcagtgcagcctcgacctcctgagctagagtgatcctcctgcttcagcctcccaagtagctgggactacaggtacaggccactgtgctggctaattaattttttttttctttatagaaagggttttgacaagcaatgggtaaagaatttcctaaatggtgatgggataactggctagtcatatgcagaagattgaaactggacctctaccttacagtttatacaaagttaactaaagatgtattaaagacttaattgtaaaacccaaaactataaaatccctgcaagacaacctaggcaataccattcaggacataggcatgggcaaagatttcacgacaaagatgccaaaagcaaaaattgacaactgggatctaattaaactaaagagcttctgaacagcaaaagaaactatcaacagagtaaacagacaacctacagaatgggaaaacaattttgcaaactgtgatctaacaaagatctaatatccagcatcttataaggaacttatatttacaagaaaaaaccaaacaaccccattaaaaagtgagcaagggacatgaacagacacttttcaaaagaagacatatatgtggacaacattcatataaaaaaagctcaacatcactgattatcagataaatgcaaatcaaaaccacaatgaaataccacctaacaccggtcagaatgggtattactaaaaagtcaaaaaataacagatgctggagaagttgtggagaaaaaggaacacttttacactgttggtgggagtgtaaattagttcagctattgtggaagacagtgtggtgattcctcaaagacccaaagacagaaatattgtttgacccaacaatcgtatgactgggtatacacccaaaggaatataaataattctattataaagacacatgcacacacatgttcactgcagcactattcacaacggcaaatatatggaatcaatctaaatgcccatcaatgataggctggataaaaaaatatggtacatatataccatagaatactatgcagccataaaaaagaatgagatcatgtcttttgcagggacatggatggagctggaggccattattcttagcaaactaacacaagaacagaaaaccaaacactgcatgttctcacttataagtgggagataaatgatgagaacacatggacgcatagaggggaacagcacacactggtgccttttggagggcggagggtaggagaagggcgaggatcaagaaaaacaactaatgagcactaggcttaatacctgggtgacaaaatactctgtacaacaaacacccatgacacaagtttacctatgtaacaaactgaacttaaaagttaaaaaaaaaaaagaggttcttattatgttgcccaggctgatctcaaacttctggactcaagtgaacttccaccttggcctcccaaagtgcctggccttagatattcatacatttatttatttttagagatgtggtgggggtgtggggggtctctctctgtcacctgggctggagtgcagtggccccatcatagctcactgaagccttgaactcctggactcaagcaatcctcccacctaagcctgccgagtagctgggactacaggagtgcactaccatgccgggcaaacacactgattttaagtacaactgtgtgctttcagtcttaagatcttcagcttttgaaggacctcagccttcctctagttctaactcctctcgttctaaggagatccttcccattcctgcagaacgtctccccaacccttcttcttcacagttctccctcctatccctgaaccattgcaagaggttttgtgccaagcctctggcacatggcacattctatctcatgttgtgatttcgttttctatgcacgtgctctccttctagcctggaggtgagctgcttaagggcaaagagctcatgtgtagcccttccttgtacccattgtcctatagcaggtgctacctagggggtgctccagtagcttccttgaatgaaccaaagagaaggggtgaaggggggagtcagttgcctaggagcttgcatggacttctgtgtcctggaaccagcccggagctgctggaagatgctagaagttggaatcctatctcatttctaaacatctgctcccactcatctctttccagggtcatcagttatccccactcctcccccccgcccccactttgtataaatgagcccctcacatccctccatcttctccatcactgtgtggtcacttcttaaatcatgcgtctggaaggcgccctcctgtaccccatcctggaggcttcctgcacttcccctcttgtttcttccagaaatgagtcagagtgaaagcaaactttctgaggtcctgagatcccggagacaggctgtgagggccgctggccccgcccgctccagcagcgtgtgtgtgtatgtctgtgtgtgtgtgtgtgcgcgcgcgcgcgcgcgtcaggggccaatgctggaaaggaaacagcggactcgctgaggagaagaaaggagccgcccccttcgtcgccagccccctccccacttcccgtccagcgcgctgctcccttccccccgcctctggcctcggggaaggagcaggaggcagcccaggcggagcgggaggagctggcagcggggcgcatgccaggcgggggtcctcagggcgccccagccgccgccggcggcggcggcgtgagccaccgcgcaggtaggggagctgccacagagtcctagcacgtcctgggggggtcctggcaaggagggcgcgctctggcccccaggaagtcgcgtaggtcagggcgtgcctctgttaacaacccctttcgaggtgagggaaactgaggcaggacgcgaggcgtgcgaggttgagagaagagcgagtcttgggctgccagcccggcaccagcgccgagccgggccaggtccctgacccaggactgtgcagcgatccccgggacccgcagtttgcgaaactgtaggagtctgacccgcgcccccgctgcgtgtccaggtgaccgggaaaggttgcagaggcgtgcttggggtttggatccgtccccgtcctgggacacctgcgccgcctgcactctcgttgcggtgcgccccagcctgcgccccctcgggacaggggacgtcccgcccgccttaaccccaagacccagctggatctcgggttccaccccttcggggacctggagggaggaggctgggagcgggaccaggaactggtgcctgtgccttccctaggggctgctctgaaatcagtgtcaccgcccacttcctacttggctacagtaacggggatggcccaagccggagactgctcggtttccaccgcctggagcgcgggtctcgctgtcaactcttagtgatgattgtggatggttgtttttcaacaatgacaggacttctaccttctcactcttaaaatgtgaggttttccaaagacagtgagatttggagttagggagtgctgccttgtgttcttgctgggtgaggacagggctgggtcagtcgcttaacctctcagagcctcagtctcctgaaatgtaaaggagaacactcatagcctggcctccatgtgtcgttaggtttgttgtatgggaaatcaatttgcaaagtgttatcatcaactggacaaatttgaattggacagcactaggaccataggaactggggtttggagacagtctgcctgcatgtcaatcctggacatgcaggagactatgacagtacctgcttcatagggttgttatgcggtttaactgtgatggtggaagtgaagcacctcgcccaatgcctgaaatacccagtgcactctcaaaaaaccttagttgctatttttcctaggcaaaatctaaataattgggagtaatgtgagaataccagtttgatttgattaatgcaggaatagtagggcatttaaaaacacatgtagttctcctgtgctcggcatggtacatgaagtcctctgaggttcagttctgtgccacagagcaaaaagaaccgtggacaagatacccgcttttcgggctctttgactttgagcctgttttctcatctgtttacaaaaaagataaaagaaaaatgggggtagtaattactgccttttgtactgatcgcattgcctgaggattaaatgaggcaaaagatctgaaagcaccttgtggagtatgagtcactatgcacatataagacatgatagtactaggagggaatggtaacatctgcaggtttttagaacttacaatgtgccagacattttattatgaattcctttgatgaaatcctccctgcatctttatgggactgggattacagtcctcatttccctatgacaaagctgaggttcagggtcaccctgcttggttcccaagctcacagagctcttaagtgtaaagccaggattagaaccctggtgtgggtgccactcacaactgtgttcttggccgcttgccaaactgaacttatagagtggagctgtgattcagaacagacctatattagaatttaggtaatttttttttctttaggagacagagtcttgctctgtcacccaggatggagtgcagtggcacaatcatggctcactgtagccttgaactcctgggctcaagagatcctcctgttccagctttttgagtagttgggattacaggcgcatgccaccatgcccagctaatttttttttttagagttggagtcttgctatgttgctcaggctggtctcgacctcctggcttcaatcattcctcccactttggcctcccaaagcgctaggattacaggcatgagccaccaggcccaacctccatcctgcatatctatagacccaaaatgtaagagtgaactgttaatcctggcaaaagaggctttggcataattttaatttccctcagacttattttataaaatatactttaaactatcttcttgtaaaacaaatgatgacaatttgcagaaaagttattaaaacattgaaagaacaggttgcaagatctcatcacaaatctctaagtggtatctggattgttttgttttgtttcaacactcatttgccagaacccttaggatagcacatgaggtgtaaccggaaatcgaggcgttgggtgtcatggttactttgcagggctgggccccgggacttttctgcaggaagttcattgctcacccaagatgcctccagaagaaagcagaaacttccgagaggagcgtgaatgctctgtttctgtgctgcagaaacaattcctagtttatttgtttcctaaattaagtttatcttattggtttttgtttttccaaaagcaatgcatgctcattacaggaagcacagaaagctacaaacaagtaagtgaacactaaaaaatactgtaatctcaccaaggtagacaaatagcttggtgtctctgtccttgtaacccatttctatgctgcatgcatccatccaaaagtgagaggcaaactattattgttttttgttaaatgacaaaaatagtacttgctaattgctcaaacattatgacattaatgtagaacaaagccaatttattatgctcattaaaactttttctttttttaaaatctaaaaattttgattggagaaggattagagactaaattgttgatatttgaattttattgtggttttggttaaagtttgatgcaggaccttcagagcaaagagagggtacaatggtgacctttaaacaatatatatattttttgagacggagtctcgttctgtcgccaggctggagtgcagtggcacgatctcggctcactgcaacctctgcctcctgggttcaagcgattctcctgcctcagcctctcgagtagtgggattacaggcgcccaccaccacatccagctaatttttgtatttttaatacagacagggtttcaccatgttgatcagcatggtctcgatctcctgaccttgtaatctgcccgcctcagcctcccaaagtgctgggattacaggcatgagccactgcgccgggccctttaaacaagatttaaagaccagcacacaaagtttctgagtacaaaaaaaggtaatattttaggttagggtcattagaccagaattagaatcattctttttttttctttttttaattaaaaaagatggggtctccttattttggccagattgaccttgagcctcaagcaacttctgcctcgacctcccaaagtaccaggattacagatgtgaaccattgcacctggccagaatcattcttttgataataatgatggtaattgagtttatatgctgtgttctcatgaatccaagcagagcccactgtttccagagattcccttggcagccaccctgggttgaggagggtcccctcctggcacagctggaaccaccggtgaagagccatttttcagtcagcaccgtttagtaatataagacttttagcctcgaggagtcttccgttgttagttcctaactttaatgactttgtggtaaaaattccttagcgaatgacttctgtgcaacaatcatgtaatttttaaaattccagatgctttagccgttcagaatccattttttctttcaaaaccagagttcaccagctgtttctcttgagcgaagactttgcaatgagctttcaaatgttcacaccaagtagaagcaggaagggagaactgtggctgggcaatgaatgaaatactgacatttagctgtagaaggtaggcaggggctcacatggtgtgcacagccccttatatgactactggtcctgtatctgcttcctttccctgccccatttcccctttggctttttgtcatgactcagaaatggatgctagacattatggggctccctccagtcactcgggtcactcgtcacagacttataaacagaatcacagaacttattgtcagatgaagcttcaaaacaccagttggctaaactccttgtgttctggcaggtaagatgtcggcatccttatttaacaaatgatgctactgagaactatgtatgcagagacatagtctcaaaataagtgcagtcatgcctcgcataatgacgttttgtcaatgtcacatatgtgagagtggtcccataagattatactgggctgtcaatttcctaatgcctagtatttactatacattttaatgttattttgtgtacttctacttagtaaaaaaaagttaactgtaaacccgcctcaggcaggtccttcaggaggtatcagaagaaggcattgttgtcataggagatgatggctccatgcgtgtttttgccttgaaggccttccaacgggacaaggtgtggaggtggaaggcagggatagtgatgatcctgaccctgggtaggcccaggctagtgtgtgtgtttgtgtcttagtttttaacaaaaagtttgaaaagtaaaaaaataaaaattaaaaataggagcttataggataataaggatataaagaaaaaatatttttgtacagctgcacaatgtatttgtgttttaagctgtgtttttataaaaaagtcaaaaaattaaaaaaatttaaaaattattatatataaagtaaaaaaagttatggtacgctaaagataatttattgttgagaaaaaaatttaaatgaatttagtatagcctaagtgtacagcgtttataaatacagtagcatgaaattatgtcctcaaccctcacgtgcactcaccactcactcactgactcacccagagcaacttccagtcctgcaagctccatgcatgataagcctcctatagaggtgtaccatttttcatcttttatagtgtatttttactgtaccttgtctatgtttagatatgtttagatggaaaagtacttaccattgtgttacggctgcctacagtattcagtacagtaacatgctgcacaggtttgtagcctaggaacagtagctatacaatatagcttaggtgtgtcatagcctataccatctaggtttttgtgagtacactctatggtgtttgcatgacaaaatgacctaatgacacatttctcagaaagtgtccctgtcaataagtgatgcatgactgtgattgaaataagtagccccacattatttttctcatgtcaacttcaggttaattttccagccacgtggccttgtgcttgctcatcataaaaaaatgtggataaaattctacctgttaagccacaacatttgcctgtcatgggtggacatttaccgtttattttcagagttcaaagtttgaactctcagagaaatgcaaataagacagtaaactcctcgaggtgaggaatggcaatctctgaagataaatcatatatttattgtacagtattgaatgttgtaagtggcagtagagatcatgtaatctggccttcttcttttacaggtgagaaaagtgagaaacagcagcagagtgattgttagaacctggctcctcttcttttacttagaactgttttcattaagttgtgtttcatttcatagttctgtataattcatccctgcttaagatacattaaatgaattgaactgaatcccttttttttgagctatgatggctcttaaaaacttagattttcagccaggcgcagtggctcatgcctgtaattccagcagtttgggaggccaaggtgggcagatgacctgaggtcaggagttcgagaccatcctggccaacatggcagaaacccatctctacttaaaatacaaaaatcagctgagcatggtggcgtgtgcctgtaatcccagctacttgggaggctgaggctggagaatcgcttgaacctgggaggcagaggttgcagtgagccaagatcatgtcactgcactccagcctgggctacagagagagactccgtcaaaaaaacaaacaaacaaaaaaccacgtagattttcaagtaattactattgttacactaaatgtcaatggatccttaagaatctatttgttcatgaattcattatttattcattcaacgtttattgagtggctacttggttcagaattagaattagcatgacagccacacattagaaaggtatcactttttgactaaattaaaaacttgctaaaaatagttatccattgatggaataggctaccccgaaaggcagagagcattttgtcattggaagtatgtagggcagtgtggatgactctagggtgactgtcatgagggttctgcactggggagggggctgcgttggatgatgaatgggaacccttccagtgctaagatgctgtgatcgttgtcctgcaggattgggattgtgcaggatttgagctactgtgtaaatttcctattccctgctcattgggcttccacattttgcttccttcccttgcccaggtggttccatttcaggaagcctagatagcttctttgcagtcatctgcccgaatgtcgtagctactttaactccccagagctgtacatgtctaggattgatattgatcattaacacaattatgttcgcccagatgaacaaatctaccaggagtagaaacgtgcatttgacaggtggccttgcatggagactaatcgctttcacaggttgaaaggtgaaatatctaaagtttaatgagtaagttgtgtcctgaatgtggaatctgagttgaaattgcattttgtgacatgtacgcctacctaacttttctttttcatacctgtcatctttttttttttttttttgaaacggagtcttgctctgtagcccaggctggagtgcagtggcgcagtcttggctcactgcaacctccgcctcccaggttcaagcaattcttctgcctcagcctcccaagtacctgggattacaggcatgccccaccacgtgcagctaatttttgtatttttagtagagacagagtttcaccatgtcggccaggctggtcttgagctcctaaactcaagtgatccgcctgcctcggcttctcaaagtgctgggattacaggagtgagccaccgcgcctggcctgtacctgtcatctcttggtttgtgagtggattgattattggactttatttttaacacaggagaatgtgcgtgttttgcatttgtagtgaaagcatgcctcatcttactccaacactgataggaaaaggaagattattttacaatggtcaagtgaaaaaaaaagtaaatacagagataaaacggggttctaatatttctgctacactggaaacttagagttgcaagagctgttttgggatcacaaatcttctgaagaaaaaaagtttgcgtatttcagtacaagtcttaatgtttccctagcgtcttgtgttatagctgcaggccaagcaaaatgaaatgtgagacactgtccttggggatagagcatctgtattcaatttaaacagtagatttgggggccttaaattgcctcgactctattaatcattttgtgttccttagtttatagaattatctcctagagacattaacttatccattaatttcttccattgtgtttatttattcattcacaaacactagcacctactgtatacacagtacagtgttgtacattgcagggtacttaaaaatgtagagtgccaggcatggtggtgcatgcctatagtcccagctccttggaaggctggggcgggaggattgcttgaggccaggagttcaaggtggcagtgcgctatgcttgtgcctacaaatagccactgcactccagcctggacaacatagcaagaccctgtctcaaaaaaaaaatgaaaaaactcccccaaaaccaaaaatgtagattgttctcaagggccatccagtctagagagaactaagggagcctggtattcttaggccttagagcttaacagccacacctaggatgcctcttcagaaggtgttccagcccttcctgtgtcttcccagttctgatactggattatgtcattatgtctctgttgagtaactccttccaatcaggcctgcacactgctgccaggacagtcctcacaaagcacagatctgattgggttattgttcctctgtggaaggggctttcagagactcattatctccccccaagcaaattcttagcatctcttttcaagctttccatacactggcccttaaacacttaaaacggacactctggcctttttattatgcacattattctgcccaccgagaatattacagaatccgtctttcttgctcccaatctgaacgcatcaaaatgtcatccctcatttaccacctagcaaatcaataatgcttctcagccttccctggttctctggaatcgtctgctctctccttcttctgttatagtttgttatggatataacctgtttttctgactccaatgtagacttcttcaactcaaggtttcagttctggtttatctccttactccctcatctatgtagtacacttatggtttactctgttctcactggattagaccaaactcttaattatatttaggatgtattaatccaatgcatagattaaccaagtctattatttttatatcttttgaaaccaatcaggagtttcagaagttcagttcagtttaaatatttattgagatgcatacactatatagtcagatactatgatagctcttgaatataaaaaatatatatacttatgtttgtatatatatgtgtaaattgatatgtaaattcaaatagatagtgttgtctacaccattgagaagcctatagtcccgtggaaaaaagagaattcattctcatgaagtttccggatattgtttcatcagaaggactgggcacatcggggtgtactaaaatcattaagaagtatttagcaccagtagatgcctaataaataccttacagtctagatggatggatagatggaggaagaaagaagggctcctttaatttataatttacctattgctgggtttactcctaggtatgacaattttgaaaacaatttactcaatgtttatttccacactgtgtatgaaatatgctgctcttcattcagaaagagatatataattctccatttgtagaacactgagttaatttcatggttgtgatgttgcttttgcttactttcacccacattttctcctctgtagggtggcagctccgtagggtggacacacgctttgggagacctgcagctgtttgtgtctgggggcaatggtgaagggcagtgactcattggcccagaactcatgatctcatctctcacccagctggctaatcggccttggggacaggaggatgagcgctgcactccctcctaatcatgcagcttttgtatgtctttctttacttgacttaaattgtaatttgaatggaaaaatggacaaattctatcatttgaatttaacttttatatattttcttgactctgatttgggattatctaagtgcatttattcaaatatttattgtgtttttgaaactttttttgaaaagcataaggtaatacatgataaaagatattgttattacccctgtttctgccatttcaaggagtcagaacaggctcagtggaaacaaaatgagatgtcttatgggagttactttcccttcagctaatcttggtatgaatttatattgacactacctttaaaattttattctgctttttaaattttactttaagttctgggatacatgtgcagaacatgcaggtttgttacataggtatacatgtgccatggtggtttgctgcacctatcaacttgtcatctaggttttaagccccacatgcattaggtatttgtcctgatgctctccctccccttgacccctaccccccagcaggccctggtatgtgatgttcccctccctgtgtccatgtgttctcattgttcaattcccacttatgagtgagaacatggggtgtttggttttctgttcctgtgttagtttgctgagaatgatggtttccagcttcatccatgtccctgcaaaggacatgaactcatccttttttatggttgcatagtattccttggtgtatatgtgccacattttctttacccggtctatcattgatgggcatttgggttggttctaagtctttgctattgtacatagtgctgcagtaaacatacgtgtgcatgtatctttatagtagaatgatttacaagcctttgggtatacacccagtaatgggattgctcggtcaaatgattagttttttatttatataaatttatggggtacagtgcaatttcattacatgcatagtttgcctaatggtcaagtcggggcttttaggatgtccatcacccaaataatgtacattgtacccattgagtaatttctcatccttcactcctcctatcctcacccttctgagtctccattgtctgttattccactttctacatccacgtgtggacatgatttagctcccacttgtaggtgagaccatgtgatatttgtgtttctgtgtctgacttgtttcatttaagataacggtttccagttccatcgatgttgttggaaaaggcatgagttcattttgtatggctgaatagttttcccttttgtatgtataccgtattttctttatccagttctctgttgatgaacatctaggttgattccatatctttgctgttgtgaatattgctgtgataaacatgtgagtccaggtatttttctgatacattgatttattttcctttgggtagatacacaatagtaggattgctatattaaatggtagttttatttttagttctttgagaaatctccatacttttttccatagagattttaataatttacattctcaccaatagtgtttaaaatttcccttttcacttttcactgcattctcttcaatatctgttattttttgactttttaataatggccattctgactggcataagatgacatctcattgtggtttcaatttgcatttctttgattagtagtaatgttgaacatgttttccatttgtatgtcttcttttgaaaaatgtctattcatgtccttttcacactttttaatggaattattttgttgttgttgttgaattgtttgggttccttgcatattctggatattgttggatgcatagtttgcaaatattttctcacattctgcaggttgtctcttaagtctgttgattatttcctttgctctgcagaagctttttagtttaactaagtaccatttccctatgcttttttgttgttgttgttgttgcctgtgcttttgaggtcttagtcatgaattctttgcatagaccaatgttcagaagagttttccctcagttttcttctagtatgtttatagttttgggtcttatttataagactttaattcatctttagttgaatttagttttgtatatgatgaggtataggggtccagtttcattcttctgcatatggccatccaatttccccagtatcatttattgaaaggggtgtcctttgcccagtgtatgttcttgtcaatgttgtcaaagatcagttggttgtaaatatgtggctttatttctgggttttttattctgtttcattgatctatgtgtctatttttataccagcctatttgttacctattgctgtgtttactcgttattctcttttttaatgagtaaaataccctttttaaaagacaacatccaaattaggagactgcctttgattaaaatgaataactattaatcatcacagagcagggaaagtgtgaatcatcaggaatttagtggagagaaatccactgttttgggtatgtctttgtattagtctggggtaaatttcttgaggacaaaccttgtctcatttgccttcttataattcatgttagacttatagtaacagtaaagacttactgaattgggttgctttaaaacagcatgtgtaatatagccaccatggcatgcaggagtaggtagaattgcccccaaccaggagtggctcttgaaacatcacagggagaggattaggtaacggttgggttagaaagaggagcacaaggcacttgtcttcatgttgcttgggctcacaagcacacttttcatgtagattgcgtgttcaagatcaacatgccaaaagtggcaaaaatctctaaaggagcctccatctacacatttcgtgagagaaaaatgtccattctccatatcaaagcacattatcatgattttaatttggagtggatttaggggactgatgaagcatggggcactgcagcatccccctagccaacccttacacctgtggtgctcccaacacctcctgcgttcatcatttatcatgaagtatggtgcattcctgaaacactggacaagtgcatcttctcctagaagcacggaggtacattccaaaggcaaactcacttaaattgtgatcagaatacttcaacttgcttgctattgttgtggataagtgatagttaaccacaaccggctgagtggccaggtggaaaggacatggatggggaaggaggttcagggtcctgcataagtcctctagtgtctgtagatctcagtgtcctcccttgtgaaaatggggataatatcagccctcaatttacacagttgtagtgaaggtccaatgtgatcagtgtttgtcacaacctgtcatcatttatgtgtatagaactgcttttactataaacttgcttgtattgtccccagcagccagtcctgcctataatctgttggcttcattgcttgtccagtgatctgtggctccctcctgtcctaatccaggtccaagtggattaatgttatctgattcacgttagtgtttctacagatatgtaatgttatctgaatcacattagtgtttctacagcaaaacagatgcttgttcccactaagtaggataaatgaagactctaaattgcttcacatctgtgcacatgaggttctgccaccatgtgagttcagtcaggtcagattactgccagatgaattagagaaggcttgaggttctcagagaattttggattttggaattagagatgatgcatcatggatttgtgcttaatagctgttttgctactttccctccccttcccctctctccctcctcctccacttccagttcttagcctcagttactattgtactgcctccgtttcttgagacaggctgctgatatgctgcctttggtctctgagccaccaggtatagcgctgcataatggaagaacagatgaacataagagtgtcttggggaagatgagcacaagacatcatggggttgtattgttacccccagcttcagcacattcccggagtgtaagtgcaggctggcttctccataaagcaacacagcagtatgctctgagtgggagtacctccgaaactcagcttccaaaactgtgggctcaccagacctccttggtattttttttttttttttttgagacaaggtctccctctgttgcccatgctggagtgcagtggcatgatcacagctcactgcagcctctacttgctgggctcaaatgatcctcccatctctgctctgcaagtagctgggactataggagtgtgtcacaatgcctggctatttttatttttatttattttttgtagagacaggatctccctatgttacccgggctggtctcaaactgctgggctcaagaaaacctcctgcctctgtctcccaaagggctgggattataggcatgagccaccacgctgtgcccctccctggtttttgatccttggtctgacccctggattctcctggttgacttacactctttggagtgctgactagtatagactctcccaatgctgccttttggatgaatcctgtgatgccacattttccagccttaggacaaatgataacctaccctgtagtctgtccatgctctggagaccctgctggtcttacaagatgaactggacaactgctttcactgataggcctgaaggaaaagggttggaactgtcaaggttccccattaaataccaaccagcaatgacaatcaaggtgagctattcttgtgctgggtaggatgctatcttgggctctgagtgtgtccggaattggtgggttcttggtctcactgacttcaaaaatgaagccgcggaccctcgcggtgagtgttacagttcttaaaggcggcgtgtctggagtttgttccttctgatgttcggatgtgttcggagtttcttctttctagtgggttcgtggtctcgctggctcaagagtgaagctgcggaccttcgcggtgagtgttacagctcttaaggcggcgcgtctggagtcgttcgttcctccttgtaggttcgtggtctcgttggcttcaggagtgaagctgcagaccttcgtggtgactgttacagctcataaaggcagtgtggacccaaagagtgagcagcagcaaggtttgttgcaaacagcgaaagaacaaagcttccacaatgtgcaaagggaccggagagggttgccgctgctggcgcctgcagcctgcttttattctcttatctggccccacccacatcctgctgattggtacagcccagtcgtctgttttgacagggcgctgattggtacgtttacaatccctgagctagacacaaatgttcgccacctccccaccagattagctagatacagagtgtccattggtgcattcacaaaccctgagttagacacagggtgctgactggtgtttttacaatccctgagctagacataaaggttctccaaggccccaccagactcaggagcccagctggcttcacccagtggatcccgcaccggggctacaggtggagctgcctgccagtcccctgccgtgtgcctgcactcctcaggccttgggtggtcgatgggactgggcgctgtggagcagggggcggcgcttgtcggggaggctcgggctgcacaggagcccacgaagggcggggaggctcaggcatggcgggctgcaggtccccagccctgccccgcgggaaggcagccaaggccttgcgagaaattgaacacagcagctgctggcccaggtgctaagcccttcactgcccggggccggcggggccggccggccactccgagtgcggacccgcggagcccatgctcacccggaactcgcgctggcccgcaagcaccgcgcgcagcccccggttcccgcccgcgcctctccctccacacctgcctgcaagctgagggagccggctccggccttggccaacccagaaaggggctcccacagtgcagcggcgggcggaagggctcctcaagtgccgccaaagtgggagcccaggcagaggaggtgccgagagcgagcgcgggctgcgaggactgccagcacgctgtcacctctcgtgagtatctctagtgctgctggcgatgagatgattcagtgtggatgattgataccaaatgtatcatggacagtgaaggctgtgtaacaacacatataggtaggctctgttacaggagttacagttctaggcccagtaaatcttttttttttcactgtgcaattgaattttggttttacctatataacattttcatctgtatgaaatgtaagctctatacaattctccattaggacattgtgtggattttggtgtttctgaatctcttctggctcagaaaattccctgctcttgctggtataatttcatacccaaagagggcattctaaccttgaaagaagttcagctcagcagagcgtctgtcattgcctttctctgtaaacacagttttccttcttccttggcttctcaggtgttttagctccagggaggaaatagtcacagtgaaaatctatttaataaaaccgttatgaaaatgtactcaacctgagcatgcactggaacagcagaagatgaggacttggtctactgccttcccaccaaaccttgccggctctgtaaattttcagagctgtcacttgtgagctatttccaccaagggagagcttctgtaaagttggggacttggcaggccatttcgctaattctttgggtgttcttttagcattgtctgcagtgagtgtgggagtcaaaggcccttcagtgcagagataatgccatcttgttccctggaaccccgaaagagccagagtcaaaggagctttttgtttcactcatagaaaaacccacaggaaatcccagcttcagatattcctattcagtttccttgtcccttcagatctcactgtgtttaggcctcctttgagtgaggcaataactagtaaaaaaaaataaaataaaataaatgaaagaatgccattcatggtggcttggggactgggcacacacactgtatacacggtgtgggggccttccccgggacgctgatgtccttgttctcctagcagtcaaaaattggccagtgaaatacagagaatactagctacctcatactgttaagagaattgactgcggtcagatgtgtagagtttcaagtacatacagtttctgcctcactgtaggcgctcaatattattattgaggagctattattagatttcacatctctgccagctcttgtgtcacttattaagcatatgactgggaataagctatttaattctcttcgtctgtaagataggaagtaataatgcttattttgtgggcctattgtgaggatcatgtaagatgagagataaaagggcttagcaaacggtagcatattacaggtggcctgcagcctgccgctgtgcaggtgacgtcccacacaatggtactggccgaggggtgaatggagccctggtgctgaggatggcgagcctttttctaattcatcagctcagaggtgccacctttttctaatttaccctccctaagaggacatctttttatattttaccagcccacagaagataccttttaaaaatttgcacaatggtaccatatgtgctagctgcaattctgtcaacaagagaaagatgttatttttagtgtagcagacagagaattctggagagggcacatggcatgctttatctggctccaacttggtcatttctgtttaatttcaatgatctgattgccatagagtcagaggagcaattttgctattgcccaaattctacattttcactaggattttccttgaaggcaaggactataacccccaccctgcccatcaccttgcttgctcaccactgccctgtacatatccttcagaatggacatttgttaacaatgggtaagagtgtaggctggcctttcacttaccttcctgtgctttgctctttactgctagggctagcagccggaaagctacatatcccaggctttctcgccagctcatttgctgttaaattctgttaataggaggcactggtgggagaccagtaagacggagagaaaaacttcctgattctgggttttactgtgaggccattgcaagcagttgctgtagtgatagtaaggaaggggtgagttggaacatcagcaaccctgcaggtaacccccttattggggctccaatcttagttgatgtagcacttccttggtggcttcagagccaaatggcacaacctcctcaacagtacagcagattgagaaggctgagggacatcgtttaggagcattaatgatgggtgtctagctatgacccccttttccttttcacttctgtcctctccttctcctttgttctcttctagttctttctatatctttgtaacaaattccctatattaaatttcttctgcttgagatacttgaagtggtcttagtttccctgcatttagcacgtggactctctgaatctgttgggtgcttagggcctgggtttgtgccctaggatcctgtgactgaattcttcctttctctttccatcctcatcatgcatgcaggattgtcgcagtagcctttaaatagattttcagccaccagcctctttctgttcactgtggacattattggtagtttaatttttctaaaaatctattttctggatccacatttctgctcaaaactctatttttatgataactatttaagcataggtatagtcatctatgacctaaaccccaaaggcaggatcgtcaccatggccaccttttctgtgatcctaataacagagagatctgtgtcagaagaggattggttgttctttcaccctggctaactggaaggcagggagctcagtggtagacacaccggtcatcatgctggtgtgggaaagatttcaaagcctggccatagctcccactgaagctcctttctgcaccttactgcttccttgtacaagtcaaaccagggcctttagagcagggaccttcattgcactgccctctcctcgcctcccaaatgataatatccagctttcaaggtctgcctgatgtcccagggttaggagggcagagaccaggcagtttatgtcatgtcacttcttttttttttttgtcttttaaaaaatttattatactttaaggtctggggtacatgtgcacaacatgcaggtttgttacataggtatacatgtgctatgttggtttgctgcacccactaacttgtcatttacattaggtatttctcctaatgctatccctccccgcaccccacgacaggccccagtgtgcgatgttccctgtcctgtgtccaagtgttctcattgctcaattcccacctatgagtgagaacatgcactgttcggttttctgtccttgcgatagtttgctgagaatgatggtttccagcttcatccatgtccttgcaaaggacatgaactcatccttttttatggctgcgtagtattccatggtgtatatgtgccacattttcttttctttttttttttttagagataacaatactcactttcaacaatttctagaactacagagaagaaaaacaaggaaatagaagatttgagcaacacaattaactagacctaacacacatctacagaacagtctatccaacaatagcagaatatgtacttttctttttttttttttacaataacagtgttatcatttattattttgattaactcgtcatttagcattaggtatatctcctaatgctatccctccccactccccccatgccacaacagtccctggtgtgtgatgctccccttcctgtgtccatgtgttctcattgttcaattcccacctatgagtgagaacatgcggtgtttgattttttgtccttgcgatagtttgctgagaatgatggtttccagcttcatccatgtccctacaaaggacatgaactcatccttttttatggctgcatagtattccatggtgtatatgtgccacattttcttaatccagtctatcattgacggacatttgggttggttccaagtttttgctattgtgaatagtgctgcatataaacataagcgtgcatgtgtctttctagtagcatgatttataatcctttgggtatataaatagcaattttgctattgccccaattctaaatttttggggcaatttagatcgctgggtcaaatgggatcactgggccaaatggtatttctagttctagatccttgatgaatcgccgcactgtcttccacaatggttgaactagtttacactcccaccaacagtgtaaaagcattcctgtttctccatatcctctccagcatctgttgtttcctgactttttaatgatcaccattctaactgatgtgatatggtatctcattgtggttttgatttgcatttctctgatgaccagtgatgatgagcattttttcatgtgtctgttggctgcataaatgtcttcttttgagaagtttctgttcatatcctttgcccactttttgatgggcttgtttatttgttttttcttgtacatttgtttaagttctttgtagattctggatattagccctttgtcagatgggtagattgcaaaaattttctcccattctataggttgcctgttcactctgatggtagtttctgttgctgtgcagaagctctttagtttaattagatcccatttgtctattttggcttgtgttgccattgcttttggtgtttcagttattaagtccttgcccatgcctatgtcctgaaaggtattgcctaggttttcttctagggtttttatggttttaggtctaacatttaagtctttaattcatcttgaattaatttttgtataaggtgtaaggaggggatccagtttcagctttctacatatggctagccagttttctcagcaccatttattaaatagggaatcctttccccatttcttgtttttgtcagctttgtcaaagatcagatggttgtagatgtgtggtgttatttctgagggctctgttctgttccattggtctatctctctgttttggtaccagcaccatgctgttttggttactgtagccttgtagtatagtttgaagtagtgtgttgcctccagctttgttcttcttgcttaggattgttttggcaatgcaggctcttttttggttccatatgaactttaaagtagttttttccaattctgtgaagaaagtcattggtagcttgatggggatggcattgaatctataaattaccttgggcagtatggccattttcacgatattgattcttcctatccatgagcatggaatgttcttccatttgtttgtgtcctcttttatttcgttgagcagtagtttgtagttctccttgaagaggttctttacatcccttgtaagttggattcctcggtgttttattctctttgtagcaattgtgaatgggagtttgctcatgatttgggtctctgtttgtctgttattggtgtataggaatgcctgtgatttttgcacattgattttgtatcctgagacattactgaagttgcttatctgcttaaggagattttgggctgagatgatggggttttctaaatatacaatcatatcatctgccaacagggacaatttaacttcctcttttcctaatggaatactctttatttctttctcttgtctgatggccctggccagaacttccaacactatgttgaataggagtgctgagagagggcatccctgtcttatgccagttttcaaaggtaatgcttccagtttttgctcattcagtgtgatattggctatgggtttgtcataaatagctcttattattttgagatacattccatcaatacctagtttattgagtttttagcatgaagtgctgttgaattttgttgaaggccttttctgcatctgttgagataatcatgtgttttttttcattggttctgtttatgtgatggattacgtttattgacttgcatatgttgaaccagccttgcatcccagggatgaagctgacctgatcatggtggataagctttttgatgtgctgctggattcggtttgccggtattttattcaggatttttgcatcgacgttcatcagggatattggtctaaaattctcttttttgttgtgtctctgccaggctttggtatcaggatgatgctggcctcataaaatgagttagggaggattccctctttttctattgattggaatagtttcagaaggaatggtaccagctcctctttgtacttctggtagaattcggctgtgaacccatctggtcctggactttttttggttggtaggctattaattattgcctcaatttcagatcctgttattggtctattcagagattcaacttcttcctggtttagtcttgggagggtgtatgtgtccaggaatttatccatttctcctcgatttttctagtttatttgtgtagaggtatttatagcattctctgatagtagtttgtatttctgtgggatcagtggtgatatcccctttatcattttttattgcgtctgttttattcttctctcttttcttctttattagtcttgctagcggtctatcaattttgttgatcttttcaaaaaaccagctcttggattcattgattttttgaagggttttttgtctctatctccttcagttctgctctgatcttagttatttcttgccttctactagcttttgaatgtgtttgctcttgcttctctagttcttttaattgtgatgttaggatgtcaattttagatctttcctgctttctcttatggacatttagtgctgtaaatttccctctacacactgctttaaatgtgtcccagagattctggtatgttgtgtctttgttcgcattagtttcgaagaacacctttatttctgccttcattttgttatttacccagtagtcattcaggagcaggttgttcagtttccatgtagttgtgcggttttgagtgagtttcttaatcctgagttctagtttgattgcactgtggtctgagagacagtttgttatgatttctgttcttttacattttctgaggagtgctttacttccaattatgtggtcagttttggaataagtgcaatgtggtgctgagaagaatgtatattctgttgatttggggtggagagttctgtagatgtctattaggtctgcttggtgcagagctgagttgaagtcctggatatccttttaaccttctgtcttgttgatctgtctaatattgacagcggggtgttaaaagtctcccattattattgtgtgggagtctaagtctctttgcagatctctaaagacttgctttatgaatctgggtgctcctgtgttgggtgcatatatatttaggatagttagctcttcttgttgaattgatccctttgccattatgtaatggccttctttgtctcttttgatctttgctggtttaaagtctgttttatcagagaccaggattgcaacccctgcttttttcttttttgctttccatttgcttggtagatcttcctccatccctttattttgagcctatgtgtgtctctgcacgtgagattggtctcctgaatacagcacactgatgggtcttgactctttgtccaatttgccagtctgtgtcttttaattggggcatttagcctatttagatttaaggttaatattgttatgtgtgaatttgatcccatcattatgatgttagctggttattttacctgttagttgatgcagtttcttcctagcattgatggtctttacagtttggcatgtttttgcagtggctggtacccgttgttcctttccatgtttagtgcttccttcaggagctcttgtaaggcagacctagtggtaacaaaatctctgagcatttgcttgtctgtaaaggattctatttctccttcacttatgaagcttagtttggctggatatgaaattctgggctgaaaattcatttctttaagaatattgaatattggcccccactctcttctggcttgtagagtttctgctgagatatccactgttagtcatcagacttccctttgtgggtaacccgacctttctctctggctgcacttaacattttttccttcatttcaaccttggtgaatctgacaattatatgtcttggggttgctcttcttgaggagtatctttgtggtgttctctgtatttcctgaatttgaatgttggcctgccttgctaggttggggaagttctcctggatagtatcctgcagagtgttttccaacttggttccattctccccgtcactttcaggtacaccagtcaaacgtagatttggtcttttcacatagtctcatatttcttggaggctttatttgtttctttttactcttttttctctaaacttctcttctcgccttatttcattaatttgatcttcagtcgctgataccctttcttccacttggtcaaatcagctattgaagcttgtgcatgcgtcatgtagttcttgtgccatggttttcagcttcatcagttcatttatggtcttctctacactgtttattctagttagccatttgtctaattttttttcaagggttttagcttcctagcaatgggttcaaatgtcctcctttagctcggagaagtttgttattactgaccttctgaagtctacttgtgtcagctcgtcaaagtcattctctgtccagctttgttctgttgctggcgaggagctgtgatcctttggaggagaagaggtgctctggtttttaggattttcagcttttctgctctggtttctccccatctttgtggttttatctacctttggtctttgaagatggtgacctacagatggggttttggtgtggatgtcctttttgttgatgttgatgctattcctttctgtttgttagttttccttctaacaatcaggtctctcagctgcaggtctgttggagtttgctggaggtccactccagaccctgtttgcctgggtatcaccagtggaggctgcagaacagcaaatattgcagaacagtaaatattgctgcctgatccttcctctggaggcgttgtcccagagaggtgcccgcctgtatgaggtgtcagtcggcccctacttggaggtgtctctcagttaggctacacaggggtcagggagccacttgaggaggcagtctgtctgttctcatagctcaaacaccatgctgggagaaccactgctctcttcagagctgtcagatagggacgtttaagtctgcagaagtttctgctgccttttgttcagctatgccctgcccctagagctggggtctacagaggcagcaggccttggagagctgcggtgggctccgcccagttcaagcttctccagccgctttgtttacctactcaagcctcagcaatggcagatgcccctccctctgccaggctgttgcctcgcaggtcgatctcagactgctgagctagcagtgagcaaggctccatgggtgtgggacctgctgagccaggcacaggatgtaatctcttggtgtgctgtttgctaagaccattggaaaaacgcagtatttgggtgagagtgtcctaattttccaggtacagtctgtcacagcttgccttggctaggaaagggaaatcccctgaccccttgtgcttcctgggtgagataatgccccgccctgcttcggctcaccctgtgtgggctgcacccactctccaaccagtcccaatgagataaacaggtacctcagttggaaatgcagaaatcaccatcttctgcatcgatcatgctgggagctgcagaccagagctgttcctatttggccatcttggaacagaatgcatcatgtcacttcttatacatgaatgagaataactgtgaaatgtgcacatgtgctctgagcctagataagattgttactatcatgttatattgttattattgtgttattatcgttattatcatgttattttcttacccataggttttccaacttgcttgaagtaatgctttcaggatactcaatattgaatattcaatactgatgggaaaactttcttaaaggaaatggacattacagggtcaactggaggaaaaataacacatttactgctcaaacatagcttgttgtttttatatttaaaaacataggcattgtaaaaagtcaaacaagcctgaaaaatgtatgggagaagatgaaatgatcactgaagtcacatattcctcactgttaatgatttagggaacatccttctagaaggttcacagagccatacaactttaccgaaatgggattatgttgcatcttgttttccaacctaattttttcccacttagtagtatagcacagatatgttttcatgtcaaccagtatgactttacactgttatttctttcttcttttttttctgagatggaggctcgctctgtcgcccaggctggagtgcagtggcacgattttggctcactgcaacctccacctacctggttcaagcgattgttctgtctcagcctcctgagtagctaggattacaggtgcctgccaccacacctggctaatttttgtatttttaatagagacggggtttcaccatgttggccaggctggtcttgaactcctgacatccggtgatctgcccgccttggcctcccaaagggagggattacaggtgtgagccactgtgcccggcctaatggttacacagtattccatgctgacaccataatttactcatccagttacattaaattggaatgttcatagttgttgacctttagaacatgccagtattaagtttttgtatttaaggtgatgctagttctaaagcatatattctgaaatctcagtggcttaacacctcagaagtttatttctccttatgtaaagtttaggttctctccatttgctgatggttaccttgaggtaccaggcttgcgtggaggggctgctgtgccttgcatggccatgcagggactcaggccctctccagcgtgtggtttgcaaggttgccctggcccttgctgcttagctggctgatagtggaagagaaagtgaagaagatgtcacaggaggttttaatggatcagaactggaagtggcagatactgcttctgcccccattccattggccagaatgtcacatggccatacaaaactgcaagggaggctgggaaatgccactcatctgtgtgtgtgggaggaaaggaaatacatttggtgaatactagctagtctctaacagagcttcccctactgtttaccaaattcctgttttgcttttcccctcacacacagaacacacccctcccagagtgagggaccctaagtcccatccagccctggcaccttgcttagtcactgttcaggatctctgggtgatgtgctgtcttccccatcacatctaaatgaggatccttgtggtttgatgacttatgaactagaagagaataaagttatttgcctcctccctagcgcctcccaattttcaatgaagcagggaagcattgtaacattagaagctcccatttagaacagagtaaagagcgggcagcacagtcatcacaggcccaaagcaacaatggaatccagttgggtgggcaaggtggaggttctcaaccagagggtgggagaactttcttgattagaccttgattttgccagaaaaggcaatctcttctcagttggtctccatggtccgagctctgtcctggcaagttccttcttgcactttattctcaatggctacgtttgaagtgattgcaggggagtccgccatcttaggagggtacacagctttgcagccctctagtgccctgctgttgtttcaaggctcaaatagacaaacgtctttaaaaaattttatttttagtccaggctcatggtttctttggccatacatttatgtcaaaaatttgataggattctgttttttttttaaattaattacttttatttttgacaaataatttacatatttatggggtacaatgtgaagctttcatatatttattcactatgaaatgattaaaccaagctaattaacatatccatcatttcacgtgtgtgtgtggtatgaaatttttgtgtgtgtgtggtatgaaattcttagcaattttgaaatatattgcattattattaactatagtcaccatgctgtggaataaatcttaagaacttattccttctgtctaactgaagctttgtatactttgactaacatcttcccatccacttctacccttgccccagcccctgctaaccaccattctattctctacttccgactttttttagattacacctgtaactgagatcatgcagtatttttctttctgtgcttggattacttgtttctgttctgttttcttcccttaagttttttatgccaatagcaaatccctaagtttttttcctagatattattaccaagcttgaattattatattactttctcaccctaatacccttttctgtcaatgagatggtgacttccttgaggccttcagggtcagatgggaaggcaaaattcttaattagctctttgctacaaggctgaatcttttacctgtgtcactcaaaagccttttcaatcttgtttcttactcctcagactttagaagcagtcatttcttccaaggctttacactcagaagtttctggacaaacatctggactctattccctttcattttatgcttgcaaaccaacaaattctttttttaaaaaagtattttaatagctttaggagtacaagtggtttttgcttacatggatgaatggtatagtcctgaagtctgaaattttagtgtacccaagttgcgtacattgtgcccaatatgtaacttttaaagtcgcccctcccacactcccctattctgagtctctaaagtccattatatcactttgtgtgcctttgtgtatccatagcttagctcccatttaccaatgagaaagtacagtgtttggttttccactcctgagttagttcacttagaataatggcattcagttccatctgagttgctgtaaaatacattatttcattcttttttatggctaactagtattccatggtgtatatataccacattttcttcatccactcattgattgatgggcacttaggttggttccatagctttgcaattgtgaattgtgctgtgataatcatatgcatgcaggtgtctttttgatgtaatgacttcttttcctttgggtacctagtccagtagtgggattgctggattgaatggtagatctacttttagttctttgagaaatctccatactgttttccatagaggttatactgatttatgttaccaccagaagtatataagcttttccttttcaccatatccatgccaacatctcttgttttttgactttttaataaagggccattctgtttgggataaggtggtttctcattgtggttttaatttgcattccctgatgattagtgatggtgagcagtttttcgtatgtttcttggccatttgtatatgttattttgagaaatgtatattcatgtcatttgcccactttttaaagggattttttccccttgctgatttgtttgagttctttgtagattctgggtattagtctgttgtcggatgcatagtttgcaaatattttctcccattctgtgagttgtgtgtttactctaatgattatttcttttgctgtgtggagcattttagtttaagtcttatttatttatctttgtgttggttgtttttggggtcttagttataaattctttgcctaggctactatccaaaataatttttcctaggttttgttctagaatttttatggtttcaagtcttagatttaagtctgtaatccatcttgagttgatttttgtgtatagtgagagatagagatccagtttcattcttctacatgttgctatttagttttcccagcaccatttattgaatagcatgtcctttcttcaatttatgtttgtatatgctttgttgacgatcagttggttgtaactatttggctttatttctgggttctctattctattctatttgtctatgtatctacttttataccaataccatgctattctgattacaatagccttgcagtataatttggagtcagttattgtgatgcatccagatttgttctttttgctcaggattactttggctgtctgtgctctttttttggttctatatgaattttaggattgttcgttctttctttttcttttcttcaacttttattttaagttcatgggtacatgtggaggatgtgcaggtttgttacacaagtaaacgtgtgccatggtggtttgctgcacagatcatcctatcaactaggtattaagcccagcatcaattagctattcttcctgatgctctccctcccacccactgcccactgatagttcccagtgtgtgctgttcccctctatgtgtccatgtattttcatcatttagttcccacttatagatgagagcatgcattctttggttttctgttcctgtgttagtttctggaggataatggcttccaactccgactccatccatatccctgcaaaggacatgatcttgttcctttttatggctgcatagtattccatagtgtatatgcaccacatttatttatccagtccatcattgatgggcatttagattgattttatatctttggtattgtgaaaaatgctgcaatgaacatacacatgcatgtatctttataacacaatgatttatattttttggggtgtataccccgtaatgggattgatgagtcaaatggtacgcctctaggtctttgaggaatcactacactgtcttccacaatggttgaactaatttacactcccaccaacaatgtaaaagcatttctttttctccacaacctcaccagcatctgttgttttttgacatcttagtaacagccattctgactggtgttagatcgtatcttattgtggtttttatttgcatttctctaatgatcagttatgttgagcgttttgtcatgtttgttggctggatgtatgtcttcttttgaaaagtgtctgatgatagtttcttttgctgtgcagaagctctttagtttaattagataccatttgtaggtttttgcttttgttgcagttgctttggtgttttcatcatgaaatctttgtccatgcctatgtcctgaatggtattgccttggttgtcttgcagcatttttatagttttgggttttacacttaagtctttaatccatcttgaattgatttttgcttaaggtgtaagggatgggtccagtttcaattttctgcatatggctagccagctctctcagcaccatttattaaatatggagtcctttccccattgcttgtttttgtctagtttgttgaagatcagatggttgtaggtgttgggtcttatttctgagttctgtattctgttccattggtctatgtgtctgttcctgtaccaataccctgctgttttggttactgtagccttgcagtatagtttgaagttgggtagccatgatgcctccagctttgttctttttgattatgattgtcttggccatttgggatttgttggttccacatgaattttaaaatagttttttctaattctgtgaagaatgtcaatggtagtttaatgggaatagcattgaatctataaattgctttgggcagtatggctattttcatgatattgattcttcctgttcatgagcatggaatgtttctccatttgtttgtgtcctgtacgatttctttgagcaatggtttgtagttctccttgaagaggtccttcacttcccttgttagctgtattcctagttattttattctttttgtagtaattgtgaatgggagttcatttatgatttggctctttgattgcctgttgttggtgtgtaggaatgctagcaatttttgcacattgattttgtatcctgagactgctgaagttgcttatcagcttaaaaagcttttgggctgagatgatggggttttctagatataggatcatgtcatctgcaaacaaagataatttgacttcctctcttcctatttgaacaccctttattttgttctcttatctgattgccctggccagaacttccaatactatgttgaataggagtggcgagagaggacatcttgttttgggctgtttttcaaggggaatgcttccagcttttgcccagtcagtatgatattggctgtgggtttgtcatatatggctcttattattttgaggtatgttccttcaatacctagtttattgagaatttttaacatgaagggatgccagattttatcgaaggccttttctgcatatattgagataatcatgtggtttttgtctttagttctgtttatgtgatgaatcacatttattgatttgcatatgttgaaccaactttgtatcctggagatgaagccaacttgattctagtggataagctttttgatgtgctgctgcattcagtttgtcagtattttattgaaggtttttgcattgatgttcattaaggatatcggcctgaggttttctttttttttgttgtatctctgccaggttttggtatcaggatgatgctggcctcatagaataaattggggatgagtccctccttttcaattttttggaataatttcagtcaaaatgatacccctttttctttgtacctctggtagaattcagctgtgaatctgtctgttcctgggctttttttggttggtaagctatttattactgtctcaatttcagaactcattattggtctattcagagattcaatttcttcctggttcagtcttgggagggtgtatgtgtctaggaatttatccatttcttctagattttttagtctatgtgcatagaggtgtttacagtattttctgatggttgtttgtatttctgtggggttagtggtgatatctcccttaacattttctattgtatctatttgattcttctctcttttcctctttgttagtctagcaagtgatctattttattatttttttcaaaaaaccagtttctggatttgttgatttttttgaagggttttttgtgtctctgtcttcttcacttattatgccctcatcctggttatttcttgtcttctagctttggagtttgtttgctcttggttctctagttctttagttgagatgttaggttgttaacttgagatctttctagcttttgatgtgggcatttaatgctctaaatttccctcttaacaccactttacctgtgtcccagagattctaggacattgtctctttgttctcattagtttcaaagtacttattgatttctgccttaatttcattatttacccaagagtcattcaggagcaggttgttcagtttccatgtagttgtgtggttttgagtgaatttcttaatcttgagttctaatttgatggtgctgtggtctgagagactgttatgatttcagctcttttgcatttgctgaggagtgttttatttccaattatgtgatcagttttagagtaagtgccatatgtcaatgaggagaatgtatattctgctgttttgtggtggagaattctgtagatatctatcagatccacttgatccagggctgagttcaggtccttactatctttattaattttctgtcttgatttgtctaatattgtcagtgggttgttaaagtctcccactattattgtgtgggagtctaagtagtctaagtgtgtcattcttgaagaacttgctttatgaatctgggtgctcctatattggatgcatatatatttaggatagttagctcttgttgaattgaactctttaccattattaatgcccttctttatattttttgatctttgttggcttaaagtcttgttttgtcagaaattaggattgcaacccctacttttttctgttttccatttgcttggtaaattttccttcatccttttattttgaacctgtgtatgtcttgcatgtgagatgggtctcttgaagacagcacaccagtgggtcttggctctgtccagcttgccattctgtgtcttttaattggggcatttagcccaaaaaaaaaatatatatattttatattttttgagatggaatttcactctgtgtcacccaggctggagtgcaatggtgcagtcccagctcacggcaacctctgcctcccgggtgaagcgattctcctgcctcagcctcccgagtagctgggattacaggcacctgccatcttttagtagagatggggtttcaccatgttggccaggctggtctcgaactcttgacctcaggtgatttgcctgcctcaggcttccaaagtgctgggattacaggtgtgagccactgtgcctggcctagcccatttatatttaaggttagtattattatatgtgaatttgatcctgtcatcatgatgctagctggttattttgcagacttgtttatgtagttgcttcatagtgtcactggtctgtgtagttcagtgtgtttttgtagtggctggtaacagtttttcgtttccatatttagtgcttcctggtggtgatgaattctctcagcctttgcttgtctgaaaaggatcttatttctccttcatttatgaaccttagtttggtcagatatgaaatcttgggttggaaattcttttctttaagactgtagaatattggcccacaatctcttctggcttgtagggtttccattgagaggtcctcagttagtctgattggcttcccgttgtaggtgacctggcctttctttctggctgcccttcactttttttttttcatttcgacctggagaatctgatgattatgtgtctgggggttgatcttctcatggaggatcctactggggttctctgcacttcctgaattgaatattggcctatcttgccaggttgggtgagttctcttgaatgatatcctgaagtgtgatttccaacttggttccattctccctgtccctttcaggtatcccaatcagttggaggtttggtctcttcatagaatcccatatttcttggaggttttgttcattccttttcattcttttttctctattcttgtctgcctgtcttatttcagaaagatagtctttaagctctgaaattctttcctccacttggtctattctgctattgatacttgtgattgcattgtgaggttctcgtgttgtgtgttttcagctccatgagcttggttatgttcctctctaaactggctattctggctatcagcttctgtattgttttatcatgattcttagcttctttgcattgggttacaacatgctccttttactcagtgaagtttgttattacccaccttctgaagtctacttctgtcagttcagtcatctcagcctcagcccagttctgttcccttgctggagaggtgttactgtcatttggaggagaagagccactctggctttttgagttttcagcactgattctttgcttatctttgtgggcttatctaccttcaatctttgaggttgctggcctttcaatagggttttgtgggattctttttgttgatctttttgttgttgttgttttctgtttgtttttcttttcatagtcaggccactctaccgtagggctgctgcagtttgctgggggtctgctccagaccttggttgccttggtttttcctgtacctggagatatcaccagtgaaggctgcaaaacagcaaagatggctgccagctccttcctgtggaagctctgtgccagggggatactgacctgttgctggccagaacatatctgtaagaggtggctggagacccctgtttggaggtctcacccagtcaggtggaatggtatcagggacccatttaaagatgagtcttgctgctttttgtctgaggaggtgtgctgcattgtggcagacccttcctcatctggactgtttgcattctccaaagccagcaggctggaatggttgagtccactgaaccacagagatggcagccacctctccccctgggagctgcatccgagggagaggtcagagttctgttaatagaacccttgttggcgtggctgaagcccccacagggaggtccctcccagtaaggaggaatgaatcggggtcccacttaacgaagcaatctggccacagtgtggcaaagcagctgtgctgcattgtggggggcccttcctcatctggaccatttgtattctccaaagctggcaggctggaaaggccaagtctactggaccaaagagatggtggctgcccctctccctggaaactcggacctatctcaggcagattccagcctgttgctgttgtatgcctaagttaagttggtataaattcaaaatagattgttataactataggatattatatgtaattcccatggtagccacaaagaaaatatctatagaatgtacacaaaaggaaatgagaaaggcatcaaaatgtgcctctgtaaaaaaaaggtcaacaaaacacaaagaaaactggtcatggagaaaatgagggtcaaaaatactgtaagatataaaggaggcaaaatggcaaaagtaagtccttccatattagtaatcgagactctgtcttaaacaaaacaaaacaaaacaaaagaaacaaacaagcaaacgaaaaacgtccagtcaaaagcatagattggcagaatgaattaaagaaaaacatgatctaactgcatgctatgagagacccactttagatctaaaggttgaaagtgaaagcatagaacaagatgtaaatagtaacaaaaagagagctttggtgtctacactaatatcataaaatagaatttaagtcaaaaatttttacaagaaaaaaggacattatatgttgataaaagggtcaatttacctagaagatacaacaattcaaaacatatatgcaccaaacatcagagctccacaatatacgaagcaaatgttgacagaaatgaagggagtaatagacaactctgcaatcaaatgcctgaataatgcagtatgtgggctagtccagcctctctcatgatttccacatcactttgatgtggacatcctggacatctgcagttttcagttacttcctgtttcctgctggcatttaagtcccttgtactttatgtgaattcttacttcagttatactgcccctacaacttgcaatgaacattctcactttggttgtatcactttccaccctcctgcctgaaatctgatgctttccttcaagctccatccccactaggaagccttttgtatgagctaagattaacaacttgcatcctttaccctccacgtgttgcatatacctataccactcatttagcacatcacatttgatacttatttatttgacacatgtagctatatttaatctatttgtttggtctcctccataaccagagctttatttccatgggggctaatgctcctttaagtttctggcaatgattactgttatatagatgcagaatcttatttttttaatgaattaacagatgtctccctaaattaggcccaaatactgatcttaatcctaaggattagctaatagaagcatcataggtattaagttggacagatatggccaaactgtttaattttgtgagcttcagtttcatgtgctaatgccatatctatctatctatccatctatctatccatccatccatccatccatccatccatccatccatccgtctatctatgtctagcttgaccatcacaacagtctaaggagaagctatgcttatccctgtttttcagatgaggaaactgagacccagagacattaagtaatttgccaaaattacccaactcacacatgaaagagtcaaggtttgaacctagatctccctgactccactgcttgttattttaaacatctacaatatttacctttcagttcttgaacttaatcttgcctgagatctaagttcaagcctttcattatccacatccccccatatctaatgatagttgtggtaggcagaataatatccccccaaagatgtctgcatcccaatcctggaacctatgaatattttaccttgcatgacaaaaagggactttgcagatgagattaagttaaggatctttagatggagagactatctttgctatccatgtgaacccaatgtaatcatagggtgctcataaaggaaagagggaggcaggagtcaaagtcagagagagatttgaagatgctcaactgcttttgaagatggagaaagggaccaaagccaaggaattcactgacaccttgattttagcccagtgagactcactttgacctccagaactgtaaaataatagatttgtgttgcttgaagccactaaatttatagtaatttgttatggcagcaataggagactaatacagttgaccctcgaacgacacaggtttgaactgtgagtccacttctacatgaattttttttttagtaaatatattagaaatatttttggagatttgtggcaacttgaaaaaactcgcagacaaaccatgtatcctagaaatataaaaaaaaaataagaaaaagctatgttatgaatgcataaaatatatgtagatactagtctattttatcatttactaccataaaatgatacacacatctattctaaaaagtaaaaatttatcaaaacgtatgcaaacagagtgtacatggcatcctttgcagtggagagaaatagaaacaacataaaaaatgcagtattaaatcataattgcatacaattaactgtatacataaggtactgtggtaataatcgctgcattgccacctacattgctattgtggtgagctcaagtgtgggaagtatccacttaaaatgccatgtgatgctaaccgtctgcacatgagcagtttctctctccagtaaattgcatattgcaatgaaagttatctctttcagttctcacatttttttttgtgtttggagcaatactataaactttgagtaacacagcgggactcatacgaagtgccactactgatgctggaagtgctcccaaaaagcagagaaaagtcatgacattacaagtaaaagctgaattgcttgatgtgtgctataaattgagatctgcactgtggttgcccaccatttcggacagatgattcagcttgtaagcagacaatgtaaacttacaatatcaataagtaaagtacagtagtgtaaatacattttctcttccttatgattttcttaatattttcttttccctagcttaccttaattgtaagaatataatacatatacagaatatgtgttaattgaccttttctgttatcaataaggcttctggtcaacaatagcctattagtaggtaagattttggagattcaaaagttacagtgaattttaactgtgcaggtgattgatgcctaattcccatgttgttcaagggtcaactgtacaataggttttctgctttccttaccctcctgatgatttctgaactagttctacagagtttcctcttttcctttgcatctctccttcccactgccaccatccagattgttttcagagcggcacttcatcagctgcatcgtcaccctctgagggtgtggaagggctctcacttccacttaaggccatgccatgctaattgcctttctggctcttttctcttaaaaggtggtgcttagaaaggaaaggaatagtccatatgtggtcttagtaggacagggaacagtaggtctttacctcccttaatccgaatgttagatctcttcaatgcaatcaaggtaatgcttatttttttttggcacccacatcacatccactgctcactcaggttgagtttattgataactacaaccccaagcttttcatgtcatattaaagcaaaagccattatgagctgttcttatatctcgtagaatgtctgccatcttgtgtcatgtagcttttgtctcaggaaaaaaaaaaaaaaaaaaaagcacagtacgaattaatctctccagggaaagatttaaagactaggataataaggagagacagatggaattctgagagaaatatggcaaattctagagctaatctaattaaagggccatgggaacttctccctggcgcataaataaaatatgacaatcagtgtcagctaagaaacccttagcaaatacctaatctcatttttaaatttatcattacatagaactgttatcttttaacaaataatggtatgatgcaaaataagctgagagaagccaacagacacaggccaggcagctgcccagcctctctgcccacccctccctacatacacttcaggtggcatgggctctcccagccatttcgatacatgacacctctgtgacctcgccagcttgaaggataaaatgaaaggttcttagtgaaggaaaaaggcgttcatcttcaccccatcgtaatgggctctgaggaggactggcaacatgtagaatctggagaggagaggtcaggactggctgcagaggaggaagctgctgaggtgattagtagttctcagagagggccttgttctttccctttaaattcaaaatggcagtgcctcaaaccctctgggcttcctggaatttgtgtttaaatgtttatgtatttccaggcgaatattcaaacaatgtagctaagatgtggtaccttcaaagcaagtaaaccagctggcttccctgctatgatccccttgcacagcctggcccttcagacaggagcctgtattctgaaggaagtccttacagagcagcttggatctactaccccttaaaagaaggaggaactggtgaaattatttccattaactttaaggtactcaagaggaccacagaggtcttattcttttcagtttggataaatctggggcagtccaaaggttgccaagggaggtaggaagaaaagtttaatttgcacacttgagctttacagtctgtctgacttcattggagtttacttctttttaaattgcagactcagggcttaaatacttccttaccttcagtgacctttcctgagccctcctgttcctgataagctgcagggcagtgctttctttcctatgatgtgttgtcatattaacacacacacccagagtgattactgtgttcacttcccctggatgtgcttcatctttgttgagttaaaatcaaattgctttctacttcagtaaatccaattcagccttcttactgaccatgggttaaagttttaatttaaaattccctttcttttaaaaattagcaattcaaattcaaggtggtaaagcagcccacattctgagattgttggtgttggaaagggccttagctatcgtctgtcctgcgtgatgcttctgttgaattatctcaaggacagaatagttactactttgaacagattaggtggaatgatgtaaatgaaagtgctttgtaacttgtaggacattaaaaaataaatattattagcatttataaagatgctttttccattgttgccaatgttacttattttttcaaaactactttattgaggtcttattgacataaaaaaagctgtacatacttagctgggcgtggtggggggtgcctgtaatgcaagctacttgggaggtcaaggctggagaattacttgaacctgggagatggaggttgcagtgagctgaggttgcactattgcactccagcctgggtgacagagcaagactctgtcaaaaaaaaaaaaaaagctgtgcatacttaatacatacatcttgataagtttcaggataagtacaacacacttgtgaaaaccacctgtgaatcccacttgtgaaaccaatcattaaacatgtccctcaactcccaaagtttcttctttattattactatgattaattttttttggtgaaagcatataacataaaatctaccctaggcaaattttaagtatacaatgcagtgtttgttagctataggcattatgctgtatagtacagcatactgtacttactagcttaagctttagatattataacatgtgttttcctgttgaactcctgtcttccttcttgtgggtataaactagaataactttatagatcgcttgggaacatttttcacctcaagcggccattcctgtccaggtgtgggatgtgcaacacagtggtccaagagatgattttcagagtcacaaggacatggcatggggtaccattgactcacgttctcctgctaaggtgaaagtctcaatttgctgctagtgcatctttaaccttctctaactctcatttccctttgttataaagacagagctcagcagacttctgtcccaaaatctttggccaacagcaaaccatatttgtatggttatcttctaattatggggagtgattttcatatcccagtgatagtgataccaaaaaagaataaaagtatcctttaaattgacaagcaccatgaagtggtttgagactggctggtgtttgggacatggctttccacggagcttgagagatgggccatggatcagattactgcccactgtgacagacaacacacaatttgccatttcctatggcagtctttgacatatctgaagtcagtgctcatgtgtcctttcagccttcccttctttaggtctcacccttccagtttcttcacatgttccttatttgatgttctcctgcaatggtgactggagtctatcagtttttcttttgaggaagctccctgttcatcatttttatagaaggagcccttgttctgatatcagagagcagttcctcaagttggttgagaaagggaagtcagggagcaaaggagagttaatagggatgacatggaagaattgcagtgatagggatgcctgggaattgttaggagaacacttaggtccttagatgtctttatgttggtgtacaaaataggggttatcaaaactataaaaaccctggaagataactgaggcaataccattcaggacatagacatgggccaagatttcatgatgaagatgccaaagcaattgcaacaaaagcaaaaattgacaaattggatctaattaaacttaagagcttttgcacagcagaaaaaactatcaacacagtaaacagacaacctacagaatgggagaaaatttttacaaactgcatccaacgaaggtctaatatccagcatctatagggaacttaaacaaatttacaagaaaaaaaacaaacaaccccattaaaaagtgggcaaaggacatgaacagacacttttcaaaagaagacatacatgcagacaacaatcatatgaaaaaagctccacatcactgatcatgagagaggtgtaaatcaaaaccacagtgagataccatctaacaccagtcagaatggatattattaaaaagtaaaagaataacagatactggcgaggttgtggagaaaaaaacgcttatatgctgtcggtgggagtgtaaattagttcagccattgtggaagacactgtggtgattcctcaaagacctaaagacaggaatatcatttgacccaacaattctattgtggggtatatacccaaaggaatataaatctttctattataaagacacatgcatgtgtatgttcactgcagcactagtcacaacagcaaagatatggaatcaatctaaatgccaatcaatgatagactggataaagaaaatgtggtacatatataccatggaatactatgcagccataaaaaagaatgcgatagggacctggatggagcgggaggccattatccttagcaaactaacacagaaacagaaaaccaaacaccgcatgttctcacttataagtgggagctaaatggtgagaacacatggacatatagaggggaacaatgcacactagggcctattgaagaattggagggttgaaggaggaagaagactaggaaaaataactaatgggtactaggcttaatacctgggtgatgaaatagtttgcacaacacacctccatgacacaagtttacctacatgcccctgaacttaaaagttaaaaaaacacaaaaataaaataggggttataagcaaaatgtgtgcaacaggtggtacatgtgtaaagactgtcaagattgggttgaaaagtctgtgagagtgcctttgcagcttgcttctctgagccttaaggtgttccacctctaaaattggttgaaatgaggtattgtatggaaaaggctttggtaaacgaggaagtgctatacaaatgtcaaatattagttttttcattagttatattgttattttatgtcactgttataacattgacattctgttcagtgtttatcctggtttctcttcagatcatataaatcttgtgacttttacgaaagattcccatgaagaggaacaactctgagacttaaaccaatttttcagccttggtgctttgtataaaggatccagcactccccagtagtcctttcataaaagagccctgccattcccaagtccattgtcatgatttattgcttgcttgttgggatttcaccatctagaggtttttaatcaagaaagcctatggttgttttagtatccaaatccatgcatgttaaataatgactttttattgtctttataatgtctgccaacctggctgggtataaaattcttgagtatgccctgctccccacctccatccaaactgtatagggagtgttacttggcgttgaatattgccttggaagccagctttaattttgccctttgtacatgacttgagttttttcagagaatcagtcaggattcattcttttttctttggatttcagtgattttaccaggacatcttggtgttggtcataatatttcaatttgttttttaggagctgtgtgatcttttatttgtaggtttagtttggtttcctatttattttttcttctcaagggacatcaattgtccatatttttgtttgccttgtgtatatatcatcttccttttcattattttttttttaccttttcctttgcattttgctattttctcaagttgatattccataccattgactctattttcagctgtaactgtgcctcttgctgcttctgagatggcttcatattatgaatgaactgagcagaacacccaggcaggcatcagttggcctatggtaaatcttcctaggttatcataaaaaaattaacattaccatagctcagattaatagttggccaatagctgccttcttctccccagctcaacacatgcttgaactctccattctcctgagtaaaggaccttggaaaaacactccttaagaactggagaaggttgtattggttttagtatctgccattaattttatccacattttacagtatttggcaggtattctcatggttttaagaagcaatatagtgttaagagcatagttatggagaaaactgcctgggttttaattaaaatttttccagttgctagccatgtgaggttgggcaagctacttaacctcttgattcctcagttttcctcatttgtgaaggaggttagtaatagcactgctatgagatgaaatgaattaatatttgtaaaatgcttataaccctgctgggtacaaagtaggtgtcttgaagtgatcataagatgcattgtcaataaactttcctccccaatttctcaatcactttgctcatttcagtgggtttcacagaggtgtcattaactgtctttattccattatattgtgccagaggttgcctgatttgttttgctcataacgggattgttttaattattcatttagaattgcatccagaatatataactggctggctagtctgtgcttcttagattctgttttttttctcttcttgaaacgagaatacttgtcaatctttgatcttcagtaagtccatgatttctcaaggtctattgagtatatttctgtcatcatgtctgtcagttcttttagtactagatcctgactgatttgacctcagttggggacatgaactcatttgaaatggctaggtactctctttctatctttttacctctcttgggcttcaattcctcctaaattatgctaccactatctttttcaatctgaagatcattttctttaatagagatgaaggctgagaatttgagctatgtcattctgccctgtcttctctcttatctattatcactgtgccctagatactgggcacttccctgcctggttgactttcttgtcctgctccatttgtttgtgtgtttgtttgaagcacacctttgtgctgtccttagtatatttacaggaagtggagctcattctggcctttggtcttcttgacatttttcttattgctttgtgacccccttgggcttactcctggttgcttcccttctgtggatctttgtacatgtcctttgaaaatttctgcctttcagacagcttccttttcaatctcagaagtacttgtagatactttacccaccttgtctgccttggcattattgtactaattaatgtcttggggcacttgggaaagatacctgttgttccttaactccctgacctgggggtttggtttgggagaggtgagaagaggcccagaaatctgcatttccacaaacctcccaggtgattttgatgcacgtgacccccagatcacactcatgcctaactagtttggtgcagaagctcctaacctcttttttctgatcaagctgtccatgaagctgagttgatgagtgacctctggtgagtgcagggggactccctggggcttaccccagggtcaggtgcaatggttcttggcttgaagccagctctaattctgtgccttcctttgccactcaagaaagacaactgaatatctgaacttgaatctgttttcattataaagaattaaataactcgcagttttagtgctttattacttcctccaacatatcttccactccattactggtgtgctgtcccctggaggtgggaaaatgactcactcagcatcctttccttggctatttctttcttttcttttctttttttaagaaactggggtctctctctgttgtccaggctggagtgcagtggctattcataggtttatcataatgcactatacccttgaactcctgggctcaaggaggctgggctactcctcagcctcttgagtagctgggactataggtaggcgccaccacatctggctttcttcttggctatttttaactctagtttgacctggtcactttctccagagatttctttccttccacataatctgtaaattctgaatggctgtcagattaagtctgatgccattcactagaaaagatctttcattaggaggctctacttgaaaccaaacggactacagcacattttcaacttggaaagatttgaagaactgggaagcatgaagatctttgtacctaattcaaggcagtgatgtttggacacttcgactgtgtcgtgtttctcttagagctcttagtaggctggttattctgaaaggttggagtgtctcatagataaacaacaaacatcattgagtaattatacttttggggctcacgtttgagtattgacaactgtgaaaagaggaggtatagactccttacgagtttagtcctatgctctaagacatgtgcatttatcccagactctcgtataaaaagccagtgcccattgtgtgcagaatagggtaggactgaggccagacttcctgggatctagtcctggagctagcactaaccagctgtgttacttatctcctataaacctcagtgatcttatcttaaaaataaggtgataatgatccttacctcattcagttttggcgaggattaaatgacataaaatatgttaagagcttagaatatgtctggcacttagtaagtgctcagtgaatttatgatgcgtaaatggacatcagattatgtcagatttgtcaagctagtttttgatttttttttttccaatccctctctgatttttttctgcgtcacatctgttatatgtgccattttgaagctttgtaattttgggaggaagagtaatgggaattgaataatgtgggcagtcactgagctgttactataacaatatttgatccatagccattgggataagaccatgctatcaattgtagaaagtagcattagtaaaacatttcatttctatggcactttggagtttacaatgtattttctaatgtcctgtctaatttgaatacaaagaaaatatgaagtgcagagaaataactgattttctttttgtctcatcaccaggctaggtgtgacccgggtgtgcagcctcagcttggtgatctcacacatcatcaaagcagttctctgcagtacattgaagcacttgttgggtacacagagtacctgttgttaggttaagcattgtaggaagttgtaagaaaagcagctttgtatggccttcgtggccatgtgtatgtagttctgcctaagagcaaagttaaataaacttgtagccaatatgacaacacagcctgatgacagaaaaaaattccccagataaccttaaaactcacctagaaggagcgaggatttgtgtagtgttccggatgtccctttgttttcaccccattcctacgcccgcccagacttacctttgctgtcactggggctcttttggaggctgggaaggattttaatcctgtctggtcctttcccaagaatagcagtatgattgaaaatgtgcccacaagcataatctctgaattggtggatttaaaacaaagttgatgagagacttccaacggcaagtgtgtaaaaagaaaatatctctttaaaagatgttattgataatgaaaagctgagacccttgatactctgcacacggctagtatgggctttatacagattcagagacatccatgtgtgtcctgcttattggtccttaggctactcccgcccgcaaagtgtagcgctgtcttggtggatcctgccggaatgacacatctttttgctttgggatgattgctgggtcctggggtctctctccctgcctcttccccagccctaccctattgcacattttagtgtggcttagctctgttgcctttgtggtggttaacactcaacctcagagacaaagatctaagcaggaaggaggatctattgtgaaccggttggaagttgatttttgaccctaagaaattagttcaccttatcatcagatagagatgctatttgtacatttctccctcatacatgtacatttactctcaaaatttcctgggctagtaggtctctcaaggtggctgagagaccctagaaggtaccagtgtaccactgggccgcatccttaaagatggtgctgtgagggacagccatggaggcccatgtgcgccattgcccttatcccttgggggctctctggatgagggctttctctgtctttgtcttctcttgtcttcgaggtccttcttactcccttgtccaatgtgtgacatcttatcttttcctccatgagctccatttttctgttccaaatagctctagtctgctggtatattgtatttgttttttcttttcttttttttttttttttgacacagaattcccactgtcgcccaggctggaatgcaatgatgtgatctcgggtcactgcaacctccgcctcccgggttcaagcaattctcctgcctcagcctcctgagtagctgggattacaggcgtgcgcctccacacccagctaatttttgtatttttagtagagacagggtttcactgtgttggtcaggccggtctcaaactcctgacctgatgatccatctgccttgtcctcccaaaatgctgggattacaggcatgggccaccgcccccatcgtctgctggtatattatactcctttctctttgtttagttaaattatttctgctttgttttgatacataacagtggtatattagtctcaaccctttggaacatttttaggtcccgatgctatcatccattatgttgaagaggacaggtcaaaggaaagagccctgtgggaccttccctgtgaccatttaggatttagagtcatttggcctggaactgttatttcccagctacgaatccacctacctgtcccaccggtctgtgtctccagcctccacttctacacatggaaatcaggagaggctgcgtcttaaatccttttggtaaaatccagacatttatgacctctacctctcccatagtttaccatgcctgacccacagtagagttcttaagaaatactattgtcttttccccatttcttatttcctgtttaaataaaataaattcagtatttgtctttctagtgtgttgacatgtctcctattctcccaaattcctcaaagaccagtgcagcaatttaccaatctcattttcacattccttcagtgtaataagtgaattaaagccaatttattatccaggattgcctcatttatttcaaaataagctgtgtaccaagaaagctctattccctcagcaagagctaactccagttttaaagctcattctagagaaaaacagacttttatagtttgttttagctattaaagaccccttttaaaaaagaaataggcctttggatgttgccaggggttagaaagctagtccagagactgagaaggtaaacaaagaagcaggggaaaaactgattttgagtgtttagagtgtgtgaaatgtcacttttccccttaacctcttccttaaggaaaaggagagattgttaaagtagtgtctggtcagggcgcacacatgtagaaggtttctgtaactctagggtaaaatacagatctgttaaaattttcatgagtttcttttacttgtcagaagttgcctacagcttagatgatattttcctgatagtttgtaaacttctattgacttctctgtttttctattcgcccatacccatttattttctctttactgcattttactgtcttaggaagataaaacagaaaagcaaaacaaaacaaaaaccccaaaaaactaagtctgaagcagactgttgaataatattactttaactgatgaacagattttcctcccacaaagaaggaaaaagggagaaaattcgtagctcttctctctttttaaagactgtgctggaaaattccaaaatgttatcggaataaaggaatgacttcgggggctcagaacaactcggggaaagacactaaaatttattgagcatttaacgtcacctgccagaaatttaaaatgtgttttttaaagaacaaacatttcatgattttattgtatccttacgacagcctttcagggtatggggattatccccattttacagatgagcaaactgagacctggagaggctaagtaacttgttacggatcacccaggtgggaactgaccgaattaaaatccaacacttcatgccaggtgcggtggctcacgcctgtaatccaagcactttgggaggccaaggcgggtggatcgcctgaggtcaggagtttgagaccagcctgaccaatatggtgaaaccctgtctctactaataatgcaaaaattagccagacatggtggcacatgcctgtaatcccagctactcaggaggctgacaggaggatcgcttgaacctgcgaggtggtggttgcagtgagccaagagcgtgccattgcactccagcctggagtgcaagactgtgtctcaaagaaaaaaaaaaccaaccaaaaaacaacactttgatttgctgtaagaccctctctgtgaatattaaactggtaaacctcatacataatgatgagattagtcatctacagaagtaactcagggcttgtctgtaaacatcctatgctccaaagtgactgcagtgtaatctcaggaaggcaagactggaatgagatcgtaaataaaaaaatggacatctaatacatacattggtctcgtctgaagaaagactgttaacagagggggatggtcagtatggaattgtaaacaggaggtcaaagaggacgaatgtgttatttacacccaccagaacccagggaagtgtggtgagaagcagcaggaactcttctgtctgctcggcaggcgggcagctctgtgtggcggagacatttgcttccactattatggttgaagtcagcggccataagatcatctatagactgagagaaggcagtgtggacaagggcctcagagcacaggctctctaggggagcatgagttcatgttctccaatctttccaactaccatgcatggaagatattagaatgaacttttccccagatgagaaaacaggcatggagaagttacacttgggcaagtcaaagaggggtagagataggcttaaggccagtctaaattcagaactctcttgactacgttgctctatctctctctctctctcttttttttccttgagacggagtctcactctgttgcccaggctggagtacagtggcctgatcggctcactgcaacttccgcctcccgagttcaagccattctcctgcctcagcctcccaagtagctgggactacaggcgcccgccaccacgcctggctaattgttttttatttttttgtatttttagtagagacagggtttcaccgtgttagccaggatggtctcgatctcctgacctcgtgatccacccgcctcagcctcccaaagtgctgggattacaggcatgagccaccgcgcccggccacgttgctctgtctcttaatagtcttgtcattcctgggatgctgccatttgttttcttttctaatggatagtggatcatgaagatgggttcacatgggcgacttgaattctagagagccaggcaatgtcacagcttcctggccagtttgtgcctgttgggggattccccatctttgatgcctttgacttccagtccttgagggacactcacttccctggcaagcactgtcttggactgcatgagtgattttctattggttggtttctgaccgggcgggcacttagctccatgctggtctgtgcctggctgagatatctaagagcagctcattgccatattctgaatcccagccctcaggggagcagccagcacctctgcttcctgcctcctctggcagatggccctgatctgagagtttaagtgatagctatctgagaggagtgattggtagagacagtagcaccttattttaataatttaaaaatcataaaatatgccactttggatacaaaagcttttaagaggcacttaataaaaatgtttagttgctttccacaatgagaaaacattgttataactaaagcacacttcagatatttaagcattaaagcatccccagagacttattcttaacagtaaaatgtattgctttgttcaagatgattctgtaatggagaggcattacagaggcaagaagagacgagaattctttgtaattagtgtgcactgtttgaatgtaaatgagtacttgaaaacagtttgctctcttaaacatcctaagttttcccactgtcgtcttccataaggtattaattggtttaaacagcctctttatttgtaggcagcacaaaggttaacttcagtccagcccctgtctagttatcatcaactccaaatgctaatgctgtttgaattcatcagacagaattgagctttttgtatgtagtcatggcctcttaaaacttacaaggccaggcgcagtggttcatgcctgtaatcccagcactttgggaggccgaggtggatagattacctaaggtcaggagtttgagaccagcctggccaacatggggaaaccccgtctctactaaaaatacagaagttagccgggcatggtggtgcatgcctgtaatcccagctacttgggaggctgagtcaggagaattgcttgaacacagggggcggaggctgtagtgagccgagatcgtgccactgcactccagcctgggtgacagagtgagactcttgtcaaaaaaacaaacaaacaaaaaaccaaaacttggaaagtatatatagtgtctctatatgaaatgagactagagaaattttataaaagaagggtcctcaagtatagataaaagacaactgtattttattataaatgctttcttatatctcagacccaggtaagttacaggtcatgctcagcacctgcccccgtgcatatagcagcaggttgttgtaacatcagcttattgagaatgtggatcactataacataggagtcgtgttatgctgttcttttaattccctcataccagtgcactacattccaatactaacatgtggaaaaaaaatactgaatatccccttgttttttagtaagaccatagagcagaacatttgcaattttataatggttttatttttaaggtcaggcatttaaagtggcacaaagctttgatgtgggcttacatctgagtattataaacatttagcacaaagtaagaacttacttaaaagatgctccagcttccagtgtgctgtttctgtgtgaaatactgaaaatttgggatcattttaaaaataaacacttatctaagttggcatgcaaaatggagcatttagaaagccatgaaaataagcccatgcataaaatatggcattaaaaaggtaactgtgaactttacagatggactagcatgaaagaagctgtcttttgctagggtggatacgagagtttgcagctctttgctgcaaaaaaataagagcagaaacttaagttgtttagttgttttgaaataacagctacacagagggctccttctggttcatccatattttattagggcagcagttaaaaaattcattagagacacccatctgtagctagcagcacccttgaggggggctcagatggtgatcagattttggagtagcactttacactaaaagaaaaagacaatcgtttaggagaattaatagcacaatggagaggggctgcttgatgcatttgaagcatacccttccacatggtttatgaatcttttgctactgaattcctcagccacctgcttcagttgggaaagagagatccaggcataacaaggagagaaaaattggatcagagagttgagactgtattggtcagtggagaacatagatagagtgtctatgtgatccgtgttgggctctcactcgtgtgtgtttgtgtgtgtgtgtgtgtgtgtaaatcacgttggcctcctggggaacttcatcagtacaaaaaaaagcttgtggtcagagctgaggctgccctggtttaccttggccttgaactccacctccctggtggtcaggtccaggtgcctttgcctcatctttattcatgaattgaaaataactctagttattgaatggcaatggaggggaagtgacctctcctctaccctcctagattccctagctgggtctatgaaattgacaacagatagattaacaggagaataggcatagacatttattttttttttttagaaggagttttactcttgttgcccaggctggagtgcaatggcacgatcttggctcactgcaacctccgcctcctgggttcaagcgattctcctgcctcagcctcccaagtagctaggattacaagtgccctctgccatcataccctgctaattttttgtacttttagtaaagacagggtttcaccatgttggccaggctggtctcgaactcctgacctcaggtaatccgcctttcttggcctctcaaagtgctgggattacaggcatgagccactgtgcccagcccatttattaatttttaatattatgtgcatggggggcatcacaggaaaaaatagtaaataccccaaagagcggtgagatttgagagcttatatactgttttcataggggaaggggaggaggatataggttgtgatttttagaaatgtgctgttagaacagcagatggaagataggagagtttgtgacaaagtttgtctgggtgtggtgtcgactcctagtttcatctcctgcaatacaaatctgtcttccctggttgatgaaacttccaggaagggaattcatgacaactgagttccctttggcacatctgttttgggcagataaagggagtttagagaaaacctttccctgcacttgctgtttttcaagtgccttcagctcaaaataatcaatattccaaagcagcatagtttggagtggcttattttggtttccttcagtgactctgtgccaggcatggtatagcacggttaaagtcataatctcatctatccttccagcaatcctaggggtggagtcccatttcacagatgagataatggaagcaacagagaggttagtcacctgaccatgctcactcataagaggcagagctgaatttcatcttctgctattaagtccaggtccataaactgtgtgcatatacatgttttttttagataaactttctattttagaataattatagatttatcgcaaagctgcaaagacagcacaaagttcctttcacccagcttcctctaacggtaagggcttatataatcatggtgcatgtattaagactcaaaaatgaatattggtgcaatgaactaaactacagatcttattcagatttcaccagtatccttttcctgttccccgatccaatccaggatcccacactgtatgtcacatgcatggtttttgacccttaaacacgaagtgggctggatgtcaaactgctgggtggcctgtttctcctcattactgatgaagaaagtgagacgctggtgccatctgtcaccttccttgtggggcccaggactctcattgtctaatggaaaggggaaatcctatgtagggtagaagatttagaacagaggcatggggacaaattttaaatatagaccatactttttctacttgtagtagtttgtagctaaaaccacattcaagaaatagaaaaagattgggggagagagagtattctgcaaagcaacaacctctctagcatcattaaagtttatgatgcatttgaatcccaagtgtactaggatgttaaataggacttttccttaaaacaaagccttccagtcctgactgcctcctagaatcacctggatagtgtcaagaagcaccaataccggaggcccatccctcgatgttgtaatttcatcagtcttggttgtgatctgaacctcagaatttttaaaagataccaccatgattttttttttttttttttgagacagagtcttgctctgttgcccaggctggagtgcaatggcgtgactgtggctcactgccgccttgccttcccgggatcaagctatcctcctgggcacatctaggatgcatgtaatttgcctgtattctgtgaccaacccttctgtgaacaccccctctgtgaccaacccctcctggaatcccagtgtggtttccttggatggtttctggtcacttttttcgcaagccctcttcttctttcaggatttaccttcttaggcggtctcatttaaccctcctggctttcccacttgcatggcatgtgtttccacctctctgtggcccaggtcctgccttggccctgtcctctcggtccccacctggaagccaccctgggcctattcccatcctgtcttctgcctcttcctccacagctgccacactgtctgtacccaagtcccagtggttctgaacttcttcaagctggctgcactcaacactgcctttcacactgtgcttgctgttctctccaccggcaatgacctcaccctcctttttggcttgggaagcctcagccttccagtttactttcctggcctcctgcagtggagttgctcacagcctggtctgcatctgcttgttgacatgtctgtcttccccagggagccatgagctccattgaggacagggaccatgactttgaaaaattaataattaatttttagagatggggttttgctaacttgcccaggctggagtgcagtggctattcataggaggaatcatagctcattgcagccctgaactcctgggctcaagtgatcctcccagctcagtcttctgagtagctgggactacgggggcatatatgcacccaacttgaaaaagtattatcaaatatttcacggttataaaaactgtatttatatataattatgtgtttaatatataattacacataggttttacatgtgctgtttgaaaataatacaatcagttcctgtgtaaccaccacttaagaaatggaacattacccttgaattactatataattgcatgcattttttcctatgtattgtttgagaataatacagtaggcacctgtgtaaataccagcaggcttaaaaatggaacattaccctcgaggtcccttgcacatcacgtcctgttccctgttaagactggtttatcattcttttgcttttgtttatacttttagcacgtatctatctcttgtgctaaaagactgttacaagcagaacagtcattccagttttagtgattctgggctgagactgtagacaattaaataaaaagccaattcagtgtaggattcatgccttccgactgtgaggctgttgtaaggaagtagcgtttgtgggaatgccacccaggagtcaaatctctagcctttgggtgatcaggaggctgacaggaaaacagcgacagagctttgcctctggtggaactcctggtggcctgcagacctgttggcgtctgtacctgcagtccactcagctttccagatgactgaaatgccccaacagggtagagtggctcgcctctccaagaaagagcagttggtgaataatcatgcctgggaaaacaatccgcctggcaaagagatggatggtatccgttggtgaatgtgatggcagcaagcccagtgcaagattctgtggcgattccttgattgacctgctcggttggtggattttgaaagggagtgggaaggactgcttcacttgcgtagaactctccctctctcttgcgctatcttcatatcgatgtctacctttctctttgtgtatatgtgtttataaatatttcatatgtatatttgtgtacagacatatacacatttggatttatatttgtatacattttatattagtcagttttcatcctgctgatgaagatatacccgagacttggaagaaaaagaggcttaattagacttacagttccacatggctggggaggcctcaaaatcatggcaggaggtgaaaggcacttctttattttatcttattgtattttttttttgagacagagtctcgctctgttgcccaggctggaatgcaatggcgtgatcttggctcactgcaacctctgcctcctgggttcaagcgattcttctgcctcagcctcccgagtagctgggactgtaggcgcctgccaccatgcccagctaatttttgtatttttagtagagacagagtttcaccatattggccaggctggtctcgaactcctgacctcgtgatctgcctgcctcggcctcccaaagagctgggattacaggcataagccaccacacccggactggcaaaaggcacttctaacccaaaagtccacagtccaaagtctcatctgagacaaggcaattcccatctgcccatgagcctgtaaaatcaaaagcaagttagttacttcctagatacaatgggggtaccagtattgggtaaatacagctgttccaaataggagaaattggccaaaacaaaggggttacagggcccatgcaagtccaaaatccagtggggcagtcaaattttaaaactccaaaatgacctccagatctcacatccaggtcacactgatccaagaggtgggttcccatggtctggggcagctccacccctgtcgctttgcagggtacagcctccctcccagctgctttcacaggttggcactgagtgtctgcagcttttccaggtggatagtgcaagctgtaggtggatctaccatcctggggtctggaggatggtggccctcttctcacagctccactaggcggtaccccagtagggactctgtgggggctccaaccccatatttcccttcctctgccctagcagagattctccatgagtgcccagcacctgcaacaaacttctgcctgggcatccagccgtttccatacgtgttctgaaatctaggtggtggttcccaaaccccagttcttgacttctgtgcacttgcaggctcaacaccaagtggaagctgccaaggcttagggcttggaccctctgaagccacggcccgagctctatgttggcccctttcagccatggctggagcagctgggacacagggtactaagtccccatgcacacagcatggggaccctgggcccggcccacaaaacctttttttcctcctgggcctccaggcctgtgatgggaggggctgttgtgaagacctttgacatgccgaggagatgtcttccccattgtcctggggcttaacatttggcttgttgttacttatgcaaattcctgcagctggcttgaatttctcctcagaaaatgggtttttcttttctgtcacattgttatgctgcaaattttctgaacttttatgttctgcttcccttatatatctgaatgcctttaacagcacccatgtcacctcttgaaggctttgctgcttggaaatttcttccgccagataccctaaatcatccctctcaagttcaaagttccacaaatctctagggcaggggcaaaatgctgcccatctctttgctaaaacataacaagagtcacctttgctccagttcccaacaagttcctcatctccatctgagaccacctcagcctggaccttattgttcctatcactatcaggcttttggtcaaagccattcaacaagtctctagggagttccaaactttctcacattttcctgtcttcttctgagccctccagactgttccagcctctgcctattacccagttccaaagttgcttccacatttttgggtatcttttcaggaatgccccactctactggtaccaatttactgtattagtccatttttatgctgctgataatgacatacctgagactgggaagaaaaagaggtttaattggacttacagttccacatggctggggaggcctcagaatcatggcgggaggtgaaagacacttcttacatggtggcagcaagagaaaatgaggaagaagcaaaagcagaagcccttgataaacccatcagatctcatgagacttactcactaccatgagaacagtatgggggaaattgcccccatcattccattgatgtcccactaggtcccctcccacacaacatgggaattataggagtacaattcaagatgagatttgggtggggacacagccaaaccgtataagatttgtattatttttatatcacgcatgtgtgctcccccaacagtgttccttcatgcacatggatggtggtgttgaaaatgcactttctgttggacttccaattttaggccaagcttaggcccaggttgttgaattaataatgaataaatctagataaaaatagaatggtggttaccagggactggggcagggggaaatggggagttaatattcaatgggtaccatgtttcagtttgggaaggtgaaacagttcttcaggtgcatgatggtgatgattgtacaacaatgtgaatgtacttaatgccactgaatgatacattgaaacacggtaaaaatggtaattttatgttacgtatatgttaccacaattaaagaaaagtaaaaaaaaaaatcatagggaaaattcaatggaagcctcaggaaatggtaggggaggtcaattccaaaaccacatacattctaaaatgtcagaaatggtcagttagcaaagtaaggattaattagattttacacttgtatgtctttgttgacatttctgggaataaagagagaagagtgtgataattcctcttctatgtcagttctagaaccttctctttgttccttaccctggtgcttgtatgagtatgtacaaatgtgtgtgtgtgtgtgttgtgtttgcaaacatggacaatggcgtgtgggtttgctactctatttctagtatttctgtgccaccttattaataggagagctgtgggatcaggcctctggatgtaaccctgtccttccttagtgcttctgagttcaaactgactaactcacaaaatgcgtctgcatcgggactgacttgtggcattcattttctcaaagggcaaaaaaccttttgtttctggtagaaattaaagatgtgtttgtgacggccctcacttctttttcaccaaatgcagcacccttcttccctttaatccgatgaggtggttttatggggtggcacataacttggagctcatgggaggccttagaaccattaaccaactgagctaaccaggttcctccattagtttaatttcaaattgaattctccttcctccatgattgaaagagtacattcaattcctgtaacagtttttatatgcctgactgacatcccttcctaaagcataagcagtttgagggcagggatggtgtcttgtttatgtctgtaccccatgtatcatctagtgttcaataaggaattgttttatggaaatggattacatgattaaattggaaatagaatacaggttgatttattccacccccagcttgccttgctcactggatgcttattacagtgacctgaaggcacttcagaagacttaagtgctctctgaattattgaaggaagatggactttggctcagtagagtgtttgtgcttagtgcctattactggattctgattctttggaaacaaattaatccagagggatatattgtttctttatggttctgaatatttggttagcctgaatgtattaagatcttacaccccaaccatgacagatgggattaaaattccttccctgaaaagaatatattcctttatgcttccactataaatttatatgcaagtcatgttttgtaaagtcgtgttcttctcttgctatttggtgcattccctgcagcattctcgaggtcccagcattttcccttcaggagaccttagaattattggggtacggggcagccaagtgacctgcccaagcccacgtgtcttttttttttgttgtttttttgagacaagagtcttgctctgtcacccagactggagtgcagtggtgtggtctcggctcactgcaacctccgtctcccaggttccagtgattctcctgcctcagcctcccgagtagctgggattacaggtgtgcaccaccacgccaggctaatttttgtatttttagtagagatggggcctcgccatgttgcccaggctggtcttgaactcctgacctcaagtgatccacccacctccgcctcccaaagtgctgggattacaggcatgagccactgctccaggaaaaaaactgagtatcatgttttcttaaactgcatgtttaagatttcatatttaaaaatgaatattgtctggccaatgtgtattttaatttcttctctgatatactgtaaactaggattgttttaggaattataaggacctcaggaaacttctgtgtagtataaactggaaacaattcatatccaccacagaaaataattaacagtgctgggtgttaacaatacttaggggggaatgagtgatggagggaatgagtgatatggacaattggtgaagccctgttgactgggtgatcaggagaagggagctgatgggggagggattggaagctgaaggctgagaaggatttggatagatgaagggagaacataagagggagggctgacaggattcttgctgatccggctggttaatattggcttgccgcaattttccttctaagctaggtaaacatatatttccaggcatcctatttggactgtgtatagagacccattgacatctgggtctgttctaagctgctttcacttccctccaatcagagcttgttgggctcaataaggtggagatgggggtcatatattaccagggcaagcaggtctgtgcttcagagaggaagtaaggcatcagcgcttccctctagaattgatctgttgcggaacaagagtcctcgagcagcagagaaagctgcgccaggctccctttccctgctcagtcgttcgttcctggactagatgggtggaacgaggcatctctgggtttcacagagcacagagggcacggcttgtttcctaaccgggtctcaaaacctgcctgcactttgggctttttcttcaccttgccatatgttgcttcctgcccttttgaacctccttccggagctgattgcacttatgtgctaggaaaggagtatttgtcttcaaggtctgaatgcatcctaatccttattgaactgcaaggtgtgatggcacgacttggatatgtaagtgagaattgattctggtcacaggggatgtcataagtttcctcaaaaaataaaaaagaggaaaaaaatagtgagaaaaaatggcctttcgttatgggaaactgggagtttttcctacagatttcattcttgccttatatgggtttcctggaattcttctagcagattccagcagtgccctccggatctgccctctgccctctgagggttaggattcatagtgtgtgacagtctttgctattcaggccaccttctgggaaggccagtggccaggggatggttttcatgagccctcagcagggtgcagaagccaggtggttcccatatctcattcccacttttggtaaacacctctcttatgtttgccctcctgggcttgttgcttctggtccccggctcatcacagcttcccagggccccggtagaaacaagggttcacagtgggtaacctcactgtgctgcaactggaacctggcttgcaggatttcaggacctttggttgagtggttttagaaaaggctactcaggggctgggcgcggtggctgtggctcacaactgtaatgccagcactttgagaggcctaggcggggggatcacctgagatcaggagttcgagaccagcctggccaatatggtgaaaccccctctctactaaaaatacaaaaattagctgggcgtggtggcaggcacccgcaatcccagctacttgggaggctgaggcaggagaatcacttgaacctgggaggtggaggttgcagtggggtgagattgtgccactgcactccagcctgggcaacaggagcgagactgtctcaaaaaaaaaacagaaagaataaagaaaaaaagaaaaggctattcaggctgaagtgccctcaggccttggaaaagaaatgaaatttcaaacaaattattttctacctagcctttttcttttaacttcagaagggttatctggatgactggtatttacatacaaaaaatagttaaaagtctttttaaaccacagacagtataggtttcactggactcatttttcaagatacgaaattgttgaattgttttcctttggtaattgaagccagaattcagtgttttctctaacttcttttcggattctttgctctctggagaacgttttgcctgctttgcaagggggtatgagtagtgcgtgtgcctgagggcctctctctgccccctcctaacgcctggccaccctgttccgactgctgcccctgccggtcgggcccggacactgcagggagcctcacatcctcggatgacggattccttctgtacatctcatcacatccttttctactggcttcaacttgcatggcctctgtcttgaagaaagaaagaaaaaaatgaaatgtttcttctgccttcctgtcattttacgcattttacgctgatatacttgtaggcaaagggaattgaaagggcatgcactttggaacgagacaagcctcagttcaaatccgggctttgggaaaccatgatccgggagttctggggcaaagtaaggctttctgagctttagctgtattattggtaaaatgggaatagtaccgatctcctagggttatagtgttaaatgcctcccttcctttctttactctgacttcttccaccaccacctcatggtccctgcttccattcctcccttccttgcaagcttccggaattctttgtaccccgggcagcaatagcccttttggagctccccgcaattggcaagagcaagtcactgtgtgagcaagtcttgggctctgttatcttcagatgctcaagtcaggaaatagggggctagaggtcattgtgctcatttccccagagattatcaatgccacccccaccccttttaggagatggcatgtgccatgatcgtagctcagtgggatccttaatgcctagtgatctcggcttaacaggacaaagattccaagcccatgtctgttctgggaagcaaagcaggatgtgtgggcctggagtgaagtttgttccatttctcgccataggccatggtatgattacagctgtgcctagtgctgcctagttttactttcatgcctgatttgcaatgtggcagggtcctgagatgagagctctgtgtgggccagtagagtcaagagactttgtcctggtcacttggctacttgcagggggttctggaaagtcaagttctctgaatctcagttgcctttaatataaaaggaaagctatagtttcgggtcggattgattcacatggttttggtcgggagtgaatgaaattaatgtaaattaaaacacattatgagtagcaaagtgctatgcaatctaaaaataataacattttaatcactcttatcatcatatgtgccaggcactgttctaagctgtctacaaatagtaactcatttagttgaatgctcacaaccaccttatgagagagctactgttaatatcaccactttactgatggggaaactgaggcacagagaggttaagtaacttgtggaaggtcacacaaccagcaagtggtacaatcagggtttgaaccagtcaatgaggagtcagcatttgttattgttcctattcctatagcatagctgggaagggaatgcaatgctggtttggagaacacatcaagcaggcctcctgtcatccactgagtgagatgagatgatggccatacattgcggcacagccagctatccatggtctgcagcaacagatcagtcttgcagggacatggatagctccgctagtgaacattcacatgttcaacgaatagctagagtaaatagttggatctcatttagaggcatgctctggcattcctctttcacgtcatttgctttccaggcccactccaggatgagagtactgaggtgccataaaagaccaacaggcaagatgttggagggttcaggagctgccaaggttgtgttcatgctgacctgttggcatagcgtacagcagtgccagctgctctgctaaaccgaggagctgagatgctgtgttgatttctacatgttccaggcaaatacttcctgaggattgtcaggatttacataatggattggccctgggaccactgagccagcatctatctttgacaggtgtactgagagatgacctttaaacctagggatgttctccagatgcagttccagctgggccagtaagatctgcatgtttatggtgctgttttttcttttcttcccaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtcagtgtctcttccacctctgtggcccgagattgtcgtgagctcagattagcactgggcagacggcaggaaacgaggggttctgggctcaactgacttcctcctggaagctgcagcagctccttttggagccggctgcacaggatgttgctgcacttctgtctctttgaattggacacagatctactctcctttttgtcttctctgtcacttaggtgctcagatttgctctccattgggccgcaggctcctctgcaggccccggcttaggtgagacgtggttcatgcagcccagctctgctttgagacaggaaactgggggcaggggagattgagctgggtgatgtttggaaggacttgagagatacaaaaatggggatgccctctatcagggcgatcctgctcttcatccgcttcactcattcccttccatcctgctgcagtggctgctgccttccacagggtcgggagacttcgcttctggtcattgaacctctttggctctcagtttccgtatttagagataacaccaactcataggattgttctaaggctcaaatgagaatgtagctgctttggaaataagtacaaactggagacatctaaggcccagccttatgatgatgctgtccatccagttatctgagaggtgggtatagccggaagtaggtagggttcctctacccacaaaagttcccagagaagcccaggtagagatgctctgtggctcatctgttgccagactgtattttaatcctggtgtgtgtgtgcatatgtgtttgtgtgtgtatgtgtgtgcatgtaggtgtgcctgtgtgtgcgtgtgtgtgtgtgcatgtttgtgctgtgtgttcatgtgtgtgtgtgcatgcatgtgcgagtgtatttgtgtgtgtgcactcatgtgtttctgcgtgtggtgtgtggatatgttcatgtgggtagggaagtggagcacccactcatcaggcatttgggaggagtaatctgcagaagttcatgctcattccccgaaagagcatctcccatctgttctttatctatagtctgatgtttctagccctgtccctgtttgccctgtttcagccctcagggacctcagcccagccctctgatttattatgcagagagggagtgaggtcagagcacagatgcaggcttgtattctgggtgatgtgtggagtcttccagttagtcattgcctaaaccagtgccccttgtctttccccgaaacccgttctgaagggcctccaatattggttgatttgaatgcatagaatctatccagtttcttaggccagaaaccacaaccatcttccacacctccctctcccttgttccacatctggctggcctccaagccctctcagtcctactgctaatctgtctctcatcaccatggccgctgccctggctcagatccttgttatctttcacctgggttttgcaagagggtctaccttcctgcggtgtttctcttctccagttaattaaactaaatgtgatcatatgtgcaaagtgcttcagacagggcctggcatctagcaagtacccagaaattaaccattgtcatcattagagaaatagctccaatttagagagtttgagtcaaaagcaaatgaagctctcccttctgtccatagctcaaattaaattcctatcttatctcaaatggtagaatctggacacactttttctttagtgtaagtattgttgtctatggcagtcccacagctgggcagggaaaaacatgacactctcttcaattacactcatgtactgcataatgacattttggccaatgacggatcacatatatgatgtgacagtggtcctgtgagattatcgtactgtgtttttgttgtaccctttctatgttcagatatgtttagatacaacaataccttaccattgtgtgacacttgtctgcagtattcagtacagtcacatgctgcacaggtttgtagccaaggagcaatagactattccatctagcctaggtgtgtaatgggctacaccatccagatttgtgtaagcacactctacgatgttcacacaatgatgaagtcacctaataatgcatttctcagaatgcatccctgtcattaagtaacgctaggctgtacttgagtatctgttgtgtgacagcggaattaacagagtagtgggaatgacagaaataacacagtccagggcataggacttacaggaaggcagagtttgcctcaataggaggaagaacctcttgacagtgggaattgtctgtgatgaggtgggctggtcagggacttgttttcccatggtgcttacacagaggccccagactgctcactggggttgcggctgaggccttcgggacagggcagaaggtcggtgaaggatctccaaaaagatcctttgaaagagtaggatttctagtgtttgggggccttattgatattatattttaattccttaacctcctctcgcttctacttaagtaaaaatgagaatctcaggaatttaagtttcagcttcttctaaaagatggttgatcctcagtgtttgtggattctatatgtgtgaattcgtctacttgctaaaatttgttgttaactccaaaatcagtactcacagcacttttatggtcatttttcatttttattttattttttaagagacggggtctctgtcttccaggctggggtgcagtggtgtgatcataactcactgcaaccttgaactcctgggctcaagcgattctcttgcctcagcctccctagtggctgggactacaggcgcatgccaccatgcctggctaatttttttttttttttttttttgggtagagatgagggtcttgccacgttgcccaaactggtcttgaactcttggcctcaaatgatcctcctgcctcagcctccaaggtactgggattacaggcatgagccaccatgcctggtggtaattttgaacctgcacagagtggcaaaatatttgggtcacctgatgtacacgctttctacttaggtcaaacaagttcagaccagatgacattctaccttctctctcatactacaaactagtatcctttttgtggtctatttaatgccatctttttttacatttttgtgctctttattggtgagttaaccattgcaaaagctccctaagcatagtgctaatgtcatctagtgctcctaagcatgagaaggctgtgatgggcctgatggagaagatacaggtgctccagaaactttattcaggcatgagttagagtgctgttggccagagtacaatgcttatggatcaataatacatattaaataagatgtttttaaacagaaacacacatagaacaaggtcatgtgttgaccgatggaggaaggtgttgtgaccaggggttcacaggaacctaccctgtatttctcttaggagcaatgcttcattattccctaattcagtattcacagaaactttatagaacataactacagtactgtgaataaggagaatcgactgtgaatattttatgctgtttagaaatcgctgcttagcgagatttccaggggttgcatgggactgagaagatggtaataaaggtagttggtgaccaggcatgcagaggaggggaagtggagtgggccctgcaaggtaggctccacctaaggccatggaaactggtgaaaaatgaaggactctgcctgtagagtattataggacgttccacaggcagggttgtggcacagtgcaagacatggccactggggctgtgcctccagcaaagacgggtattcagacatatctcagggcagtccattcagggccttatagagatcactggacgaggtgggcatcgtggggtgggctttggctgtaaatgaatttttttcctgaccttgtttcctgcatttcttcagcttctgttctaataaatgtttaatgataccatcatttgggtgtggcgatggtaatgctatagctttatgtggccctcaaaccattcacacagcctttcttctgtccctaatatataggactaagttactggtaaactttgcagttgtaatatagaacaattcaaagacaaaggggttaatatgattattcattcattctttcattcattcagaaagcatttatcaatgacaacgagtacaatgccttatcctaggctttggagattgtattaggacaggctagtaacaggcactacgttagaggctcaacacaacaaaattgtgttttttgcgtatgcttcatgttccacagagatttttggggggcaagaacccagcctgcaccatctgaacatatgatccccttagtcacagacttgaggaagagaatgttagggagtcctacaagagcgatcaaatgcttcagcgtagaggtaaccccatcactgccactcataccctgttcagcagaacaaggagagaggcacttgtactctttccatgtgcccaaagcagtggaaaatcaagtcagtgtaagtactagcatcctatacatggatgcaaaatagttcttgccccccagatgctcaaggttgaatgatgtgcacagataaaaccaaacaaaggaaaatgatggctataacctggtgcaataagtactccattcttccagtgggtcagaaaaaaaaacccaaaaaacaaaaaacaaaacaaaccttggcatcatcctggtgcattttcctcagaccccacctgtgatgtattagcaaatcctgttggctctatatttaaccagcggtcttctgaatataaccggaatcagatcacatctcaccatcttcaccattgccaccatcctcactatcatccaagctcctgtcatctccttcctgaatgttcccatagcctcttacctggcctcccttcttctgctcttactaacagcagccagagtgaaactgtttaaaacataagtcagatcatgtgctcctctgccccaaactctccagtggcgccccatgaacttcagagtaaaatcagaacttttaaatggtcttcatgtctcttcttgacacagtcctcattacctgtgtgacctcattctctacagttttcccttacatcaatctgccccagatccagtggcattcttgctccctcttgcttttcatttcactttcacttcttgctttcttaccagaaacacttctgcctgagcctttgtactggctcttccctctgtgggaatatttttctcccagacagcctcgtggttcactcccttaccacttttaaatctttgtgtaaatgtcaccatctcaaggagatcagatttcaaattgcaacctctaccctctaccagcatccctgatccccataacgtggttctcccttttcctttttcatagcattaatcacttgctaaggtgccataaaacttacagttgacccttgaacaacacgggtttgagctgcaagggtcacttatatgcagattctcttccacctctgccacctctgagacagcaagaacaacctctcttcctcctcctcctcagcctactcaagatgaagatgatccactttcacttaatgaataggaaatttattttctgttttttatgatgtttttcgtcatctagtcaatgctgaatttttttctcaatgatttttaaataacattttcttttttccactttacttttattgtaagaatgcatatataatacatataacaaacaaaatatgtgttaatcaactgtttatgtttttggtaaggtctctggtcaacagtagactattagtagttaagttttggggaagtcaaaagttatacacagattttcaactgtatagggccggggttggttcccataatccccgttgttcaagggccgactgtattatgtttttgcctagaatgtaagtctggagggctaagcattttatgatgtatccttgttacatcaacacaatacaaacagggcctgataactaagaggcactcagtaaatatttgttgaatgggtctatgaatagaagaagcaagtacaggtcacaatggaggtatagaggagggacatttaacacagactggaggagacgacacttgtgctaggggttgaaggaaatgtaggtgtgagccaggcaaagaatgggaggaagatgtttttcagggatcaagcccaaatccattcattggtaggccaagaattcattgtcagtaaatctttgggtctcctgttgagaagaacaatgattgtattagtcagttctcatgctgctaataaagacgtacccaagtctgggtaatttataaagaaaaagaggtttaacggactcacagttctacatggctggggaagcctcacaatcatggtggaaggcaaaggaggagaaaggcacatcttacacagtggcaggcaagagggcgcttgtgcaggggaactcccttttataaaaccatcagatctcatgagacatattcattatcatgagaacagcatgggaaagacccacccccatgattcaattacctcccacgacatgcgggaattatgggagctacaattcaagatgagatttgggtggggacacagccaaaccatatcaatgatgctaaatcaacccattggtaacactcagagaagtaactggatcactgagtctccatgtgggttaaataagactgcccttttctgtaatggaaaatatttgaaccttagggcttctcagaagggttttgtgagagctttgccatcattcttactcaagccttcaggacagcctgctgagcttaagttcatgctctttttctcttggtttctctgccaattttggtgtgtttaccttcataatttaaatgtgaggtttagaacagagaccatttggtcaggaaatttgtattccttctcattatgcatttcttcatgcagatgagggcacagtgtgatgtttttgtttaaaataaaataacattttaactttttatgtggatgttatgctcaaattacactttttctttacatagattttttttggagaaactaatgcatctggcattgaaaaaatgtgcatttttgttttttttttaaaaagagaatgaagaagttcagttttgaaacagtttctaaatgttcttagttttcacaaaaatgtttgcttgaattctattgtaattttttattttttcccctttaaaccaacataggtaatatccttaagattaaaacttcagaaacttcaggaagatgcagttgagaatgatgattatgataaaggtgagttttaatttgtttattgattgttttgtcatcatgtcccaattttctttccatctttactcatatctaccttttgaatcccaaaagaattgtacaatctgttcctctgatcatctctaccagggaatagttgactcttttacagcattattgttttgtagatttcaaagtacttcatgaacattaatcctttgggttataaatataaccttatcaattgtccagaaacacttagcatactcacacaataaaaattatattagcttgccacctgtctgcccatggtgtgatgtatctataatccacttgttcataaaaaatattcgtctgacacctatgatatgctagggaatatgggagacaataggaaagtaagacagacatggtatctgcccttgtgatgccagtaaacttaagccttcatggggctctctgacttcataatttccagaaccagagataggaaatgaggtgaatttgagaaatgtcagactgtgccaaagggggtcacatgcatcaaatttccacatacatggcctaaaatacccaagagaaaaagaagttacaacattagaccagagatagagggactgatctgaggccaggaaaacaaacaaacaaaaaaacaaaaaaaccaattaaaatgaggcaccaaaatagaagttgggctgcaagcagatgagggctgacatgggggttgaatgggcacagggtagactgagtcaaaggaaagctttcaggtatggttgtcctgggaacaatcctgaaaactttagatgctcattgcaagatctcacacccatttctgctgggtgtgggaaagagaaagggctgaaaatgacatgtagattcccctaggcacctactaacttgatagatactcctgctattgagcaagttaggacacccaggattggtatggaaatggaatgtaggtttaaggattcttctggaagctggttagctttaaggcatgggtcttcagcatttagcccatgtgacattctcattgtatgtgtcatagactgttggaattagggcactatgggaataagataagtgatttccaaaaggaggtagaaaatcctgttctaggaaatgctgttgcatgttctcattacctatccattgcagttgggtttagaaagtcacggggcatgggaggaagggagaaaggactggagacagaggagggactcttgacattctcccagtcctccttctacaggccacttgatttcataataacactgggtggaggatgagttgcctgagagaggaggcaagtcggaggcaggggaaggcacccctcaagcccagcgtcagtggcttcagcccgggcacagctgtaggcagggagaaaatgagctattcctgggccagggctcacctgctggatttcatctatgagagataattacagctagttttgaagctgcccactattgcacagatttatttttattaccatgaattgagtcctggactctctacctttaatgacactgtaacacataaagcttacaatgcagtgaaaaagtaggccaatcaggccctagtttgtcccctgctcctgcttaggacctggtgaactttctagacttggttctctcaatggcttcattaaatggagacctcacttctttaatcttttctccaaacattccgcaacacctaagggaatggggtttgagaggatacacctcatcagggaagctcaaagaatacaggcatcttctttagtgtttctgcctttttctgttcctgttggtacctcactacttactacatcagaagtttcagggtgggctcagcattctgtgttttcccaagccttcctggtgactggggtgtgtcctgaggcttgagaaaacactggtgcagagtttatgctagtgagcactaggcctggggggcagcagccagccaagccctggaagaggggttgagtctatgggttgtgtccttcctgatccaccagaaatctgtgcagcagacaagcatcctggtaggcacaggacacacgatttacatgccactccccttgtcttcttcccaatcccacagacccgattcagtgtgttgagaggtaaatgttcttgtggaatatgcacaatgcctggcatataggaggcaggccctcagtaaatgtggtgtgagggaattaattaataaatgacttgccctctgaatgcatggaggctatggatggcaagctagagtgaatgaggggaaagcactcttgccacctgaaggtgggcttagttctcagctcatctgcagtgcccaggatggggggtgggagtgggtgaagggaaagatctttgcatagaaattggcttatgtgaaaaatatctattaagtatccatcgtatacaacagcacttctcagactttaatgtactgtgaataacctgggttggtaatggattaaaatgcagattctgggctgggcgcggtggctcatgcctataatcccagcactttgggagtccgaggcgggtggatcacgaggtcaggagatcgataccatcctggctaacgcagtgaaaccccatctctactaaaaatacaaaaacaaaattagccgggcgtggtggcaggcgcctgtagtcccagctactcgggaggctgaggcaggagaatggcgtgaacccagggggcggagcttgcagtgagccgagatggcgccactgcactccagcctgggcgacagagcgagactccgtctcaaaaaaaaaaaaaaaaaaaaaaaaaagcagattctgattaagtaggactggggtggggtgggagactccatttctaatgatctcccaaatgatgcgcatactgcgagcctgtgagccacacttagagtaataatggcatataagaaatcacaacaacgccgtgtttaaggcatgctgaatgccgtcctcaagatctgcatctcaaggagtatgcagtccaggaggggaaactggataatacacagtaagaataataaagctatacataatatgtcccttaaaatacagacagaccaaggcgggtggatcatgaggtcaggagtttgagaccagcctggccaacatagtgaaaccccgtctctactaaaaatacaaaaaattagccgggcatggtaacaggcacctgtaatcccagctactcgggaggctgaggcaggagaatcgcttgaacccgggaggcggaggttgcagtgagcagagattgcaccattgcactccagcccgggcaacagtgggagcgagactccatctcaaaaaaaaaaaaaaaaaaaaaaaaatcattaaaaaaaaaaaaataaaggcagacaaagacagtcccaaaaagggacaaatgacttctgccagagatcttggggtgggtgaagaatcaaagtagtggaggaggaggcagtttagatgggtcctgaaggatgggtttgatgcaacagacgggggattccggcaaagagaagagggagaaagggcactgttaccatgagccaccatcccaaagttaggcttgaaaggagacttgcggctgactatggtttgaaatggatcacaaaagggctcagtacttggacttgtcagtgattggtaaattattttaaattgatcactaagtcattaggaaagtttggaagacataaaggtagtgaatttgttatgagatttgttcaaataagatttgaatacaatttcttctctcatatagtttattgagggtaactattaaacattttaagaattgttgagttttttttcatagtttttacttgaatttgctcctttttctctgttaggagcagctgtgcagccctgttctgtctcaggggaaggggtctgccggaatctgagaggtttgccagaagaaatgagagggtgaccttatctcccttggtttttgctgcttttttcttttgctctttctttctttctagtttcactcataaaaatgactttgtgttccaaagaaagaagcagttggcacagagtagagagttccatgttttatctcatcaaagtgctggcaaatttccccactaatgccttgtgggaaaaccttctcaggctctaattacatctctccatcactagggaagtaaagttaatatttccttatattcttgcataaggtgggagggcttgggagaaaaagaataaggctttcattaatagcatttacatagcgtccttctccaagaggattcattagattcattgcattaatgcctatcccgtgcttatggtcaggtgaggggcaagtttgagacctcagagtcctgcagagagaggaactgtggtcagtactggagataaggattccagctctgacatgggtggggcagagaaaaggtgggcgtgggcaacaagtttctatgtggttactgttctagttgttcctgcacctgtttgtgctccataatatccccctggctgctcgtgtcccatgtccaccagtgaccatgctcacttccacttccgatgtgagcaaggagagattgtgaaaaggaaggaacacaattttgggaactcagcatttcagtgacttatatcaatgtgacatatagagcagctggcttcactctgcttgtttagaatttcctttttggagtaaaagtagccagcatcatattactttctctatcctttgtctcaactcatatccattatgacagaactctagtataataaacatttatatacaatgacagacattgaaagaaaaatgatggtggcagaggccaagcataaaaacactctagggtgagtcttttgtctaaattaccataatgtccctttgtctgaattatgtcttgagcaagatttctctatcctcagtttctcgtcactgatggtgtgcaaattacccaaccagatacccctttccttcacagggaacctgccttacacctcccatagggtttggtgtctcagtggcttccaggagcctggcagttagaaccagaatccctgccacataagcgttgatgtgactgaacacagcacaaccccagagatttccttttccctgcgtttcattccagtctagaaagaagaaaacaagattgaatagaatcggccattcttatatcctcaggactgccagaatcaatgggatgtggatgccatctgggggcccatggaacataaatgcttttcttggcagcctgtatcattttgctttctgacttaaaaagtggactgcaattgaaatctgctcagagagacaggtccagcaaaactgtcactttataatgtctgcacagaaaaaaagcaaacatgaccaccagtgcaatttccacctgcagctcccttgaacaaggcacttctctccctgcctgcacaccaggactttggagtgttcttgtctgtgctctatagagctttcccttcctttgctgtgagatctgcttgctatatcaccttgtcctggtatactaacaaaatctgctgattaaaacccaaatcaacagcacaaatctcaagtatgtgtcatgagactcactacatccttagcacctatgaaaaatgccaacacttagacctgcaaacacaaatgggaaatgctcaaagtcaccattggctatgatctctgcccttaatttacagaattgtaaattctcctgcaaacaagaaaagaagctaagatagtgcaaccaagtaaaagaaatgcattttatgtttcctctttttatgatatgtttgttttattagatagctgctgctctggtgccaatcataacatcaaaagacacaatcctgaatgccatcatcctgaatgttgaaatctcccaaaattaaatccctaaaaccccaaattcctaaagtctaaatccctaaagtctaaaatccctaacatctgcaatcctgaaaaatcacagtcctgaaagattaaaatcccacatgctggaattctgaaaaccaaatgtggggaaaggatttagtgagttttcagttgtgtcatgttagttgcatcatggtaggtggaactattacctttttattgtctttatttggaaattaggtatggtttaagaagatgcatataggtgcccagctgacaaggggtggacttgtggacttaattttaagtgtcaacttgattggattaaggaataccttgaaacctggtaaagcattattttgggtgtttctttgagggtatttccgcggagattagtatgagtctgcgtgtactaggtagggaagatctgtgtttaatgttggcaggcaccatccaattgtcaagggcccagagaaaacaaatgtagaaggcaaactggtctctctctgagaaatgagacagactttttcctgactccatggacatcagaaatttgactgcatgaaagtgcattataacaacgttgactttgtgtgtaagcactgtgcgtatacataacaatgttgggatttcctcaatagatgaagagatgtttggacatcggcatttgtgaaaaataaaatttcttgagatctctgctctctgggtggctgcatacgaccccctttgcaggtctgttccatggtgggcacattctcattcgttgcctgattacatcacgtgattactgtgggaagaattgtcactatcattggttttcaattgaggtcacggaatctgctgagagggaggaccagctgtgtgctctggccactctgtcaatttgtctcccatccctactgggtctagagcattttgtgtcccactgtggaagactgagctttgtagacagttgaggacaaaacttagctaggaagtttctgacttctggaagctcttatttacatgacagtgaggaaaggaacagatgagcgctctacacttggaggtagcaggaaaattttccacaattttatctaaaaaattagtctatttttatctaaaaaacaaatgctaattaggaaattagctcttgtgttaatcttcagcattgttctcagaagagcataagcttgtatatctgcttcctcttactttaagtaaaaacttaaaaattgggagatgggctatacattaagacaaaaataccataggaagagaatatgaacaaaatgtcatttatttagtttggttgcattgtcttagcttctcttcctgtttacaggagaatttacaattctgtaagttaaaggtagagatcatagccaatagtgactttgagcattgcccatttgtgtttgcaggtctaagtgttggcatttttcatgggttctaagggtgcatgcagtgagtcaagtgccacctacttgagattttagctttgtgcacagatgcgaaagcttattggcacctgatgtacttccctctcattcacagcataaaatgtgatttcacggtgatgccttttctccttggctttgcatctgggtacacgcttggctctttcttaggtcttggtaggatttcttggaacccctgcagctctggaggtagaagcacagtggcatgaacattccttcctaactgccatgtcgtggtgtgtttctctctgggaatgggaccatgctgctttgccttccctgcctatgaggacatcagtctgtcctataaggatcacgtggaatgttgtcatggtgcattattcatgataaactctgacagcttcaaggttaggtgtgatgctgaatacaaaacaccaagccaagccaaaagaattttttttctctcctctatgtcctctccctaaatggttcttagttgaaacttgtacatgatttcctactagctgagctgtagcaggaagttgtgccaacagtggacacatcttattcacgttttatgcatctgcctatgagaatctgtaagagacacaagctgttcatgttgtagagtccggttgatgaagcagaatgtggttcaggaagtctctcttgcgcttagaagactgattttgaagctgctctcataggttttctgcttcttctgccctcttagagtggctaggaggctgcctgggattccaggtaggtcttggccctaagacctcagctgctccatagaaggtggtcagacaggatgaggcagtgacttcgatcatctggagcctcacacctgtaatcctagcactttgaaaggctaaggcaggagaattgcttgagcccaggagtttgagaccagcctcggcaacactgtgaggtcccatctctacaaaaaaatgacaaaaacaattagccaagcacaatgtcatgcacttgtgttcccagctactcggaaggtggaggtgggaacactgttttagcttgggaggccgaggctgcagtgagctatgattgtgccactgcactgcactcctgcctgggtacagagcaagaccctgtctcaaaaacaaaaacaaacaaacaaacaaacaactcaatagaaatgaaaaggatgtgctaatgatgagatgcaaacccccaaattgacatgtaccttcccattacaacaattttaggtccaaactatgcatttggtgcaaatggttgatttatccttaacaggaaggatgtcttagtctgcttggactgccatggcaaagtactactgactgtgtggcttaaacaatagaaacttattgtctcactgctctggagattggaattctatgtcaagttgtcagtagggttggtctcttctgaggcctgtctctttggcttgtagacagctattttctccttgtgtcttcacacagtcttccctctgtatgcattggtgccttaatctctttttataaggacaccagtcatattggaataggatgcatccttgtgacctcattgaaactgaatggacctctttaaaggtccagtctccaaatacaattaaattctgaggtcctgggggttagaactccaacatatgaatattgcagggggatataatttagcccaaaacaggaagcctaaagggctcaggacagagctaaatactaaacacattcaggtatttccacaaaatttgaataatttagtttgactatctgtggtcattgtggtcatatgtagacatttgattgaaacttttttttttttaaagcagactttttgacacaagtaagttgattcttcccacaagtgaacttagctgtttttcacattttgttttattgcagagcctggctcttaggccagtatatcatggtatcccttcacacaaacaactatctactgaatatctgccagatttaccatgccatggtggacaaactatgcataaaaaaatagcccaccaccaaggagtatacagcctagttggaataaaacataaatagtacaaatatgtgaaacttcagctaccattagaattgattttttttttagaattgatgtttatttttgtatgaggacatatttctttttttttttttttttttttgagacagagtcttgctctgttgcccaggtggagtgcggtggcgtgatcttggctcactgcaagctccgcctcccgggttcatgccactctcctgcctcagcctcccaagtagctgggactacaggtgcatgctgccatgcctggctaattttttttttttttggtatttttaatagagacggggtttcaccgtgttagccaggacagtctcaatctcctgacctcgtgatccaccgaccttggcttcccaaagtgctgagattacaggcgtgagccaccacacccggccatgaggacatatttcaataggcagagacacaaattaacctagtaccagctgaaaagaggacttatgatctggtgtgaccagaggtggcaagagtgatcagaactaacatgttcttcacttttttctctgtattgtggcttattctttcaaacctcttgttttagttatttattgctgcatgtggtaggctgaatgatacccatccctccccaaagatacccacatcctactccttggaacctgtaaatgttaccatatttggaaaaggggccctgcagatgtgattgaattagagaccttgatgagggcatcatcccagattatctgaggtgggtcctatatgacatcagatcatgtctgagagacgcagtgggagattggaccaattgaagaggaggtggtgatgtgaccacagaggcagggattggagtggtagctccaagctaaggaattccagcagccactggaagctggaagagacaaggacaggattttccccaagaatgttgggagggaatacagtctgtcaataccttgattttagctcagtaaaactgatttcagacttctggcttctaaaactatgagagaataaatttatgttgttttaagcctgtaagtttgtggtaattagttatagcagccacatccaatttatatacggcataaccaccaaaaaacttaaagcagtgtcaaagagttacgttagcaaaatggtagagtttgcagctccaactttgtttccccacagaaacatcaaaaaacaaacagaaaccattagaacaaacatgatcagaactctggaaaataggcaaaagtttaagcaaccaagcaaacactgaataaagaaaaaggccacttgaaaatggtgggaaactttgtagcatttttatttgctcttgtcccagccttctctctagcaagacagttctcttgatgatgacagccttcattcccagtgtaggaccctggtccctgattacagagggactagagaagaccttacttattgtggatgtctgttctaacctgtctgggggctacgttaagtactgacataggcatgtatctctgcttagcctaacttagaacataggctggaaaaatggcaggcattgcttgcaaatgctcaaagtgagctaacaaactgcaaaaacctggggcaaaagattactggttgaggtgtacaatagaccatctaaagtccaggtgcaaaagctggaagagattctgtgggaaattaggacattcaaaagcaccatgtatacaggaaaatgtagaaatccatgcatatacttggggcaagatgcatgctcagaaaagaggagagaagaccctaagctttcatttcaggctgatccttgagttaagtgtaaggttgggtaagtattgtaggagttccccagcacagagccaatctgcaaagactgggaaaggaagtttggaaaagtatctacaaatggactattatagccatcaaaaataaaaaacagcaaaccctggggaagggtgagagtccgatagccagagtttacattataatatttaagtgcccaatgttcaacaaaatatcacaaggcatacaaaggaaacgagaacacatggcccattcaaagaggcaaaataagtggacagaaactatccctgagaaagcccagccatcaaatttattagacaaatactttaaaatgattgtcttaatgatgtccgaagaactaaaagaaaacatggacaaagaactaatggaaaccagaaaaacagtgtatgaacaaaatgagaaataaagtgatagaaattataaaaattgatcaaacagaaattctgaagctggaaactgaaagctgaaatgaagaatttactagagggttagacagaagatttgagcaggcagaagaaagaatcagtggacttgaagatactacaatggaaattattgagtttaaagagcagaacgcaaaagtaacgaagagaagtaaagagaactgaagggacctctaggacatcatgaagcagatatatatatatatatataggagatatatatatatatatatataggagatatatacatatatataggagatatatatataggagatatatatataggagatatatatataggagatatatatatataggagatatatatataggagagatatatataggagatatatatatatataggagatatatatatatctgctttcactgttgttattcaacattgcactgcaagttatagtcagagcaaaatagataaaaggcatcataatggaagggaacaagtaaaattatctctatttgcgattgacattatcctatatgtagaaaatcttaaagaatccacaagaaagctgctagagctaatgaacaaattctataaagttttaggtgtgaaagtcagtcatgtttttatctacctggaatgagcaatcccaaatggaaaataagaaataattctatttataatagcatttaaaataataaaatacttggaaataaatataaccaaagaagtgaaagacttttacattaaaacatgtaaaatagattttaccttgaaacatgtaaatagagtttacactgaaaaatggaaaatagcccagaaatacacccatatatctgtgtccagttgatttttgacaaggggtgccatgtccattcaatgggagaaaatagttctttcaactgatggtgctggggcaactggattttcacatccaaagaataaagttggactcttgtctcacaccttaaacaaagtttaactccaaactgtgcaatgattatggataaaagtttggtggttcttcaaaaagagaaacatagaatcaccatatgattcagcaattctactcacagatatgtatgaaacagagacagagagaaagagacagagagatggagatgggggagagagacagaaagagagaagagagagaaacagagagagaggagagagagagaaagagatagagaaagagacaaggagagacaggcagagaagagagacagaaagagagagatagggattgagagagagagaaagatatagggagagagagagagagagagacagaaggagatggaggagtctctttcacacatatgcacatacacagtatgctggaggaagctctatcatcttttatgaatctatcttaagaaattatgttgttacttccaccacatggattcatttgaaacaagtcatcaaagttgtcccatcttcaaggggagaagaattagaccatttttttgatggaagaatgtcaaagaacttgtgggcatattttaaaatgatcacaccactttattccatgtggcaattgaagacttttgaattaacaacacacgactagagaagaaaaagagacttcccctcttggatccagtatgaaaaccttcaggaaaggattgggttaggtgctgactccttggaccaatgaccataaccaaagggatgaggtactgtaattagccaagcctggctacctgtctgtctctgtgatgaggtgggtacatctgttaggagaagatgggggaactggtgcagtgcagataaaaatagtagctagtatgcttattgcctagtgaaacatgcacacacgaagcaattaggaatgattgagagcagcatatgaatttaaaaatgagggatgttaaaaatgcataaagaagattaaaatgaaaacactccttacagagttcattcatttggtcaatacagtcatttccatcccaaaacctggtcttacatgttagcttgaaggtgcctcttgcaacagattttccagagacttttgtctgatctttactgggaccaaagtaacctttgattgtctctgactgtggctgtttttccgggagctttatgtgctgggctcaggaaaagttcaacccatcaataggttatcacatatatatactctgggactgattggaccacattttctcactgaattgactgattgatgaattcagttggcagaattaactcttctatgtctacatgaagtgccatttagaaataatcaactcttaatcagcctgggatagtcagtactaaaagcaccttcatgagctgtgaaaaatttaatgcatttatttacatatttagttttaaattttagtatattgttagttgaggtatagtttccaaacaaagagccgtgaaatgtttagtaactgtctctgtacctctggatgaggacagctcagccgggaatggagggggactgggtgaggagaccagaatgtcagtgtggccacgcagcacacttttgttttgtcttctgtccttgagcactggcttgttcctggataaactaggcataataatacctatcctgctgtgtgggtggaaggttaaatgtgataatgatgtgtgtgagatgcctgcacagtgcctggaggtattgaagaattatttgctgccttttctttttctacctaccacttacccgctacccccgggtgctacatgttagaaaacactgtgtaaagtgtggatgcttctgaaaaatctccctgccagcagttagtgccaatagcgtgcagaaaataagatgcaatgatttggcttcttttctgtttggcaataagaagcttatttgcacatagcctgatttctttcaatctgcaaaaaaaaaaaaaaaaaaaaaaaattggaaatgaagtaaagcaatatatattaaaacatgcaaattataaagaagcatttaaagcttgactactcttcacattgtcgtatggcaaactattttttttatctgcagtctaaatttcatgacctagaatctctcgttttctgcctgatgctttgttgcatgacattggatgacattgagaaaatgaaattgaaaccctgcttgggctttgaaagaactggcaatcctgcttttaagagtggaaggaaaaaaaatggaaagggaaggaggaaaatgggacatacatggaatactaaagacaagactgaagaaagagaggttgaaagctctctctcttctgattatgtttctgtgggtctctactgttttgtggccttcaccctcatgggcagagaaggctaaggtgtaattctcaggtaaccatttaatctttccatttaaaatggtcatttacaaacatggagtccatttcctttgcataatggcaacgagatggcgcctgtgctccttcgtggaattccttgctctgggtgatggactggacagctaatttgtttttataaagtgtctgggcacttaattaaatcttgcatcctgtctaataaaaaatcaatatcaaatccactaccaacacgttctggatggcagagaggcatgccagaagaaaatcttgagtggcggttccttccagatttagcaagctctgcagtttgtgtttggctgttctctcatcctgttgcttggcccagctcctattcctaagtcaatgagggcttcaaagcatggtgtgaatgcatcagctgctctagaggtcctgtctttgggagatgaattgtggcccattaaaaaaaagttctctagggaaatgtgaataagtttcctgcaagtctcggaaataaaaacctttatggtatataaatatttgaaggttaacaaggtcttcagttggaggaaggcaggcccttggcagaaccaaagggcatctcacgagtgggtagaaagttataggagggattggtcttttctgctttggtgttggtagtggtagctgggggtctctaggctgattgtgtatgatctggagtctggagccttgctacagtttgaactggtcagaaaagccaaggcccgcctccctctgctgactctgtctcactgagccataggcgtggggtcctgcattggccatttcagttttgcttgttgatgaggaaaggtagatcaagtgggtcaaggtggcaagggtcatgtattcagagtagggactgagtggagttggaaaataagcagcagtgaagaagagagatcactccagcaatcttctcactgccaaaagtctccaggtcccatagactgagcaccattcaataattctatgtgttgtatgaacgcatcagacaattccacaacctccttacttcatttgcctgcttgtcatagtgcgagaattgctttcattgtccatttgtttcttgacagtcaaatctcttcattaataaaaaaaagacttgaattcatggcaccattttattttccaatactattgtatagaatgtccaaactaagatctaaagactatctttttcccaccatccctctagaagttcctgatctttgttatatctcagcccagctcctcttgccatatcccctattacaatgaatggcaagtcaagcagaaaaaagcctgtgggtcattgtggactttcagctctcccgggacatgagccactacaccttttcgattttatctcttaagtatctcttccttctgtcctttgatctcgtaagtgttgtctggacacacgcactcgcctcttaatgggtccttggtttctattttcatccccctccaaagcatccttcgatcatccttcaatccctttccaatcatccttcatgttgtaaccagtcttctttctaaaactcatttacaattgcttttctacttcatctctctgcgtgactaatgtcactatcaggacaaatgttaaatatggcctgccataaccagcttcttgccctggcccttgcttagctttctaacttcatttcttgccattccttccccacttcaagcaactttctctctctttttttttttttttttgagttgcagttttgctcttgttgcccaggctggagtgcaatggtgcaatcttggctcaccacaaactccgtctcccgggttcaagcgattatcctgcctcagcctcccgagtagctgggattacaggcatgtgccaccacacctggcaaattttctatttttagtagagacggggtttctccatgttggccaggctggtctcgaactcctgacctcaggtcatctgcccgcctcggcctcccaaagggctgagattacaggcatgagccaccgcacctggctgcaactttctctttagtcccttggtagttcccgaaggcatactgccttgtccactgtttagtacctctgcctgcacttaccacctccttctcctactaggtcatccagacttggtttctggttggtcatggtgtggctcatgccacaatcctagctttttagaaggctgaggtggaaggacttgaggccaggagttgtagaccagcctgggcaaatagcaggaccccatgtctataaaatttagccagacatggttctgtgcatcaatagactcagctacatgggaggctgaggctggaggattgtttaagcccaggaggtcgaggctgcagtgagctatgatcacaccactgcactccagcctgggtgacagagcaagaccctgtctccaaaaaaacaaaaaagacttggtttcagtgccccttcttttgagtgcttggtatattctctatcctcatacatattgtgttttagcatagctattggctgtcctcttggctaaactgttagcctcctagggaaagaaagagaccctattcatttttactctttatccccagaacttagcatagtgcttggtcaaagtagcctctcaagaagtggttgttggatgaacaagtgaattcatcttattatcacttatcatcttattatcattgttacattattaatagctgataattctactaacaatagaattataaagcattagcgcttttcaggtcaaccttgttaaaaacctgactgcaaagttcaattctgccatttgctagctgtataagcttggacaaattattctttctaagctttattttttctatctataaaatgggataatagggttgtttggagaattaaatgagatggtgcatgctaaatatttgggttatgtatcattcagaatgaatgtttgttaaattatactcactggtaaaatatttaggtattttagatctgctagagataggctttttaatctctttgtgtttttttgttcaaatgtatttgcgaactgattattttcttagataatcattttcttagataaccttagcgcacctaatttgatgcctgttgagagtagagagaaaccaaaaagctcacagcagaaggactttttcatatgtcacagtagacaaacaaagttattttccgtcacagccatgtattgggtggaatgacctttagtagctgatgacagcgatgtagcagaagggacagttttccacttgacctttatacaatgtgccagcttgtctcataacacaaaataagttgcaattgacaggcttgatagaacactaacccgacaggagacagacactgaagcagcccctgtttgctaccgagcgtggcaacttccatatacccaagggtgccttagggatgactactccctaagtcatggccagaacatttagtgtaattagttcctctaggagtttattgtgaggtgagatttgctcataatgaattttcattgccaaggacttggttactcgcaggtaccccactatagtcttttgacttttctgtctttgtaagctgtcttcctctcctctttgctctttgcttttaccataggatgttttcttctttactctttttaattttttttctttaagacagggtctcgctttgttgtccagctggggtgcagtggcatgatcatagctcactgctgcctcaaattcctgggcttaggcgatcctcctgcctcagcctctcaagaagctgggattacaggtgcatgccaccacacttggctaattttaaaaattttttataaagacggggtctcactatgttgcacaggctggtcttgaatgcctggcctcaagcgatcctcccacttcggcctctcaaagtgctgggattacaggtgtgagctgctgcactcggcctcttctcagcttttctaatgcttcatttttgccgttccctaacttgactacttttagttttctaccactgggtgatttttttcccttggggctttctgcatgagggctaaaatgtgaagttcttaagtttgttccttctcccagatagtcacagggcagaagtggttctgagcagcaggtaggaaacgtgttgtcgtttcgtttacaggtttgttggaggaagttgctaccagtcatctcactttgcatacctagttctgacattgactgcattaataaccacaggtaatttactttacctctgcaggaagtcactggaagggttacattttcatttggggtgaacagcaactgtggatacggatcatgaaaattgacaatggaaaatgggcatgccattctggaacttttcccagcttttttccagagccaggtctgtcctgatgtgagaaatgatgtcctcatctgccaaatgagtacaataacattagctctacctaccttgctgggctgatgaaagaaacagaggaaataatacatataaaaactgtgctgattgaaaggagctatgtcaacatattaattcaggctgtccctggttggagtattgtggataatgttatctgctttttattcttttccacactacagatgagaaaaaaaaagaaaaaaagtttttaggagagaaaaaattagaagaaaatgtttaaaaatactctctggaaagttagaattctaataaaatccttagtaccacagttgaggatttggcttcatgctccaagtaagtaaatctggctgagattaatatttgatgcatatttatgaaatcagatatatcaaaactgtatcaaaagatataaatcttttatttttcttaaagaccttatacaatgaaatgttcatttatatcatatggacttggggcagcaacaaaaacttggcaacctggggttgctgatatttacagctgttcaacattttttggatccatgtattctcttcagaacaccagaaggctgtgcttttcaaattgtgttctgaggagcctcagagatgccttagggaaggctgaaagggaagcttcatccagagtactttggtttccatctgttattagtccagtaagatttcatctcaaaaagggctctgttgctaaaaaaaagaaaaagaaaaacaaacaatgaaaaaaaatcaagaagtaaacaaaaattcttgaaaagcactgccttggctgggcacggtggctcacgcctggaatcccagcactttgggaggtcgaggcgggcagatcatgaggtcaggagattgagaccatcctggctaacatggtgaaactccatctctactaaaaatacaaaaaattagccgggtgtggtggcgggcacctgtaatcccggctactcgggaggctgaggcaggagaatggcatgaacctgggaggcggagcttgcagtgagccaagatcgcgccactgcactccagcctggcgacatagcaagactccatctcaaaaaaaaaaaaaaaaaaagcactgccttaaggactttcaaaaatggtatctcagatatttggaaactattgttgagagaaaggaagagattcctcccaaatctgggcttctttttcatgtttgatagaagcttgaattttgagtaaaaaacacagtatgctagagatgcttaacctggaatgaccatggtatttgatacaaatgaggttctgtagaatgcggacagctctgcctggactgctctatgaaatagatctttctacttatccacactcgaacaagtgtgtccagcataaacatcacagtgcttcaaatactgttagtcccagtcaaggatgttattctgtgtccattccactcagaggtattcattttcttcttggcagctggaaccaattgctttggatccaccatggaagcctcgacatcctgaaccaaactcctattaatgaaacttcccaaatttaaacaaagcaagacaaatagatatccacacagcgtagatcatgacttctttagacatcatgaaaagaaaaagaggacccacgtggaagaatacgctcatttatgatcagggtagcatcatattcctctcccttttaacattatttcaggatagcagctgtctggatgctggccatgggcttgaaaaaaaccaggtgggcatttctgcccactgtaccgtttctcccatgcgtttcccagtcccctgtcatggcatgaaaaaaccgctattgttctgtgttgggacaattagatttttgtaggggggagaaaccacccaaaagcaaatggaaaaatatgctatgattaatgtcagttacgggaattaaacttcggaggcctttaggacaattatgaaggaatcattttccccttggtggcaatatgtactacagttgtcccttgatatccatgggggattaattccaggacgcctgtggatacagaaatccacgtgtactcaagtcttgttttcagtggatatgaaaagtcggccctccatatctgcaggttttacacttggcgaatgctgtatttttgattcatgttggattaaggatctggaacccctgatacagactgtatttattgaaaaaaaagtctgcctatgagtagactcacatgttaaaacccgtgttgttcaagggtcaaccataactgcaggcagaacatctgggcaggaagctcctgcaggaagacctgtaaactcaggtctgtggaacggcgatgatcttcttcccttgcttccagaattattgctgtgagatcaggtgcactggctacgaccttactctttgtgcagaacttatttctggtctggtttaagtgaacgttattctttctgtgcagtcctgtggttacatcaaaggttaaatttcatatagcatgtctgttatatcagacttctctgatggcctgtccagagcaaacattttaaaatattggtcctattctgtcttataacagtctgctctggtgatttttgtctcatcaattggattatgacactgtcagccactgttagtgttattctcaaattcagtcttccattcatctctccttcccttccctggcagacagacttctgcagccactgggactgttggggtgaggaaaggcaagaaccgatgtttcattctctccctcccttcttcctccctcttttttgttggttgtggggtgggctacatcttcttacccaaacaaccaggagcatttgttggcaagtttattgtgcccagtgccgatgtctggacaattaattccctaggtcagtggctttcacagtttgtgatggtgactccaggaaggaaactcaccatgaccctgtatatacatagaacaaaaatgcagcccactctgatattgtatttgttctattctagttcattaaaagtgaatgttggtcttcatcctttaaatggatattgtcacctgctaatagattggaccagtattttgaacaatggccttggtacttcatttggctttgcatgctcaattgtcatatcctctgtgtggggaagggggcagggctgcttccctgggctgtctcctgggatgcccaggggccctgcctgcctgcgtgggtccttggggacctagaagttccggtttttcatgaaacagcggggctctagaagagccttttcccttatcctgactcttccaccctgatttcttcccgaggacttcttactatgtttaaagatggcagtgaagtggcctgtgggttctagaaccctgcaaacaccgccccaagtgtgataccagtttacccttcttgtagacatccccaaacttcaaggtgattgtcttgaagcccttcacccaggagagggaaccagcgtacaataaccgctgtgctgcaggagaggggaggtaaagagttgtcacagccttgagcctagctcttcccccaaaggcagtctctcttttcttcttccttcctttagtcatctgtgtatagacacagatgcaaacttttcctggaattcctaatcttaagcagtcttcaataggagacctggcttcagagtctgtccttaaacagtgaggtgccctgtgtcttttattcttaactgtggcctatctccactcaaattttggcatttggcgtttggttgtcagtggttattttacattctcaagtgtcactgtcatttggttagggtagttgtcagggtggttctgagagccaagtgtgtagcatagctttgttgttacaaatgaaaaggccagttcccatttaaccaggtactgctggctttctctacaggatttggtctacatccattagtgctctttgttgtccatgtcactataggagagattccccgggacctacagggtcactgtctgtttccaggatcagtgagtcactccctcgtggcctgttatggctttgtgtgaccacagagagggtcacggtggtgtggaagcagggagggggagtcagccctcgctgtgcagcaaccacagtgacgtccccagtgatcaggcttcgtggggatgctcaagtccctcttgatgatcagctctagtgattctcatgttctgcacgcacagaatacatcctggaataatggtggtgaggtaggaaactggcaagacttattttgtgttcacaagcctcctgacccaaacaggatctggtccagacagggtcaagtgaagaaactgacgcaaaccagcagatggcgacaaaagccatccctaactgcccttattgctcattagcataagacatcccaccagccccatgacagcttacaaatgccatggcaactaccggaagttactgcccctttcctaggaagttctaaataacccacccctcaatttgcactagctcaccccttaatttgcctgtaattgaaagtgggaataaacacagttccgagagcccatatgttgctgactctgcattgctgcctatgagttagccctgctctgcgaggagcagtacgcttcattaagatgattgctgtctaacaccaccaggtcgcccttgaattatttcctggttgaagtcaagaaccttcctgggataagccccagtttgggggcttgcctgtcctgcattgttggtattttccgtttgctgagaaaagttcagttagtgctgcctgagctggctgaaggcccttctgggctgggtccatatgcccaagagggtgacactggctggtctcgggggtggtgtctttgagggaatgagattggtcctacgagtgctggagaaactgcacactgaaatggtgtagcctagcattgttagggagtggcagataggagcaagaagctgaaagcagggagcagacaggaaggagcacatcccctttcctcctccagccttgcagtctctttggagctggcagcaaagtcagaaacatggttggtctacagaggtccagcctcagcatcacaaaacagaagataaaaagatatgtttagaggggagagacaatagcttaataacaggcacagccccaaaataacattttgcttttccatgttatgaaccaagtgagagataacatgaaggcatgaagaagatggaaatctaaatatcagcatcgttcctgataacataacattatggaatgtggcttgggtatatggcaacagtgggcttcctaataccaaaccccagaacaagaattgcccatgcagctgtgggcagtgatgagctgcaggcaccttttttttgaggcctggccttgtaaacctgagtttctggaggagcagagcaaatgagtgctgcccaaggtcacctggcctccaccaaggagggagagaggaagcactgagttacacatgctcagtcttaggtcccagtttaccagtggggaaattcagtctatctccctggacaggtgaaagcagcggggcaacagggaaagcccctcctcatggatacctaagggcagggaagacgggctgtattccctccctacataatgtaaaagacaatattctcaaaagcagttgacacaacaggggccagttcttataaattgatagtatcaccccagaatgtgtttgggcaaaggcagttttataagtggccacatgatctggttccatgacatgctgcttaactgctctgtcttaattcaggaagtggttttagaatatcaggaaaagagagacggatggactgcatcatctttctagaaatatcatatccataatcacatccatgatctctctcttagcctatgatggacaaataagggtctgcagtgagattttacccttccctgcaagaatctggggtgtaactattcaggattattcattaagagagggctctcaagctaatagaatcaaccttggattaaggctggcatagtaatgcagtcagtacttggtaattagcaatattctgattcttttcttaaaacaccagctcatccctgcctgctcctgcttgtcttcaggtgtctgcaagatgataaaatggatgaacatagcacatgattatccgtggaatactcagaaactatcatctctcgtgttatagcttgctttttctctatttttcatggacacctgtgcttctcactctaattttacattgcacacctataatggattcttattttctgctactgatatttttgctagtgtataagatagaatttcatatatcaacatgtcccagtattcctcagagggcttaatgacttccaggtggttcagaaccactgatgcctggggccctaaagggagactgctgcatgtcctacatgtgtgaatggaggacagagagcgagtttaggacagggggcagggatggacattttacattttgaagaagtaaacactgggcaagactggccattaattcctcctctatttgaccatcctctgggtgttgggactcactgaatataggctgagtttcagagagacgccccttgagtagaattaaatctgaatcaagaagcaattaaacccatgacagcaatctcttggaatcatttttacttttgtaacaactcttctacttgtgtttttcaaaactcttcacaggcattcttttctcaccattttacaataatctggtggcatgagttggcctagtgttatttttcatatgtgagatgagtaaagtggctcttagaggggttaaatagggcctggtgtggtggtgggtcatgccttgcaatctcagtgctttgggaggctgaggtcggaggatcgcttgagcccaggagttcggggctgcagtgagctatgattgtaccaccgcactccagcctggtgacagagtgagactctgtctaaaaaaaaaaggaggggtaggggggtggtaagaaaaaaccctaaaattatattataagattgtttaggatgaatccaggactaaaatctgggtctcctgactcttaagcagataaatcagttttaaaacttgatttttttttcgtatgctagaggatttcatacaaagatggaggaatcacgctgcatccctttggtgtttacttgatcattttattcctctttagaggtttatctttaggatcacatgttgtgccatctatgatgttaatctttaagatgctagcttaaagcattataaagccaagatttgttttttaaagtgtctaaagagaatgtctcttgttaaagtgagactgtcttctcattttacaaatcctaactgccttttacagcacacagtgcggtagatgttcgggaggcagccgccaacaaggcacaatcgcccactgtcttcaggggcctctggcttagtcctcatgctcctggatagcacctaccaggagttcccatctgggtccaggagttaggctttaatacctagtaagagtcattgagctgccaactattattttgtagctcagaggtcttggagctctatccttggagttatacacttaaccagtgaagagcctaacggccaaagatgtaactgcttgacatatgaaaccacatggtgaacttagtttgttctaccaaggacctgaggtctttcttccatctgcattctgttactattgcatttttgctctggaaaatgttcccatttaacgaaattttacttctaaaatctgcatggcatctgaggagtttgagaaagtacttctaaaatgtgtcctgcagagccttctacagtgtatctttcggcttctccttagtatttatagaggcatatatatatatttttattatgctttaagttttagggtacatgtgcacaacgtgcaggtttgttacatatgtatacgtgtgccatgttggtgtgctgcacccattaactcgtcatttaacattaggtatatctcctcatgctatccctccccctcccccaaccccaaaacaggcctggtgtgtgatgttccccttcctgtgtctatgagttctcattgttcaattcccacctacgagtgagaacatgtggtgtttggttttttgtccttgagatagtttgctgagaatgatggtttctagcttcatccatgtccctacaaaggacacaaactcaaccttttttatggctgcgtagtattccatggtgtatatgtgcctcattttcttaatccagtctatcattgttggacatttgggttggttccaagtctttgctattgtgaatagtgccgcaataaacatacgtgtgcatatgtctttatagcagcatgttttataatcctttgggtatatacccagtaatgggatggctgggtcaaatggtatttctacttctagatccctgaggaatcgtatagaggcatattggagtccagtacatacacaggttcacagtgtgctagaagcattgctctttattagttattcttatcactggctgcagttttgtgatttctctctattaacattgcctttgaattgaaggtcactgttttatttgtattgctgctcttcagccaaaagaaaatagcttcattctgctttgttccaagaaactaatattctagcacgctttatgccttctgattggatttcatccaaattggaatagctcaggctagtggaaatattttatttaatcctctagggtttttttttttttttgactagctgttgtatcttgatacctttacatcactcaaagaatttaagctgttcctgctgccatgtcattagccagagaccaattttgtacaacccccttggctttgggcctaacactggtatgttccatttgtccattccagaaagggatgtacacatcactgtggtttgaattatattttaaaaaataatgatgatggtggttgctcagtggtgctcctctgatactctgaattctattatagatgaatgagctgcaaaatattctataaaaaaacaattatgtcttaaaagattataggctgcagcaattaccactaaaagggtgagagagcctgtagtttttgagcactgacaagcagatacatccagctaattttttgtgaaaacaccagcagagcaaattactcatgaaaaatctgttcacaggaatgaattaaatgccatgtccagtttaacagtgaacactgactgcaaccaaaaaccaatagagataaataatgaatggcatttgaattcattcatttgtatgattccaaaaatagcctcagtgccaatagtgtttctaatgtccaaaacccactgtagacatggagaaggataaagaagccaatgaaaaagaaactaaaaaagtgaccatttggattttattttttctccacattcctgcagccagtcacattgaccttttatttttattttttatttttaaactttagattcaggggatacatgttgtgcaggtttgtgacaaggatgtgttgtgtgatgctgaggtttgggcttctattgatcctgtcaccccaaatgtagttagtgaacatagcacccaataaaatgtttttcaatagtgcagtttctacagttactgttaatatggaattggcccaataacaactggctgaatgtataagttggatgatagcttgccagaaatttcccatggccttgttggtaggctggggtaagatatgataatatgctataaagaattattcttttaatttctctcctagttagactatacctaataaacttcagttttcagtgcacagaattggtcatttatcagctgtgcacctagattgctaagtgagttagtcctagcctaagtaattaacccattttggtgatgactgaatatatgtctaaattcaattaaaatgaagaatatggtgtaaaattatttttatgcaggagagcctgccattacattttaaataagagtttctctttcagagtttacatatttttaaatggctaaaaaaaaaaaatcacagttttttgtgtaggcatgatctatcacatttccctgtataaccccaaatgggaaaatggaagttctaggttccaagcttgggttcctgaatttcactttaatattttaaggattaagaaagaaccttgaaaggatattctgttgtagcccagtttttaggcagtattgattcaggaaaggcaagccccaaactggggcttagcccaggagggttcttggctttgcccaggaaagaattcaagggaaagatggtggtagaagaaaacagctttattgaagtggcagtgttatagttctgtgattgctcctgcagcttaaaggcagttctgcagtaatatttatacctacttttaattacatgcaaattaagaggtagttcatgcaaaaatttctaggaagagggtggtaacttctgcattgttggatcattgccatggaaaggggcagaaactctcaggtgttgccatggcaatggtaaacatggcatgctgggcctgtctttgaaaaggtgcttccattgcctccctgttttaaccagtcctcaattaggcctggtgtctgagccccacctcctacctctgtatcactcttaatactttgttatatttttattaatatatcaaggttatgttaattttgtgcactgaaagagctgtgaattttgcaaaagtttccaaattaactgagaagtgccaccaagagatatagtctattcagtttttccaaaagctgctttcttagcacatattccatttgggcataattttagcaagttgacttataaagcgtctttaagtggaatatttcttcccctgcctcacagccaaggcaatggctctccctggcactgtgcaaaccctgagccagacgctctgctctcaacagttacaacaaagtcaccaggtagatctagtttcactgtctctttcactgtcaaggagactgagtcttagagaggttctgacttgttcaacatcttgcaactagtaaagagtaaaattaaggtttgacttgagacagcttcttcagaactcatgctcttaaatcctgaccctatagtgtgaataccttggacccctgctcagccataaagtcctctcttgccctccactgtcatgaggactctccaaggttgtattgacttgaaggctacatgagaaaggtgggtgggtgcatactttacagttgagtttgatagcatagcaaggcttgacagataatgataactagctatctatgtgcctagggtttctcatacatcgcatcatgaatttttttacaaccttgtgtccagtgtattgatcagaaaggtcacagagacaagaagtgccccagcaggaattcagacccatctctgtttggcttcataatttatgcaaatcgatcccagacagaattctacttagaaatgcctcaagataccagttggaaattatctttcatttctgaaactggaaattaaaaaattatttaaacaatgcataatcattgtaaaaatatgtaggcattgggatatacagtataaataaaagaaaaatatcctttgtagagatcctttgtagacatagccaccattcatatttcgatgtgtgtcctttttgacctttttcattgtgtggctgagtggcattttgtcttttgctatttccgttgggttctctgtattatggctacttggatatgatctaaggaatgtttctctttctccagtaagtgctttcaatgcatatatcttaataaacaggtagaaagttggatagtttgctctttctactaataagtaggagccacgatagtagtattgtgacagtggtgatagtggttggagtgctagcggaggtgatagtagcagtggtcgtggtgctgatgatagtacgtgtgagagatgagttggtggtgtaggtagtgggaacagtggcagtggtggtagtggtgatggtagaagcagtggtagtggtgataggagtggtggtggtgatgataggagtggtggtggttgtagcagtgttgttggtaatggtggtagtgttaggagtggtggtagttgttgtggtaggagtggtagtggtggtaatggtagaagcagtgggtagagttggtgatggtggtagtggtaggagtggtggtgatagtggtggtaggagtgatggtggtgatggtaggagtggtggtgatgtttacttggcaaattcttgctcaggaagagtgtaggagtgttgttggtgatggtaggtaggagtggtggtgatggtagaggtggtggtaatggtaggagtgttggtggtgatggcaagagtggtggtgatggtaggagtggtggtgatggtgggaatggtggtgattgcagtaggagtggtggtagtggtagtgagtggtggtggtgatggtaggagtactggtgactgtagaagtggtggtggttgtaggaatggtggtgatggtggtgattgtagaagtggtggtgatggtaggagtggtagtggctgtggcagtgctggtgatggtgagagtgatggtggtagttgtagtggtgatgatggtaggagtggtagtggctgtggcagtgctggtgatggtgggagtgatggtggtagttgtggtgatgatggtaggagtggtggtggttgtggcagtgctggtgatggtgggagtgatggtggtagtggtagtggtgggagaagtcgtagtggtggtgatggtaggaatggtagtggtggtggtggtgattgtgggagtggtggtggtgccatgagtagtggtggtagtggtggtggtggtgattgtgggagtggtggtggtgccatgagtagtggtggtggtggtacgagttatggtgatgatggtagtgatggtaggggtggtggtgacagttgtgatggttggggggtggtgatggtagaagtggtggtgttggtggtaggagtattggtggtggtgatggctgaagtggtggtgggggtagtaggagtggtgatgatgatgatgacctgactggtggtggtggtggccgtattggtggtgttggtgatggtgggaatgtttgtgagcactttccattgcacttaaaaagaagtggacaaactcatttctcttgcctggacagttgtgagtgaagatgcctccatccctgagtctgaaccataagcttggaccacatatataagtgattcacttttccatagcatctgtgaagacatacttatagaaacaatgtatagttctgaaaatctgagggtttaatgaaaagtagcaaaaattcagttggtcatttacttccctggcacatttgatgattgacatttggtgaaagaacactttattgtgaatctgtttgaagtggtggggcaatgagtattttggaggtgcccataatcaagctctttcttcagaagcttgtgatcctgagaaattttgtgttttctgtgttgtctataaactgcaacttaaggatgtttgcaaggcctattggcatcacgtgctctctctctctctctctcacgcacacacacacacgcatgcgcacacacacacaagcttgctagagcttgccagtcatatgacacactcaagacctggtgtaagtactttttctattttagtcattcacaacttaactggtttacttggcaaattcttgctggggaagaacacttgcttcagaaccacatatcccactgaaatgtgtcagcaaagcaacaaatatgtatcaagaacaaggcaataggctaagtgctgagtgggcagatatcacagttaaattattgcttgtcttccaaaatttttgtatcatctccaaaggtttgtttttcctttcatatcacaacaaaatgatttcccagtcttctttccacacattgggcaagcttaaaatacaacatttctaaaaatcctctttggtgttccctgaaaagatctatgagctatggaaaccaagcttaccctaagctgtttagcattaagaatttgaggaaaccaaatctccacttttatgcagaaatcaaagagtagcataagtaacttgtaggttattttaataatacaataattttgtaaacaataaacagctcaaattttgtagctggctttgtaagtagagaaattgaaataaagtcactcaaaatcacactgactgattgattgtcaaaactcttagttcttcccaggactttttaaaaaacatacttttaataaaaagtacagataatatttacatattttgtatcctgatttatcttgtaatattaaaatatttcctgttttcctaattgttcattgacttactgcataccattctatgagtggatataccataatttacttaaccattcccctagaattggatctgaggctgtttccattttggagagttttttttgtttgtttctgttggctactgaatacttcctatgggaaagaggtggacgtggtggaaaatgaattgatagaatagtttgcatttgtataaagcatgcaaatttgtatttccagatatgtcacagtgaaaggatagaatctttcctgtagaaagaacacagaggttaagaatataggttttggagtcagacagaccttggctttatttctgaatccacataactgtgtgactaattttgaaaattttctcgaactttctataagcttctttctttcatttccaaagtgggagtaaccactctctcgtgggatcattgtgaggataaaatgattgatatgtagcaatgtgcttggcacatagcagtgctcataaaattgttgctattttctatgtttatcttattcctcatccaaactgtaacactcattcatttattttagtttgatttttttgagtcggggtctggctctgttgcccaggctggagtgcagtgatgtgatatcggctcactgcaacctctgcctcctgggctcaagccatcctcctacctcagcctcctgagtagctgagactacaggcgtgtgtcactgcacttggctacttatttgtattttttgtagaaatggggttttgctatgttgcccagtctgatcttgaatttctgagctcaagtgatgctcctgccttggcctctcaaagtgctaggattatagacatgagcctctgtgcccagccccattcatttatttattcagcattcaccagtggctgttgcatgcctgacactgagctttttactggcaagacagagctgaatgaggctgtgtttctgccttgtggatcccccagtatccagggacccagatcaaacagataggcaagacccctgtgtcacggaggaaactacaggggaaggtactgctttgggagtggctcttgggaaaagtaatagcaaaagcccagaggttagcaccgaaaaagatcaagttcagactctgcctttgctattttcttgctgtgaggccttgggtaaattacttaaagtttctgaatttcactttctgcatttgtattcttactctgcaaagtgttgtgaaagaatatacatatagctctgggcatgtagcagatgctcaaaaatgattattatgcttgaagtcttcagtgccccaatcatggctgattttcatgaaaataaactcaacaaactccagtgttctgaaatgtctgagactggctcagctgtgctcaggttagtctgaaatacattttattacagtctaattctctgcaaagtggtcatccacacatcttgtgtatggtaatgtggaattagaatattcagctctcagtgaatttcatttattggccattatgtaaaaaccaaagaaaaatgacttatgaagacattgattgctttgtagctttaaaagacctccttagaattagaatggctacacagcctctaagaatatggtctacactatatattttgtcatcctgcagacacaacaaggaagtgggaatcgaatctatttagcaggatgtctttatgtgtgaagatttcttgctgcttataaatgcttatttgattatttattcatagatatagaaagcacttttctttcattctgtttcctcattgtcacccaagtaagagtcacttattactgatgtgctaaagaataacagatgagcattgaccttcaattaaacattagcaaatatgttgcagtagcataaaaaataacatccacttgcttcagaatagaatgagatgatgcttaacatttctattgctgaggtcctacaagtaaaacatgtttgtttcataaatagaatttatattatcaattggaacatattcttcaatgcattattttgcctactgcttaggaatatcttcctttgttaattttgagttattttatttctactattcagccatgcttataaaatgcaagtcatatttctaatattattgctgttcttttagtcagatgggttcaaccacatttattcagcacctgctatgtgcagtacacttgtcagcatgctggtcttaaaccttgagctataaactgaaatcacattaacaatgtctagagaaagactgcagagatttaaaataaagaaaagtcagagaaaggtgagttatgttttttttgaccactgggccaaacagtgaaaggagaataggagaggaggttttcttaaaggcacaacaggattcacacaaatgaggagacttagaacagaaaggtcacaaatacagcacttgtagtgctggggatatgtattaatattttaaaaaaacaacatattttgaaataattctgcacttaaaagtcacaagtatgctacaaagagctcacatatctccctcgttctcatgcctgagctggctccttcctgagctggatacatacgcccgttatcagaacgtttttctgaccacttgagggcaagctgcagttttatttttatttttattttttgagtcagggcttgctctgttgccccggctagagtgcagtggcatgacatcggctctctgcaacctctgcctcctgggctcaagccatcctcccacctcagcctcctgagtagctgggactacaggcatgtgccactgcacctggctaattttttgtagagatggggttttgccatgttcccaggctggtcttgaactcttgagctcaagcaatcctcccaccttggcttctccaagtgctgggattacaggtgtgaatcatgatgccctgtcactcctaagtaccccattgtgtatgcccccaaacaaggacactctcccatgcacccaacctgcagcttcctccaagtcatgaagtcagcattaatacaacactcttctccagtctacagactccattccatttcaccaagcatcccagtgatgctcctttctcctttctgactcaggaacacacattgcatgcagttgttgtagctcttaagtttcctcctgcttgagcagttcgttagtactcaatcgttctctgtcttccatgtccttgaaagttttcaggagtgtagaccttacattttgttggatgaccttcagcctgggtctttcggatgtttcctcatgaccgggttcaggtcatgcaaccctaatgagaacctcttgaaaatgatactgtgcgttcacatcaggtgtcacacagtgtggacccctcccgccactgtggatggtaaccttcatcaccccatcattctgtggctgcctggtttctccagcactaagttcccatgtttcctttgatatctaaatagtatgttgtgggcatgatagtctatgattattctgatgcctactccccatcaaacctccatttcatcattcatttccattagtcagcattctattagcatggatgtgttggttcctattctattcaatgggctgtactttattactattattttgattctcaaagtgtctcaggtttggaccagaggaacttcttcaaggtgtctcttgtgttctattgacatgtccccatctgcctttgaatacttcttaatttttttgtacaacaggatgctgtagacacatctgtactgcccctgcctcagccctggcctcagccatttctcccaggagctctggttccttgtatggatggatggagtttagaaatcaggatctgtgtgcttggtgtgctcatggctactgaggtgtcattacttataggccttctcagtaggtaaatatagaaaatgtgtgtaaatgcactcatatgcttccttcgctatttccatattcacctgtgagtttgcatattaaaaactagtagtttatgctaatgtttcctattccagtgcaagtcattagaatcttttctacccttccccctttccatgattatatgaacattctccaataatcaggaatctggccctctttatcttcatatccttaactccttcatttgtttacatatttctccatgtaacctatctcccatttatcccagctgtcttccccatctgttgctgtgttcccctcaatgtgcctcatccccaggccctggcaggctcatcaccacgtgtgctgccagatgcctctgtgtggcagcccctgcatccttggtgctggtgagtggaccacctgtgtgctcctgtacaggctcccaacttaccaatggggccgctcactgccaccttttctgcacaggaagagacgagaaggcccatttatgattttgaccccagtcccaggcactgagttcttcaagggccaggaatgtgacttgttgatctttgtagcccaacagtctagcaatgttgatttacccaaagcattattaattgagtgacagatgaaataataaataaacatggcatttgaaaggtgaaaaagtcttgtcaatcattttcaaacactctcctctcccagaggaaccatttccacatcatctgtatcacatggacaaagattgccaatctgggtaaagcttcctccttcccccattgaggtgtgaaatggactgaatgcttgtgctccctaaattcctgtgttgaaaccctaattctaatgcgatggtattaggaggtggagtgtttgggaggtgattaggtcatgagggtggaggcttcatgaatggaattagtgcccttatacgaagaaaccagagaggtagcttgttccctttctgccatgagaaaaagcagctgcctgaaacgtggcagctctcaccagaacctatgctggcagcttgatcttcgacttccagcctccagaactctgggcaatacatttctgttgtttaatctacccagtctatggtactctgtaatagcatcaccaaccgacatagacaaggaggtctctgatgcacctttttgttgttttgtaacaatcatgatttaaaaacatcttgtggaggtattggtcatatttagcacatgaggctctgggacttaagtggggtaagtgatttgtcaaatagaatatgcacagttagtgtcaaagccgttgcccggatctgggtaccctgatccttagtgttgtgattctgtgttctatccaatgtcatgcctcccccacatgactcaggagcagagtgctggcatggagaagagacagggtggctgagcgagctcacttatggtcctgaataccaggggcagaggtttggactttgttctgcagcgcacatggagtcctccaggcctttgagaagattttgtattacaggttgagtacctcttctatgaaatgcttagaaccagaagtgttttaaatttccaatattttggggggttttagagtatttgcacatatataatgagatatcttcaggataggacccaagcctatacatgaaattcatttatgttttttgtacatcttatacacatagtctgaagttaacgctatgcaaaatttcaaaataattttgcacatgaaacaaaattttggctgcattttgactatgacccgtcacatgaggtcagatgtgcagttttctacttatggcatcatgtcagcactcaaaagctttcagactttggggcatttcaaatttcagatttttggattagagatgctcaacctgtaacatgtatgaaagtgcttggagtaatgccaggttctagcagatgtttttgcattttgtttatcagcttgtgcacatctgagtgttaggaaggtcgctctgttggtgatgtgtggaaaccatggaaggagtgagagagatcagacagagagtaattcatccttgcagaagtgctgacaactcgggctaggctggggacagtagaaatggagaagatgtgaatatgtcaaataccacgagagactcacgaggatgtgaaatgtaggaaggggacaaagcaaaggatctgaagctgaaggcctggatgggatagtgcccttgcaaggcagagtaacatcttgctaggtaggtaggcagtgaacttgatttaagacttgatgagatttatgtcttatattcatttagttgctaatgaaaaggatttaaagtggcttatgaaaaacataaaaaaacaagaaacaaaacaagggaatctaaagttcattgtaatcagactcattttttgaacaatttgctgtgagccaggcagcatcccaggtgcaggtcactatacaatgaccaacactgtgtcatggcgcctcttgtgtggatgcatgaggccttgaacatgtggaggtgagggtgtggtggcttgtcaaggagaacctgcctgtgcttagggagctggtggagcagggagcctacctgcagggttggcaggaccggaggagatactgggatctgatggatgaggtagacttagcctgggctggatgtggaggaagaatgactctggcaatgggaacagcagattctcctgaaccctgctcccagctcctctcacagcaactttgcttttctggttccctatgtccgatctgtcagagaacatctcaaatccgaccacttttcaccacctgcgctttcatttccaggtcctggctacccttaggtcttgcctggggaacatcaatgaccctgtgactggtctctgggctctgctcttttacaatgtgttcccaacagagcagccaggtgatcctgttaaacatgagctagatcatgccagtcctctgctcagaacccttcagtggctctcatctcccttggggtaaacaccaaagtctgctacaatggcctatgtggctctgaagatcaagcccactctcataccctctctccctcatctactactttccccttggttcaccctactaggagtgttccttacatattaaagtgtgtatttgcctcatggcttttgcactctctgggagctccctctgcctggaatatccaattagtgaataggggtgtcattcggggaacccagagagccagcttttgtcagaatggaggtaggatgcacccttatgctaaccagaggtggtgctggcagggcaagtggaagctcccagtagctgagagctgtgagagaggctggagtaggagataatttagaaattggagatcatcactgaagctatgcaattgctggtgaccatcctgatgcccttttctaatcataagataaaaaataactggggctgagcatggtggctcacgcctgcaatcctaacactttgggaggccgaggcaggaagatcacttgaggccaggagtttgtgatcagcctggacaacatgacaaaaccccatctctgaaaaaaaaaatttaaaaagcagagcctggtggcacatacctgtagtccaagttacttaggaggctgaggtgggagtattgcttgagcccaggagtttgacatcagcctgggcaacataacagggctccttagctacaaaaataaaaataaaaaaagctaggtgtggtggcacatgccagtagtcccagctacttgggaggctgaggcaggaggatcgcttgagcccaggagttggaggctgccactgcattccagcataggtgacagagcaacactttgtcttaaaaaagaaaaaaaaagagagaaagtagtagcttttgatgcctacccttttgaaggtgagtggcagcatggaacatagctaatcacagatattttctgcgataacttatatctttctttggaattcactgtgagtgtaatttttggcagccagtttaccatttccagtgtttaattttgttggatcagcctgcgctctctgagaacttttcatctggcagtggatgggtatagtttagaatatggtggatagcagagggaggctagactgggtttttaattttttttggaatttgaagacagtgcttaatgatattactaataatagacaatccttttgaacacatacaaaatgccaggcatgatgctaattgctttgcatagattatctcagttaatcctcagaaggccttatgatgtagatactattattaaccccattttttacagagcaggaaactgaagcttagaaaggttaagtaacttgaaggtcagacagctagaagtggcagaggtggggaagactcaggttttctcctaacccctatggaacagatctggatgcatctttacatacattatgactgtatcaggatgctattttagaacacataattcaagaactttattgcgtttcaccaaagttttgattttgtagaacaagaaataaagtattaagaaagaaatcatataaacatttgaacgcttggtgtcagttaaggaatgggtacatttcagcattatcctagaaggtcttatcaggccagactctactgcgtattttaagtggggtgtctgaattagcttctgcagtaacttctgaagaaggtggcacagactgagagatctgctaattacttgggacttgatcttggacagatgaccttttctagtatccttagaatgaattgttggtaaatgcttagtttccggctataggtttcaatgcatatgacaagtttatgtgaatgtctttcacttaacagcctcagagacacaagttttctgccctttcctctacctttttgggacccaggtgtgtgccttgggaatgggccagtgcaggaaaagagttaggttgagaggcacgctgtgactcatgttactctctgctggtgtatgataaaaggttttgttcaaaatgacaagcttgttgaaaaatgtgttttaatttagacttgagtcttatcgaaatggcctccttagaaaatggcttatagagccataagaacataaaggagtctttgtgatctagggtagagactcttaaaacattttctcattatgacgtaaaaaaggataatgtttgtattgcacactggggttaagtagtaagtgctcatggcccgaggtgatggcttgggatgttgagctgccttgggcccacccactgccccagggtgaagaggatcaaggtcttagtgcactagcctgccaaggaccaccagaagggaagctctgatgaatggtatcttaaaacccagtccttccatttctgcagaaatagttttatgtgaaactttctaattctttgggcattggattttgaagataagttctcattagaatggattccaatttctgcagtttatttaaaattttttaacagtttgataccaacactttattagcaaagaaaatggaatcaacttttttttttggtgccagaaagcatagttttttttccataagaaacaaaggtggaatatatgtaatgggtgagagacaaccaaaacttgccacataagggccagtgagagaatcccaacaaatagcaaaagttcatttttccatgacctattcatcacagaacaattaaaaagctacacaaagatcagtcttacctgcattttagaaatacatttcaattcacccatggatccaacatgggtgatctatctatctattcttttagatagacagagaagtttttattaactaacttaggaaaaaacactacctgttaaactcataaacaattgtttaaagagtatctacagaatccttctctcaatgtttccatgtaaaagaaatgaaaatcaatagtccagagatcctcgttaataatgagccactgataaacacaacatatttataacttgtataacattttatttatgtgcattctttgagcattatgcaatatgtaattaaaatttttttaaataaaaaaatttaatatctttattttttgtcaattgatttttccccacttaaaaaatttgcaaataataattgtgcatatttatggggtacatagcgatgcttcagtacatataatatatagtgatcagatcggggtaattagcatatccttcatctcaaacatttattttcttgtttttttttgagacgtagttttcctctgttgcccaggctggagtgcagtggcaagatctcggctcactgcatccttcatctcctgagttcaagtgattctcctgcctcagcctcccgagtagctgggatcacaggcgcctaccaccatgcctggctaatttttgtatttttagtagagacggggtttcactatgttggtcaagctggtcttgaactcctgacctcaagcaatccacctgcttcggcctcccaaagtgctgggattacaggtatgagccaccgcgctcagcctaaacattcattatctttttgtgttgggaacattcaacatccttctgactatttgaaactctaaaatatactattgtgaactatagtcattctctattgctgtagaacactagaacttattcctcctatctagctgtaattctgtaacttttaacaaatctctccctatccttcacttccccctacccttctcagcctctaatatcctctatcctacctcttacttctatgacatcaaccctgatacagtttggatgtttgtccccttcaaatttcatgttgaaatgtgatccccagtgttggagatgggcctggtgggaggtgtttgggtcatggggtggatccctcgagaatggcttgattctcttcccatggtaatgagtgagttttcactctgttagttcacatgagagctggttaaaagagcctggcatttcttgcttgttccctctcttgccacgtgatgtgcctgctctcccttagccttctgccatgattgtaagctccctgaggccctcactggaagcagatgccggcactaagcttcttgtaaagtctgcagaaccaggagctaaataaatctgttttctttataaattacccagcctcaggtattcctttatagcaatgcaaaacggatttaagcaaactcattttagcttccacatatgagtgaaaacatgtttaactttctgttcctggcttatttcacttaacataatgtctttcagttccattcatgttgccaagaatgacaggatttcattcttaatggctgaatagtatttcattgtggatatataccacatttgctttatccattcatctgttgttggacacttagattgattccatatcttgactaatatgaataatgctgcaagaacatgggggtgtagatgtctctttgagatgctgatttcctttcttttggataaatgtgcagtagtgggattgctggatcatatgattgttctatttgtagtttcttgaggaacttccatactgttctccattgtggctgtactggtttacattcccaccaacaatgtataagagttcctttttcttcacatccttacaagcatttgctgtttattttatttttttgtctttttgataatagctatcctaactggggtgagatgatacctcattgtgattttgatttgcatatacctgatgatcagtgatgttgagcattaaaaatacatttttggccatttttatgccttcttttgagaaatgtctgttcggattatttgcccatttttaaattagattgtatttcttttgttgagatgattcagttccttgtatattctggatagtaatcccctgttggatgggtagtttgcaaacattttctcccattctgtaggttgtcttttcactctgttgattgtttatatcttttatttttttgagaaagggtctcactctattccccagactagaatgcagtggcatgatcacagatcactgcagcctcgacttccccagactcaggtgatcctcccacctcagcctcctgagtagctgggactacagccatacaccaccatgcctggctaatttttgtatttttgtgtagagatggtgtttcaccatgtttcccaggctggtcttaaactcctgagctcaagtgatcctcctcgtttagcctcccaaagtgctgggattacaggtgtgagccattgggcctggccttgttgattgttttctttgctgtgcagaagatttttaatttgataaaatctcacttgtttagttttgctattgttgtctgtgcttttaaaatcttattcataaaatgttttcccaggctcatgtcctctgttttcttctcataattttatcatttttggtcttacatttaggtctttgattgacttagactagattttcatataaggtgagagacaggggtctactttcatccttctgcatatggatatacagttttcccaacaccatttattgaagagaccttcttttccccgattagtgtttggaacctttgtcaaaaatccaaaaatcagttgacagtatatatgtggattaatttctggattctcaatactgttccatcggtccgtgtatctaattttatgccagtaccatgttgttttggttactacagctttgtagtatattttgaggtctggtagtgtgatacctccagtgttgttcttttcgcttatgattactttggttatttggggtcttttgtagttccatacaaactttaggatttttttttctgtttctgtgagaaatgtcattggtattttgatagagattgcactgttattttaacaatattaattcttacaatccatcagtatgggctgtcttttcatttgtttgtatcctcttcaatttctttcatcaatggttcatagtttcccttgcagagatctttcactttcttggttaaatttatttctaggtattttaatatttttgtagttattgtaaatgaaatttccttattaatttatttttcagctagtttattgtccatgtatagaaatgccactggtttttgtatattaattttgtatcctgcaacttcactgaattcatttatcagttctaagagtttttttgctagagtctttaggtttttctagatataagagcatgccatctgcaaatagggacaatttaacttctgccattccaatttgaatgtcttttatttctctctcttatctaattgctctggataggacttccagtgctatgttgaataagactggtgacagttgggcatccttgtgctgttccatttattagaggaaaagctttcagcatttccccattcagtaagatgttcactgtgtgtttgtcagatatgccatttattacattgaggtactttccttctatacctaatttgttgagaatttttttattatgaagggatgttgaattttatcaaaagctttttctgcatctattgagatgatcatatgatttttgcccttcattctattgatgagatgtatgatgtttattgatttgcatattttgaaccaactttgcattcctgggataaatcccacttgatcatggtatattatctttttgatgtgttgtttgattctgtttgctgatattctgttgagaatttttgtgtctctcttcatcagagatgttggcttcttttgttgttgtgtccttgtctcattttggtgtcagagtaatgttaaccttgtagaatgagttaggaggaattccttgccttttaattttttggaatagtttaagaagaattggtattaattattctttaaaggttcaacagagggtgtgggataggggtagggagtgcataccttatgcttctaatctggagcaatgcagctgtgcagattcctggcagctctccaaactggactcagggcttgcaagaactgtgagattctccttttgcaaggactgtaggtgtttgctctgtcaataggagttgatgaggtccttctgtttatcttttccatgcaataagaagtccctcctgactctaggcagattcaatctgagcaggggatacagggctgcagaggctgagtgcctgcatgctgcctttcgggactgccattcatcacagttgcatcttcactcccccaccgtactccagcaccctcccttcaacactccagtcaaatcttactgtttattcattgccttggtccttttttttggtgggggtaggggggcaggcagaatgccaggcatctctaatcaaccatctgctgacagcactcttccaaatgatctggagtttatttttatttttaagaaaaaattgtattacacagattctatatttataccttgtgctagtagacttaaggtcattaaaatataatggaacccctactttacaacagaagtggatatatagtcatctatagcatggtagaattcgaacatcatttctatggctttagtaactgtgactggctctatctggatgtgcaatttctgaggaaatgttaaaatcaaaacttgggcactgattttttttaaaaaaggaattatataaaactcaccaaaattatagtttttttccccaaaatgctcattgtgcttttaaaataattaatattaagtatccctctgtgtgaagaccataattatgaccatcatatcactatgtcaacaatgacctttgagagttaaaagaataaaagataggagagccatcttgttggtgcaaagaagattcttagaagtaccaactgagagatgaaagtgctggcctagaaactagtaaccttgtcatgatgtcattaaggcaaaggttcactacaactggagctaagagacaccggggttatctattttgcatttcatggttcttttttcctctctctcatcattttgggtttccagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcagtgagtacttgttattgtcaccattttcccctcatgtttcttcctacctctcagctcccacatagtgaagagctgggaggagcttagctgtagagacccttggctgcctttcctgggaagggccctttgttggttgggaaggtggggattcttccagagtgagagatggcccatgtgggtcatgcatctctagaaagaagacttttctgccacttgacagagagagaaccttctcaagtgcagctgcatcccaggtctgaagcatctcttgggaaactacccttctaagaaggtgggggtaatttcctcttgttgaggcagcttggtgtcctgtgatcatattaagcctgtaagataaacagatggtcccctctgaccgagcgatgaaaatccatcctcctcctaactctgccctccagctcctgagcaacatttgctatttgtgtcacccaaggctcttctgagattagtaatatatagagagcagttgctgcttctaatccagtggcttgtggtcctggctgcatgtttgaataacttagaaagatttaaaacctaccaatgtccaggctcctccccaggcaagctaagtcagaatgtctaggtgtgggaggcaagggtggctcccagatattggcatgcttaaaaaggctgagaaccactgctccatctacctttgtgttccctttctccctaggtaaaggtctgagagggaacaggtgttttatgaatgctatgagcctcatcacaattcaggtctggttctacttagttatcaacatggccacaacaattccactttatttcccacttccaattggtcctgacaatcacaagattttctggcctattcctattaagtgtacatggcattatacatttagtttatcttgatacctccctgaagcctgcctgcacagtgagaccaattactttcagttttgccagtagcatgtagcagagtgaatggcacctggtaggtgcttccttataactatttgcttagtgaactttttcatggttctcctcaatagagagtgaatttcacctcgccattttcattcttttctaatctgacattgagacatcattgcaacattgcgtgttcctctttcacacatgaggccactcccaaattgactttctctgtaattctctcattcttttatctttggggttatttcttgtcgtctactccagtcttgggaaaattttagcatgtaaaaatagggcacaaagattgaggcacaataaatttagctaatttattatgtttctatttatttaacaaacactttcataacagttactaaatgctttagaagttactcatttaatttatttccatttttgaaaattgtggtaaaatacacataacataaaattcaccatcttaagtgatggtgattaagtgattaagccattgttaagtatacagttcagtggtattgaatacatcataatgttgtgcaatcatcaccaccattcatctccagaacttttccctcttccccaactgacactctgtacccattaagcaataaatccccatcccttcccctcttccagtccatgacaaccacattctaatttccatttctctgaatttgactactctgtgtacctcatagaagtgacatcatacaatatttgctcttttgtgactgacatttctcatagtatagtgtcttcaatgttcatccatctgatagcatgtgtcagaatttcctttctttcaaggctgtataatactccattgtatggatagactacagtttgctcattcattcattaaaataactcatttaatgttcatgacaattctagggggtagtattattttatatattgatatctacatgtatagagatctgtatctacatctatacctgaattttaggatgaggaaaccaggcccaatagaagctaagaaacttaggcagatccaccagcaggtgagtgctgagggagacacaaacccaactgtctggcttgcatcttggccctgaatcagtgcactgtgctgccttttaagtctgggctggcaaaggctgctatattattatctctttagccatacctgcaatttggatggagagtgtattagtccattctcacattgctataaagaaataactgagactgagtagtttataaatgaaagaagttaattgtctcatggttctacaggctgtacagggagcatgatggtagcatctgctcagcttctggggaggcctcagtaaacttacaatcatggtggaaggtgaaaggggagcacacacattgcattgccagagtaggaacaagagagagagagaaaagagggaggtgccacacacttttaaacaacgagatctcatgagaactctatcatgagaatagcaccagaggatggtgctaaaccattcatgaagtatccacccccatgatgcagtcatcttccaccaggccctgcctccaacacttgggattacaatttcacttgagatttgggtggggacacagatccaaaccatatcattccacccatgttctccccaaatctcatgtttttctcacattgcaaaatacaatcatcccttcccaatagtcccccaaagacttaactcatttccagcattaactcaaaagtccaaagtctcatctgagacaaggctagtcccttctgcctgtgagagtctgtaaaatataaaaccagtcagttacttccaagatatagacattgggttaatactcctgttccaaaagagagaaactggtcaaaagaaaggggctacaggccccatgcaaattgaaatgcagtagggcagtcattaaatcttaaagctccaaaataatctcattttgactccatgtctcacatccagagcacactggtgcaaggagtgggctcccataaccttgggcagccctgcccttgtggctttgcagggttcagatgctgcagctgctctcacaggctggcattgagtacctgcagcttttccatgctgaggatgcaagctgccagtggatctgctattccagggtctgcaggatggtggcccccttctcacagctccactaggcagtgccccagtggggactctgtgtggggttccaactccacattccccctccatattaccctagtagtggttctccatgaggggtcctgccctgcagcagacttctgcctagacaaccaaacttttccatacatcctctgaaacctaggcagaggctcccaagcctcaactcttgcactctgtgcacctgcaggcttaacaccatgtggaaattgccaaggcttatggcttgcaccctcagaagcagtggtccaagctgtatctggacccctttgagccatgtctggagttggaaaaactgacagcagtgtgaggagcagtgtcctgaggctgtgcagagcactggggccctggggctggcccatgaaaccattccgtcctcctcggcctccaagcctatgaggggaggggctgccatgaaggtctctgaaatgcctctgaggccttttccccattgtcttggctattagcactcagctcctttttacttatgcaaatttttgcagcctgcttgaattcctccctcgaaaatggtcttttcttttctaccacatggccaagctgcaaattttccaaacttttatgctttgtttcctctttaaatataagttcaaactttaggtcatttatttgctcatgcatatgagaataggttgttagaagcagccaggccacatcttgaatgctttgctgcttagaaatgtcttccaccagataccctaaatcattaatctcaagttcaaagatccacagattccctagggcaggggcacaatgcagccaagttctttgctaagcaataacaaaattgacctttactccagttcccaataagtttctcatttccatctgagacctcatgagcctggctttcactgttcatatcactaccagcattttggtcataaccattcaatcagtttctaggcatttccaaacttttcctcatcttcgtgtcttcttctgagccatccacactcttccaacctcagcccattacccgattccaaagccagttccacattttcaggtatctttactttatagcaatgccccacttcttggtaccaattttctgtattagtccattttcacattattataaagaaatacccaagactgggtaatttataaagaaaagaggcttaattggctcactattctgcaggatgtacaggaagcatgatctggcatctgctctggcttctggggaggccttaggaaacttacaatcatggcagaaggtgaagggggagctagcatatcacatggctggagcagcaagagagagagaaatgggaggtattactcacttttaaacatccagaccttgtgagaactctatcacgagaacaccaggggatggtgttaaacattcatgaaagatccatccccatgatttaatcacctcccaccaggacccacctccaacattggggattacaattcaacatgagatttgggtggggacgcagatccaaaccatagcagagagtgatgcttttattctggtcttgcctaagtttttgatagaatatgattaactaaaagccagtgtcatgcattcttaattatattaggttacaccataaggacatctcttacatttgactgtttgaaacctgtcaaacattttatggggtttgacctaataaggcccccagaaaagtataggcctttattaaacatttatcaagccaatattaactgttggcttactttatgagctatcatcctctttccttttccttacaggagttgtctgtatactatgccagtgaatgttccattcactttttgagctcactgtgacctgatttctgtctctatcactcctcaaatatctaccaaagtcagcaatgactttctatttgctaaattaaaagacatttttcaattcttattctgctatgtatcatggcagtgtctagaatttttaataaattcattcttaaaactcccatttcccttggctttcatgatttcacccttcctggtcttcttgctacatttctggccattcttcttaatgtcttatgagctccttctctccctttcttcttaattttttttttttgagacagagtctcactctattggccaggctggtctcaaactcctggggttaagcaattcttccaccttgggctcctgaagtgttgggattacaggcatgagccaccatgcccagcccctttctctttaatattgttgttcttctgtcttctgttctagcttttcctctcttctcactttgtatcttctttctcagtggtctcaaatgctctgagtcttcagatactgtttctatactattttttcccaaatttctatctctagccctgatttatctccagaattccaatccacaattcagttttctattgagcatctcccttatttttacttaatttagtatctttttatccttaacattactatctctttatccttgccttttactaagtttgctatcttttaaactaaatttaccgttgttctccccattcagttccttctcctatatccccagtctgaatgactttcactgccatttacccagttacccaagcaaggactctgaggcatctctggatcctccctttccatccctccccacagtcattggtcaccaagtcctgttgtgtccactgtctgtctctctcatttccactcacttgtctcacctgcacgtcagtgccttagttctggtctttaacactttaaatctggattattgcagtggtctccttgctggtatttctgattccattattaccacctctcattcatcttccacaaggccatgatagaagtattatgttatgctcaatggctccccattgcttgcaggataaaattcatgttgcttagcatgacattaaaagtcttcacgatccagcccctgcccagctgcccagcatttaactagacattaccagcatctgcaatagacacttactgaaatattatatgttacccccatgttctgaatgtttctagattctatgatcttgctcatgccccattgttgttaccaactatttcccattcttccagacttagtgaaacaaatatccttgcaaagctctgctcatcagtcacactgcctctcccttgaatgacagcataccttgaatgacttcacttctgcttaggtcttaaatacatctgttttcttgaatatctgtttactctgacagatgataagctccttgaggacaagactgtattatatttatctttctatttctagagactagaatagtgtctggcccataatctgtattctatattcattgaatgtgtgaatgtgacacatatgcatatgtagctatatataggttcacaaacgtatatgtgaatatcgagagagagagagagagagagagagagagagagagagagagagagagactgacttcactttattgggattcagttgccctagaggaaaatgctccttcagcttttcttctgaaattgccagcaagaaggagttgcacagaatcttgacagaaccttggataggaggtcatttctggtcctttctcttccaccaaccagctgtatatggcttggtgtagttattgaacctctccaaactccactcccttcatcagaaaatgagggggttaaattagatcactggtttctaaactaaagttatttatgtattattaccgtaactagaaaataatgagttgaaattaactttctgaaatttttctaatgcatattaacacaattacctagttgctaaaatttttttaaaacctgcctttcagtgtgccagctacccactgctgttttcacagtgaccaccagggggccatggtggcaggctgaagctcacacagcccagagcctggacagaaaccgctctcacaggctctccgagtcaaggggtatatataatatttttgaatgagtggtgcttttcctgtagaaataaaatagttgtatcaacatgaacaatgttaaatactaattaataactcaaataagtgcctgctaacctttttgggatcaagtatttatttattttgagaagctgatgaaagctatggacttcctctattgcaaaaccacgtgtacacatgtacatatatgaaaactattgagtgtattttcaggagactcacagatctcctgagttattcgttcactccttagagggtctttggttcccaggttaataaaatttagtttaggataagatttaagaagctgtaaacatccagatacaatcagatcctttatgttttattatttttgttgtcactttgttcttaaaaatcacaatttaattcagcttttgagaaacactgtttaatcctctgaactcgtgtagaagagcaccctgggttatgttcagatcctgccagcagccaagagagctttaactatcttcaggggttaactaggttcctctgagggcagatatcggtactcaaatcatttgacccctcttctgtggggtcctctggcccagtggatttgcttgttggaggaataacttttgtgatatcctcttgattcctgtgggaagttcatgtatctttgccacaacaaatggtatatgctcaggccaccctataatagaccctctctgccctgctaggtctctctaattcctttttccctggtttacggggcagcaacacatcagaagtgagttccttagacaatgctgcagcggacagtttgggtgccctgtgtcccaatccctcggcctccctccgattccctccacaactgggaaccgtgctcacagtcggctttccactcaggcacccaacaggtttatcaggcctgtctgcacaggtgttctcggaacctgtgtgaggaggggtgggggtggataatgccccagcctacccagcctcttagggaacagttctgaggcatgctccacactgtttttttttttcttttctaggaggttcctactactaggaaccttttggccaatgggttccatttgtccgtgtggtgaccagctccacagtgaaccttttattgaattttcctctttctcactctagtttcttgggaatcacttcttcaaaatcaacctgtactcaggtccctgtctcaggctctgctgttaagagaacctaaatatagacagatatccacattagagaattagatgtcagtcttccttcttgcagggcacccccaatctttgtgagtgaatctagtggattttttttttcccactgggtttgagtagaagagtttactcccatgtgggccaggtttggataggcaaaccatggggtaggggagaaaaacgcgtctctcatgaagacccatttcctagatggccaacaggtgggtgggtattgagagtggtggttgattgcagaggtgctggttgagcagccccaggggtaggatgccccactccatcattagagattcagaatgcagagcgtttaggtctaagtccttcagctttagtttccaactctggagcaacaggaaatttctacctcaatatcctgtgacaacagggattagaagagaagagagaggcttctgttcctactgtgtcttccatccaatcaaaggaaagttatttttcctttctcctaagagagagagttggcctactatcatcacacatttggaagataattttctcatgaatacattgcatttctctaactatacaccccgtgcatttttccactggatcttcaccaatatgtacgtgaaaactggtcctatttgtaaccgaaattgtgtgtgtgcatgtatgtgtttgtatgcatgcgcacacaaaatgtcctttatcgaagaccttttcccaggggataacctcaaactcaagcaaacaaaatataacaaagtttaaaacaaagatctatcatggttttccagtggggcttatcaaggcagagccccagtttgcctgtccacatatttcccactagcatgcttcctttgagatgggaacagagaagatgaatgttgtgcagcaccatgatgcttttgggcagagtcattcttcctctggccaattgctcctcaattgcctttgaaacatgtgattctttatttccctttggttgtcatgtagggactaacacagcattcagtgtcacagaattcagtgatggtcagctctaagcccttgagattggaatcaagatacactgtatgagaccagaaaataactgttacagacacattttacccaggatataaaatgagatggctatgatacaacatgaaaattatcattactggctggacatggtggctcacacctgtaatcccagctctttgggaggctgaggcaggaggattgcttgagaccaagagtttgagacaagcctgggcaacatagtgagacccccatctctacaaaaaaaaaaaaaaaaaaaaaaaaacaaaactagccaaatgcggtggtgcgtacctgtagtcctatctacttggaaagctaagtcaggaggattgcttgaactcaggaatttggggctgtagcaagctatgattacaccactgcactccagcctggctgacagagcaagatctcattgcaaagaaaaaaatatttgttattaccaacaaaccaggatatatttctgaaccccaaatcagatcaggagatggggaaccacaagagacagtggcatgccctgtgtcccactcccaggagaccaactccagacccttagtcatggcctcaataagagaagggagaaaggacaaggggggaaactaagttgtgagccacagaggacttctcagaacttgttttggaactattggattataaataaaagctcccaaataaaggtcttccatatcatcctctttgttcaaactcaactgaagtctgtcctgaggccagtggcatcaggcataactattatgaacccagataaatattcatgtgcctctcttgccgggtggtcatttctatgagtgggataagactgtataaaacaatgaaagtcagtttcctgaggaatgtgacttctccatgctccttactttttagacccaaatcatatatatatggaagaattataaagttacctgtattgtctctggcaattttacaacattcttttgtgctctcagaatggccttggtaatttagggcatcgtttattgaatgagcaagctatttctaggtgtaaagtgcacttcattggttctatgactggcccaaaccccttctttatcaccatcttcccaaagagggagagatgggacacacaagtcatatgacataaatttgataggatagtcatcagtagggagcagcaattagcaaccttaatcagaagagttatacccaactcttgttgccagaaatagtcatctgaaaggtggcactccctcaggaccgcatttttctaactgtgatgatgagaacatcggccttgttagttttggtcctttctgagactaaaattctgcgattccagcagtggcacaaagcaatttttctggtactctaacaacattaggggtctcagagaaggacctcctgtgttacatgtgaagatgcgtaaaccacagcactgtcactagcagttccggtgcaggattttctcacaggtggatttcctggcttctccttgccctgtcaacattctcacttgcagagccttctgaaggtggcctctcgagcaatgccaagggcactagagggcccagggggcctgagtgctgggctgggaaggaggtggcaatgtaggctcatcacaggcgtgcaccccttaacaagccggcacaggaaccacagacacctagacgatttcttcattcttttttcaatattcctgaaatatgcattcaaacagtcacatggtaaaaattgtcaatggaatgaaaacatttttcctgtgcaatttggagctaattttttctgtgatgtaggatcttattttatgaatggattttatcctcctttaaattattgatggaaaaggccaagatttttcccgtactggggtggtgccgatggagacctgtatgacactgtgggttccgggtgtgatcttggacacctgaatccccattggcactgagtgctgttctaacattctaccctgcatgtttttatttcttgcccctgagggatttgctcattttgcatactgattagtttatagcagcgatgctaatttgcagcgacatcagggattacactttgagaattattaaatataaaggggacaacattgcagaacacagaggaagcctgactcagaggacagaagatttgaaagacggaagcctgtcccttgcttcattactgagctacagtgtgtcctggggccatcactcagccatctgtggatccctttctctacctggagtaagaatatgagagacagacagaagagttttggttaatcacaggggattttcttatggattaagtaatgaatgtgattaatgataatatagagaattcccagttacccacctgtagctactctgtagctaattttcaattctgtgttgatttccttcaatgactctcatcccgacccagatggtatctatttaggaaattcaagaaacttgtactattagcataagcagagcaaattggggaataaattagtgcaaagaaatgatccaatgcaatagaaaagtgaatataaacggcttctggattttctaggacacagactcattgaatcattctataaatatttgccaagcccctactaagtgctgggcactggggccctcaccatgagatgagctcagtcccttccctccaggttcacagtcaggaacgagtaactgcaaacaggctgagactctgcagcccagaggaggaagtgcgtttcgttcccaccgacatcagtacctgatagtagtaggatggttttcttccagacatttcttctgatgcatataaatatcctcagacacattttatctttttttctttctcttttcttttttctttcttctttcctttcttttcttttttcttttctttctttctttccttctttctttttctttctttctttcccttccttccttcttttctttcttttcttttcttttcttttctcttcttttcttttcttttcttttcttttcttttcttttctttattttctttcctttcctttccttttcttttcttttcccttcccttgcctgcctgcctgcctttcctgccttcctgccttccttcctttcctttctttgtggtattgattgccctgttgcctaggctggggtgcagcagcatgatcatagctcactgcagcctctaactcctgggctcaagtgatcctgccacttcagcctcccaagtagctgggactacaagcacgtgccactgtgcctaatttttagttttgttttgttttttttttttttttggtagagataaggtctcactgtcttgcccaggctggactagaactcctgggctcaagtgatcctcctgcctcagcctcccaaagtgctgggatgacaggcttatgctaccatgcctggcccacatctttcatcagaaagtgagtgctttggacatgagtacagtgttcattttcccgatacaaacattgagatcctggggagatcaacagcaagcttcttgaggatggaggcgttctgtctccatccccaaacagccccagtgtgagggtggggtctgtatacaggagatgctcagtggtcatttatcaagtcaatttgttccccatagttcgctccatagggaaaacatttttgttatcatcatcactgtcattcttattttaaaaatgaagaaggtaaggttcagagagattaggtaagtgcggtgacacggtgtgaaaaaggcagaaccaagacccaaagcgtggcctctgcctccacaggctgtgcactctccacgttgcactgccctgctgatagccaccaagaggactcaaacaatgggtgtgtgtggatgtgactggaaggcaggggagatggaagttcctgggcttgctgagaacctaatggtgtgtggtatctgggaaagagcaggaacctgggactcagcctgatccgcattgactcctaaactctccttcctgctgtctgcatggccatgggctagaccctgacccaccgggactcggtttcctcatcagcaaaaccggtataatagcatcttcatcttaggtctgtaatgagaagcgaatgtgatcaaaagataacgtctggtgaacagtacgttcttgattcatagtactttattttattattatcagtttaaacatttttcttgatgctgctatttgcctttaagcatatgaaacaaagaatagatttctaaattatgtcatatgttacaataagtgacctttaagattattcagagaatccgatctttttggtagacttaggaacaaaagcaaggttcctttttctgtaactgctgttttctaacttacaaaaactgaggtgacatattttctagtattgtttctaaatgtatgaagcctgcttcattgcaccatggttggttggttcacttatttcgtaagtgtcaagttaagactcagcaagggggaagagtctcccccagctttaaagtctaccatcattggtccatgccttgcaattgcccatttcttcattgctttgtaatttttctgttgatgcatttgtctctcctgctccatggaagaaccaagaactgtttagcattgtgtccccagagccaagcacaatccatagtacataccaggcaagctcagtaatgttttttctttttctgaatgaatgaatgaaatggggtaggagtaaaaggagacaaacatagcacaacatatattaggatcagttactcattttcttttctaagaaatgcggaggcagtgcgaccctgtgttaatatataaataagaacatgcagcttcacgcttctcctcattgagccctgaaataagtacaaaggtggcagacaagatctagctgtgtgggagatgccacggaaggaggggatagctttaatttggcctttttaggatgctgagtttatgcctccaagtgtcagagccacagatgtctgctcctctgcaggggaagatgaccttgaaggtgatgttattgatgagctttatttaaaacacagacatgttcaagagctacaagactaattggctatgttaaaatatttaaatcaaaagtgcagctacttagtgtgtgttggcaaacattttatgttacagttgtaaaaatgatacatgctcactatggaaactttagaaagatcaatggaaagaaatgattccaccacccagagataagagctgatagcattttggtgaatatttttcttttattttatgtacatgttattaatatttttacaatggttcatttcatactttttgccataaaacctgctttagaaaaaacagcaataaatagtgaacattttccaggccagtgtatcttcttgtgtgacctaattttagtggctgcttagcattgctaagaggtcctgatgctggagcacgattagagtattttcagtcttgggctactaagaaaaaaacctgatttttgtagccgatctttgtgtaaaactatgattatttacatgcaatcaatacttggatgtgggaatgtagaatcccaagttatatttaattttaagtctcattcttattccctactctcaccaaagacttatggtttgggaaaacctttgccaggccagtttgttaggtgaaagatgatgttttatgttgtttggattttcatttaaaactatctttggaggctgggcttggtggctcatggctgtaatcccagtactttgggaggccgaggtgggcggatcatcaggtcaggagatcgagaccatcctggccaacaaggtgaaaccccgtctctactaaaagtacaaaaattagctggctgtggtggcgcgtgcctgtagtcccagctacattggaggctgaggcaggagaatcgcttgaacctgggaggcagaggttgcagtgagccaatatcatgccactgaactccagcctgggcaacagagctagaccttgtccaccctacaaaaaaaaaaaaaaaaaaaaaaaactttggataataatcattttccttaacacttcatttatttctgaggtgggggatcttgctatgttgcccaggttggtctcaaattcctaggctcaagcagttctctgccttggcctcccaggtagctggaactacaggtgtgcatcaccacgctcagctgtattccatctttttggaatttctggttggtgcacttgtcttttccttcataatttgatataactttttataaattagcaatattatccctttttctgccatatgtgtagcaatatatttttccccacttgtcgttcgcctattagttttagttgatggtgttttcttggacatagcttccttgaattgttgacgtagttttgcttagggtaaattgttttcctgcccacctgcattccattagaaatggattgttttaagggtgaatttgtcattctttggtgacaaataccaacaagtctcctttaaagacagctcaccaacataaggcccaaacctgtgccacattttcactagcatcactgtcaccaaatatgtcaactccggcaagaataagagaaggagcctaaaagattttaagtggttttgacagtctttagcaaattttttctgagaagctcgcatccaagcatctgcaaatcagtcacccctccttttaatctccatcaaggtcagctctggaatttggccctgtttggatagtccaaggcagtgctatccaataaaatctagtgtgagccatatacacaattttaaatgatctagtacgcacattaaaaaagattaagggccaggtgcgatgactcacacctgtaatcccagcactttgggaagcggaggagggaggatcacttgaggtcaggaattcgagaccagcctggccaacatggtgaaaccctgtctctgctaaaaatacaaaaattagctgggcatggtggcacacgcctgtagtcccagctattcgggaggctgaggcaggagaattgcttgaacccaggaagctgaggttacagtgagccgagattgcaccattgctttccagcctgggtgtcgcagtaagacattatctaaaaaaaaaaaaaaaaaaacaaaattaagaagaaagttaatcaagtgaaaattctgccaggagctcagttgcattttctagaactcttggcctaattttattaagttcaacactgtgataagtgctgggaataaaaaaaaatgtgatgtgggctctgcaagaagtgtatttctctgtgattaaagctgattgtgggagaaaatcttctgaaaccctcagtgacaaccttctcattgactagtgactcaaacagtagtgcaaagcagaagattctaaatgagcagaggaagggtggatgccgtaaaggcaagggaactggtgaatttcagaaatagtgagtgtgaattcaatactcctaatcatttgaataaagatcttgttatatttccccaaaattaataagaaacaggtgaaattaattttaacaatacatttaattcaatatatccaaaatattatctcaacatataatgaacttaaaaatattacgaatgagttattttgtactctttattttcatactaagtccttaaaatctggtgtgtgttttacacttttagcacattttaatttgggctaaccatgtgtcacatgtggtcaggggctaccttatcagacagtgcaggtcccataatagtattctgactaaggggaaaaagcaaaaatcacaagagattgtaattcaggtagaaacttacattaaggagctcatcctaaaaacaggtaagtaccctcctaagtatgagaacagatgggggccacttgctggagtttcttactcttaaaatacttgtcaacatgaggatttcagcttctgcatacctgtaccaataggtatgtgttgttttaagggccagcggagatgacacccacaccccactgagaatggagccgaggctgttggaacccactgctcaggacagcttgcacgtgtccatcacgagacgagactggcttcttcaggaaaagcagcagctacaggtgagcaggtgaaagatcttcaagaaatatgatggcatttttcttttctttgagacagggtcttgctctgttgcctaggttggagggcagtggtgcaatcatagctcattgcagccttgagctcctgggtgattctcccacctcagcctcccaagtagctggatctacaggtgtgaaccccatgcctggctaaatttttttatttttagtagatatcaggtcttagtatgttgctcaggctgctcttgaactcctgggctcaaagaatcctcctgcctcagtcttccaaagtgctgggattacaggcgtgagccactgtgccaagctggcatttttcttatccatttaagccaaatgcagccaagtgggtctttgctttccttgagtgtagcaattagagccttggctgtcaagccggggagtacaaaaaggagagatggtgggaatgactagaaggcttgtaggaatctcattacaaacgagggttgaaagctcagcagcatttgtgcctgttttcgatattcctcattaccttttgaatatgcttttcttgtctgccaggccaatttgccacttcttatcattttgacctttagaagcttcctttgaaaggcagaaagacatctgtgctgtgaaaatcctttatggaaattcctatcatggtagactgtgagctgcagttgttaagagacagagttgtaagtccggactgagcaaggcaggcacatctggaatgattagccggctgcttggaagcccaaggttggcccagaacagaggatgcaagttggctaagaatcatcgaggggctacaaatctgggtgcagcactgagttaaagccagagctctggaagttgacagggcaccccagaggcagggaatcttgaaacagggtccatgcctgcttgagcctggagctgtgaagcatgagtggggagcgatgaggacacattgattagaagcaacgtgacttcatgggaagagcataggtcttcaacacccaagttcaaatcctggcttaggctggaggcttcccatctctgatctggtcatagagtattcgtgttatctgaatttgccccatccaggtcactgcaagagtaaggtggcaaagggaggaaaaagtcagggcaatttatttgaaattatttcccccattaactgagcacttacacagtcaatgtgcatcattataacgtttggatagctgaaaatgtgaaatctggtttttgatttttaataacatttgccaattaaaggtctacacaattcctgagacagtcagagtgtacagaaaataattttagccctgggcacttagtgtttgaagcactctgggaaaggtacttgaatattcatttattcaacagacatttattaagggttcactaagtgccagatactgtttgaagtgcttgagattcctggggagcttttgatccactaggggtgagaatggggagatagacaataagtgataaacataataaaacctctattagacaactggtatgttatagggtgataagagcttcacagagtagactaagatgatgtggaagaggatggagtctactcattgagaagtgagattggacccaacagttcaaagaggagagggagtaggccttgcagaaatttctgcaagaggatcctgcagggggataccaacatgaaggcttagagtgggagtgggcctcctgtgttcagagggcagctggaggcccatgtggctggagcagtgtaaatgagggggaggatttggggaggaagtcagagataaaggggccttgtaaggatgtggacttttctcagattgcaacagggaaccattggatggtgttaagcagtgaagtgacatgatctgaccacattgtaaataatttgactcctgtattaggaataggatgtaagacaataggaaaacagtatgcagcttccttaaaagattaaaaattgattgactgtgtggtccagccacccccccttctgggtatatatctgtctcaaaaaaattgaatgcacagactcaaagagatgtttacacacccatgttcatagcagcgttatacacaatagccaaaaggtgataacaactcaagtgctcatcaacagataaatgataaacaaaatgagtatgtacatgtaatgagatattagtctcggaaggaaattctgacacacgctacagcatggttgaaccttgaggacattatgctaagtgaaatacactggttgcaaaaggataaatgctgtatgattccacttgtctgagttacctagaggagtcaaattcatagagaaagtagaatggtgattcccagggacttggaggaagagaggataatggggaattagttttcaatgggtacagagtctcagttttgcaagatgaaaagagttctgtggatggatggcagtgatggttgtacaacagtgtgaatgtacttaatgccactgaactctacacttaaaaatgctcaagatggtgaattttatgctatgtgtgttttaccagttaaaaaactaaaagaaaaagaaatgaatagggtagaggaagtcaaaagtggaggtagagaggttagttgagagactttgtcagtaatactgtaatcttggagcaattggggacactgaggcattacttttttcttagaatgtcttggtagtagacattctttagtaactcccaattcttctccccactcccagacttgaagtgggttcaggaggtagaagttgtaggtgatgcacctcggggctgagagaacgtgaataagaggttaggagacacccaggattagagttgcactcttatccccacaaaacatgggagtatgttaattaagagtcttattttttattcagaatcatatgggcagtgagacgatgatctactataacactgtgcacatgacgggcattcattacctgctgcttgtttagttaattgaccttaatattaaatgatattttatggattatttggatttcagtttgctatattcgtagaaattaacatttatttatattttcatgaactttagactgcatggcaccatctgcagcatctcattcttctctcagtcctgtagacttaagaagccattttttacctttctctgtactctgaattcttgtgtttggggacagactaacaaagggtcagttgcatttcttgttttggtctgtggctggggtaacctgcttagctcagacctcaggtgcatgaggctccctgccctgtgtcctaactcatccatccgaaatgaagtaagtcatttatgtatctgctgggttcttccaagtcaaattcttggctcaccccccatagttatttaatgcttgggagggaatgtttttccttatgccaactcattagaaatataaagctggcatgatttttccagttcagcaaacctccaaaaatctgcctgcctcagaaggggagttttgtagttctggtgcatatggccaattctcatttaaacgagtcattatcctcagagcagtttgccatgagcagggttaatttataaaatcttgtctcctcattctctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggaggtactgctgatttcctaactgattttgggtcgctcgcctctttgacctgttcattggaatgattttgtctgctgtctttcatttctaaacatttcccaagcagtctgtatttttcagtggaagcaccattggtgttttgggtgggaaaattcttcacggtgtggggcagtcctgaacattgcaagttatttcacatcctggccacttaacccactaaatgccagcgaccctccccattccaatatgcaccctccccatttccaaacaccctcaggacaccctctctccctttgagaactgttggaattcaattggttagagatcctaatgccaacttttgctgaggacgatcatctggatgaactatgcctctcactaagggaagaggcaagctattgagagagggacacccaatggcaaagttcccatctggaagaatggattgttactggtagctaaaatgtattgggtgcttaccatgtaccaggcagtgttataagctgactctatgagttacttcggttgttgtattcattttacaggtgaggaaaaacgtttaagaaggttataatttgcccaaagtcctaattaataagagagaaaactgatatttacactcctgttcattaattctgaagcccggtcttctccactctactctggagtgagaatcatccctgtattctgtatcatggaatgtctataagatacacatctactttttgccctttatttatttatttatttttaagagacagggtcttgctttgttgcccaggctggagcacagtggcacaatcatggctcactatagcttcaaattcctgggtttaagtgatcctttctgcctcagcatctggagtagctggaatcacaggcttgagcctccacatctggctatttttttttttttttaagttttttgcagaaatggtgtctctctatgttgcccatgctgttcttgaactcctgggctcaagcgatcctccctgcctcagcctctggaggagctgggaccacaggcttgggtcaccacatccggctatttttttgtttttatttttttgtagaggtgaagtatttctatgttgcccaggttgctcttgaattcctgggctcaagcgatcctcctgccttagcgtcctgaagtgctgggattacaggttttagccattgcacccaatctttcttgcccttcaagagctcatactctcatttctgagacatacagaacgcacacttacacatgttggacaaaaaagtgagtggcacccgaatgggtagatgagcagtaaggactgcaagtgctacgtgggtagagccgggagtgggagcaatggtcggcttggccactgtgctgaagaaaagacttcctacaactcaccacctgtagtggttgagaatacggactctgccacctgattgtctggagttgaaggttaactcctcactcaactcattattggccgatttgaggaaaggggtgttgataataatttctaccttatagagctatcacatggatgaaccgaggtagtacatagaaaactctcagcagagcctggatggtactaagcactttattgtgcttccagtcgtcgtctttacaatggaaatttcagtcttctgaaggccttcaaactacccgtccaaatatatcttactgtatttagtgaacgactgttctgtcttccacatgtatcacatcctatccagcctataaaagcaagcggcacatgctattctagggagttacttaagatctcctcccattccccttctatcccgaatatttccaggcagaactctccatggctcatgcccatggagagggggaagagatttggattgttgccggttttcatccaaatgaaacgggtcccttgaatacagcttgttctctcccacctgcactttcagaaccattcttcagctattgccttggtgtggtgggtaggctgttatgttctcattttgcaactgaggaatcaaaaactcagaaagtttccctgatgatgtagctagtaagagaccatcttgtgtacaactatggctgtctttgggcctgaatcaataaaagatggtttccttccagagagccaaggaagctatttctatgactaattctctttcctcatctaaaactaggagctccacagtgtggttggctgatagaactgagcccaggacttggtctggttttctacctgtatcctctggtttgccttttaatcaggatgagtcacagagaaggcatgaatgtgtgacttttactgagtaatctagtgctttgataggtttttatttgtttgtttgtttgtttgtatgttttgagatagagtctctctctgtcacccaggctggagtgcagtggtgcgatctcggctcactgcaacctccgcctcccaggttcaagcgattttcctgcctcagcctcctgagtagctgggactacaggcttgtgccagcacacccagctaattttttgtatttttagtagagacagggtttcaccatgttagccaggatggtcttaatttcctgacctcatgatctgccctccttggcctcccaaagtgctgagattacaggcgtgagccactgcgcccagccaattggataggttcttgaaaggcatttcaaaagttgtggctctctgattttatgatgctgttagggaaattatatatgaggatgatcttgaacatggggcactgctgtctgtggggtcctctgggagaatccaccatccccaatccgaacattcccactgagattacagaggtcaggtcaagaacaggctgccacgtttttgtgctgaggtgactataggaaaacctgggtatctcaaggactttcagaaaccatgaaggcttcatgtaggaggagatcttgggaatgtaaggatgaggctgggaacagtggctcacacctataatcccagcactttgggaggccaaggcgggaagaatgcttgagtccaggaatttgacacctaatctctacaaaaataaaaaaataaaaataaaaaaaattagccaggcatgattgagtgtacttgtagtcctagctactcgggaggctgaggcaggaaggttgctcaagccctggagttcgagattacagtgaactatgattgtgccactgcagtccagccagggcaacagagcaagaccctgactcaaagaaaaaaaaaaggaatgtaaggacgaagagtttcatgggagggtaggaataaaccagagcagttaaaaggtacaaaaaacctggacaatctaatgactagttaataacatgacctttttctcctgcgataaggaagttatacaggtgcctgcagcatggaacactcatggtgagcagaggccatcagcactggctggagttttgtgtggctggagtgtggccaccctgagacatcctcattatctgggtgattctcaagaggtgatccttggcatcagtctaatttactttgaggtgcagggaggtatcgccgcatctggagggcagtgtgggctgtgtaggtgcacactttgattggtcagcttcctttcttccaccgtagggaggtgaggcatcagactgctccctgccgtaaccatcaactagagaaacccgtcatcaatatttgggctttccatttgagaaggaagatatgtcttttccaagctgatgggctgcagcatggatctgcagaagtgaagcatttgaaagaaaccagtgtagaaccagctggctcaacaggtcagagagattgcttggtctagtatttttaactaattggacatgatcctgttaacctaatttttgctatgaagtattggttgtcttttagaaaatgctgacttagggataatatccagtaggtatatttagccaaatgaacccatcttacatacatcaatagctgccttcattgttcatgagaataggctcttcttaggccagatggagagagccagacaaattgtgaaacaggaaaaccttgaagtcttataaagagaagttgcagagactagtattgttacaaaacctagagaaacagatcactcaacatcacgactgttatcatcatctataaggattttcatagaggccagatacaaactcagggtgctgtctgtttgtaatttactcaactttctaacatgcaattgcaatatgctttgtttcgtggacaacgacccaacaacttgaaaagaaacttcctaatagcatgtgacatttctggatgtatcactggtggagacttacgtgcttacatggaggccatcgtttctgactgtggcttgttgggaaccccctggccaatgtcagagatgggctggaagtagagggcatgtgctggggtcaaggacacccagtgattttcggtttgggtgtgataacagaaatcaaagaagccatttgaattttccaatgtctgtgttctggatcaaataacttagcaggaggagatgaagtgttaccatcccagagacatcatagacactttttgagtagagccaacaaaaatggttttcttccagtgaacaaaaggagaaccctttttaagcactggagaatgaggagctccacagtatggaagctgacagagcaggggtgcatgaaaggacaggaaccacttaaaagatatgttcatttgaatttctctcatccctgggatttcaacccccctgctttaaaacaagtgccttgttttctcctgcaagtcttcctttgatgtgagggtcttagaagaaccacttttacccagtgagcttggttcttctcccacacgaaacccatggttcttgttctaccccctgctgactgcattcccattctctgtaatgggattgtgatgtgggggtgggggagggaggagagggaaaagatgggggacacagggaggaggtgacagtgtccaagattttctgtggatcacatccctccatgtgggcatgaggttccatctatttatttggcgtaaattgaggagaatggtgatttgcagctcctctctgtctagcaccattagctcagcctcccctggcttcttgttggttttatgtgtctggaaaaccaggggagggcagcctgtgacctcatgtagcatgcatatggctaacggcaaagtgagggaggaataattatagtaataatcacagtgatgacgtggagggctgcctaggatgctttctaacattctttagaaatgcttgactggcttgtattcatctggggttgagttcttcattcctcagctcctcggatttttcatgcttcatgtgaaatgtgttctggcagctcatggatgaattgtcgcttgttgtgcatttggaagaaacatgtcacatcttttgcaaaccattggcacaaagtgtgaaacaaactcaacccctggttacaggagggctggctgggccttggttggagagtctgggagcctcgcggcagggctgggctggggaggctcgcgggtggagaggagccaggccttctgcagtatccatgcccccagccactagctaaactgcccagggctccctggcggggggcactgattatgcagggtgctgcaggcatcctcatcacacctgtgctcagtccacaacatgcagtccctgctgatgtcagtcctccttgcaagtgagatttgaaataatgtaattcaccagctcacaactgaatgggaaaaaaaaatcaatagttcctcttttccctcagaaacatatcttattagagtgaggagacagtgaaacagcaaggcctgaattggaaaactgatcctgaatctaggatcctggtagagattctcaaagagggttgcgtggaagcagctgtgtgggaggggtcccattaatgctcttgccccgggggtagtgcgaggcagccaccaaactggagtcacgcacagactgcagagaatatccctgcagcatatcagcagtctccaagctgcttttccattcgtgaagattgttgttctttaatctccacttctgggctttgtctttctctctcctctgtctttgccttctacctgactggtttgccaagacaatggctttatgggactgagagcattagacatcatctggagaaagaggagagctttgcatttttctaggaaattctgattttccccctcttttttttggtaaggacttttctctcttttttagagatggggtttccctctgtcccacaggctggagtacagtggtatgatcatggctcattgcagcattttactcctgagctcaagtgatcctcctgcctcagccttccaagtgctaggattataggtgcatgtcaccatgccaggctaattttttaattttttatagagatgggggtcttgctatgttgccaggttagacttgaactcctgtcctcaagtgatctttccacctcagcctcctgggtcactgggattacagggttttcttttccccctactcccctttttaagtaaagtagacatcttgcttttctcaggaattcatgaggcagaaaaatatttgccaagacagcaaatgcagtgagacagaagtgtgtgagcaatgctggccagatgggtgcccggagtgaggcttccctgcataggcgacatctgcagcattcaggacctccctgcaggtgtgccctctccactcaaatttatcctgtctgtccttcttagttagactggtgttgatactcatacactaattttaatatctctgttatttacaaactgtcatacttgcttacaataaccctataaggtttgttgggcaatatattgtttttatgcccattttgcagatgaggctgctgagggtccaagttcacacagccgtaaaagcagtgccctcacgtctttggcgaatttttaatgcagagggaatccagagatggttcacactgatggcctgggagagaccaggccttggacagagtgcttagtccagcaatggaaagaagtccagcccagcagagccgtgggtctgtgggcccaaggaaaagagaatggatgtccctccaggccagggatggttgtctctgtgtgcctagtgttgcctgattggattggagccaaggtgtatctaaaaatagacagcctgggaagaccaaacaggcaactgtctcaagtcagagaggtctgtcagacgttccaaagaaagaaatgtgagaggaagagaaactggaaagcaaggccccgccccagggctagaggaactggtattacttgtctgtgaaaagagggtttgaactgggtggcgtggaaggtcttttctggttctacaatactttgcactttagtattttatgaaataagttaaaataagctgcctaaaaacccctcataattctattcctaggagctctatgttaagttcctccttaaagttccctgggcaggctgtgaccatccacaggccacggtgctccagctggcactttccttagggctggtccctagagcatggacctgagcaaagcctgctttccaagcactgctgctgcagctcagagcttagacctcgcctcaccattgtatatcctcccgttttcttctggaaagtcgtcattacaggcaacgtggaaaagtttaccagactataatctggtaaaggaggaagaggattggaaaagaaggaagagatttgaaaatcccccttatctggctgggtacagatgctgctcaccaggaaatgtaggttcccaataaaacaggacccccatttccagttttcattgcgttgtaaattaaaaataaaatcttaagcccccaaccactgaacggattccctcttggccaaggagaccccagagactccatacaaactgagttcccagccccagtgggccgggaggtcggatttgccttgttataatccctcccttttgtagcttagacataacaacagagcagcatcaatgctaaaacgagatcataagaactgatggaacagactctcggtggcaataagataccaaattataaacaagacctaaggccatgccaggcagggataagtctcacacccctgcacctaaagagtaaactaccttctgactgccacctgggttttctttttctctagcggctaaacgagcactgtcctagagatgagctatcttaaaaccatggcagtccttgcaccgccagatgctgactgactgactctctgttccaccagctgtaactgcagctttcattagaaaagagactgatttcagtaactttcttctgatacaaagaccaactgtggactgcttctggcctatttagagacacttgagtgcctttgtgttctgaaaagaccttttacatagagggcctaattgtaatacatgtaaatgttaagtctccaccctaaggtgaacataagttgtatataacatgtatgcttattcagtatgcatgcattaggaccaccttcatgaatattcatagctcctgctataacctgtggaatatgtatacttggtcaacctattcttgtttttttttttttttttttttttttttttaagatggagtctcgctctgtcgcccaggctgcagtgcggtggtgcatctcagctcactgcaagctccacttcccgggttcacgccattctcctgcctcagccgccggagtagctgggactacaggcaccggccaccacgcccggctaattttttgtatttttagtagagatggggtttcaccgtgttagccaggatggtctcaatctcctgacctcgtgatccacctgcctcggtctcccaaagtgctgggattacaagcgtgagccaccctgccggccttggtcaacctattctgtgtaaattcctgtcttacctgtccctcccttaaagtgcctgctaatggcttctgccggaggctatgcttcccagcctgttagaatggcaaccttgcaggctgtaacccccttttaagaaataaagctctccatattctcactcataggtgggaagtgaacaatgaggtcacatggacacaggaaggggaatatcacactctggggactgttgtgggctggggggaggggcgagggatagcattgggagatatacctaatgctagatgacgagttagtgggtgcagtgcaccagcatggcacatgtataaatatgtaactaacctgcacaatgtgcacatgtaccctaaaacttaaagtataataaaaaaaaaaaaaagaaaaggaaagaatgaaaaaaaaaagaaataaagctctcctttctaaattgataaattgtgtgatttttaagttaacaggctatatttgagaaactcaagggaggaattctgttttacttgcagatgtaaaaaaagactttattaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcattattcacaatagcaaagacttggaaccaacccagatgtccatcaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgttgtggggtggggggaggggggagggatagcatctggagatatacctaatgctagatgacggttagtgggttcagcgcaccagcatggcacatgtatatatatgtaactaacctgcacaatgtgcacatgtaccctaaaacttaaagtataattaaaaaaaaaaaaaaaagaaatgcagcctcaggaaaaaaaaaaaagactttattttgtgctacagtaacatttacgatgatttttgaataacagaacaaaggagggtgaaaaaatggatatgtattttataatgtattttaatattttacaaattctctgggcttgttttctttaagaagcttacaacatgagtctattattcttagtattattattgtttaggtagctctttggaggcttgtgatttgtagactcatccatttctcttttatataatttaggcattagattaattattttcaactggagccccatggattatcaaagatgagagatagtcattttagaatgatcatagctagttctaatattgcagctgcaagtcaactctcacaaacatgaaagcatgtgacctattttaagtctttctcctagtcgatttcaacttttagtttccattattatcaccttgagaaccgttctgtacttaatttctctgtaatttacatgtcttttgcaatcttctgttccctttatcaaattctcttattctttcctttttgtaagttgtatgttactattccctgctttaacttttcagatgttaatttagtatgtcaggctaaactcttcttcagaccttgagctgaaactctgggagaagagcagaagttttggaatcttccagcagaaggtaatttagctctgctcagatagacccttctccagtgactgctgggaatatccccaggttggaaataccagctcattgcttgctgagaatttaatcagttaagagcacacctttttcgagctgtggaagggtgattaatctaccctgtgctgatagctaggctgctaagatgacccaaagcaaagccagacagaacctctagatttcctgtagctgctttcagtggggggtgctgtgtcttatatagagatcgttgttaaacattcatcttgactttcattgtcattactattttgtacttcctctttggcaaatttcctcagcttcctctttgagtcatgttgatattggtgtttggattctttatgcaatttctcctttagtcaactggatttttttcctactgttaattcattttgttcaccagtggtctatttttgcctttcttatccaataaagtatgtccatctttagtttacccacagaaacattttaggaaatgaaatcgacaatattccccagttttaggaatcaggctgatctgttgctttgtcaacagattttgagagatgcttgagagaaatgtgaggttaaaattgtctctgcagacttgagctgtgcatatgcttattcttagccagacgccagttaattaaagatgattcagaaaagaagaataaacccacagcagaaagtacaacgtttttggcaaactttacagttatggaaaatataaatacttagaaatttaggagaagcaagaatatattttaaaaattagtattaaatataaatgcaaatggctgggcacagtggctcatgtctgtaatcccaggactttgggaggccgaggtgggaggatcacttgaggtcaggcgtttcagagcaacctggccaacatggcaaaaccccgtctctaccaaaaaaaaatacaaaaattagccggctgtggtggcacgtctgtgtagttccagctactcgggaggctgaggtgggagagtcacttgaacatgggaggtggaggttgcagtgagtggagatcgtgtcactctactccagcctgggtgacagagcaagactgtctcaaaaaatataaataaataaataaatgcaagcagttctgggtatttatttaaaaactcagttgttcccatgggagcaactggacattacttattaaataatcagaataaagggagggtagtaattgaaatggaaatatgaagttgcctttggatcacgtaacagaataagcctggatgtagtatcattttccccttagatcaaattgttgtatttaatgggttgaactcacttgagtttttgggggtgggggaaagctctagagcccaagtactgaaatcttgtttggacatttaaatacatcgtggttatgagaatagttgaaaatatggagctgacttgattaccagtctccaaaaataagaggctggtaatttatttccttattattgtaaaaaagaatcattaaagaacttgtgaggaaggggtagaaaggagaatgattatgatctgaacataaggctgttcatatttctgattcctgttctcattttttcattattaaaccaccaaaatctcctacagacaaatgtctgtaagtcaaaatgtttttggcacatgaattacagtttcagtttggaataagattgtttgaggcaatgagaaagatctggttgaattaatacttggagtatttggataagccaaataccaagttcatcagttaaaaataaagctgtgatttttgatgaaactggacttcaatgcatgctgtgatgttgtgatgtcaggcagagcttcccagtaagcctggggacctgcaagagatggcacggggtgagggtgtgaacgcgtgtgtgtgctaccttactcatatgtgccaatttggaaagttcagcaaattcactattagggcttactcctttcctctgctcactgccttcgcatcagcacctcgatcacaggaaatcttttccaagaaaagatcagaaatccttacgttcatttttttctctccctttctccctccattatcccttatgatatgagttacatgggtgcatcttattaaaaagggttcatggtcttataaaatgtgacatcggccgggcacagtggctcacgcctgtaatcccaacactttgggaggccaaggtgggcagatcacgaggtcaggagtttgagaccagcctgtcccaacatggtgaaaccctgtctctactaaaaatgcaaaaattatccgggcatggtggtgcgcacctgtaatcccagctactcaggaggctgaggcagtacaatcgcttgaacccgggaggcagaggttgcagtaaaccgagatcgcaccattgcactccagcctgggtgacagagcgagactccgtctcaaaaaaaaaaaaaaaaagtgacacctcattttcagtttgctgagttatttggagaagttgtactttactaaaaggactcagaatatcagagtgtagcatcctagtggaagacacagtatccttgaaattcagagaaatagggagaatgtgagtcatgatgtgatgtatattcagagaaagagtcaaataactaaacgttcaagtatttccctggcctagttttctttggttcttttacttaatgtccttagccttggccagagagaaaaactctaaatatatttattccacccttgttaaaaatttatgtgcctgattttggtcagattactctaaaatattttcttactataatccaggtatggtatatgtctgcatgatttatgaaatggtctttctatactttattcctcccatgatcctcaaaagatgagctagttggtgagcacgaaggtgagtgtctggcttgagtccagcaaactctctggcttcagccaccaccgaactggaaagagataatgtgctttgccaaaggtggcaaggatggcaagcagaggccctggtgctcctacctctcagctcagatctctctccactgcaccacactggctttcccagaagtaaaggtctcagataaccagcttgagtcatttttatagccatgtagaatggcttgcttctgatgaatttatgtaccctgttgtgcctttacaagatcatctgaagtctagaggaattcatggcgtttgtgcctctgtgctccatgaatgtccgatgggtgccatgtgacattatcagctgtgaggatagaagggtctaaggaaagaaaaaggccaagtagataaacatgaatttcctaaagctgtttccacagtcattttgttatccacttgccctctgacagaaggtgaggggactgagcagtcattggcaaggttgttaatgtcaacagatttgtctgtgtgtgtgtgtgtgtgtgtgtgtgtgtgtgttattttatttatttatttatttatttatttatttatttatttagagacaaagtcttgctttgtcacccaggctggagtgcagtggtgcgatcatagctcactgtagcctcagcctcctgcactcaaggaatactcccacctcagcctctcgagtagctgggaccacagacacatgccaccatacttggctaatttttgtattattattattattattttggtagagacgggttttcaccatattgtccaggctggtcttgaactcccgcgctcaagtgatctgcccatcttggcctcccaaagtgcatgggttacagacgtgatccaccatacctggctgtgtgagtgtgttttcattaaaggcccaagtggcgcctgtgctaagatagctgtcattttgctctttccatcatttgtagtttgctttagtaataatctctcattcttaaactgagttttacaaaacaagaaacaggggatgggatagggaatgtagggagagggtagagagaaggctgtgcagagataaaattgaatttctcatctcctgtagctttttgctaaagtggaacttcagcataaagcctcatatacacaggcaggaagatgagcggacaactgtctgcagggagcaggccgtttgcacagttagcttcctagctgaaaaacacatccctcacttagtgtaaaaaatgacatgtatctcctgtatatttgtctctattttatatttctaatatctaatatatctctattatctattatatttctgtctcatctaatatattctgtatatttctgtctctattactctattatagagtgaaaaacaacatgtgtctcctgtatatttctgtctctattatcaatgttatctggcactttataaaacctttgtgttttttagattctctaaatatctaaaaataaaaaaggctagtaaaagatttttgaatgatagagcagttaaagaatatgggatagtagacctggaaggattttagaaataatttagtccaacttcctcattttgcaactgagaagatggagccccagatgaaagtgacttgttcaaagtcttgcagaaagttagtggggtagtggtgtaattctctaagtgtcgttaatattctttttctgcagaggtccagataagaacaggaacagagtttgttcttcaaaggctcatctttggggcaggtgtgttgttgtcaccttggatgtgcctctaatgctgagagccaaggctttgcctccagtgccaggtgctaaggtggttatggctgggttactggtggtacgaggaactggtaataaactaccaaagattgtatggaatgagaggtggtttctttaggatataatattaaaggggtctatccaggcctgcctgacattgtgtcccagagtaaggggtcaaatggaacttcccaccttgtcttcctacccttgcacctgtcccacaccatggtaggttttatatggggacctagcctgtatgcccaggtaatatctacacccttcaaggtagcctgtgctcgactactgcttgggcctagaggtatgcccactgcactgcgtccacccttgggagcagtgctctgagaagaggccctggcaggatgcagcctcctggctcttcaggaaggcacttctcgttttggctgcctgaaccagctttgggtggcatgtacctttggcgccccatttacccttcccctcaaggataaggaggatcaggacagagccctctaatgtggcagagagcaaggaaggcgttcttttgcctggatctaaagcaagtattggaagtattactaagagagggtgtggatttaagtatgttctaaggctcttgagataggcctccctaagggacaggatctggagaaaccaagtaaatagttgttagttgctgttagattggggcatgggattctctaaccaaatagatgcccaatgcagctgtcttagtccattttgttactacagactgagtaatttataaagagaggagatttatttcttacacttctggaggcttggaagtccaaggttgaggggcttgcatctggcaaggaccttcttactgcatcatcccatggcaggaagcagaagggcaagagagagagagagggaaagagagagtgagagtgagagcatgtgtgctagagagagcgctggagagagagagacagagagagaaagagagagacagagaaggggaggggaccaacctcacccttttgtcaggaacccactcccccagtaatgatatcaattcattcatgagggcagattcctggtaacctaatcatttcttaaaggtcccgcctctcgacacggttgccttgggaattaagtttccgacacgtgaattctggaggacacattgacattatagcaatagctataggtttttgagaaagatgagcaagatgctctaagcacaatcactctgaatttttggagccatcttctgatcttggcagcatgttggcagtgagaactcatctggcacttgctagaggcaggctcccagatgagaccactggtgccctttgcccaggcctacacctcacttccagacttctagctcttgccattctaagaggcaggaatgagtgaccctccacattgtcttccttcccatgccagcctgtattagtttgctgccataataaagtagcaccacagccacctggcttaaatacagaaattcatcatgtccagaagtccaagaatcagccgggcgcagtggctcatgcctgtaatcccagcactctggaaggctgaggtgggtggatcacttgaggtcaggagtttgagaccagtctggataatatggtgaaaccccatttctactaaaaataccaaaaaaattagctgggtgtgctggcgcaggcctgtaattgagctacttgggaggctgaggcaggagaatcgcttgaacccagaaggtggaggttgcagtgagctgagatcacaccactgcactccagcctgggtgacagagtgagactccatctcagaaaaaacaaaaaaagtccaagaatcaaggtgtcagcagggttgcttccttctggggactgttagggaaggatctgtatctctccttggcttgtagatgatcattttctccctgtgtctttttatatcatcttccctctatgcatgtccccgaatccacatttccccttttataaggacaccagtcatgtcggagtatggttgatcttaactcaaagtacatttgcaacaaccctatttccaactgcagtcacattctgaggtatggaggtcaggacatcaacatacgaattttgtggagaacacaattcaacacgtaatatagcccatgaaaggaaaccctctaacagagataaaccagagagtaagacttctgagagatgcaatttaaaaagaagagaggacatctcatgagttgactccaagtttttaacctctttctctgtcatgcaaagcttcaccccagccatacagtcaagagcagctgcagcctttaatccctgatcctgagggggcagtggtgggaaatggggataaagatggagccgctccccatcctgtggtttgagtgtgcctctagcagaggtgaggatgcttccaccccaccccaccccaccccacttatttcttagaagacaagaatgtgagtattgttcattaatcaaatactgattaggtacacactgtgtaccaaacacttcaagtacttctccaaaaatccttgcccacatgaaattctttttctagtagtaaaaggcagaaataaataacaaacataataaattagtaagttacatgtaggttagtagaaaatgaacatgacctggggattggggtggaagacgagtggatgtgaaatttacagctgtcaatggagtagtcaggccagcctcactgagagggtcagaggtgagcaaagacttgcaggtgggagggggttggcccattatgtgtgctggggcagaaggtcaaggcagtggaccctgcaccagccacagcagatttgaggagctgtcaggaggcctctgtggccagggtggagtaagcaaagaagggagctgtaggagaggaggtaagagacgagatgagagatgggccatataggcccttgcagacttggctcgactcaggtgtgatggagtgagtagtggcattttatttgacatgcttgtgaaggctcaccctggctacatctcaagaacagactgtagaggagtgagggtgaacgcagaagaactgttcagagacgattgcagcatttcagaggagaggtgcccgtggcttggagcagagtggtagaagtagagacagttctttggtcagatcagttatctttagaatagtttctcactcccaagtcattgaaccaaaattgcctggctgtctcctcctgtataaatgtctcattctggcccttgaccaagtcttggcttgtattatctagattagtgactgttattgacttaaattccatttgcccttctaattacggctgaaaagcaatctgtcccccaagattgaatttttattactcatatttttgacatcagtggttgcattctgtttgtgatattgcaagagtattgaagggagccctttttcatttctaatgaatcatttttaaataataattttaaaatcataatccgtaatcatttttaaaaatgatttttaaaaatccataataatcatttttaaaaatcaaagacattctcacataacattttcttagagccaccattcataatacttagctcctaaactatagacaagaatggtaatgttctacacacgtttattgtagcagcccacagtctcccagttgggcagattgaaaagaaaccgtcagtctgaagaaaacaaaagagtgccgtgttttctgttggacctgctgctgctgctacatggagtagcaactctttttacctggatcgtgaagcaccagtgtgcggtgccctaataatacctataactcatcataccacaagaaatggaaaattccacatgcatgagtctgctagggctgtcgtaataaagtaccatggacagggtggcttagacaacagaaatttattttctcacaattctgaaggctgaatgtctaagatcaaggtgtcagcagggttggtttcttctgaggctcctctccttggcttgcagacagctgtcttctcttttgtcttcagatgatcttccctccacatgtgtctgtctccgcatctcttcttttcttttcttttcttttttttttcaagatacagtctccctctgtcgcccaggctggagtgcagtggcatgatatcggctcactgcaagctctgcctcccgggttcacgccattctcctgcctcagcctcccaagtagctgggactacaggcgcctgccaccacgctcggctaattttttgtatttttagtagagacggggtttcaccgtgttagccaggatggtctccatctcctgaccttgtgatctgcccacctcggcctcccaaagtgctgggattacaggcgtgagccaccgcgcctggccttccacatctctccttataatgataccagtcatattggattggggttcaccctaatgactttattttaaatttattacctattgaaaagccctatctccaaacatcgtcacattcttaggtactggggattcggactccaacctgtgaattttgggggacacaactcaaccggtgacaggcacctttgcatttaattttcttttgccacagccaccccccaggctcatctgctgctgatgtgcgttctgtgcagcacattcatgtcagtagtctcaatttttgtaaggtttcatttgttgagggtgaaatttggtcatatgattggaacaccagtttgtgagtaaagaataatgtgtatttacaaatcatgatattgattatattgtacattgaacaaaattctgaaatagaattccaaaaatttgtctggatgacagttcattttaaataggtacacagcttctgggagcggtagttagtattgttcaacagttaggagagcagatagttagactgcctgggttactgtttaatctcccataattaccagctggttacccctgggaaagttacttaaacctctcttagtctctttgatgaaattttcttgtcttacaatgtagataattagagtttctacttcatagagttataataagaatttaaaatgctcatctacatagagaatttgggagagtgtctggtacatagtaagtgttcaataaatgttggattctattatttccagggcagccactttgaatgaagatactcatttgggtaaattaggtctggtgtgtttctgaaaatgtgttcgctaatttgtttggacaaattgtgtgtttctagggtaaggcataatttcatctgagaggataattcttgtttgttatgaataatatgcaagttttttaaaaagtggggattggtttcactcattaaagtacacggaactcctgcttgtcagcattgaactggtcttattttctggtttttggtttgtagtcctgctcctggaattacggtttggggaccacagtgtgatggcagcagcaacatgtgtgtatgtttgggggactaatgtgacatctttgtaccctaggccagacaccccacttcaataaaagcagattccctgttatctttattatgttttatagtgctgtgtaaactttggtttgagagaattcttctactataaatagcctgaaacccactagcatagtatatagattcctcatatcgtctgctcccccaacaattgcttttattctgtatataccccagggatacaactaatgttaatagtagcctgagcaaaacgtaattgggaaggcaaatctgttgcaaaaaggaatatagcataaattaattataaatcaaattaaatataaaacaatgcatttaattatctgcatcactgcccccttcctctaacatggatatctgagaggagactgattttctttctgggatagggccagatctcagcccagacaagtgaactgtgtcaacccctggaaagatggtgcttgacctccttttttgtgatatgttgggcattagctaaaggcactgctgttttggtcagctaaaatttcagtatcagtaagaggatctactacctatctgaattgttaatgcatgggctagtctttgtgtgtgattgggaacacctacttataatatactattaaatgctcatataggttcaatgatgtgttgaaccatttattaaaaatgtatttgttgaatggactctaacgagcccagcaagggaaagtgcatttctgcccaaggaaggttttcagtttgggcagcaggcattagccacccaaagctggtgctgctgttagaatcagaggaagaaccagtacgggtccatgttggatgccctctgtccttctcaccaccctaagtggtttcatctgccccaatctccatgtctgtgtgacactctgacttatgttctctcaaaagatccaatccctggccagccagagtctagcattctccaggcaggattccaaacattgttttccactgttcccactgagtacacgaatttttgtcagatggcagctcctgaattctgaagagtctggtgtcacatgccccacctctgtcaaacctcacttcttccatttgggctgatctcagctggactggaaaaccctcctctgttgaaagtaggtctaaagtggtaatgactgattagtacggacctgcaccagttcccaggtatttacaattgaaacgagtttgcttatactcagaagtgacaaattggtggatgtgataacatcaaaatatagttcttacagttgaagaacaaacaaacaaaaatcagcaaattggcagcttagctccgatacttggcaacctctggtatgagatttcctgacaccctgcacactttcccttcccctcccaacacataccccagaaaccttgacctttccttttgcaggtcatcatttaatcaagtaatcactcctcttctagcatctattacattttctggcatttctagcagcagtaagtggttgagggcaggaaccatgtcttcatgctctaagttcctagcttgctgggtgcccagtagatagatatttgaagaatgagtgagttcatgaatgcatgaaagagtggaaaactctagaatggatgttctcactgctgtgagcatccacgtaatccagtcctgttcttccctcccctttctgacctctatcactctgcggggcccatggaccccatgacgggcttacactgctgaagaggcctgtctggttttgtcacattcagactttcttcctccaaatcatctctcatagtgcagcccaattatttttctaaaaaacaaaaacacttctttcatattgctctcttgctagaaaacggaatgatttctcattgcttgagggataaaactcaaaactccttagtctggcatttaatactgactagagcttgcccttgatatttctttaaaaatattttaattgtaaatatttcaaacatatttaaaaatacaacactcatttatccactactaggattaaacaaatagtagaatttaccccatatttactttgattttctttccctgactaaataaatttattttattttattttttggagatggagtcagggtttcaccatgttggccacgctgctcgcgaactcctgacttcaggtgatccaccccccaaggcctcccaaagtgctggaattacaggcgtgagccaccacgcccggcccctaactaactaaataagcaaacattatagatacagataggccccaccccatccttctctctcttttcctaccagaaatagtcatttccctgtttatctttcacaactcacctgtgagaaccatttggtccagttagatttatcttcttgctagaatttcattctctttttttttttccctttgaggcccagttcacttttcacctcttctggtaagctttcccaccaatctcctagttctaaattgctgcacaagttattttctccattgctcaaggcagacaatattctgcctggtgacagcttttatgtagcagttttctcctagtattgattttctattccccttatagtaattttttcctcttgctttatattatagcgaattgcatgcctgtgtttcttctctactaggtaacaaccttcagaataagatctgactcttaattgcattgattcattcattctacaggtattgactgagggcttactaacaagctccaggaattctttaagcactggggatgcaggagtggacacaacagacagtcgctgccttcatggaacttaagttccagtgggagagagagaaattacatgaataaataaatatgtcaagatgaaaagtgctatggagaaaagagaagcaggagaaggctaagggggtgctatctcagacatactttaaatatgtgtctctcctttatgctctatgtcaatgccgaatgcagagggctctgggtacatatttgctgaattgcattgtctacccaaatagatactatttgattccctgctggtgagacactactcagtgtagaccttccttctgggaaggttgttataggaatgcagattttaatcctttgctgccaggagcacaccttggctgttcttcccgttatcagtagatgtacactctgggcatgataaaattgtaatactagctttagtaaggcataataagggaggaaaggtctgtttcctagcaccatatttattccgtagtcaaatggagccaatttggcatcatctttcctcctgcacttcttcgtccatcagaccagtggaaggttcactttttgcagtgttcctaactgtagtggtattgaattgtggttaccaagaagaccaatctcctctttttaattcttccagcctccaggaaagaataaaatccctcaacttgtcacttaaagaaatcactactaaggtaagtacctttatattcccattttccaaagaagcctatgaagttttcgtttgacttgattttacatctagatcttaggatacctggcttctgcaaaaaaagatgtagactttgtcaagccattttgcaggcccaatgatgagttaaaagagccaggagagagtgcttctgtcatagtggaggtcttgacttgtggacaccccagaaatggactggtttggcctttgctacaaaaggagctgtcaatttagggactgaaaaaggactgccactatgcatattgaaagcctttgcttaaagatgcattcggggcttggtgcggtggctcacgcctgtaatcccagcactttgggaggccgaggtgggtggatcacctgaggtcagaagtttgagaccagcctgaccaacattgtgaaaccccgtctctcctgaaaatacaaaaattagctgggtgtggtggagggtgcctgtaatcccagctactcaggaggctgaggtaggagaattgctttaacccaggtggttgaggttgcagtgagccgagattgcaccattgcattccagcctgggagacagagcgagactctatctcaaagaaaaaaaaaatgctttcaggatggtagtaatttgagaaattaattacttttcttcccaggagggcaatgtctggtttcctcacaaatagaacagttggtgactgtttttttgttctttaaagcttttcagttggcttgacaatcattttgcctactttatccatcgtttatactgccatagcaagaccttggtttgtgtacagacagaatacgtcttcactattccctgagagcacagtcaattaaatagtcaatgtcctcattagttaggataaccacagtttacaaaacaaaagcccttctcatatgtatttatacctggccaagttattgacagactgagaaacaggatcaattactctgtgaattatgactaaatgttgtggcagagaactgggtatgaatcattcattatttgcagttggtctgggaacgaggggtggttgtaccatggtcgaaatgtaaaaaggacagcttgctgagcagagagcaacgcagctgagagcctgttggcctggaaggactctcttccggtctctgtgcccagagaaagaaagtcttggaccctagatcaggaaacacgccaagggatcaccgcagctaagccagaatcagggatgtgatgttggcaaaaatgtctggagttactctgtgcattttctccatttctgtatctaatttatttctgaaaacaacacccagtgattttgctaaaggtcacagagccgcaggtttgatgggtaattataacttgtgtacaaagagagcttcctgttaggaacaagtggtgcccgtaagacagcatcggagccagggacccagaaatgcttgacttctgctctgctcacccaaaggttctttcacccaggctggagtgtaatggcatgatcatagctcactcagccttgatctcccgggctcaggtaatcctcctgcctcagcctcccaagtagctgggactacagacacatgctaccttgcccagctaaatttgtttgattttcagtagagaccaggtcttgctaggttgcccaggctggtcttgaacttctgagctcaagcgatcctcctgcctcagtgtgtcaaaattgggattgcaggcaagagccaccgcacctggcctctcttacattttctgctgtttatcaggtgcgtcctgatttctatgtagaattaaaagatgggaggactgtcttgggtctgagtttattgactatcttcagaacatactgtatgggtaatatgaatgcatctgtacaccaacgttgaggatacaggtgtgcctattatataatgcagatggtgcttatatgggtgtgtgtatgacactgtatattgtggatacacacatatactgatacgcacccaatattaggatttgctgaaaatttccaactactattaaagatcttagattttcccaaatatcaaaaatgggttgttttgtttgcatacagtcctactccatttgagttgctataacaaagtactgtagacgaggtggcttataaacaacagaaatttaattcccatcactttgaagcctggaagtctgggattagggttccagcatggctaagttctggtgagaggccctcttacaggctgcagacggttgacttcttgttgtattcctgcatggaagaaagagggcaaggcggggtctctggggcttctttataagggtactaatccccttcatgggggccccaccttcatgacctgatcacctcccaaaggccccacctcctaatgccatcaccttgggagttagactttcaacctatgaattctggggggaaaaaaacatctccaaccattgcacataccttctctaatacatttataaaactttataattacttcgcttttccataaaattaaggaactcacatctttgattttaaaatgtaaacataaaagccccatttgataatgagttccttggtgtccaattttatttgtaaataaaaaggatacacaggttttccggggatgtgtatgtgtgtgtgcagaggtggataggtgtgtgtgcacagacacgaatgtgtgtgtgtgttgtgggcaggggcctatattagtccacagagaattaaaacaaaactgtccagtcacacaaaacacctttctctgtactttaaactagattgaccagtgaccatgagctgagaccaaggtctcagcttgacatagctttctttctctagtgtgttagacacaccacacacacacacacacacacatacacacacacccctacctgatattctttagactcctgtctcagaaagaaatgaaaccttccttgcactcattacatttcttaaactcttatgggttacccaaaccaaaagtaattaagggataaatgagatggaagaaacagttggaaataaatgggatatctggagattggtagatattagattacatccagcagagcctgaaagaatgaacattgcaatttaataagaagattcagaaaggttgtttagtattaatattgacagcttgaaagatagatttgctcaacaaaggagaaactgactcaattatgattaacagatactgttcactaaaatcagaaatattggacatagactggatgagacataagaattatggctggtattacagagttaatggaaatgccctcagacctcagatgacattattaaatagataggatgggatgtgccagtcatctggtttgagccaaactaagacttggtgctgggggaagggatatcttccttttaactctgaaaagtctcaagactgttgaaagggtctcggaattaattactttggacatgcggatgcccaacatcaccagtgcatgctttggtttagaggctaccaaactgtcgtcttcatccagagaatgatttttataaaaaagatgttggaaaattacagccactgaatagaacatatggaagtccatgagagaaagagtggagtattttaggcaggatggatgaggtctgctttgactccaaaaataatctcaattcaaactgatataagaaaacatttaaagttgatggtgtcccacaaaccttagattcttctgggaaattaaatttttctaggtagctcattaatctgagtctagataacattggcatatgaaaagtcttgagactgttgaaagggttcaaaaaaggaaaaaaatgtgatgttttagcctccaacaaaataaaagataacctaaagacatttggaaaaagaaattaagatttaagatttttgctatttttgaaaaaccaaagaaaaaaactgtaggatgtgtttggaatgtcatgggaaaatacatgataaaactctcaaacctcactgagagttacttgtctatttttcaaatctgacttgccagcaagtatctatctgccttcaaagtttccctaaacagtgtctattaatactagtaattaaatttagcttgcagctttgaccttcatctcaatggccatatctttattcactgcgtactatgtgccaggcacagagcaaaatccctgctcacatagagctcgtatcccggcagagagacaatgtggaaacaaaggaatagaattacatggtgtatcatctgagaagaagctgtggaagaacatcaagcggagggagggccaagggaggttgctattttgggtgggtaatcagtaaggcctttcctcccaggcagcgactgagcagtctggaagggtatgagtgagccaaaccacctgggactacaaaagtgatgcagacaggaggattcggcagaggcctggagaaggcaggaggcaggagtgatgcaattatgttaccttgtggttgctctctgttagctcctatcagttttgtaattggatgtggggtgatgatgggcatatgcttggaatatgccattgctcactttatttttgttcttcttcctacatttccctccctctttcccttctctttccttcccttcctttcccttcccttccccttccccttccctccttcccttcctcccttcctcccttcttcccttcctccctttctccctctcttctttgtctttctttttccattgcttgctttttgaacattgtcttccaattacttttcatcaccccttttaattacttacaaacccagaaatctctgacctggctgttccactgccttctgatttttagctgaataaatgatgattcctggtcatttctctccccctaggtgtgtatgagtgagaaattctgcagcaccctgaggaagaaagttaacgatattgaaacccaactaccagccttgcttgaagccaaaatgcatgccatatcaggtaactggcagtgtaggagacgttgaagctatccaactaaaataatgacagctaccagcacatcgtgttttgtcctcgatgaacattccactgttattatgtcattctcagacatctgaaagcttttctgggaagtttcactaatatgcacataatatagcacaaggtgtttaagtgagtaccgtatttgggatttctagttcctgtttcttgaagagtttagagactaaatgtactctgtgtgccatatgattctagcagatgtgtatgtagcattgtgtatctgtaaatactgaatgaggattattgggtgtgatcagaccctttctatagagggaaggatggtaacatgagacaaattaatgtcctcagtttgaaaatctagtcatagaaacttggcgaatcctcaaaggattatgctccctcttactctggcagttattaaggaattgatttttccattaattagtagcttgaagtcaagagtctctgaaaacagtatcttatcctatcattagtgctttcaaacactcctctggatttgttattttattttcacaattgctatattaggtagatgggagagagaccgtgatccgaatggactgatggggaggttgaggctgcgggatgtgtcctttggttaaggtcactcaattagctaagcagtggcagatctggggctaaagtccaggccctctctcggtgtattatatatggatttttaacccagttatgtaatgacagcttcaaaaagttctctgagttttataggttgaatggacccagagctcatcagcttcaaaagaatcataaaaatttaacaaaaagttataataattacatgtatgtgttttaaatggtattttaagaaggaatacaataattggcagcttctgctcctcagatcattaaacaactaatgttggcagctaaagagcaatttggtccctggtgcagtcacgcgtattatttacaaccagtagaacatggcagcgcaaatgtggggcttggctcttaacagcttcacatgccatttacttgaaattatgggcccatttgctgagagaaaaaaaaagaagattgaacacagtcttgcttctgagttagggtttttgcctttcttaatcaatatatctttcccaggaataccggtggatgagtctgtgttaagcccaagggaagaaatgtataattcaggcagcagagatagcctcactccaatgtgaacaatctctcttcagactccagggaaaatgcccaagatggtatattgcgtatggcgcaggtttcctgttttagctctttggtcagctgagaaaattggtgaggcctgatctgctgaaggatgacctgaattaaccctcctggtaactgaccttttgacctcactattttctggttgctctgtatgctctttggtggaccggcctttcagtcaatgggctgtccccataggtgatactagtgttaaggtggtcaacatttgtttgcaactcctgcatataatgctatttctgttttctcctgtttcaataccttcagaatgggcaaaccctcactccattaggtaagattcttaaaagccctattgaatggaaaggatcttggtttttttttttttttgagtcagagtctcgttcagtcgcccaggctagagtgcaatggcgcgatctcggctcactgcaagctctgcctcctgggttcataccattttcctgcctcagcctcccaagtagctgggactacaggcacccgccaccacgcccggctaattttttgtatttttagtagagacggggtttcactgtgttagccaggatggtctcaatctcctgaccttgtgatctgccctgaatggagaggatcttaagggaggtccttaagattcttagggggtcttttgtctctcttcaagtttctatgattcgcttagatttatagactgattgatatggtttggctctgtgtccctacccaaatctcatctcaaattgtaatccccacattcaagggagggacctggtgggaggtgtttggatcatgagggcggtttcccccatgctgttttcgtgatagtgagtgagttatcatgagatctgatggtttaacaagtgtttggtagttcttcctgcattcattcttcttgccaccttgtgaagaaggtgccttgctttccccttgccttccgccatgattgtaagtttcttgaggccttcctagccatggggaactgtgagtcaattaaatctattttctttaaaaattacccagtctcaggtggtatctttatagtagtgtgagaaaggactaatacatccatcctgactttgatctatggcctgaggtcctttcttaatttgagaactatttgccatttgcagagagtaggaataacaaattagtttcattttcaaacctggccagatctagctcctttacatgtaacagtttattctttaattcatctctcttctcttgcatttcatcacaggcattgacaggaggtcagtgggcacttctgtattctgcctggaaatctccttggatgtctaactacaattattagggactcttttttatattgcctcagttggtaactgagtgacttttttgccactacaaggatctttttttttctagtttctgatatatttttcttacttttttctatccttcacggaggcccatgaggcttctgcctactaccaagtcccaaaaccaatgcctcgattttaggattttgttacaatagtatcccatatccagataccaaaatctattttcattatctactgctgcctaataaaaaataagtcactttaagacgtagtgacttaaaatattaccagttatttattttgcccatggaaatacaatttgggcagggcttggcagggacagctagggtggctcaactggggtgggagaatccacacccaagacggtgcatacatatggtctggctgttgagtgctctctatgtgggcctctctataggcagcttggcttccttacaacatggctgctgggttccaagagcaagtgtcccaagagaaaggaaatggaaatttcttattcttaaggtctgaattcagacactggtatgcatctctattaatgtgtaataagtggctcctcaaacttcatagcttgaaacaacaaacctttatctctcacagtctctgagagacaggagtccagagtgacttagctgggtggctctgactcagggtctcataaggtcgctgttaagacacactttggagctgcagtcgtctaaaggcttggctggggctgaaagatctgcttccaaactcatgcatgtgttgttaacagacggcttcagttccttgccacaagagctgtgccctaggacctcttgcaacatagcagctgatttcctcagagccagtgatctgagggagagagaccaaataagacagaagccacagatgccaggcgcggtggctcacgcctataatcccagcactttgggaggccgaggtgggtggatcacgaggtcaggagatcaagaccatcctggctaacatggtgaaaccccgtctctactaaaaatacaaaaaattagctaggcgtcatggcgggcgcctgtagtcccatctactcgggaggcggaggcaggagaatggcatgaaccgggaggcggagcttgcggtgagcccatatcgcgccactacactccagcctgggtgacagagcaagactccgtctcaaaaaaaaaaaaaaaaaaaaaaaaaaaagccacagtgtcttgttaggacttagccttcaaagtcacacagcatcacttctgcttagtgactagaagcaagtcactaagttcagttcagcccacaggcaaggggaaggaaacaggttttaccccaaaggaggagtattaaagaatttggtgggcatatttttataaccactgcagtgttacttccattgtgttttattggtccagcattcctggtgtgctgattcaagggaagggccactataacaagtctcaatgagaggtgtgtcaaagagtttcagtgccatgctctaaaaagtgccacagtatttattgagacagaaggattttgagaactgaagacctggacagagagcttttcagtcagaggaaatggcctgttccatttatttactgaaaagaaaaatatcatggagcatctaggaagtgtcagatctggttctaggtactgaggatgcagtagagaacaggacaagatcccccttcctttttttttttttttgaggcaaggtgttgctctgttacccaggctggagtgcagaggtaagatcatagttgactgcagccttgaattcctaggctcaagccatccttagccttagcctctggagtcacgggattataggcatgagctcctggctcaatgtctcttcttttttgatagctgtgttctcccattggccacagtggaatggagctagatatgcctgggctgaatatggaggaaaagctcagctatttcttcaggaggaagagtagtctagattggcccaggtataggattagtattgtggtagctcttcagagttggttaggaccaggatacacagagctctgaattgtaggctaaggataagagcattttagggagccattaccatgttttagcggagtagtgacatgattaaaaccagactttaggaagcgtaatccggccatgttgtacacagagggatggatgtggcaacaccttgggagtcatggaattaactaggatgttagaaatgaaaaaaggaagaaaagtaggctagtataggaaatctactacagataggtaattattgatttttggaagaaccatgatgatattaatatatccagttgagtgtggtgtaatacacattaagaaaagtaatttagagagcccattgtttctctcccttttcactgtacacaccttaagtgtgttttagtcacctctttttttccattctctatttctgtttcaattttcctgttcagcagaggatagtttggtttaaagccgatagcaaaagtggattctgttgttgctgtccttcctagacatatcagtccgttctcacactgctgtaaagaaatacctgaggctgggtaatttataaagaaaggaggtttaattggcttatgattctgcaaattgtacaggaagcatggcagcatctgcttggcttctggagaggcctcaggaaacttacaatcatggcggaaggtgaaggggaaaccagcacttcacacggccagagcaggaggaggggggtgggggaggtgccacgcacttttaagtagccggaccttgtgataactcactatggcaacagcatcaccaagagggatggtgctaaatcattaatgagaaactgcccctatgatccaatcaccttccactggtgctaaatcattaatgagaaactgcccctatgatccaatcaccttccactggtgctaaatcattaatgagaaactgcccctatgatccaatcaccttccaccgggccccacctccagcactgaggattacattgcaacatgagacttggatggggacacagatccaaaccatatcactagtgaaggaaagtacagccctgagctctatgcatactgacgtagaggaagaaactcaccagggcagagagatttctcagtttttgagtgcaggggccatacagttagtagagagaaacttgggctttggaatctgagaagtgtgtgttcaagtgcagctttatcatgacttggctggatgatcttgggcaagttgtttaaccttttcaggtcttgtttcttcatctgtaaaatggagctaataataatattgcccatcacattaggttgttgtaagaattaagtgaggtagtaaattagaataatgtggtacatcagtatattaatacatgagataataaatatatgaacgtgacgtggctttccacagagtgaatacatgcttagctagtgattgttagccatgcatctgagttgggggagacccagccagtgggtgactctctgatcaggtgtcactcagtgctacaggttcccggccagtgtacctgtagtaaaagggcagcggtggcatccatacctcttaatccaaggcagctttggcctcagtgcctgtgcagtctcctgactggccaactaggctgggccacttgtcaatggggtggattcgtttttttgtttggttttcagctccgagttcaaaagcctgggagacctgctggcttctctcccagagctgggccacatattgttaacctgggccctggaggtctgatcagtgtcctggctggatccagtgcagtaagagaagccaaggagaagacagtcttccaaggcctgaagcaggtctgacctaactgcccaatgtaggaggtttgccctgggacaaactgaggtcctgcagggttcgagggtgaaaggcctcttctcccaggaggcagccccagacccaccttgctgaactggctgcctggaaaggaagtgagagcgaagatctcaaaaaagagcagctctttaacctctgtgctgctctcactgaacgctcccgccctctgcccaggacttgatggctttggccctggccctggggcagagcgaagggaaagcgtcagtgccctctagggccgagagtgtggcactacagcaagtgtgtggtgggtgcggctgacttgtgctctgtggctactacccatccccatcagaaacctgggcctgtttccttctctggaatggtgctgggactttccaaaccacggacctgtagtgatgagagttggtgtcttgagtccgcgtccaccgtctgcatgccatgcctgccttcccactgctgggggccctcaaccctcctccagttcccgtgtctaagacttagcaacaagcatccttcctgtgtgttggactgcgggtctgcaccattgtgagacacggtcctatattgggccctacctctatcggtgctcgttgacctgactggtatcacagtcctcatctggaacggggccagccaagctctggccactcccttgtcctgggacgaaggctcagcccctgaggcccggcgagtagtcaaggctggctctctgatgcctggctgctctgatgctggcatcctgcatgcacttccagctccagccttgtcctgctcaaattacccctcattattgatctggtccatctgttgagtcaccctccaatttttttcttccactttgtttaatgcctggcactcaaaagacagccagtagaagtatttgtttttcaaaaaatggaccctcattcattggttgctgatccctagaatctgttgttttcatacctccttcacttgttaagattttcatctcctgccctgacttcagtgggtacgtctggttttaagccccggtcctccttctcataggatccatcctctgtcaggtgattggagctggctgatgttccagcttctggatgctggaagccagcagcagcagctgcctgggtgacagcctcactgtgtgttggcaggcttctcactcaccttttttaatcaattggacctgaaaatcttgaagctaaacaaacacagccctgctattttggcacaagatgaaggccagttttaagtggtctataaaagctgtgaaaaaaacttttaaaagagaattatatccagggcacccaagctgcttccagatgccagaggcagccctgcatttaataatatgcttgctggaatccctttaaaatggtagatgttggccatctttttcttttttctttgcattcccaatggaaggacttccaatgtatggccctggtattattccctgtatgttttagagaagctctaaattcctgtagccgtcaaacttgggtttttcactcagactgcatgttaggatcatctggggaaatttaaaaatactggtacccaggcagcaccaaattccttcggtcagaatctctagggatttttcctgaatataggaaccttcataaacagtttccaggtggttttaatgtcctgtgagggctggaaccaccgtaccagtgagaggagagctggcctgccctgctcactgctggcagatggactcttgagtcacatctttgcacacccagaagctccaggcccaccgtgtaccatggctaagtagctgcaactgcaacctggccttggcctggaagcacatcttgtaggatcactgatgttactctcccctggccttccccttgtcctggaagatgtgcctaaggctgagagacttcattgtttaattcatctagctgtctgttctgagagcccccagctaaactgaggttccagtcccagaacagctagcaaaccgccctaaggggaaatgaaggggagatggacatggtatttactgcgtgcctttcataggatgctgcttttacctggtagatggcccaatgcctagttgtctgacctgtgaccaggggctcctcgcctgggaaacttgtttatatgtctttgtggctcttgcctttcctgtgttcagtttatgcccccctgcccattgctctggcgctgggagccaaaccttgtgctctcttgggcatcccaggtaaaacctggcctggggcatcccctggtcttcagatggaaggtgcaaaggcaatatacaccacagtaggaaacaaattcaaaaagtgtaatttacggatcctgggcagggagggcacagagagtcgggagggcagtcctttgtccctgggccactccagataggaatgaagcatcatgcagagagagagaaacaaggcacatggcaactggcagtgtgtatagggagtagggtctgggccactgtaagttttcaggcaaatgtgtgaatggcctgtttaaaggaagcaatggggaagcagggagcccagtctgctagtcaggggagatgtctctcagtttttatctctcgccactggcttgagccattgggtgtggtttccttctaatgcctgggcagctgtgtcattcccgttacagtcaccacatgattctaattgccttagaatttataggaaccagttggcagcccaacaagtgggctcctctggccagtgagggagcctggtgagggaatcttcccaggacaggcagagacatctgcctggttcttagattggccatctttggtctcacctcagtttggatatattttttttttatctcacctgcccccttgttatctgcttccaagaagcaaacagctcaaataattatttattttaaaataacataagaggatgtctctgatactccaaaagccttttttttttgaaaaaaaaaaaaaaaggatggttctatccaatttggcatttcatttatagagaataaaaactatctatacccaaaatgtattcattgcacacaattgtattttaatggcagctggaaatcttctctcctaactgatgcttttggggaaaataagaacatttggacaataaactagattttctagataaacacaaaatgggtgaatttcacacatccaataatgaaagtagttttttccttaaattagaaacaaggatttaaatttccgtcttcttctgaatgaatatttggcacccaaccaagaaatatatatcattttaaattttcttgaggaaatatccttttcttgcataattaatttaaaggaaattaaattgaccatgtcaattgtcaaacaaggaaaagtaagaattttgcttatttgttattaattttatttacaatagtatttaaaggtaactttgtaaaataacccctaatgatataatctaaaataaaatagattgtatttaaatcacttttttattatataccacgaaaaactactgaatgattaaaacattcttaagtgggttcttaacattgtatggaactggaaagagcagttcagatcacagaggcatgggcactgtgttctaagtggtcactgcactgattcagaacagcaggggctggctctgtactgggtgggtgggtgctcaaggccagacctacacagtgctcctgtgtctgcagctgcagggaagcaggagaaacagtgacgatggtccaggagaggccacctgacatatggcagaaaaacaaaattcagggtacagacagtggctgggagcatcaactcaatcgctttctttctttactattttccctctttctaaaaaagtctgtgatttagatcagtggctgcaggagggagacaagagacccagtaaagatgttttcaaagatgatgcctatctggtgtgaaaagaaatgaagacctacccaaagagaataagcacaagctattatgcagagcttgctacagcaagggagtcagacaccatcatttgcaatttggcagagactcaaaggtgggcagacgagtgggagagctttatagtggaaaaaggcgaaggcttcaggtgtgccctgattggaggttatcaatgcggggaagctggaggcggctcactagaagcgaacatcctgtgtgcttggtcaggggaccatatttggctttctctggtgggtcctaagttggaatcggggacaaaaattagggaagccatcagttattaatccagtcctgaacattttgagtcaattgttacagaagttattatttagcttcctggatagttactagagagcaatttggcttccagcaggtctgatttagagcaggccagcttccggggttgctttttgtgggtaagggtattgttttctgggaaagttgctgcaccttgtggatcagagttccatcttttgctatggcctggctgttgtccgattgtatatttagtcagtcaccaggcaccacattttctcaagctgttggaaagttctgtgtgtccagtgttatcttccccttgtattctatgaaatatatggctgtctgaaatgtttgatgtgcaaagccagccatggggctctgctcacagcaaatgcttttggctatctcaggaagtcatggtgactggaagaaatgcacaaccctgacagaaaatggcaaattctagctgaagggacctccagggagaagggggttggggaggggagcagttggctggggcttcttggccgcctccattgccctttggttcagccagcccaggctcacagcagatatccttgacctcgccaagggaaggctctgaaagacaaaggtagatcttgatcttgcttaactgtgcacttgagcttgcagttccttgaaagatctggtgtcacgcaagacaaattatacagcagtctactatttctggagtttgatcattctcagcactggctttatttctttttttccactaaagaagtatagttcaaatgtggataggtgaaagtagataatcttaggaggatcgttacaaactgaaatgtccatgagttcaggaaagtgccatgtgtgtgaggggtaccccaggtgagaggcctgaggattgggcaggtgaaagggaccatgtgggcacaggattcatccccctcaccatgtgctttctcactttagtgatgatttctacccaggtgttgactaagtcacttattgacatgagatcagaagaaacaagttcaagttcagcaatctcgcatgggatcttagaactctgaaactctgtgaccttcacaaggttacctctgggtctagattttttaactggaaatcaaggacaatcattaagagactccccttcctggattgttgggaagattaaatgatacaatccaagtaatgagagcattgtagtctctaaaattggattctcaaataatgacctcaggtgaaggaagaactgttcaaaatgccccaggtgctatgaagtacagagggcaggtattttttttaagggatggggtcttgctctgttgctcaggctacagtgcagtggtatgatcatgactcactgccacctcaagctcctgggctcaagtgatcttctcacctcagcctcccaagtagctaggactaaaggtgcataccaccatgcctggctaattttttaatttttttgtagagatgggggtcttgctatgttgcccaggctggtctccaactcctcaagcaaccttcccatcttggcttgccaaagtgctgggcttacaggtatgagccaccacacctggctgatatttgaattcagagatgctgaggataagtaatgttggaacagagtgggtaaagtcagcttcagcataaattgtgtttatttaatttaaacacaatttaaattttgtgttttggctatctcaggaagtcatggtgactggaagaaatgcacaaccctgacagaaaatggcaaattctagctgaattttaaattgtgttatttgcggaataaaatatgtggacaagtgctttaaaaaacctatgagaatacccaggtttcattcccttgttgaagagcaggcgggcacaggcatattgggatgccataggtggcatattcttctccacacacatcctccttggcatttagaaagggcctgtgaaagttatgaagattcaggtcacagatctctgatgggactttcttcaggtatcagcattgactttccaaattttcatcactgagctcctgaccaatttcagcagtcagagaggtctgcatcaagcaaggtcttggtctaagcctcatgggattagatctgaggtcaaaatgcctataaagtattgatcaagggcattgtagcattttctcatggcttgggtcttgatatgaatggtctctttgggaattcacactcactctgctcttttaaaatgttcacttttatcactgtgcattttcccaagccttatccctcaggatcaaagaaagggcctaggctttaattaatgatctctcctatgttttaccaagggcactggtctctcgagcttgcagtgggttgcaagggattagagggtgtatttgcagcaaaacttctgtaccggcactcgctctgtatatatagtctcttccaatctgcttttagagatcttttctttctgactgtttgcaggaggacatggcacgctgtggcatattctgcctgatgtctctggaggcatagttggtgcccatcccactttttattaactctcttggttgaaaacacagcccagaagacatgttgggacttcataagcacagcctaaggaggaacattggaaggtacaacattgtacatgtggccaccctgccccaacgcagtcacacctctgtgctggtcctcctgcgagctccccagagcatggggtcccttgaggttctttgtggcatgcggtagggggctcgatcctcagcttccttgacttggccattgttcaggatggaaattaccgatccgggaaaagttttatttgaggttactgtttacagcttgaagctcatggaagtgcagtctgctctcctgtggactttgtgggtttttcctaaatgggtccaacccatcagcttggcatttggggcactattgttttgaagcaacttccttgtgagtttagtctcacctcctaccccttgcccattgctctctaacctgggttcctgtttcttcttttgggactcttatattcttccctcctgaaatctgcctcagtctctccttctggaataatctctcttctcctctgacctctcctagtatttgttttttctttggaaggcaccttatcccctttattttatggtaacttcctggagagcaggagcagtacttgttctcttttgtgcttgtcatgttgcttaaaacacatgagtgttttaagcagtgagagacaaacacatgagtctcaatagggtctttatccaatcatggcattggaaactatggacttcagtgacagatgttatgtgctaggtttcagaatgcctttaaggtgggaaaacattttgtatcattttcaacatttgtatcagtttgaaatctgcctgctaagtaacaataaaaaagttagcaacataatttatgtttaaaaggaagtgttctggggtgatgttcgagttggaaacttgccctatgctttactgcattgtgatcttcagcaagatattttagttctccagatttccgctttcccagctgtaaaaggagacaacaatatgaatttcagtgaacataaaaagcacccattattttatacattgcaaagaaagaaaaattgctgtcaattaagcagtaacagtgctttctatggtttagaatttttatcttatacttaactgatatagctcttttagatgtatttaggcttttgaaaaatcacatatcactcattaaaaaggaaaataaattggttaaggttttccttggcatcttcttcttcattctgagtcttccgaaacacatttggactcaatgttgtcgaggtttgtgtttccccacacgtcatcatcctgtgaaccattgaagttgatgggaggcaactttttctcccccaagaataaagagttttctgtaggattgtctgccaaactgctaacacctttcttcaagttttgaatgctggtgctttcccagtcttacaaatccacatcaacacaagattttcaggcaacagccagtacgcagatggtcctaaaatagtttgtacattgaaacaccagggggttgcagatggtcagccaggccagggaaaataatccagttataaccactgcatcctgaccacttcctggctgatggtgattgtaggacacatccctgtttcagagatgttaaaatgtaaaataataataataataataataataataataataataataatataagatataacctgtttcctaaagttgtgatgacatttaaaggtgagaaagtttgtagctattattgtgattatggttactataaattctgagaaaacacagtggggttttctaattaacactaactaatttatgggacactcattaatgttatatatttatttattgttcaatgttcatgcttaaaaatttcttaatttttcctctttttaattgaggtatggtttatattcagtggaatgcacaggtcttaagtgtttacagttcttgaattttgacacctgtgttacgaacagccctaccaagagatagaacagtctcatcactcaagaaacaacaccctatcttgtcccagtcatcatcgtccctcctctgttctgatatcttctaccatggattaattttggctgttctagaacttaatggaatcatgtggcactactcttttgcatcttttctaaagacatgtacatgttggctgggcgcggtggctcacgcctgtaatcccagcactttggaaggctgaggtgggtggatcacgaggtcaggagtttgagaacagtctggccaacatggtgaaaccccggctctactaaaaaatacaaaaattaactgggcgtggtggtgggcacttgtaatcctagctacttgggaggctgaggcaggagaatagtttcaaactggaaggtggaggttgcagtgagctgagatcgtaccactgcactccagcctgggcaacaagaacaaaactctgtctcaaaaaaaaaaaaaagaaagaaagaaaaagacacatacatgttgctgcatgtatgacgagtttgtttctttttattgctgagtagtctttcattgcatagctatagtattatttttgcatcttcctgctgatggatatttaggttgcttccagtatggggctggctctcaggcataagacactgtgaccatttatttgagtgcaaatatttttgatgacatgttttcatttcttttgtgtaaatgcctggaagtagaattgttggattaaagggtaggtatacattgaactttatgagaaactggcagaacttttcttgaagggaccattttacatgcgtgagagttccagttgctccatacccttgtgaatgttgacatttttagttgagttaatttgaaacatttgagtgggcttgtagtggaatatttatggttttaatttttcttttcttaatgattaatgatgtcaaatgttttttcatatgcttattagccatttgtgcgtctactttgtaaaatgcctgttaagtcatttgaccatttttcaatggcaccatttgtgttttaattgtcaagttgtagtattcaattccttgtcagttaaacataatgcaatgattttctccaagtctgtgacttgtcgtctcattttttagttgtgtcttttgatgagaagtttttaattttgataaagcccatttatcctttttaaaatagtgttttctgtatcttatctgaagttcttgcctactccaaagtcaatcaaatattcattttttttttgtagaagctttatagttttaacttttacatgtaggcctgtgatccacctttaattaaatttttgtgtggtttgaggtatgaatcaaggttaatattttttccatgtagatagctagttgttccagcaccatttattgaaaatactttcttttcctcattgacttgctttggcactttggttggctgtatatgtgttaatccactcctggactgtttattctattccatcgatctgtttgtctatgtatattcaatgccatattaccttgatttatagtggctttagcattagtcttgaaaccaagactcactttttaaggattgctttggtcatcctcctcctcctcttccttcttcttctttcttcctattcttcttcattcttcttcgtcttctccttccttccctccctccctctttcacctcctcctcctccttcttcttctttctccctctccttctttgaggtggggacttgctatgttgcccagacaagagtgtagtgcctgttcaaaagtgcaatcatagtgcactacagcctcaaactcatgggctcattcttctagattttatttgtttagatatgaagtctcactctgttgctcaagctggagtgcagtggcaggatctcagctcgctgcaacctacacctcctgggtttaagtgattctcctgcctcagcctcttgagtagctgggattacaggtgcttaccactgtgccagattaatttttatatttttagtagagatagggtttcgccatgttggccaggctggtcttgaacacctgacctcaagggacccaccacctcggcctcccaaaatgctgggattacaggtgtgagccaccatgcccagctcactcttagacgttttagaataagcacataaatttctacaaaagaacctcataacattttgattggaattatattaaatcaatgaatcaatgtggggaaaattgaaatcttaccaatattgaacttccagtgtatgtatacagtgtatcttttaaattatttgtctttaatttgtctcagcagtttttgaaaaatagttttcactgtagagctcttgcacatatttaaagaaagtatccctcagtattatgagatttaaaatattttgtaaattgtattttttaaaaaatcatcttctagttttttgttatttagacataagattgatgtttgtacattgaccttgtatcctgcaatcttgctacatttaatttatcatatatttttctcagtgctttacagaatttcttgtttattcttgtaactacctatgagtcaggtgttattgcaattatattttataagaaatttgccccagatgtgctaattttcttgctccaggtcacacagtttgagtaacaggggaggaatttaatttaggtcaactctgattatatggcccagtccccttccacactgctataatatgtcatctctttgacatttgtatattattggaatggagtgacacattgtggtttctctggattccactgggacatttttgggtcatcatactttacgggagatggcttcaccaatggaactcctaaaatggacataacaagaataaggtgataaaaaagacggtgatttttccagtttaaggagagcaatatttttccaggttctttccccagaggactgctaaggaaattgtacataatctcaaagtgcagtttctttgcccatgctgtgaatgtacattagctgctgctagatcttccatgtgtgtggatgctgtaaagcttgttttcccttcttctctcccacaacgtgctgtaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatggtaggtagtgcacaactgttccccggcaagatattgatgatatttgttgtgttttgtggccaggcagaatgttctgtgccttatgtgaacgtcactgtgaagagcgtcatggagcacatggcccttttccttggggacatttttggcaggtgccttggcaaaccgaatggaattacttgtcagcttttgttttcatattcacatgtgacatcttttctttttctgttccctgtctcaacctgtgtttgctaatagccttgttattatttagagcagtctctcccttggcaaggtcttgagcattttctttgtgtgacaattatcttccttttgtcccttggctccgtctccttgtctgcacaatcatagactaaatcaggctgatctgagaaaattgagggaagaccataaagtggctcttctatgtgtggacttttctgagagcttctttccccaggaaggatgatgtagaagatgtgaatgccgccttagccaaagtgtctgcttgtcagaggagttcaagtgttcctgtgttctttccttttccagtcgttaggagtaactgagcttactctgagatttgcacccagagggatggtctcagaagacgctggttcagtgcaaattgagatggtaaaaacttatttcttaaaaaatggttcctaaataaatgtcatttactaaaacaaatgaaagaaatatatatatgaataaatggctatattttacaaagtatgcttatttaagaagaaataagaaaaaacggggctgataggaaccagatttgaaatagggcttttgtaaatactccgtaaattgaagtaaatgaagagtagtatttataagctagattgagaaatataaaatcagctagctgaagttaagtgcatcaatttgggatgaataaattttcttttaaaatgtctatcaatttgtgtagagagaggtttcttcatagagatattagaatcaaagagtatgttcagtagttattctgtcttctttgtaatgaatacccttaagttggcttaacagctcagtacttatctttttttcttttcattcttaaaggtcaagccttgtttttgccgtatatgtaactagagacagtacgtttgaggctaaataactgtagtactagggaatgacaacacgctcacccaagacaccgcagcctggtttactctgtcatgataggaatgaggattgtacatttgaaataggtttctgctattgattttttaaatgtataaacgatggaaactacggaatttctcatgttttcaccacatagttttttgtcataaaatgaagaatatattatatccaagaatgaagaggaagtgaacaaatttgagcaaatttagtccagcaatattttcatttgaatagttgagcccctgaaagccattaatatctctttttaaaaaaagaaccatgcagtatttttgaatctcatcatcgtcacttcactaagtattttcacaatgatgaataaaacataaacaaatggaatgagagattgttaccatggatgattctaaattgcagatggctcattactgttgtgaagcctctctttatgtttttacacttggattttgctggatcagccaccctttccctatacattgatttacacgtgcttaattttttttaaccaatttgaggtgagttggctttaggtgaaccaaattaataatctagggttgagagtgtgggaaacaaataaataatgaattcctgaatacattgaagcttttatttattaaaatgtgataaaactggggcaaagtccatattcagctttttttgtgttttgagggttaaaaattcagagggagctctgtgttcaagtttaaatgtagagaaagtacaaaggagagtgtacttatgcacatacacatatgcatgcatgtaccatgactctttttagccttagagaatgaaaccatttaagaaatgagcaatatgtagtattcttaaaaaaagattttgatttccaacaatagttgtggaatgcagcgttcaggggaaaaaggcaactcatggatgatcaagccaccctgcttgtcaggaacccagactcttctatcttgttcttctctgccccacaacatgtgccattcagtccaacctggctgacccagccacatgcatgtccaagtccagtcagaaaaaaaacaaagaaggaagagagctcatctatcccctttaagtacgcttttagaaatctgcacacatctctgctacggccacatccctgtgaccttaaccttgttatatggtaacagctacttgcaagaggggctgggagctgtccttaccctgggcagcaatgtgccccactaaagtgatgaattctgtttccatagcaaaaggggagatttgcagtcttagggaacaattagcagtgtctctcgtacagagaccttttaatgatgtgaagtgtatctctaatgatgcacctgagatgaatttgctgcatgcatcacttaaaatatcattgtatcttgtgtctctggctagattgtgagtccaccgaggtcagaacattgttcttaggtttcactgtactgctttggtgtccagcatgatgtcttttaaaatagtaaatatactataccatcaatatttgttcatttactggggccagatgttaaaatgacacatgaatgagtcctctcttcctgcattttagattgcagatctggaccttgaatcttctgcttctttattcattttccaaattaatgagggtagtgataagtttgtctttcttggaaggtgcttgagttgtctgagttggatattcagtttggagtgtcagtaatagaacaatacggtgatagaaaaggaactgaaatatgccaaggtactcaagggcaaagggagacagacctcatcaccgaatccattggcttttgttgccaagacacaatctctataaagagatgataaagaagtgtgctttaactcctgtcagctgttcttgagacttcaggataacacatttgaattcggagcaatgttaagtgcagtgaaatagaaggaaaagctaaatctatcttccaagccttgaatatttatggaaattaactataaacatttaattattgtggattccaatgtgtgtgtttatttaaagaagggtggaatgaaaaaaatcagcaacttttacagtttgctacatctgcttttttttttttttttgagacagagttttgctcttgtcacccaggctggagtgtaatggtgcgatctctgctcactgcaacctccgtctcccaggttcaagcgattctcctgcctcagcctcccaggtagctgggattataggccagctaatttttatatttttttagtagtgacggggtttcaccatgttggccaggctggtctcaaactcctgacctcaggtgatccacctgcttaggcctcccaaagtgctggaattacaagcgtgagccaccgcgcccggcctacaactgcttttcaagttaaaaggacagccctcagatttacgcagcagtttttcaccatcccttgtgtataaattggtaatctgtattgtactttattaatattgttgatttcgcactgtaactcagctataaaggaaaccgacgtcaaggggagagatttaatcacagaataatcaggactagaattttaaataggacatcattagcatgttaatgaattttcccaccttatgccagctgcctgagtagaaaagatactgcagatgtagctcaaaaatctggctggttccctggcccagtgagctgtcaggaatctgtgtagggtgatccataagctaagtgaagggattctaagtgagaataccaagcagcaagattttgtttttctgagaacgatggctaactgtgcccagcctaaactcatttgtctttcggtgagtaagaggggaatgggaggcagagaaggggcagttgaagggcaatgaggttggagtagaggcacctttccaattatggtttgggattaggaccttttgctttagatagaaaagttgtaagttcgcaatgacaagatcctgccctaattcttggcacagtctcacaatttttgagcttgaaatagctaatgaaaggaagcatgagtgtcttagtccatctgcgttgctatagaggaatacctgaggctgggtcatttataaagaaaagggaattctttggctcacagttttgcaggctgtctaagaagcatagtgccaacatctgcttctggtgagggcctcaggctgcttccactcatggcagaagatgaaggggagctggcctaggcagatcactggtgagagaggaagcaaaaagagagagaagggacatgacacactctttttaacaaccagctctcccagaaactaatagagtgagaactcactcattgatgaccaagctattcttgagggatctgcccccagacccagacacctcccattaggctctaccttcaacattgggggtcaaatttcaacataaggtttggaggtcaaagaaaagaaactatagcagtgacagattatactgagatatcggtttaactctgaagttcccagatgcagctacttgcagaatttcacttcacacctattaagaaaagtcttttagtttagaaatcctgtgagttacaagttctgcatatataggcagtaattcttttttccatatatgtcagatatatgtagaagaaactgatgaaaaagtagaacaaaagaataaaatctatgggtctcttttattggcagggagagggaggaaatggagagccgggacaatacatacaacaaagataaaaacaataaaattagcaaacaacaataaaatttaaaaacaaagacagaagaaaatgccaatgtcaagtgttaattatttggttgagaatatgatgtgataatgaacttcctagaagtcacagcaaagaagacagttgaagcatcatccttcttcctcaaaagcaccttgaaaagcacagagctttttgggaattcagagtgatgctaaattcttcaagacacttctcttgaaagcatagtggaaagtcctcctgaacagatttataacacatgcagaaagctcttttacttgtattattattttttacaactttttattttaggttcaggaatacatgtgcaggttctttatataggtaaattgcatgtcatcggggtttggtgtccagaatattttatcacccaggtgataagcatgttatccgatggttgtgaccaactacctctaggaaaaaaacatgttggggatcccttcaaagcaggagggactgtgcacaggagagactgaaaccacatacacattttagatatgtaggtatggacagtttttcccacaaaaagatccagtttttcagcagatttttaaaggggtcattctaagagtcctcaaattttaagaaacattaagatattaaactgtcgaggtgaattagggcttgggctagtgaagtttaaatacggcatcttccaatttctgacattatttcaagatgtaacttagcacctaaaaagtggctggagaacatatcctgtacactcaccaaatgtcacttctttcctctgagctttggctacgacctatgtataagaaaacttagctctccgggccagaacggtgatagtgctcttgataacagagggccaagccgtctgctttggaaccagatgagtgttgcggtgctatgtggcaagaaatgtagatgtttatatgggaaatagatatgtgtctgcctttccaaattcgaaatctttggtcatttagatttaaaaaaaaatgtcaaataggatcttttggaagaaataaaaaaaattcaaaatcttttccctcaggtttttctgataggctgaggttttaaatctctaatcatttatctttgatttgccttattgattacattatcactttatcaggaccctgactaaatctgtttgtgtttttaatttctctccattttttcctttccagttacatccttgcatcactattagtgtgattatttcccttcagccatttttgcctgtgaatttctaagcttgaaatttgcagctaactttctccctcctttattaagtcgctgtgataattcttttgggaggcatcgccatacagtggaaaaagcctggattaggatgtagggggtgtcagtttaatctcagtcctgcccttccctaatcatctgcatagcacctgatatatatagcatcagaatgtgaggctcaatgagtgaatagtcttcagcaactcactgaattttatctgagtctcagttgcttcatatgtaatactgtagaaccagatcttgaagttgcatttctatccatccatccatccatccatccatccatccatccacccatccatccatcctttccacaagcatttattgagtacttacgatatgctaggcgctgtggcaggccctcatggtccagagatgaattagatagtccctgtggctactgaggtcccttttaactctagccccttgtatgtgaatttccacaattcaatttatactttgttcatttattttcttgctctcagctacttttgatctccttttcccacttttatccatatatatttttaaaagtccctactattgttacatcttttttcacttgtctctctacttgtttctatactcccttaaaatacgtaagtcacttaccccctgggtggaaatacaatgatgttttcaattatatttcataccaaattgcaacaggcagttttttttaacatgctaattcatttagagcagaaacttgactctatgtaatagggtgggtacatgtgtctcttaaatatctgccagattttctgctttgtagattattcttactaatcagtgcgtattagagtctctttgtacatttcatatggactctgggctttgataatgttggtagacacatgtactcacacacgctcatataatgtcctgaagattaagctaagagtgatggtaagtggaacttcatgatcttaaagaagagcctgtttgccatgttttgggtgaggggattattttttgcatggggaccctatcatgtattgcagaacatttcacatccctggtcattgcctgcatccaactcttcttcccacccccatttttcaatgcccccaggtaggagtggtaccaccctcagttaactgcataacttcagcctaatgctttatgttttagtatcattcctatgatttgaaaatatgttgtcatgatcattagaacttgcctggaattaataaaaccaaattctattattcacattatctttcatatagatccttagaggtttaaatataagttctttgcagatttcttcctccattgctctttactgtgtatattcagtatgtatttcttgggcacagatttctgtatgcacagatgagctacagctattgtggatttaatgttttctttgaagaaaaggaatgatcccttgtacgaagtcaccctctttttagtaacaaagacttatctctttctttttgtttctcaagcacttgagaactaagcactgtgctaagacttgacatactttagtcatctcatcctctggaccactgtggtactggctccactggaatctctgttttaccgatgaagaagctgaggtttaggaaggatcctgtcacagagccttcagggggcaaggccaccatctgaatccctcttacctgccattttacctttgacgttgctttatgttctttatgaatttgattcctaacgtcagtctctctatccatcccgcaacctcatcaccctacctaaataccacactcatagattcataattacaaaacaaaagtctacaaaaagtcatctattgatgatgttgaacatcctgaaaagacgggtatttttttttcatttttgaagttttcaagcaccctccctatattttgtgcctgagatgatgatccactatctgccatgttgctatagcagatggataatttaactcagtagtaggaggttctataggttatcaccctatgaaactcatatcttttgtattaaaacctcaattctttattttcgaagggtgactaggagaaacttggcatactaccataaatcagagagaagttgaactatagcaatttaattggatacatattcattgacttcaaaccagttttttgtatattttcaaataactgttgctagttctgcttcctgttctaaaatgctgaaatggcaatcttttcctttgtattcctataagtaaatgcattggttattagattgatacattactcagttcctggtaaagaagtagttagaagccctgtttgcttttaagaatttactaatttgtcatccttttgattacaaggaattcaatttgcaacatgtgatgtcaatctttctaggcttcttttgagtgagttttgaactttagttaaataaaacaactttttttttttgagacagagtctcagtctattgccaaggctggagtgcagtggcacgatcttggctcactgcaacctccacctcccgggttcaggcaattctttgcctcagcctcccgaatagctgggattacaggcgcccgccaccatgcctggctaatttttgtatttttagtagagacggggtttcaccatcctggccaggctggtcttgaactcctgacctcatgatccacctgcctcggccccctaaagggctgggattacaggcatgagccactgcgcccagcataaataaaaaaaatttaaactattatataatttaggattttcaggaatgaaggttgattctttataaaccaaatttgattttgtgaggttttgcagaatttaattttacttggctaaatatgactcattatatggtcacagttttttcagtgattaatttggtaagaaatattttgttttccttcttggcattatcatgagttatggcttcctgtacacattcctgccattttagctgtgtactttttctttgaagctgccatatgttaacaacccaagagagatggtatttactggagagatcatcacttgttgctaatttgatttttcagattctctgagctcttataaaagagagagagcatgctgatgaatgttttcctgccctgactgctttgaggagctagtgtttgctgccctgggcccttagtcctgttatgttttggacttggggatggccactgtgtctaatccactttccattgaggcttttctgtaactggggagggctggatcactgtaggggtggacaaccctgagtgaatgcactgcaatttaatatttatggccggtacagaaaccatcaagaattgcttaaggatttactgacttggcatcatcaaaaatttatgaggcaggtatgctcatattccacaagcctgcatagtcatagaatgtcgttttatttttcttttgacattatgctttctggagtcttaataactcattaacaactgatgacacactttgctttttggtttaattataaccaaattttatttgccaaaatgatgtttaatttttggtgtattaacccattatgaatatctctcttttcctatgtttactatgactgctttacatttccagtctccccaaatctgatattttccttccccaagaaagaaccaaatacaattatattacgattgcatggtctgtctggtttggacagggtgactgaaatcttgggcttctttttaactctgaattggatccagcattctactttgcttcgtatgtaccaatcttgttgggtgagacatatacattggaatttggcaagtgtttgtatacccttcacccaactccactgttttcagagactgagtaacagtagtggctggatgccaacttcatgtctgccctgagaaggtcaccaaacacggacattcccccgtggtctggaatcctgcaaatctgtcagcctttggaagtgaagtgattctcccctaaagattatagagaaattctctgaagtcaaagctgatgaaatgtctggagttactctaggataaaattttaatttatttcaaaaaatacctttagcataaaataaaatttttgaaatgaatgaaaaatgtttatcatgcaacttctataacagagcccctggttgcatttttttgcattatcttctgtgcttgcagtacaggaaagctttttacacacttgtactgagaaagaggatgcaattttacatcctctgtctgtccttaaccttataggacaatagtgagagcatggcaccagttaatcctcgtaactgtagtttgagacaaatttatcattcccaatctaccaatgtgtgaaactgaggctcagtgaattaacagagtggctcaagtttctgtatatgggaagtaaagaactggaatgagactcatctgtctcacttcagagccatactcttcattatacacttctgtgtccctggttgcattataatattccaatttattattttttatgtacataacagtccaaggatcaatatactgtgacttacttaactacctccttattctgaggtgtttaatgattatttcatgaattttttctgaagataaagtgccaagattgggattaatgacccaaagaatgcagtcatttttatggcttcatacatactgcagattgatttgcaggttatagcaatttaattgatactaccaatccatcctttctaataataagcattattttttaaaagattattagtataataacagagtggtatttaattcatgccttgtttttgcatatctttgactaatacattcaacttgtttttttgtgcctttataagttttttttgagacagggtctcactctgtcacctaggctggagtgcagtggcattatctcggctcactgcaacctccacctcctgggctcaagcaatcctcccatctcagtcttccgagtagctggaagtacaggcatgtgccaccatggcctggcttggtagagacgggattatgccatgttgcctagagtggtctcgaactcctgggctcaagtgatccacctgccgtggcttccaaaagtgttgggattacagagtgagccaccatgcccggcctactttttttcattgtgtgtttcactcacgtccgtgtgaagagacaccaaacaggctttgtgtgagcaacgaggctgtttatttcacctgggtgcaggcaggctgagtctgaaaagagagtcagcgaagggagataggggtggggctgttttataagatttgggtaggtaaaggaaaattacagtcaaaggggggttgttctctggcgggcaggagtgggggggtcacaaggtgctcagtgggggagcttttgagccaggatgagccaggagaaggaatttcaccagataatgtcatctgttaaggcaggaacaggccattttcacttcttttgtggtggaatgtcatcagttaaggcaggaactggccatctggatgtgtacgtgcaggtcacaggggatatgatagtttagcttgggctcagaggcctgacattcctgtcttcttatattaataagaaaaataaaatgaaatggtggtaaagtgttgggatggtgaaaagttttggaggtggtatggagagataatgggcgatgtttctcagggctgcttcgagcgggattagggcggcatgggaacctagagtgggagatattaagctgaaggaagattttgtggtaaagggtgatattgtgcggttgttagaagaaacatttgtcatttagaattattggtgatggcctggatatggttttgtatgaattgaaaaactaaatggaataagagaaggagaaaaacaggtattaaaggtctaagaattgggaggacctaggacatctaattagagagtgcctaaggagattcagcatagtcctgccagcaaagattatttatttacttcaaaagttaagagcggcagtttggggatagcaccaggagatatcagctgtgatggcttggaaaaacagtgtaaaccggcagcgtaaacaagagcagggcatgtatgagtagttgagaatggtgaataggagtataactagacagaagatagtagggatgacaagttttttggggcacagtccaagttggtctggtgtctggaatgagactggggcctaataaaaaggagcgtccatacaggagctcaaatgggctgtaccctgtagcattccgaggacaggcctgaattctgagaagggaaagtggtaaaagtattgtccagtcctttttaagttggtggctgagcttggtgaggtgtgtttttaaaagaccattagtctgttctacctttcctgaagacggaggaccgtaagggatataaaggtttcactgaatactaagagcctgaaaaactgcttggctgatttgactaataaaggctcgtctgttatcagactgtattgaggtgggaaggctaaactgaggaattatgtctgacagaagggaagaaatgactgcagtggccttctcggaccctgtaggaaaggcctctacccatccagtgaaatggctacccaggctaagaggtattttaattttctgacttggggcatgtgagtaaagtcaatttgccagtcctgggcaggggcaaatccccgggcttgatgtgtagggaagggaggaggcctgaacaatccccaaggggtagtagaatagcagatggaacactgagaagtgatttcctggaggatagatttccaggatggaaaggaaatgagagattctaagagacagggtagcagcttgtaacctatgtggaagaggttatgaaatgacaacagaatagaatgggactgtgaggctgcaaggagatattttccttggtctaagaaccatttgccttgtgtgggaagagactgataggtggaagtttcagcaggggagtaggtgggaatgactgatgtgaaggagaaaaactggccgtgagggacagaagttggagagctagctgcttgtctagccaccttatcagcataagcgttgcctagagcaatgggatctgacgccttttgatggcctttgcagtgaatgactccagcttcctttggaagtaaagccgccttgagcagagtttttattagaggcattaatgatggaggacccttgcgtagtgaggaaacctctttcagcccatgtgaccacatggtggtgtatgatatggaaggcatatttagagtcagtataaatattgacgtgtcgtccttttgcaagagtgagggcttgagttaaggcaactagttcggctttctgagaggtagtgggggggggtgggcagagtggtagccttgatgatagatgtggaagctactatagcatagcctgcctttgctggtgagtggcgattaggcctggtggaactgccatcaataaaccaaatgtgatcagggtgaggaacaggaaagaaggaaatatggggaaatggggtgaatgttaggtggatcagagagatacagtcatgagggtcaggtgtggtatccagaataatgtgggaggctggattgaagtccatgccaggaacagtggtaattgtgggacactcaacaaagagtgagcacagctgaaggagccagggagcagaaagtatatgcctcaggtgtgaggaagaaaatagattttggaagttatgagaactgtagagagtgagttgagcatagtttgtgattttgagggcctctaaaagtattaaagcagcggcagccgctgcacgcagacatgagggctaggctaaaacagtaaggtcaagttgtttggacagaaaggctacagggtgcggtcctggctcttgtgtaagaattctgacctcactaaccatgcctaggaaggaaaggagttgttgttttgtaagggattgaggtttgggagattagtcagacatgatcagcagggagagcatgtgtgtttttatgagaattatgccgagataggtaacagatgaggatgaaatttggacttgactgaagtaatgggggctgtctgtgaagccctgtggcagtacagcccaggtaatttgctgagcctaatgggtgtcagggtcagtctaagtgaaagcgaagagaggctgggatgaagggtgcaaagggatagtaaagaaagcatgtttgagatccagaacagaataatgggctgtggagggaggtattgaggataggagagtatatgggtttggcaccacagggtggataggcaaaacaatttcattgataaggcgcagatcctgaactaacctgtaaggcttgtctggttctaggacaggtaaaatgggggaattataaggagagtttataggctttaaaaggccatgctgtaacaggtgagtgataacaggctttaatcattttaaagagtgctgtgggatgggatattggcattgagcaggctaagggtgattaggttttaatgagatggtaaggggtgcatgatcggtcaccaaggagggagtagaggtatcttatacttgtgggttaaggtggggggatacaagaggaggacgcaaaggaggctttggattgggaagaagggcggcaatgagattcagctgtagtccaggaatagtcagggaagcagataatttagttaaagtgtctcagcctaataagggaactggacaggtggggacaattaaaaaggagtgcttaaaagagtattgtcaaagttggcaccagagttggggagttttaagaggtttagaagcctggccgtcaatatctacaacagttatggaggcaagggaaacaggcccttgaaaagaaggtaatgtggagtgggtagcctccatattgattaagaaggggaaggacttaccctccactgtgagagttacccaaatctcggcatccatgatggtctagggggcttccaaggcgatttggcagtgtcagtcttcagctgctaagctgagaagatctgggaaggagtcagtcagagagccttgggccagagttccaggggctctgggagtggctgccaggtgagttgaacagtccgattttcagtggagtcccgcacagatgagacgcggcttaggaggaatcctgggctgcgggcattccttggcctggtggccagatttctggcacttgtagcaagctcctgggggaggcaggcctggaggaactcctggtcactgcggtttaggcatttggaagttcttgtgtgctggagatgtggctggggtttgtctcacagtggaggcaaggaattgcaactcagaaatatgttgctacttggctgcctctactctattattgtacaccttgaaggcacggttaatgaagtcctgttgtggggtttgagggctggaatttaatttttggagttttatttaatgtccagagcagattgggtaataaaatgtattttgagaataagacggccttttgaccttttagggtccagggctgtaaagtgtctcagggttgctgccaaacgagccatgaactgggctgggtttttatagttgctgaaaaagagcctaaacactatctgatttgggataaagaaaaaggagcattaaccttgactatgcctttagctccagccacctttttaagaggaaattgctgggcaggtgggggagggctagtcatggaacgaaactgtaagccagaccgggtgtaaggaggagaggtgataaaaggattatagggtggaggagtggaggccgaggaagaatttggacctagcttggcctggtgaggaggggagaggtcagatgggtctgtagaaaaggaagattagaaagacttagcgacgcttggggttgggactgaggggacaggcaggagggaaagaaggaagatttgggatgagttgtactgggaacagagactagggagggaccgatgtgtaaaagaatgtctggacgtcaggcatctcagaccgtttgcccattttatgacaagaattatttagatcttgtaggatggaaaaattgaacgtgccgttttctggctatttggaaccactgtcgagtttgcattggggtcaagcggcatcgcagaagaaaataaggcatttaggttttaggtcaggtgtaagttgaataggttttaggtttttaagaacacaggctaagggagaagaagggggcaatggggggcagaagcttgcccatagtgaaggaggcaagcccagagaaaagagagagtagagacacggagagaagggatggggggttcttgccccctagaaaagctgtacttgccactaacggtgaaggaccaaggcaggcgtccctgcatggtcagacacctctgaaacgtgggtgaataatcatgcagacatccccgtgtgattaaacaccaagcgaagactgtcttcccgagtccgtgaacagcgccagagttttgggtccacagataaaacgcgtctccttcatctctaccagaaaaggaaaggaactgaaattaagagaagggagagattgaagtgtggcgccaagattgaaaggaaaaagaggttgagggatagtgagagaggttggagaagagagtaaaaagaggccgcttaccagatttaaaattggtgagatgttcctttctgaggaccagaggtcataggtggatctttctcacagaacaaagagcaggaggacaggggattgatctcccaaggggggtcccccgatctgagtcacggcaccaaatttcactcgcgtccgtgtgaagagaccgctaaacaggctttgtgtgagcaacaaggctgtttatttcacctgggtgcaagcgggctgagtccgaaaagagagtcagcgaagggagataggggtggcgctgttttataagatttgggtagataaaggaaaattacagtcaaaggggggttgttctttggcgggcaggagtgggggtcacaaggtgctcagtaggggagcttttgagccaggatgagccaggagaaggaatttcaccagataatgtcatcagttaaggcaggaacaggccattttcacttcttttgtggtggaatgtcatcagttaaggcaggaactggccatctggatgtgtacttgcaggtcacaggggatatgatggcttagcttgggctcagaggcctgacagtgtgttgtctatgtcctttgtctattggttttattttgaaggaggcacctagtggttttcttctctttatataatatggttatcaatcattttttcctatttgtatgtgtgtgtgtatttgtgaaattaacccctcatcatgattaatagtggaccaagaacaaagtataaaaaataatatcatgttgagataacggcgtagaatggattttaaacttcttaaggcattagggtgcaaatgatgtactaaacaacatagaccgatctttctgagtaaaaacattctatttccactctgtgtattaatatgcattggacctggcctttcaaacaaatgtgatattcagggaactgccgcaattgagaccttaataaaccagtttcacttttttcagtaaatctgtgaaagctattattttacattttctccactgttaaaatacagaaactgagagaagtactcagtatcctacccaagaccttatttttcttcaggatgcatctcatgttttgtacttcactgtctttggctgtttttttctttattatttcccattttcttaagttgatccattataaaaacaactcctgcttacaggactatttttttccttccagaggcgtgctgttatttcataggtgaacggatagtgtcctgatggtgtctgtggcccttgaagctgcagtttaaggagggggttcaaagaaatggtagagaaaggtcgtccctgtcctggaaggatgccagataggatgacctttgaaactgtcatcaggggcatgaaaaatgggtttgcaatagttccctgcccttctctgcataaacgatatacagcatttgatattaaggcaaatatccttttccattgatgatgtgtaatcataaatcataagaaatttctatgatttcggattcaggaaggcacctttctacctgttgcagctgttgggagtcattctccctccagcccgactatgtcttcccactgcttttggctgctcccattggctttcacattctcctctccacctttggactatcccctacccttatctatccacacattcacttcctacattccttccatgcctaatcaggacagctcctctgaccaccttaacttcccaggatgtccgcgtgctctggataaagtgcgctaagccccgccccgcccctccccgtgtgatctgagtcgggccccactgactttcctgtacacacatcctctgtcctccttggacccatatttgtagtcagtctctctgttcccactctgcatggcacttgacctgatgctgggaaggtaatcattatccttcccttaatgtttcaggattattcattctattttgccacatctaatgtaatatttaatagcatctatgaagaagactgaagactataaataaatgctctctttagtattgagaaggttttatacaatataaaatttagagtacatttttttctcaggaggtctgacattaatattaatcgtgagccccaaagtagaagcttttatattttagcataatgaagtttaccatatgtttcaaagtcacttgcaattgtgcttctcataatgacaattagaaaggtcatcctgtcttgccaggctccattaggtatataaaccagctcgtggctgtcaccgtgaaatgtgttaaggcacttgtatgcaaattcaaggggagacatgatattttttatcccaaagtgtagctgtttacaactaattaccaaacacggaacaagcctattgtttgcctttacatgatatatgggcatagaagtttctaaagcaaattctcctctgtcttttcattgattaaattatatgaagtcaccctcttccatgaagcattacatgatgaggtccccaaagcactgaataaagaaatttgtcattaagacactggtgtatttctgatctatatattttttttctgcttcactcgaaaaacttattatctgcatgaaagtatggaaactgttattgtatttaactctctacatgtgaaccttgaagaaatgatggggcgaaggtgaaatgaaagggaggaggtgaggaggtggcacaagtaatgttttcttatggaacttgtagagggataaacctacattagaatcaaagcaggtaattcctgggaaactgaagcatgccattgtggatgtgggtcatgggaactgatgctggaaaaaaatagttcctaatctggtttgggaatggcaaatttcgttgccacaattgaaatattaatatacttctttgtatgaatgccctttcatttatgccttttttttctttaagaggcattttttctctaagacaggctaaacttctgtattcaagcctttagagtttgcaaacatttatcaatagataagaaagatagataaaaagtcctggattcattaatgcacagccatggtctctacagttttgaaatttctcacttgggagaatactggagaagaacatgtggcccgtgaagcatttgactgttaatatttcgtactattcagatgctttaatttaaaaaattaatctatgaatttaacatatattcatgggatgcagacactgcagagagctgcctcttcctggactttgtgtttgaactgtgttccggttgcttaagcacccatctatctggaatggtttgtgttcaggttttccagaggaaaggatgactccatgttcctcaaggaactttccaggcaaatgaatttgttattttttaatattaaaaatgatcctctttattgagagtgatagactaagggaggaataaacagttgtaatagccctgtgacacataagcggagaaaaaaaccccctccatgcttatgtaaataggaaggagaacaactgtagcaagaatatagaaaaggactcctttcttctctcttccactctcgttttttgccctttggcctaaagctgttaacattgggtgaatgtccctgtcgtcatcttgcattatatctcacgttctgtttgttattgatagggatggatatctgagagtctatatcaagagttacatgtaagtttgtgtaaggcccttcttttgcttctacatttttgctcgttgtatggatgcattttgtaggactgtgagcttatatttaaaacacctgtgcggcagtggacccttgtcaccgcctggcctctcattcagaagccttagctgttcctcaactcctacaacacatgttgagcgcctctcaggtgccagctactgtaataggcactggggagtggaagggtgacaagatgtgattcctgacctcgagagctttgcagtcactggtggaggaggcacatgtacacagcaaatagggcacgatgtgttgaaggatgaaatgaagcaataaacaataggtatcaagacagcagagataaggacaaccaaggatgccttcgaggagccagggagagcctcacagaggaggcagggcatgcaccgtggcttggggatggaaggggcagaaatagtgttgttttagggaagaggagagcacagactcagaggtcggaggaacgtggcacatctaggagacagggatccaatcccagccctaccacttagcagctgtgtaactttgggaaagtttgctaatcactctgagtatgtttcctcccacgtaaagtagaaatactactactactaatattgacctcttaggaccatgagtagataaagtaataatacatgtaacaatcttggcttagtgccctagcgtatcataaggactcaataaatattagtttatgtgattattgatctggctggactgaagggtgtaagagtgagaatgataggagatgaggctggagaagtggacagagccaaaccatgagataccttttcaccaggctggggttttcaagatttctgaaaggtcgtggctagccattaaaataacttggtttctgtatcctccactgctcctgaacattcttgtattacagttgtgttagtctgtttgcattgctatcaaggaatacctgagacagggtaatttgtaaagaaaataagtttatttggcttatagttctgcaggctgtacatgaaatatagtgctgccatctgcttctggcaaggcctcaggaagcttacaatcatggtggaaagggcaggggagccagccagcgtgtcacatggcgagagagggagcaagaggcgaggtggaggtgccaggctctttttaaacaaccggatcttgtgtgaactcattaccacagaaagggcaccaagccatgcataagggactcgcccccatgacaccagcacctcccacaaggccccacctccaacattgaggaatcacatttcaacatgagatttggagggggcaaacatctaaactatatcaaaagtcgatgattaaacacagtctcatataaatgttctacctcaaaaaaacccaaacattgcacacctattatagctaagataaaaaatactgacaacaccaagtgctgccaagaaggtggagcaggccaattgctcatacatctctggtgggatgtgtcagtatcgcaggtggggttgtaagagtagagccatctggaagacagtgccagtggcttatggagttaaacattacacttgccatgtgacctggcaattccactcctgggtacttatttatcctctagaaataaaaatttatatcccacaaaactgtaatgaatatttatagcagctttattcataattgcctaaaactgaaaacaagtcaaatgtccttcactgagtggatagaataacaaactatggtaccttcacatagtggaacacgactcagtaataaggaacaaactatcaatatacacaacaacctggctgcatctcaaatgcattgtactgagtgaaagaaaccggtctcaaaaggctacagctgtagcatcctattcatacgatgctctggaaaagagacctctaagggcagggtttaggaattgggagaggggctggggaagggtctgattagaaattaacagcccaagggaattcttggttttgtttttatttgtttttttttttttgttgttgttgttttttgagacggagtctcgctctgtcacccaggctggagtgcagtggcgcgatctcagctcactgcaagctccgcctcagcccaagggaattctttaggggccttgggattgttctgtatcctgtttgtggtgatggttacaagttacagcccatagaactgtacaacaagtgaattttactgcgtgtaaatttttaaaaaattttaaaaacttgaagacatatagctcatttaccacgtgctttacctgtcttatctcattaatcctctctatgaggttgatgttattattacaggtcgaacattcctaatctgaaaatccaaaatctggaatgctccaaaatctgaaactaattttgaggcctgacatgatgctcaaaggaaaagctcatagaagcatttcggattttgcattttcaaattagagattctccacaggtaattatgcagatcttccaaaagctgaaaaaaatctgaaatccacaacacttttggtcctaagcatttcagataagggatactcaacctggatctctattagtgcattattatctactactattattattattgactaagcagaggctttgtgaggtttggcccaaacctacataccttccagggggcaaagcctggcacaagccaggtgtgcacactccccagaccctgaatttccacagcattgcgagtcacccctcaaggagtcacagagtgggtggtagatctttctcaggctcttgtacaggctgtacctcagtttatccagctcattggtcagtgtggttgctctgtgcatcatgctggtgcaacttttacaaatgtgcaaatgttctaaatgcttagtatcagagagggagttgcctactgaatattttctgacctcttaacttgtactgttggctaagttaaatttggcttcttttcaaggaactattaccttcctagagggtttgtgtggtgacacccataaaaatcttattcagtttttgttcaattcacagctttaacttagtctccttaaaaatcactcaggttgtaaccaaaggctgctctatggctgagtagaattgttaattattaataactgttaatcaactacatagtcaacctcagacaagagggcaagagataattccttagacacacacacaaaaagagcaaaatgttaaggttagaaaacagtaaaaacgatgaagatatttaattctttttgcatactttgtaattatttgtttaaatatctatttccctagcctctgtgccagtttttctcgttgttttttatttttatttttttaagagagggtcttgtgttgttgcccaggctggagtccagtggtgcaaccatgactcactgcatcctcacactactgggctttgatcctcccatgtcaggctcccaagcatctgggactacaggcatgcaccaccatgcctggctaatttttaaaacatttatttttgtagagataggatctctctctgttgcccaggctggccttgaacttctggtctcaagcaatcctctcaccagtcctctcacctcagtctcccaaagtgctgggattacgtgagccattgcgcccagccttttcgaggctattagttttctgcccccagttcctgtaatccttgcatagaataggggcttagtaaaggtttgctgagttagaactccatttcaatggatattgaacttgagaactgagtgagacttgtggagtatggtatttcaaagtattatttatccaacagtctgatatttcagaatcattcatttgccaactcctatgtaggtactttggagatattatttgagttattccttatgacatcccatgcagcaaacatattccttcctaaatgaggaagctgaggctaggagtgatgagctgatttgcttgttatgcacactggatggagtgtgagctgtgtcagacacgtgaattcagatcctcttgtgccacatcagagggacatgagatggggtggctgtttcacttctgtgagcctcactttccccctcattcatttatgtaaccaatggtgggtccaggttttgtgaggactggagcttacataatttgagtatgggtcttatttaaagaaaaaaatatataggattatgattcaaatttggatacagggtttgaaggagacttgtgacagcgggagaccctgaggcttatgtgccattagattcatggtaaatctgtccttgctttcaactaatttttatagtgagccactacgtgccgggctgtgtctgcagctggttacatgtgctgagcctaacagtaccatcctggtcctctagaatgctagagcccactgggagacaccaccagaaaacagacaacggcagtacagtcagataagtgtatgatgggggggtatgaaaagccaggaaagatttctggaagagatgacatctaagctgctactcaggatatgtaaaagttaaaatggagaaaagtatggaaagcccatttgaggcagaagaaagaacaagcatgagaggtgatagagaaaagcttccttatggggaccgcaagaagtttagtggggctgcgttgttcagtggggtggaggagtggggagagcttcagctccagaattaggcaggggccaggtgggcttgtgtaccacttaaggagcttggaaatggtcctaagagcaataggaggcacttggacagatttaagcagggagtgatctgataagatttgcattggggggatgaaaaaaaggccacactgggtccagctgcagaatggagagagaatccactccacactgggcacgagggccatccccctgcagggaggccagtggcaggagagaggaaggtgacaggagagcagctgtgagaacgaagaggaggggatacgttacaaagttgttcagcagtgagaaccaacaggacttgagagtggatgcttagaggcaggaggtgcaggtggtcatgagggaggagataagatagaagcttagctttctggcctggaccaccggtggggggtattcattagaatcaaggccataagaacagcagatttggaagagattgtatgtctcctttgagccagttgagtttgcagtttctgagtgacatccaggtggagatgttcagtggagagctggttgcaaagctgaggaaggagagctgactgacggcagggctttggctgttctcagcatatggattataattagagccgtgcagatagatgagagtgcatgggaaaagccagtgcagagacaagatggtgcaaaggagtatcctaaagaacattaatctttaggggacaggcagaggacaaggagccacaaagaagcatgagagactgtggtcagggatgagggaggaccggcaggagtgtgtgaggagcacggattgtttttgtttgtggggttcccctgcctttagggacacactaactctttggatatcaactggttgtcccggaattccatttagctctgtttgacttgtgtgcagagcccatggttttcacagcccctcttcctttcagatttgataatttgctagagtggctcacagaactcaggaaaacactttacttatgtgtacaggtttattgtagaggatacaactcaggaacagccacatggaagagatgcataggacaaggtatgggggtggcgcagagcttccatgccccctccaggtgcgccacctcccagcactgccatggcctcaccagtccagaagctctctgaaccctgtggtttagggttttcatggagcttggttttatacattttagggagacatgagacatcaatcaaatacatttaagaaatacattggtttggtccagaaaggcaggacaacttgaagcaagttgggcgggcagggaggcttccaggttataggaaggtttaaaaattttctgattggcaattggtcaaaagagttattatcaatacccagcattttgggaggccgacgggggtggatcacgaggtcaggagatcaagaccatcctggctaacacgtgaaaccccgtctctactaaaaatacaaaaaaaattagccggacattgtggtgggcgcctgtagtcccagctactcgggaggctgaggcaggagaatggcatgaacctgggaggcggagcttgcagtgagctgaaactgtgccattgcactccagcctgggcgacagagcaagactctgactcaaaaaaaaaaaaaaaagaaaaaaaagaaaaagaagagttattatcaataagaaggaatgtctgggtttcgataaggggttgtgcagaccaaagttttctcatgcagctgaagcctccaggtggcaggcttcagagagactagattgtaaatatttattatcagatgtaaggtctgtgttgatgttaataccggaggttatattgaggcatgttcaaccctacttcccgtcatagcctgagccagtctttctggttaaattttagagttctctggcctggcaggaagtccatttacatggttgaggaacttagaattttgtttttggtttacaaagagaaagcagagaagggtgatgaatgactgagccacatcctggtgccagctctggaccgggtttggctgtggtctccacaaacatttttgaatgaatacatgagtgagcaagtgagtgagtgaatgggaggaaggccggcggggggaggtttgaggagagtggggaaaggtctgctgtggtgccttgaaggtggggagacctggcacggggaacacagaattgccaggtggatttggtgcccatttggaaggtggcccagtgacttctggggacagtgtccctgagatcatgcattttccccagctgtgctcagcagcctgcttcagggagagggaatggcaacagcgagcacgccaggctgggggtttccaggcaggtagaggagaaaggcaactgggttcgggagccgaacggagtggcaggaaggtgagtgaagtgatggatggctatgtctacactggaggctggtaaaggagggaaagtgataggttgaggggtgggtggctggatgtggtcgtggaacaggggcagaaataactagggtgtgggaaaagtagtggcaaggtggctgggagcttggtggctcagtttgggtgcagatgaagccaaggtgaagtgaggtgggatggtgagaccaaggacccagaagcccaggtgtcggcctggtgatgcaaggatggcggcagggctcggggtggggaggaggtggaggtccaggatcaaggcccccagagaagggggatgtcccagatgagagcaatgagaaggacagcttggggtgaagctgaatgccctgagccttcaagcagcaacagattatacctgaaggtagagccacgttagggacgtgggaggacactgactgcttgggtaggggtggggagtgagcatccacactcgagtggctgcagatgccatgagaccctccagggatgaccaggtcactgttagggcagagaggaggaggcagctttcagaaggagctgggcatgcagagcttgctaaccagtgatggaggatccaggcagtagggcaaagcccatggaggggcccacaggacgggacaactgcgaagacactgtctgccttggaatgcgggcagcatcttcatagccatccagggatttggaccctggccttcctaagtgagagctatactttttctataatttctgccactacataactgccaaagttaaaggtggaaaaagagtctctgtcctagcttttcagcgaccttttcaaaaggaacagaaaatcgtcgcattctcttgcttctacaatgccagtgattgtctgatgcatcctgggtttgacaaaggcaggtagacactcacggtgcagggacacgccagttccaaatcgcatctttactttttaaatgttgaaaaacaaaaaagacagtgcatcttagaatttaaggcaacatagtaactaaagtggcggaggcttttaactgaaaccagaagaaacagcatgagttttgttgttttatgtttcttagctgaaagaaactcaggcaggataacgtgataaggaaactcaggtatttgcctgtgattagttcaggaactgttgaaaaaagactctgggattgggcagaactagagtttagatcactagcttgaaggacttttaagtccagtttaagatttggagagagttataaaggctaagccagcatttataagaacatgtaccaattagagaagtacaggagaatttgctgttttctctgttattataaagatcattgttcttaaatttacattagtttgctaggcctactgccacagaaaaccacagactgagtggcttggacaacagatgtttattttctcccaactctgaaggctggaagttcgagatcaaggtgtcagcacaaatggtctctccctaagcctctctgcttggcttgcggatggctgtcttctccctgcgtcctccctcacatggccttccctttgtgtgtgtctgtgtcctcatctcctctcctcatagggatgccgatcagactggtttagggctcaacctcttgacctcgtttcaatgttatcacctctctaaagaccgtgtctccaaaaagtcacattctgaagtaccagggattagggattcaacatataagttttgggggaggacacagttcagtccatagcagcctattccatacctcattttataagaagagaatttaaaatcagatccttgcctagcactcttctggtcacacacagaaaataatccagaaagttaccttggctgctcagcctcatgtggctggaccctctgttgctgtaagacctcaccggacccttctccgtcctcgctccttcacatgctggaaccttccttacatgtctagatgcaccgagcttgttcacaccttcagggtttgttccctcatcctaaaatggtttctccttagttttatatggctctacccttgtgccgttttggcctcaagttaaatcctgttcctccaagaagcctccctgaccatccaatggaaagcagccacccagcaatgccagatctcattaccctgtctcagtgctcagtgtggtacttattgctggctgatagggcctcatttatcttgtcaccaatgtccccagcactgaagcaatccccagcagatagtgtcactcaaatatttgccaagtgaatgaataaaaccagaagagttaggaagaaatgaagagagctgctgggaagaatctggatgttcctgaagtccaagactttatttttttaggtgggattcatcaaaaggaggcagtttgcctgaggtcccttccctgggcaaagagagaaacagggctggtctgactccaggcctgtctgtgactttgattgttttaacaagcagatggtatttttgtacacagtgacttggagaacttggagacgcgtatcaatgccgcctttcttccctgtcccttgcataacaggtttggtgtcttggatcaagtttggggcagcatcaaactgcgccactagactgcatcccatgatgcagggattatactgtattcataccctgcagtgtttgcacatagaagccttactataaatgtttgctgagtgaaaaacagtgaataaatgagcgaatatttaaatgacaagaactgacagtcttttgaagttcctctagggtggtgcttctcaaacttcaacatccatctgaaccatctggaaagctagttaaaatgccaggtgtgattcaggaggtcctgggtagcctgagaatctgcatttctaatgagtttccaggtgatggtattgctgctgttctcacctctcctttgtgtagcaaggctctaggatgtgtccaggatggtctatctacttggtcaaagataatcttgtgagttgactagtcatcaaaagaccccgatcacttctcagtttgtccaaaaaataacacatgcaactttcagccagttacttaacctcagtgatcttcagtttttgtgcataggtgaattggagatgggtgttaatgccccctttcttccctgtcccttgcatattatgcctgatgtcttggatcaagttttgggcagtatcaaactatgccattagatcatatcccatgatgcagggattacattatattcatactctgcagtgtcttgcacatagaggccttactgtaaatgtttgcagtgaaacaacgaataaatgagtgaatatttaaaagacaagaactgacagtcttttgaagttcactttggaggaacctagtccaattatcaggagatattatttgttgaacactttgtacctgctgagcttcttgatatgtgttacgtttacttatcacaacaatcctgcaaggtggaattattatcctcatttttttttttttttgagacagaattttgctcttgttgcctaggctggagtgcaatggcctgatctcggctcactgcaacctctgcctcccaggttcaagtgattctcctgccttggactcccgagtagctgggatcatagggatgcgccaccacgctcggctaattgtgtatttttagtagagacggggtttctccctgttggtcaggctggtcttgaactccctacctcaggtgatccatccacctcggcctcccaaagtgctgggattacaggcgtgagccaccgtgcctggcctatcctcattttacagaagaggaaactagtgctcagagaggttagacaacatgcccaaggtccccaagtcaataaccaggagccaatagcagggctctgatgatgatgatggtggtgtgtgtgtgtggtgtagtgtatgtttgtgttttcatgtgtatatgtgtgtgtatgtgtgcgtgtgtttccctcataccattttgcttatcaaatgatcctttaggttctttccaagtgtatgattttaggtcaaagacaaagcatgacacagttcactgtgaattgtgagttattatacaagctcgtgaaagagtcggataccttttctgatcctcaatataacctttgtcttctcaccaccataacacgttggtttctcttcaggaactgattttatattctcatgagcacatatgcagtttctcctatagactgtaagatttttaagagcaaggactgggtcttatttttcattttgttccctagtgtcttcgatccttattgcattcagtggtttgatttgaacagaactttggaagcatgagacagactctgtacattaaaatgcttccatagcactcaccatggtgtccaaagtgtcactaaatctctgcttgcttgagatttctctatcttaattaatcttgatttgtgctgtttttttgtgaaagagtaaatgcctgtgggagggctgggccccacctacggagaactctggtagtgtgccaagagcaggactgcataattggtgcatgtgacaaggaacagaggagggtggaggggtccctggatgatgggggtgccttccccttggctgtctttattgtgtccccattggcattactgttactgatcactaaatcagggaacagacggaggcgtgaggtaggatcctacgacagacagcctttagtgagttaccaatgacgccagagttgaccatcaagtaaatctgttgccttttgaaagacatgtctgtctgtacaatgctagggcctgagttgcttaaccttctagtaaaccatgaatttctctcacatgtccttggggtgatgaaaatcttcccgagttgtgcggagcacaaagtagaacctgacagggaatgttctgaaataattgtgtggatggtgacaggtaaaaaaatacactgtagagatatcgatcctgtacgaatgcaacctaagttgttgctctgttaagaaatgtttttggagttctctatacactaaaaaaagaagaaaaagaaaaagaagaaaagtggaaaagaagagatttctcttgtcttgtatgaagcagcaaaataatattctatcagaattgttttaaatatggtaaagtggggcacttctatttaaagggtacgtctttggttcattttttatttttaattgccctgatatctcttgcttttgggaaagtccgacgctctggctctctgctatctgttcaaccagccttcagtagaagtgggaacacaaatggctcattgttttaattttggatttccttaggctgttgctgtcacctagtcatctcagacactcttacagggaaaccagcactggcagggtgtgaaggtcatagcaagggcagcagtgcttcccaggatcatgtgcctggagaggtcggtatgccctgacttctaaagggggcctgccttccacaggacgagcacttactgagcgcttctcctgcacttactgtacattctcatccatatgttagttgttgttaccataaatgtcctcacacatctgtggcatgtggatgacaagagcttctgagtatattttttaactgtgtttttcgaaggcaactttaagtgctaacaatccagtggttatatgggtggctattgactttcagattcacggcactgttctgagtgggtaattcgccgcctttctctaactcttatgtccttgaggaacctgaatgtacagatgattacctgtacctactgagcatcctctcgcagagttggggcgataaatattctgcaaaacctgctataaaacagtcagccctgagcagcaggaaactgaatatagtcactcacatagctaaacccaggctcaggcctacattcacccctgtccgaagggggtggaaatgagatcatttcacacctcacgtggaagtgcagacctgaaagaagacttggggctcccccagcacaggtgtccccattttacaggtgccaaaggctgtggcggagacagagatggggagaggagttggccgtgatgcgtcgtcatggagcatctcacatgtaagggccatgagaagtgaggacagaagggcagccaggctggctggtcttcatgtgggccagttgagtgggaatgcggcactcatgggccggcggaagaatgagcatttgaggaggcagagttccccactcttctgaacctctgttttacaaaaggcttagaatataaaattgggaccttgtctttggaaaggagggagcaaagtgttaacctggacagctttggtgcacaaggtgagaggtttaccaagggctcacacactctccttcatgggagagggtgcttaggaggaggtctggctgctgtgaggtatgggacctgtccaggaccttctactgctacagcaggaacagcactgtgagggagggatgttgctcttcctatttttcagtcgtggaatggaggctttgaaaggtttggtaacttgctcgagatcacacagccagcgaggggtagcatgggattaaacaccagtcggctcgtctccaaaggcctgactgacaaaaacaaatttcaatcgattttacttttcctctgtaatagatgaggaatatctcatttcagaatatctgaaggtgacatttggagtcgctcattgattcaattattctgaatctttatttcagagcttatttatctcaggttttagatgtggaatgctccaaaactattcattggtttcacttccctttgcattgctaagtaaaggtgatataggagaactactcacaggggtgagcacagcaagggtacgaaggatgtaaaatcagacgcagcttttctatgcatctttcttaaacacattactcttaacccaagagacagtcaggatcattaactttcctaatattttgtaaagcattcatatagcaacatttggggcacatgcgcacctggtcttaagtcagggcaggagtggctaattaattctctgattcctcaggcttcacagtttcaaccagccataattattttgcaattgaggttccctctctgcctaaactggcattgttatcaagggctaaatgcatcagctttgtaataatgaagatgggtgccaattccatcttccatatgggatgaagttggggagagagatggtggagaagcactggtcagactgtaaatgatattgagtagaaagaagtcagggatttttgtttttaacatgaaaaagaaatagaattgtaactaagttgaagtttctttactgtttcatcttgtttctttacaaatttcatcttgtcatttacaagggtttatgccacatagctatggatttgggcccaatatttgaccttatagcagctctaaaatattagactgcagttaggaaatgccctctggatctgatttttaaacagaaccaaatgcattctactcttttctgcttttaagagtaacactgcttgaggatgcattgaagccctgctagacatctttgctgatatttgcctttagcattctttctggaggtatttagaccttaataaactaccattatcctttaaaaaaggactgaagagaataatatttgtagaaacaaaataatcaaatacagtcctacatcatttaatgttggggatacgttatgagaaatgcatcgttaggcaattttgccattgtgtgaacgtcatagagtgtacttacacaaacctagatggtgcaccctactactccacacccaggctacgtggtgcagcctattgctcctaggctacaaagctgtgcagatgtgactgtcctgaatactgtaggcaattgtcacactgtaagtatttgtgtatctgaacatatctaaacagaaaaggtacagtaaaaatgtggcattataatcttaggggaccaccatcacatacatggtctattgctgattaaaatgtggttaagtggtacatgactgtactagcattaaagttcttccgaactgagagggtggaatgggaacaggtactggcttcttgttttaagggctgactggtgaggaaggtactggcttcttgttttaagggctgactggtgaggaacttgccacacagagcagtaggctcaactaggctgaagacaggctacagataggctccagggttgacccagggccaagatacagcagctgccttgtcctggctcgctgcagacttggcatctccagtgcctgtatccctgaatttgtggttgaacttaagtttggggagtcccagtggccctaatgagactggaaataccaccctaaacaacctcctttagcagctaaactgacaataataatctgttgtttactgcacaggattgagatgagtgtagcaatctcctagacgaagggccaagctgctcacccacctgggtggggtggtcagtctagggcggcccaaggggattcttgggtcacgatgaccctggggctgataaccaactcacaaatacataaatcaacaacatgaggctagcttctgctggggctttgttgtctggtgggcctgagttttaatcccggctgacctcttactaagcgattgtgggtaagtcattctaatttttttctctctgagcctcaaattcctcatctataaagtgagcatgaaatcctattctagtcattctgagggacaactgaagtgatatatgtgataatatgaaatatgatagatgtgatatatagaactgtaaaacttttaaaaagtaaaatgcctgttaaattgttaaatatgtgtaatatgtgaaaaactcctggcaaatatacctactaatatccatttccatatagttcttttatataaaaggtagagcagtatatgtaaaccttctaataaaacacttagctataactatgaattctcatgtgctcttcctgctgtcagcctctcctcctgctgttaaatctttgcaaggcctcctctagttgttatgttctgaaaagattcaagtttgtatcctagacttcaaagttatgtctctcctatgtggtgtgtagtgtatcaccctgtacttggaggtatgtgatacaagaaactaaggaactaaaataattctttttttttttttttttgagatggagtctcactctgtcgcccagtctggagtgcagtggtacgatcttgctcactgcaacctctgcctcccgagttcaagcaattctcctgcctcagcctccggagtagctgggattacaggtgcccgccaccatgcctggctaattttgtattcttagtagagatggggttttaccatgttgaccagactggtctaaaactcctgacctcaagtgatccaccttcctcagcctcccaaagtgctgggattacagacatgagccactgtgcctggcccctacaataattctttaatgtgaggaaatatcaaatgaaaaataagaaattctaggtaaggaaagaaatttatttagtggaagtataaaagaagtttaaaaagttgaagaaaattttggttttcaatgttgatgcagcgtcctttgtgaatctttaaatttgtgaatgacacttttgaaaacttacaccttattctaagtgtctttgttcactttacactgtactgtaaagaatcacaagagtgtctcataaataactttctatataacatatgtatatttcaaaataacatgttatatatataatacatacaatttttgtcaattaaacagtacattaaaaagacaaaaataactttccataaatgagctcaagttatttcatccacagtgatagaatgttccccatttgatgcaagcagttaaacttaatttccattaagacaaacacacaaataacaatcctccttcccaaacttgaaatcccacttctctttttgaactctcttcatgaagtagtcccttttcttgcatttacaacataaagcctaaaccacaaatattggagggcaggggttgaggatgagcaattgagatgttcctcatgcccttaaaccaagagtccttatgttctctccttcctaaggatggcttattttcctttccatgaaatgactttaagggtgattatatccaaagggaagtgacgtttccccttctttctcttcagttggtccattttcacagcccacaaaagcaagtctctattttgggacttgattcaaagtctgaaaaaaccctaggcacatctttcttccttgaatatgttcacgtgcatattccaaaaaaggttctcattgctagttaggccattaattttatgtgatatccaaatcaaacagctgctgtactgtttaagctcagatcctaaaatggcactttgaacatgaaagtcgtggctgccactctctgggtgactatctggcgatgacacttctacctttgtttttggcttgacgtgcatatgccgaaggcttcagcaaacataaactcatacaaatgtttgtcaagctgtgtgagcctaaacagctcattagttgcaagaatgatcagatgggagatgggttgcccaatttggatggtgacctttatgagctctcggttggattgcagatttatgtgtcacagtatattggaacataatgaatcctgtggcatgtggatggtaaaatgcagggcagaaactgtgcaatgaagaggcaggaagaaggtggcaggtccaggagcataagagcagttaatcatctcctttcccccttcccctattctgcttcccctctgttctcggggtgcccattaaaatgcagttggtaatgaaatgctgtttgaaatcaaagttgctgaaacgatattgtggatattgtggaaatctgtcatatttattttaaggatgagcttacttccaggtgctttcagtgactgcagccccgttagttcccatgcattgattctctctcatgtccctgctccagggtaattctcttgtgctcaggcacatgaccttctagttgaaaacctgcccctgccatttctttatgtggctgcggcccagggagcttgcctgccctgcgtgagcaggttgcaatgataatggttcccagtgctgctcagtggggaactgaagtcatggtattttccttcatatcctcttgaagcttcattttgtgaccttgtttcatcctgctgaacctatcattggaattaccccaaaggtggtggcaggggagtccccagaaaggagtgccccaaactttcccaagatggggcctactgagattccaaagaaagaagcagtaaaagccggagtgatcaggccaaagcattcattaggggaacttaggcagagtgggctgcagcaatcctgcggcggcagcatgaaaaaaggggtcttccacctagaaacatccacagcgaggtgctcaggggatggagtttacatgagggtttaaggaatttggctcagggccagggccagtttctttcagtgttttgggcaaaagcttagatacctttatcaatgtgtgggaatgttcaaggccctggtttgggttcaagcctgctgggaaaaacctgcagctgtctgggtcacagagcggtcaaggcactctgtgagttttggtcacaacagaaaggcaagggctctaggggaccctccagaactacaggctccaatgtcagccccactttcccaagtacaaatttatttcagaaattaaagtactactcttactttttcacacatttcgaagtcatgtgttgacatggatagcctgtctagcacaggaaaactctgatctatttaactgatttaaaatgtttataattgattatctggataagtgtcattgatggcactccaggtgtgtgaagacgccactggcctgggaatcacgacatgtggggtttgtcccagatccctgccatgccatttaaacaccatgggcctcagtttcctcacagcaaaaattagggttatactagatattctccatggaccttgtcaagtattttttgtgatgctgggattttataactaacacaggcaaacaataacctagaatgattagaatcttgaaaaaattgtttgtttgtttgttacagagaatcttgaagttagctgaagtctgtttgactttcttccggaatcagcacagtccaaatgcagccatgacttctcactgtcagaactagacgggccacactgagaaagaatgtggaccggctacccggaatctggccgcttagtgcattcaagaatgctgcttggtttctatggctgtgatttccaagcattttctaaaaggtttatagaggagaaacctaagtgcctgccaccaccccaccttgaagtcaaatttccctgaaggcactggagcatagggagaaaaacatcagctaactcttgccgctataggcccgggttaaattgcagctgggaaattcattccagtggcttgccgggctaaacacaattgtggatggagcctggagaagcatccaagcaaacaaccacttgtgtcagttcagttgtttcaccaaaaaagcaaaataaaacagattttactaactcaattaataattcagttgccccataaaatatagcctcactgaatttcttgtcttgtcttccaagacattaagtcagggcttatttatagccatggctctcttccctggctaagcatccgggccacctgccccagcaggtgagcccttggtccaaggtggtcctggactcagcatgtttttcagagttctccaggtaattccaatggttagtcaatttatcattcatttggggctgattatcagtcttccatgtggataaaaccagttaatttcctgtggatcttttttgaaagccttattaagaggagggagccctgttttgaacttgtgtcatgagctctgcctgtctctggaggtggcaagggtgctcgtcttcattctggtctgtgtcgcatgctgtcttcctctgtctccctactctttctcaaccttcttatttactattccacacactcgctgggttagacaaccttttctgttgttctgctgaaggttacaatttggagtcgattcctgtagtcttcctttttctattcactttcaaaaaagatgttgcaaagtccaagtttcttcctcatgttccgtttctctggggagtgctgtagaagtttccataccttcctgcttctggccttcttagtattttaataactcctgccttgttcccaggtttctccaagtatctggggaaagtagaaacctcagagatggggtctggaaatgtaaaacgttgatgaatttcagggtcacccttgtgaaagctattgattggtcagaggtattctggaaaagtctgcaaaatccagaagctaatttctattttaaaatacaccctataactcttgagtgcccactcatcctcagctggctctggggaatggtgtctgagctcacggtctcatctgtgggagctgcatctcatcaacctattttggaaaccagcatacttctggttctgagaattcagcttaaaaacaatacctagtttcctgtataatccccccaccaaaaaaaagtttgcaatgtgccccatgtctatctgacacattttcacttgtttcttcattgatgatctaggtctgtccaccctgctctatttcttttctatttatctccattatcttagtctatttgggctgctgtaacaaagtaccatagactgagtggctcataaataacagaaatgtatctctcacagttctggaggctgggaagtccagaatcgaggcagtggtagattcggtgtctggtgagggcctgtttccaggttcatagatggtgccttttcaatatgtcctcccattctggaaggggcgagggagctctctggggcctcttttgtaaggggactaattccattcacggagattctaacctcatgacctaatcacctcccaaaacccctacatcttaataccatcactttggggttaggattttaacaaatgaattttgggagggcacaaacatcagtctgtaacatccatttgatgcctacttcaaaattttttgttgctattacatcaaaatctcttctggctttttctgaaagtggatttctatgtaaccactttttcttttcttttgcattatgactgagtttttcttcttaagaaaacaagaagcacgggtagatgatggagagcatgagtgccagagagtaaggaagcctgggctcttctgccagattttgtgttagtcgaaaactgaggacttggagggttgatgagctgagcttttcgttggggctcctctttcccatccatgtattgttccagcagtacaaagtttgtcaatcagagagaatgtgggttcccatggcaaggtggcttccagttttcatactctgtaaaaggcttagtgatggaaggagattaaatgtaatgctttaatgtggatttaggtagagatcttgtaccacagaaaattggaaatcaagggtgaaaaactgagaaatggagtgatgtctttttcttccatacaatttcatatttgcaaagtaaattaactctaaatagtttagggttttattccagaaatctataaaactttaaagaatcttggcatctgattgatttttctagtttatgaaaaactgacaatattctaagccaaagacacattcaacataataatgcaggttgagtatcccttatctaaaatgcttgggacaagaactgttttagatctaggatttttttttgaatatttgcttatttacctgttgagcatctctaatcccaaaatccaaaatccaaaatccaaaatgctcctgtcagcatttcctttgagcatcatgttggtgctcagaaaatagtgaattttgaagtatttcaaatttcagatttttggattagaaacctacatatcaaaaaatattttgtgtaatgtcttacgatgtgtgtgtttggagccttctcagggttaagcagatatgaaaagcccacgttttcaggaaagaatttaagaaaataaagggccaacattttttccctcctggctccatgtcataatatttttgccggctgcagagtctattcttttctatcttcagacttatcactatcaagcattttccattccccacaattctcattttttgttatctttttgcacttgcaaaaactgaaatttggcttgaatgagacacatttccctaccctttatctctcactgattcattccttgaattgggacaaatctttctaatctaagccagtttcatcctcttgcaatacagtaacctgtgtcagcagagtcctgtgtgggatgagtttggcagaattgcagactgcatttttggacctagcagttgaagatgattctgtccctcatcaatttttttccgcaagggcacttttgccttcaaatggtattgtgtttttctatttcctttatctaaagaaagtcttcaacttagttttgttctgttcctgtgaatgtcggcacaggaaagtccttgaagaacatgagaaacaggagcttcatctgggctctgtgatggtgccgttgtatgaattgaaatccatcagggtgggactggttatctgtctaacaaagatgcaatgagacatgattgagagtgtgcttcgggtggagtgtttcttacattttgaggttaaaagccttttctgtcattgtttttattatttatttatttatttttattagagatggggtcttgctacattgaccaggctagtcttgaactcctagcctcaagcaatcctcccccaccttggcctcccaacgtgctgagattacaggagtgagccaccgcacccagactctgtcattgattttgacaagtttttttttttttttttttttttttggttgttgtggttttggaagttttttctcagaaaggacatacttgactgaatttttctcagagcctaattattatttagttatttgtatttatttctttttgatttcactacagtagccactatatcttgagtaaatttagcttttaacttgctttatgttttggtagatcttagtgattatgcaatttgatgatgccattcaatatcaaggtcagaccacagcatgtacaagaggttgctgtcacgtgatagttttccattttcatctcttagtatgctctcttatttcttgctttgctcattcaatgaatgttttaagagtctgattgagatattacctcatagtagattactttcccattaatgtttgctcactcatctgtaggcctaggaagctttatatctatttacaacagcgactaggaccaatagtgtgctgttaaatgcttaggaaccagttctccaggaaaaaaaagtcctgattggcaacgtctggccatttccatagtgtaaatctcccactgtggctgatttccagctatttctggtttaacaagtggctcacaaaattcttgaaagtttatcaactggctttcaccaggaggatggctccagcacccaccacacctgacaacagttatattactttacggatgataaaaagctttatcatcgttttatttcatttctgatttacaaaacaaccctgtagagtaggtggtgttatacatgaggcatctgagactcagaggcctaagtggctggaagtagctccagcagctattattaggcagagcagagacggaatgctgcctctgagctgagcattcttggtgttctcatcactcatggcaactgtttcccattgtgaggattcccttagtggtgtcatatttggactccaaagaagtatactcaagaaatgactacttcgatggttttagcagataatttttagttatttgaggataagaataatagtctgcttatgaaagaacttggtaaatttttttcttctggttttcagacaccatttctgtcttaaaatgaagtatctggtgtatgattgctttgtaatattttgttacttaagggtggtatccagacaacccttagttaatgttatagaatcagaactagaaagacctcttcattcttcacttagagaggatttaagtgtctctggccatttattgggttaataatggtgacttcaggtgacccaggaaacatctggatatctttgctgcacttggaaagacatttagtttggtaatattttcaaatcatgtgatcatttcaaaatgacttgcaccatggagtgatgatgtgatgctggcagcagctgctgtttgctggagatttcgtgtgtcaggcacagttgggaatactttatgaatattagtttatttctcaccttgaaggtagacattgttctcagtttgttgaaatcgaggctcatgtaagtaaaaaatgcccacattcatagcaaataagtgacagagttagtctctgactctgcaaaggacttatatggcttttgtataataaagtcggtcaccccattttggtaataaaagggataataaaagaccaacatgtcttcattagcttgcagataagctccaagtttcagcacgtgcatagtttgtaatgccttcacagggtctgcaggctcattgccatgaaaatatagaactaacaagaatttagttttgattgacatagtttataaaatgttcttttttttttttttttttttttttttttttttgagacagggtctctgtcgcccgggatggagtgctgtggtgcgatcttggctcactgcggtctctgcctcccaggtttaagcaattttcccacctcagcctccacagttgctgggactgcaggtacccgccaccatgcctggctaatttttgtacttttagtagagaaggggtttcaccatgttggccaggctggtcttgaactcctggcctcaagcaatttccttgccttggcctcccaaagtgctgggattacatgcgtgagccaccgcgcctggcctaaaacattcttttaacaaaagcatagctttatgttgaattcaggtagattcgaaccattgcttttaataacacaatatgggttctttcagactcttggggtagattgaacttctcataaaactgtcatgggacagattgcaacttctttccaatatcagaatctctaggtgagttcatccatttctttgccctgggctttttaagaaagtagggcaatgagtccctggtttctcatctccgtaagaatgaaaggatgctggagccaaggtctagtctactgccagtttctccaggaacaatgtggaggaaaaggaccagtgtagatcagaagtccatgagcggaaactcagaatcaaagcggttattcaattcttcttttcttggaggaaatcactgtgtcgcctgaagagaaaaatgccctttgctcttgcactggggagttctgtttagtgcctttccacacaaaagggctgtactggctggtactatagactttttttatgaagatctttttcataaatccttttgcagagtatagccaggtagcagtatatgaacattggaagtgaaacagttttcgtcacacaaaattaacaataaaaacacatgcaactcatcatttataaaacgatacttgcaatttttcattattctcatttctgagggcaaattttcagatgaaaacagaaaggaattttagaagttttcatttttttttcctacatcaggcttccctatatgtcgtctgtataacaagcaccttgatctttcattcagttataagaggctcataagcgttgcctctgttttctatatattggtagtgtcattagaaaacctgagggggtgggccgggcgcagtggctcacgcctgtaatcccagcactttgggaggccgaggtgggcagatcacgaggtcaggagattgagaccatcctggctaacacagtgaaaccccgtctctattaaaaatacaaaaaattagctgggtgtggtggtgggcgcctgtaatcccagctacgcaggacgctgaggcaggagaatgacatgaacccgggaggcagagcttgcagtgagccaagatcgcaccactgcactccagcctgggtgacagggagactcgtctcaaaaacaaaataaaacaacaacaacaacaaaaaaatctgaggaggtggacaccattttttggtactgaacgacgtgatgaccgtttaaaaagaaaggtagatgttaagaaggcttccttatacaaaaattcttgtatattgttccttccaattttatttttgttttgatatataaaatcctatgttaaatctctcatcctgaatatcagattactccagaaggagaaagtagcagtctaattattttatttggttgcatggtagtcttagtacaattaaatctcctttgaaagtttctcagttatgtagttatgaatagcactccacaccacggctgtggtagacctggagcggtattgggcccaggtcacagaatgatcacggaaggactttagagatcacctattgagtccctgttttagagaggagcaagcaaaggcccagagaactcactccatttgccgaggtccgacaagtgtgtaggtgagctggagccagaaccctgtctttcggtcttcactctagagctctttccaaacaaacatgctgacctgggagtctgacaattgctgtatgctgatgtttcctatttgaagtccacatgtctttgcaggggaagagaactgtctagtatcattcgttaatgcccactcttcatgtttgccaaagaccaccaatacattgggcagtgattgtgttacactggtttgtttatatgtcggctttcagtgatgccagaaaatcaaaaggaggttaagaaatcccagaggttcacccaggatgggaggctaaacctttgttgtattatgagtcttaattcaagataacataatctttagcctaataaacattaggttgaattttgaaaatgtaaacactaactgatctgtagactgacgtctatttccttggcaatattggccacacccattaaataataacttctcattctcccttcccccagcctctggcaacctctgttatactttctgtctctgaatttgactactttaggtgcctcatataagtggaatcacatgacatttgtccttttgtgatacgatattttctttaaaaagaaaatgaacagaaacagtacatgagagaagtcaggtctgcagccagtgtgcctcttagttccatattcatacaaggccctcttggaagctcagctttggagttggatattatctcagaagatatggcagcttaggaatctggtactctaaaaacagatttacaagcattagacttttttgtatatgtgtgtggtcattttagtcttcctgaaagtggttaagaccaatatttctaggcagactatagttcacatcatccagttctgtaagtcttggattatcgatctcattgtcatggcaaaaaaggacagggattactcaactcattactcctgtgtccagacctctgagcctggtgtgtgtgtgtggctcagtgcctttcccatagtggcccacatccccccagggccctgcatgaagttcctgcaagtctaccccctgcacgtgcagagcaaaaagagcttcctatgggagctgttctccagaaaagacagaaacccgggccctagagaaccagaagatttaaattccagtttcagctctgccattgactaattaggcaactgtaggcagttcactttgctcctttggaccagagatttctcatctacaaaatgaaaaacttggatttaattatctctgaagtcacttcaagcagaaatgtaacaattctttgatttattaaaaaaaataacatcaatgataatgaccaacagctaacacttattacaaggctccaggcactttcgaagtccttaatatttaatgttcactactaccttaggatataagtactgtgatgcagagtcctggacacagagaagtcagcaacttgcctgaggacagcctgcaggacacagcactgtgatttgaacccagagagtctgacttcagcccccagcgctcaactactattaattgaaagggcattgaagagacatgatgtcacaataaaaagaaaaaaagaaaagaaagcatgtcttcgactttctagtcgtcgtgctttgtatggattcttctttcaaccttgacgaaagggtataattaatctgtaattaaagtcatgatagtttcttaatacgaggaaatgttgtcattgcggttctctgaacacaagagggcgctgtggcaaagcttaccgtctgctcatcctctgccgcaggagggtacaacttcgtgggacaaacttcaaaagaaagatgccatttctaagacctcatttatcacctcgggatagccagtcttcatgcctttaaaatacagaataaaaataacacataaatcaacacaattacattccttcttgatagcatcaccagtcttcttgaggcctggcgtcaaacctctgcttcagtgttacgttatggggtgcgcatgcctccttaatacccaccttgctggtattctccagatggctgtcttcttagcagtagatggaattaagcaccataatgagggatattttatttaaatctgctttaaaaaaatcttccatgacttattcacatgtctggttagctatcacactgccattccatgtgatcggaaatgagaaagatttaaagaaagtaattgtttagcatgcaacggatgtacctcttttgcttcagatgagaataggcagcatagaagaactggggctgattcgtggaaggtttcccgtagctagaccctggaggctgtaaaaagtggtttggaactgtgtttaaaaaataataataatagagggaatagtgaggtacccaggaggagcagagagcgcctgttccagccatgggagcatccccatcagatacatagatgctcttaattaattaggctgctagtaaaccctcctgagtgtgcaagacaggaggaattcattttcaagctttaaaaaaaaagatgagtcttgggcacacagccctgtggcccatttgttattgtcgtgttacccataagtcagcagttttcctctcctgttgttgatagatcttcccatacagttagatttgtttagaaagaaaagttttaagtccttgcaaatgattacaaactgaagaactggaaaccctggttaggaaacagttggagcactatgtatggcttaatgaaaggacacagtctttttaatccaccaagcctgaatcatcagcttggttaagactatctgtagaaggtgagcagagcacttcaaacctggctattcgcaagggagagaaaaaagctgccactgtccccttagcattcctctgctaatcttccatttgtattgcaataagtgtgctttggcattgagtgtgttttaaagctcctgcttagctggctgggggacaagaaaaaacaaaacctcaaggacactcccactcagaggcataaaaaaataaacagttgtttctgcttttgagaagaagtcacatgcatgtggctggcattctcaggtgggcaaaggagagtgctcggtagcacctgccccaaaccctccgttctcccctttttaggtcagaagagattctgctttcctatcttgtctccagttttcactcttagtccgtattttccctccccttttccactctgtccttaactcctctttccctctttcatcgttttcctttatttttcatctctttctttattccttctcaagggtttgccggtggttttgctaggcaatactgagcttcaaggccattgtcatggaagtttccagtcctgggatgtgcttagaccagcctttaactatgcatcctcaaaacagctggcagcctaatcaaaccttattttttttctctttgtgagagaggtgaagaagatgataacatgaaatgaaatctagggcctttagaaagagtcagcaaaccaggcgcagtggctcacatccataatcccaacactttgggaggctgacgtggggatcacttgaggctaggagttcaagaccaggctgggcaacatagcaagaccccatctcttatatatatatatatatatatatatatatatatatatatatatttagctgggcatgatggtaagcaaccatagtcctggtcactcaggaggctaaggcaggcggattgctcaagctcaggagtttgaggcttcagtgtgctgtcattgtgccactgcactccagcttgtgtgacagagtaagaccctgtctctaaaaaggaaaaaaaaaaaaaaagagttaccggttatacatttttgagaggagcaatggggaaatgcaatcatggggtaataataatcaggacaagagcaggggtatgtactgtcccccaccctgctgccctaaatgcgaggaagaagccacgttgctggacccataatgagaagcttcagaaggttgatagagagtgctgatcttgaagacatttagtctgggacacagactacatatcagcatgtcaaacatatcagcttgcttgaatgaatgagtgaatgaatgaatgagtgaatgaaaagtggtgaaggaagaagatggttgggtttgggagaagaatatgcctgaaagatatacaaccaccggggagtctgtcttgtctttacagacacttaactcaggaacagacttgctggttgtcttgagtgtgaagtgcaaaaagtaaaaatggccctcaacaaaaatataagtcaggcctgtgttagagatgtcaaagatgaagacctttatgatgatccatttccacttaatgaatagcgtcttagtccattttgtgttgctataatggaataattgtggctggggaatttataaagaaaagaagttcatttggttcatggttctgcaggctgtacaagaagcatgacactggcatctgcatctggtgagggcctctctctcttgcttcctctctggccatgtgatctctggccagagaggaagcaagaaagaggaggaggtgccaggctctctaggggaactaatagagtgagaattcattcacccccgagggagagtattaatctgttcaagggtgacctgcacctatgcctcaaacactgcccattgggctccaccttaaacattggggagcaaatcttaactttagctttggaggggccaagtatctaaaccatagcagagtctctttgtgatgatcttgagatgaaattgtttgggccttggttcctgagaggggtcttgccttattcagcagtcatatttttttctagataaaattcttactatcctttagacctggggagagcccgtgtatgaaaaacagaacacaaagctgaactttaaataggaaaaagctagcaaagggactacctctgggggcactacttgagcctgtaagcagtggttataggagatctgagagtacgggggtcctagagacaggtcagttcttagggtggggcaggatataagaaagggagagtgaggaaggctcagaagatgaggtttgaacacttggccaccattttgcctgggatcatcaggggaagctcctgatatgggaacatcactcccaggcaggacaccaagaggcaaaggccagtgtgctctatttagtaagaaggtaagataagggccagtgtgataagtgcatggagccccatgggcatccaattaataaaacagtgatggaccactacaatttaaagtcctttcttagatgagctaggcaaaaggttctaattagagatacctgtcttcccctcttttccctataatgcatccaaagatctcaggtgtaatagatttgcagcttgtgctaagtagttggccagagtgtgctggcttctgtgacctacgtctctgagcggcccgagctgtctgttggtgttatcctgagctcgttgtgggaaggcggctggagcagggtgtgctgcccatctgtggctccatcagtttccataaggcttcagcttgatcagtgcagcacgaactgtggcatgtttggggcttgggagattgacagccccccaaaaagccctcaaaacatggtcaagaggacaaacgagaatgatagacatatcttcactattgccagcctattaacctattacaaactctgtttttagagattagccattagtttttccttccaaaattattatgctgttgtcatttcctccacaaactgagatatgcctggtgaaatgacttaatttaaaaagtaatttagattatattttaaagaataaatattttcttcaaacttatctgattttcaaacgatcatgactttaattttgctctagtaatgcactttctgagaataaatgggaatctcagttttgtaatatgtacccgcatttttcttcttacagctattgggggtgcactgttggggatgtggtgggggctggacctgtgtggaatagggcagatactgtgtgcgggtctccacttctcaaaggagcttcaaagctgactgcactcattgatgcagcgagcccagggccttgtgatgttccctttcttgttggttggtgctggaaagtctagagtcacagactccttttggactaggctacaaatgcatatatactttgcagagcattgcctattagtcgccattctctcctcagagtgtaggcaggttccgagggcagcacctaatgtgggaagagagaatagaaggttctggggaaggggacccactctgggcagagggagaaggatagggaggtggtttggggaagaatcacaattatccttactttaattaatacatttccttggatggcaccaacagtgaacacagccacacgctcttctgcccatagtgctaagtgggttctctctttgactagaattgtgtcgttgatgtggaagtgcagttgaattcaaacgatctgtagctggtggcttttattcctgaagttcaaatatagacaaccctcttagcaggttctaccatagttagccaaccatgtgttaatctccgcctctttgtcttctgtcttaaaggaagtcaggccaccctaaatcgcggcctctcatgtgtgcctgactgtggagagtgtgattttccagcagtctctgggtctctataatgtttgaatttgcctttggggtgcatgcgtgtggtatgtgtggcatgtggggtcaggggtggtgagaccagctctgaattgtttccagggcagcttggtggcaccctggccagatcctgcatgtgacatttcccaacaactctttctggtctgtgtctcacctgtcataattcaaaggagagccatggactgtgtgcgctagattcaccttcagagactggagagtcccatctctgtaccacagtggacacctggacttcctctggctttctcttggggactctgccaggcagaggccctcagccgtgcactgggacagttctgtgggcagtggcaggaagccttcagtcggtgaacagcgtgaagacagcctgatgcatgcaaggcgtggggatgtgattgtgtgagcagatcaatacctatatctcaaaaatgagaactttcactttagtacttgatcacttaccctattgaattatgtaagtacttcagtctcttcaacattggctttctttcattctttgtttttttaatctcccatcttagtaatgaaaaaaaatgtatgtgtcatgtggttcttttgtaaggttatttctctccatttgcttgaaaactttcttattactcctaactccttttattgatttaatgaaaccaaatgctcctgaaagtttgaccctgatctagtgatacctgcactctctaggtccctaaaagaccccacagtctgatgctttggctgcagatggagtcacagagatgattcagctttaaagtgtctacatcatagattggaaaatgcctttctagggctgaagttgtagctgtttcctagacttctgtttattttccatttctttacccactcctgtttgaaattctgctgttgtttgcatactgtttgcctttgtgtccctctttccatctgttcttaaaaaaaaaaaatcaactgagttttattttaaaccaatccagatgacaggcacacagtcttcacaatgctttggaaaccagttgaagaaaattctcgttaaattactcatccacccaactcattttccatacatgatctattgttggggtgcctgcctgttttcaagataagtgcatatttcagaggcaggttccttttaccccagataagcaattatttaagaaattggctttgacatacattttcagttttaatttttccttttacattctgaaataatctctggttgcatgtagcttcccactactgcatataaagatgtattccaggcatccgtcaggagtttgtctattccatgaagaagacattgctgtggaagaagatggtgggaggcctgatgtcctttctgtgcagccctgcaagggccttcacctccagggcctaatctcacaagcaccgactctgcactcagatttccgacaagaacttccgctgtaaagtggccatgttaaggagaccttgggaagaacaaacccattatctgatattgagtcactatgaaagatttgggagtctttcccattagtgccccggtaagagaggcacaagaggatcatgcaaggctactaatctccatttcaaagccaagaagaggtcatcgatttatagtagggctgcagatcagaagcaaagcggacttcagcctgatagcagtcaaaagacttgtgtttcagcccctttctatgatgtcctttgactagcgccccttcctgtgtccctcccctgcattccatagcattgggtcttctacaagggaccaattagtgatttgaaaaccaaagtgaatagagtacttataaaatctggtggtgcactcacaggaggaaatgagttgggagggtttaggaattgtaaggacaagtttactaatgagaaggcaggttaggaatatccttaaggaaaatgcagatgacaaatttccagctatcaaggaaaacgggttcaacctcataattagatcattcccgcagagccaaggaactgcaaaacacatggatcttcactgccatgggagactgactctaagaagagaaagttgtcagaggggttctgtgtggaaaatgtaattggaatccccaaattatgacttctatcattggaagagggcatcttaaataatttttttttttgagacagagtctttctctattgcccaggctgaatgctgaagtgcagtggtgtgatcttggctcactgcaacctctgcctcccaggttcaagcaactctcctgcctcggcctctgagtagctgggactacaggcatgcaccaccacgcccagctattttttttatttttggtagagatggagtttcactatgttggccaggcttgtcttgaactcctaaccttaggtgatccacctgcctgtcggcctcccaaagtgctgggattacaggtgtgagctaccgtgtctggccttaaataatcttttattttttatttttgagaaaaagtctcactctgtcaccaggctggagtgcagtggcacgttcttggctcactgaaacctctgcctcctgggttcaagcgattctcctgcctcagtcccccgagtagctgggactacaggcgcacaccaccacgcccaactattttatttttattttttagtaaagatggggtttcaccatgttggccagggtggtctcgatctcttgacctcctgatctgcccacctcggcctctcaaaatgctgagattataggtgtgagccaccgcgcccagccaatattcttaaatagtgatgttcaaacacatggcctggccaaagacttcctaactcactctcattgatttttgtcccttccattcaaaaacacttgttttcatagtcctgtgcttcaaaacgataaaacaatttaaccctgtattaaccatctgaattattaagaataccaggctgggcgtggtggctcacgcctgtaatcccagcactttgggaggccgaggtgggcggatcacgaggtcaggagatcgagaccatcctggttaacatggtgaaaccccgtatctaccaaaaatacaaaaaattagccaggcgtggtggcgggtgcctgtaatcccagctactcgggaggctgaggcaggagaatggcgtgaactggagaggcggagcttgcagtgagccgagatcgcgccactacactccagctctagcctgggtgacagagtgagactccgtctcaaaaaaaaaaaaaaaaaaagaataccatagcattaagtgagataccaatgaagacatgaaaaaaatctccatcagaaactagggtggagacatcgtaagccctcaggatccaggcagagcatcatcaggatgtggccatctggttctctgccaaccttatgctgtcctctcacttgtccaacccatggatatcaacattgatagaaaaatcaatctctatctttgtaaaatctgccctgtctgtggcaagctgaatttttattaagctgtaatgtttggagtagatgatccaggatgctatggtcagtgatggggagaggagaagactctgcagctgaacctgtggggatgtgagccaccagcccccagccctggtgagtgaaggccacctgtcagctgagtaaggggacatgagccaccagcccccggccctggtgagtgaaggccacttgtcagccgagtgttagacagccaggggctcctcatcctgctgcctgggcgctctggcaatgtctgctgctgtaaggatggccagctgcctaccaaggtttgaaatcatgagcagtattgaccaccccttgggtacttgggcaattcacttccctggccttgacctcacttccctggccttgacctcactgttttctcatctgtaaatgagaaaaagagttgagatgatctataaatttccctctaacacatctaggtctgtcattacttaaacatattagtttgaaggaactaaactgtactccctctgaattaccaagtacaaggctccatggtcattttcactctcctgtctggtgacagcaggtgtggcttggctttgctcttctccttccttccaactttctcctaaggtctataatggacaacttagatcattcacaattcccccacacagtttggcttgggaattggggccacaaataaagaggacaaaagagggaaaaagcataaagcaaactgtaccagaaggtatgtgaatggcgaggacacgttggctaatggggccatggtgtagcccattaactcagcttcctaggaatgctcttgaactagtttctatttggaaatgactgataaatgtgggctgaaaaggcccgagagccccaaaatacagcaaggacactctgaaggaccccctctgatatacttgggatgtgtgtccctgcccaaatctcatgttgaaatgtaatcttcagtgttggaggtagggacctggggggaagtggttggatcatgagggtggatccttcatgaatagtttagcactatcccccgcattgtactgtcctcacgatagtgagttctcatgagatctggtcatttaacagtgtgtggcacctccccgcttgctctcttgctcctgcttttgtcatgtgatgtgcctggcctctttttgccttctgccatgaatgtaagcttcctgaggcctccccagaaaccaaggagatgccagcctcatgctgactgtaaagcctgcagaacaataaaccaattaaacctctctttttaatacattacccagcctcatgtatttctttatagcaatgcaaggatggcttaatacaccttcccatctcatatgtcttttaacatcttaagttcatagcaagatgtagcaacagtggctgcagcctacagagcaagcttgccttttgtagaaatggtgtaattgccactgacccgtgatagttgcaatctgggttttaaagctttgtgtctgaacactccacacgttttagcattcctgaatcctagaattcagtgctgcaaatgagtttcaagagggtttatggttttcaggggccatagcaggctgtctctgaagccacaacagaggtgggcaggctacagctggagtaatcatgactgattcttttctgctgctgcctcagtgacaggtgtgtggatttactttgtccctcccacctttctttgcttcccaccctcattgttaatggtaaagcaaaggcttagggtaatgggcagggtgtgtacagggtgcccactgctaaatggttccacctgggtggagacaggcctgatgggagccacagaagagtactgatatcatagccatccaaagggccactctggagggagagcggagagcagactggggttacatgatcagtgggtcaagtcagcagtcacaaggaaatctccccaacaagtaaagaactaaaaattagaaggggaagatttagtttaatataaggacccatttcttatcaagagctctgtgacacctaccattctcaggggtggctcacatgagcccaccttcttactgcagagaccaaccttgtacagccaggaaaatttactggatgttcacagacatctttgttgtatattcctgacataggttattgacaagcactgttacggttttgagcaccaagagaaaaaggtcatgttgtactagtgaatcaacataagtgtaatggctaaattcaatgtacaatgggactataacttacctcctttactgtttaaagaaaagtcaagatacacgcattcagaattttgtatttttatcttgttggcagagggaaaaaataagtattgatgtaatcccaccaagtaaaggttaaggtactcaagttaggctgcttgcattcaagtcctatttctggttcttactaaccagctttcaacgcaatacttgaataccatgaatttctggttcctcttcccattggtgttcagtggatgttaggtattaatgttattttaggtatactctatgagactgtatggtacagctgcccactatcagcctattggtggaacatatatgttcagatcagtttttttcctccatgtaactttgcatggttgcatttacatttaaaacaaaaaacacaactgaagaataggaatgcatgactgatgtgcatggaatcagcttatttcgactgaacagatgaaaataaaaaatgacttaatagctaaattcaaagatataaaatgagtgcatggtaaatggaaattgagtggtaagtatctcaattcatattcactgagggcaagatgaagacaaatgaactcaaattgcagcagaaaggaattaaacattaagaatcaaacttcttaacttcagaaaatagtcttttgaaatgtctgatgcaaagaaatgacactgataccttaaaacagttcattcttttattaatatttattaagcatattctatcaggcaggtgctgggctcggtgctgcagatacagtgatgaacaagacagataggcactctgactgcatggcccatagtctagttggagaggaaaacttaaaacaaagacacagacaggcaattataaattgtgacaagtgacatgaaggaaggtacaagagtgtgaaatggggcacctgaccaggctaggggcagggcacagagagaccgccctgaggaagtgacaagttcagatctgagggacaatagtaacagatggggagaaaagagcaccagaccctctgaacaagcaacctgtgcaaagactgcaaggccgcagggggttgctggcttcaagggatggagaaaagaccagtgaggtcagcagagatggggagctgagaggggtagccctgggttcaagacacaggcaggaaccagactaagcaggttcttgaagcaagtgaaggactttcatctttatataaagggcaatggaaagttgtcaatgtcattgtcattttttttaaatgccttttttactggagtgtaatatgcatgcaagaaagcacccataggggtgagctgggtgaatttcattgtgaacacatcaagcaaccagtaccaaatcaacaagcagaacattattaaccccccaaaagtcacccttagcccttccaagtcctcagcatgttccaaaggcaaccctatcctgactggtaacaacactaggttaattttgaccatttagaaactttatataaagggagtcataccatatttattctctgtgcctggcttctttcactcaacaacatgagactcatccagattgctacttatagccataaatcactgtgtgaatagaccatgatttaattatcagttttgctgttgtggacatttgggtagtgtctggctgtttggaacagtactacaggttgagtatcccttatctgaaatgcttgggatcaggagtgtttccgatttttttttttttcagattttgaaatatttatatgatacttacttgttcagcattcctaatctgaaaatctgaaacgtgaaatgctccaattagcatttcctttgagcgtcatgtcagtgttcaaaaagtttcaaattttggaacgtttcagattttgagattagggatgctcagactgtactatgagctacttgttgattctatttcacctgatcttcggtgtttttctaagagtggaatttctgggacttaaggtatacatatgttcagcactaatggatcctgccaagcagttttacaaagtggccatttcaatttgtactcccaccagcaatgcatgagagctcccttaaaaggtttgctatagccagtgatgtgatcagatctgtgcttttcaaagaccatatggcctcctgtgagcagaatgggctaaagaggcaggagtgcctggaaggacctgtgggggctgtgatggtaggtcaggcaagcagaagacagggaaaggccaggatggaaagaagtacatggacccaggagagatgggtggggaaatggctgatgggctcagggaatgttttgggtggggggcatggtgggcaggagaggggagaggtgacaagaatgaccctgttcaagacataggcaggaaacagatgggtggtctatgattggttagatggtagtgtttgaactctggagatggatcagagatggggaggtgtggatcataattctagtgcattaagagtacataatttgaggtgcattagctatgtccaagtgggaatcaaggaagcaattagatacagaggtctggactcagagtgaagtcccaatggacatgcaaactggagagtcattatagcaatatgggtgagtactatggtttgaatgtttgtgccttccaaaactcatgttgaaatttaatccccaatgtggcagtattgagagctggggcctataagaggtggttggatcatgagtgctttgcttttatgagtggattaatctattcatgaaataatgagctaatgggttatcctgtaagcgggactggtggttttataataggaagagagacctgtatgtagtatattagcatgctcagccctctcaccatgtgctaccttgagactctacagtgtccccaacagcaagaaggctctcaccagatgctgcccctcgaccttggacttttcaatctctgtaactgtaggaaataaattccttttctttataaattactcagtttcaggtattctgttatagcaataaaaaccagactaaggcaatgaggaaatgtcacctgggttgagagtagtgagaagaatgtctcattttgttatttcttagtttgagagcagttattcaaattaaagtttgaatatttaaaaaatttttgctcttgattttatttcaagttaaagcttcttaggcatgtgtttatttgtagggcagagatgataacactgttataggaccgacaggttcgtatgcccactgcacagtaatagacccattacatggagacagcaggatttgcagcagaaaaagagttaaaggtcagtgggcaccaagtagagaggggaggagaccctccaatccatcttcccaagttgttctgggttggagtttttaaggggatcatggagagcaaggcaaggtggggggggggtgaaatcatcgggatgtggaaactgtattcttgggtgggtcagctcctaagggatccctcagaccagctgagtcagccattccctcagaatgcaggacctgaaggaatatctcataggaaaaacttaacgtttcatgatgttcaaggtgttatcaatagagcagttaaggggaactgtgatctagggtctatgtgattccaagacagtaggcagcaaacaactctgaggaaggggttggagcccaggctggcctcatgattagcgccgagtgtgctgcaagctgggtttattttcctttctcccctctctttcttccctgacgaattttatttaaaaaaagtttatagggatggtttcaacaccatgctgtgggcaagagaagagagataccttgttctctgctgcagggcaccacagtcaccaagagtggactttccctggcaacagggcctctgcattggtctgcttgagctgccataaccaaagaccacaaaccgggtggcttaaagaacagacacgcattgttgcactgtcgtggaggttagaagtctgagaccaaggcgatggcaagattgcagagctctagggaaggatctgttccaggcttctctccttggcttgtaggtggccgtcttctccctctgtctcttctcatggtcttccctctgtatctgtattagtgtccaaatttctcctttttattagaacccagtcatattggattagggcccactctaatgatcctgtttgaactctgattacctctgtaaagaccctatccccaaataagttcccattctgaggtcccaggggttaaggtctccaacagaccttttatggaggggggcacataattcaacccatccacactcccagccagggtcccgcttcaagacgagcacttcctcttccttcaccatgcactggggcaggtgactctaactagtgcccatttcgtgtctcattctggaaactatgccgatcagtcaaagtttccagagccagtgaaatgttctcatcacacgaggcttctgaacacccagaaattttgaagcaagaacatgacaataatcatcactctcattcactgtgtgccatgtccttgcaagttcacagctagcccttacaacagcctgcacaggtctgattttccactctgcttcattgatgagcatctgagacgcgggagcataagggaacttgcttgaggtcacatgcttggtcggtagagactcagggtctgcgcccaggcttgccagcccatctccactcctccctgctgtgggcccagggcacagcggccacaggaggacttggctcttctttcaggctttgcgggcacagattagctagacagagtaaatatgggcatagcgattgttaacggctaacttttgggtgaatgcactattcttgccatctcaggctgatttatttgcagcactggtagtcagggtccctatagcaagggaagagataatctctaaatattccctggagccatgagaaacggccaggtaaagaagcatccttctttcagctggaacacggcgatgttttctgtcacctcaaatgaggtgatctccagaatcccctcaatcctgtctcattcattcaggcacaaaaaaggagaaacgtagttgacaggaattagatttggaaatctttcagagaaaatgtgtttgatttttctgtcccacacctcagcagtttatttcacactgcgcttattggtctctttgtctcacttctccttacataaatcctctgggtgtcgtttgaataatcaaaacgtattagatatgaaacataatgtgtatcatgttgcatcatgctactgtacctgcatgttgtaatttgtaccttatttgctgtctatgcaatgaaaaggctttcaagtttttaggtcagaaaggtttaatcactgtccctagtcaggtttgcagcacagagccaaatggatggtgtgcatttggacctgcccttggaagtcaggctgtgattagctagggcaaaagtttccttatctaggtgtgaacgtggaatggcctgaaatgtgtggacagtctattatgtgttcatcactgtgcataatgatgggcctgtagggatgtctatgacacgcaggatacagggctgggcacctggttgttggtatcagatatgtaggagaagaaggaatgggtgggggttggagagaacacaagcacaagcataagacggttctgctcccaagaggctcattcgtcactcagtgctgtagacacacgggagctgccttagcacagagcgacagatgccatgagacaggcgcccactgctgatgtgggcagaaagagatgtgcaagcgaagggcaacagatttggttgctgagattaataagaggaatcaagaaatgctcccaagagaaaaatgatacttaatctgggtcttgaataaccattcattcattcattcattcttctttctctctataatattaattagatttctgctaataagtacctagaaatgttctaggtgtaggaaattcagcaatgaacaaaaaaaacccaaccctccccccagcaaccccttgccgtcgggagctcacattcctataggtaagtggtagtggtgtggagaggggctggcctagtgaaaggaacagtgccagctgttgcacagggacttgtgatgaggttggtgtgagtgggtggccatgtggggcaggtcagagaggaggcatcgagttgccaggtgctgggtcccacatgaggagtctgtgtgccaagccaaagagctttctcctgaaggcctcaaggggccactattggtctcagcaaggtgggaggtcatattgtcagacttgtgctgggcaggtgggtgcaggttagaggcaggtgaggccacaggcagggagcctgaggcctggtgagagctggtgagagaaattcaaggtaaggatgaggatttcaggatgagtctcacttgctggcttctctaactacatggggatggtgcaattgactgagggtaggatagaggaaaaggatcaggtgcaggagaaacatgatgcgttcagggttagccaccttgcttgtgaattctagaattctgccagcctcacctgagagcccctcagaagtaagaggggcttcttactgtggaggaagtgtcagaatgccaaccaaagatggccagctaaataaatgacatgcctggtggtctgacatgacaaatcctgagggtcccttgcccagggtgggtggcaggggaatggcagttcacattcaagatctaagttttgagagataagaatcatctcctttggggtggggcagctgcattccacactcgggacccggccactcagtgcggggtgatggtgcagttcccagggactgatgtacctgctctgcagtggcaacctccgagtgtgagagaacccagctcttttttggacaattttgcatctgactcattgttggtatttgataacatttgttatgctaatataacaaatacaataacaggaaaatcagaaaatccatgtgtactcaatgtttagctcccacttataagcgagaacgtgcagtatttggttttctgttactgcattaatttgcttaggataatggcttccagctccatccatgctgctacaaaggaaatgatttccttctttttttgtggctgtgtagtataccatggtgtatttgtaccacattttctttatccagtctgcccatggatgggcatttaggttgatttcatgtctttgttattgtgaatagtgctgcaatgaacatacgcgtgcatgtgactttatgatgaaacaatttatcttccttcgggtgtataagaacaatagacgctggggcctacttgagattggagggtgggaggagggtaaggattgaaaaaccacccattgggcactatacttgttacctgggtgatgaaataacctctacaccaaaccttcatgacatgaaatttacccatacaacaaatcatacatggacctccgaacctaaaataaaagatggaaaaaaaaaaaaagaaaaccagaatataatctgagttctgtctttgtgtgatccggttttacaggaggaattaacctgggatgggggaaagaatgcatttagtgctggaatatataaggagaggctttcctttgtcccctcctctcttctctctcccccaggattttttgtccttccgtgttccacctgatccatggccaactggctttagaagttgttattaatagttcaccatgctcattttcatgaaacagagggaaaggcagcctcttcatttgatgtctagttagcaaaccagaggtttgacaccagctggtcataacagacatttttaataaaacttacctccaagttaaaataaaaatgctgccttagagattttgtcctgaaacatacgaaaaaatgacaggtgggatctctcatgcaaaacttctgctagggctaaaggaaaatatctgataaggttgtttgcccatgggggaaggattaattggattttctgtcttgcccctagtgtctgaccctctgttattatgacaggaccacagaagttttgaacgctgaatcatagtttatagttttagcatttttgagctatggagataagagtgagggaaggagtgtgataggggagtgagttcccacaatactccggtgatagttattgtctgcctgaaaatgtgaatacatatattcaagcccgatgtagcctgttcgaagcaacccagccgggcaatgaaagcctcagctgaagatcataggattaaatccaggctcccctctttcaagtaccttctcatgctactgcatttatgtgggtagtctgggattatgtctgtggtttgtttcactattttctggatcacttctgaaccagtccgtgtgtcagtcctgtggatatgcatttcatgaatgagactctgaggaattttctaatagtgtctatggtggcagtgggaaaaggggaggaggcagagaaagaggtggtagcaagagaaagaactgtgtggagctcgagctaaaagcaggagctaagactgcaagatcaaatgattcccactcagttgtcctagtctctgtctttgttttctgtggccataacagaacaccatagatttggtaatttataaagagcagaaacatatttcctcatcattctggagactgggaagttcaagatcaagggctggctcaacagaaggcctcttgctgcatcatgccatggcagaaggtggaaaggcagagagggcaagagaaagcaagcaagggggggccaagttgtccttttctaatgaaccccctcccacagtaacggcgttaatccattctagagggtggtgcccccatgacccaaacacctcccattaggccccacctcctaacactgccacattggggatcagatttccaacacattaactttggggacacattgaaaccatagcactcccctatagcaatgagtaatatccgcatagtgattttacttattaaataatattgacatggcttcctctttatggtttgctagtggtaaatcttcaaaactcttgggtagtttctgtggatataaattccaggtgaggttagttgttaaggaaagaatttccatgaaagaaaaacgtgtctgagttttgaataaggaaagacatacattgtgggtaactgaaatgccattttttcactcctccttcccccaggctctaaataccattgctgaattgaatccgtccagtttgcacgtgtgtctacagacatgtgtcttatggaatacaaacaatatgtgcttcttcttaaggttttgttactttgtcccttggtggtaagttttacaaaatgatttgaaatactcagcgctcaactccaaaagccaataaaacaggaggaagacattgggtatgatttggaaataagcaaaacagaacagacctgactttctttctctttcttcctttcttccttccttcctttctttctttctttctttctttctttctttctttctttctttctttctttctttctttctttctttccttctttcttttctttctttcttttctttcctttttttttttttgaaatggagtcttgctctatcacctaggctggagtgcagtggcgccatctcagctcactgtaagctctacctcccgagttcaagcgattctcctgcctcagcctcccgagtacctgggactataggtgtgcatcaccatgcacagctaatttttgtatttttagtagatgcagaatttcaccatgttggccaggatggtctcgatctcttgacctcgtgatccacccacctcagcctcccaaagtgctgggattacaggcgtgagccaccgtgcctggcccagacctgactacttgctagtataattttattttaagtgcacgttattattctgctttctccaatatcagacagctggttccttcttgaagcaactcttaaagacagatggaccagccatgtcttcaaagtgttggcttcttctgtggctcccattttcccgtttatcctagtgccttgacttcttcacttgccaacctctgttctccctggcaccaaggagttatgtagcgttgacttgttcttttccatttgaaggtggaaggatgaacataaggtgccagactgggctatttcatcatagacagatggatttgctccattcatgtaaagagttccttttgtagaatatctgaatcctggtatatcctttagatggatgtataatccctatccccacacttttctcccaaacttgtgagttataccattaagtctacaggactgggcagttacgacctggacattagtccagttttctgtattctactacaaaaacttgtttctgttgtttaaaacatgggattatttgtaagttatcactccagaaatgaacgtaactgaatttgctgaggatttaaactaattacctgacatcaaattggttcaaggaagtggggaaaataaagcaaggattgacaactactatttgcttcattctaattttaggccctttaactttaaaggtgaattattccttgttttattcttggagtatttattttatgaatacgtgaattacaataacaaaacactataccgttgtgaaagtgagtgagctacagctacacacaccaacatggataaatctcctataaatctcatcatgtcagcgagcaaagcaagttccagaagaatgcccacagtatgagaccaattatttggtttgaaaatatgcaaagcagcattccatatgtcttaaggacacatacatatgaagggaaaggataaatccatgatgggagtgataatcccctaaaaatagttacttgtgggggaagcagtggagcagaatgcaatctgggaagggtactgagggagttcttatgcgatagtggacagggatggatttatgagtcaagaagagcaactgcacggcgtctggaaggcgtgctggccctgggctctcaggtggaggctgtttgcatgatcagcagataggaaggtaccatggatgcaggagtggtctgaataccagaggaggcaagccaagtgagcaaggggagggagacgagaggtgccaggaaaaccctgtctcatgagaagatgatgatcctagaaggcttagaagagtgtccaccccaggccaggtgcggtggctcacacctgtaatcccagcactttgggaggccgaggggggtggatcatgaggtcaggagctcctggctaacacggtgaaaccccatctctactaaaaatacaaaaacaaaattagccgggcatggtggcgggcacctgtagtcccagctactcggtggctgaggtgggagaatggcatgaagccgggaggtggagcttgcagtgagccaagatcgtgccactgcagtccagcctgggcgacagagtgaggctctgtctccaaaaaaaaaaaaaaaaaaaaaaagagtgtccaccccagtgcccccatccacagggctgctgctgctgagcacccatgcccttgggtgacccactctcctgctcaggggcccagaggatgcttctttcttcttcctgggcactttcccctgagttttggtttaaaagatagaattcccgatgaagccagcttgctgcagtcctgtagccccacatctccatatgcgatcctttgagggaggctgagcatccctgcatctctgaatgggagacatgtttccaccttggctcctgggggcactggggccattttcctggtgttctgagcactctttctgcagaagaagacactctcagatggtagattttgtggatttcagtaagtagagtccttcaggagtctctaggcagaaagcacctgagttgacagcaagaactgagagttctgggtctgcctctagatggctgtttgcctattccagcctcactgtccccatatccagatggaatgacatgagcatatgggcaggacaagccacctttgtccataaggcggggtacacgccaccaagactaagactgaagcctaggcaagacttagagtatttgtggcttcagagaaacatcaaattgagaggaagatcgagtgataggaaaactgaagccagagaagtaagtattttgtatgtagagtatcattttccaatcatcgctggtgtgataaaacagcaaacgtcactgcttattgaaagcaactagacagtatgtttggtgattggattacaagttttccttttagataaggagagatttaatctgtttctggactctttaggagcacccttcccagttttacagttgagggactggagaccctgagaggtgaaggggcctggctgcactcacagtggaagtgatcccactggatctcagatgttgagtttctgacactcaatctagagctcttcttaccacacatgcttcagtctacacagttctccccctctttttttttcatcttctcatctactgcccttattctctctctctctctctctgtaaaacatgtaggggctgtcatagacgacactgtgtgagcggaagttgatgacttcaattgtgacaaatatcaggagctcctctcaaaaattaccttcacaaaagccttttagaaaagccatgttgctgtcacatgtagctataatttgggttgtgctcaaaagacttaaattggttaataccgaagggaggtgtggtttattctgtatttgttgttctagtacttcttgggtttgggggctgctgttatgagaaatggcttctcctagactccagaatgtgcttagagagtgtttttctctttgaattgctaaaaatgttatttcctctctcctggatttttcaaggtgtgcaataagttgtgtagttgctgctctgctgcacagagctttaatataaactgcgtattttcactctgtatgtgtgagtaatctgtgccttctatggctctgatcgtgggtaagcaaaaaacacagtgactgctgaaatatagggatggaaatttctttgtcagtaaagatcctatgaaatcatatactgagcatacgtaaaatatggaattgtctctgcagtattgatcgagcacaaatccactttcgtaaagcaaaaataaaggtcaaacagaaaaggcacatcactggtttttaaaattttttgaataataagtacttgaaattccttaaaaatgacactatatatgatttaacttagatagctagaatagtcaaatacatagaaacagaaagtagaatgcttattgccaggggctccagccctggtgagggaggaatggggagttaagtgtaataggtgctgggttttagagatgttgacaaagttctgaagatagatggtggtgatggttgcacagtagtgtgtgggtatacttgattccaataaactgtacacttaaaatggttaaagtggtaaattttatgtaatgtatatttaattgcaataaaaaggataaataaatgataccatatcctcgtgatttcagatacatctcttacttactgatcattcctcctgagaatgtgttctgtctccatgctgattatgtttcctgttctcttcctttgggtgctgtgttcagcatttttaatttttttaatagttaatgctatgctcacattttcctcccgtgacaaagagtgggaataagcgtggcacatgtgtctctcaccatctgtttgatagctgcacagaagccttaggaaactgagggatagacacgctcccactgagttactcaacactgctgcttccttgtcctctggctgaaggctaaaccctgccttctactgtttacaacaggagtgtccaatctttcggcttccctgggccacacttgaaggaggagaattgtcttgggccacacataaaatacactaacactaacaatagctgatgagctaaaaaagaaaattgcaaaaaaaaaatctcataatattttaagaaagtttacgaatttgtattgggccacattcaaagccatcctgggctgcatacagcctctgggttggacaagcttggtctaacatatagtgttaataggatatttgaggtggagtaagaccaatagatcaggaggtaattgccactgaaaacatagttaattactcacagatcctgtgtcatgccacgtgaggaagcaccagggtgggtcaggagacagacggagcagggaaataaggtcaagagactttattgtggtttctgcaggaaggaatgctgagagagagcaagcccattgaggactgggtagtttgaataattccagtgggctctgggatgtaggggctgcccctagttgtttggtacctggtctggggtgattagggcaggggatagtggtcctgagtgtaagatcccaataagaggagttgttgggtggtgtgggcgtcacctgctgttccattggcctttagccagggcctgagagctgggtcaagataacataatttaaaaaacgatattatacccaccagactatttcttcctggtagaaagcaccacagatccatatggacttggatggatctgtggacagattccatgtttgagaagtagccataacctgcggccttcccctttctacaatgcagactccatcctcagttcaacagaagtttcacaggtatctttacaggtgtttcctgagtcagccgatcaggtgaattgtttgaccccattgccaagaatatttctggctggaggttccgaatacctcaaagagaaagtccctgcttgaaagagtctcctgcccccccaccaccttagaacagttgctggcattgattgctctaccaagagaaaaatgctgatacttgacaaactattgacacacctgggaatggccacataatgttggataatgttaatgccacaggtggaggacgtgggtgtcaggaagaagaagcagtatatgattccacaacagtaatttcattcttcaagaagattgattctattgggaatgatttttcccattaagcatgaaacacagagaattcttggtggatccattcatttagcaagcagttttgtggaagacagcatgtatgactgccaagggtgtggggtgtggtgtccaagtagtgccttcatggctccctcacttataaactgtgtccttgagtaaactgctgaaccctgtggtgccttggtgtcctcaccaataaaatagaggtaaagatacaagctcactggtttcctgtgaggactaaagaacacctgtgaaaagattattaactatgttagagaggagggtgatgatactaattggaaacaaataaggtactaaaacaagtgagacgtgatcttcactctgatggaatccagtgggggaaatgaatataaaaacaggcaattataaaaaaaaaaatggtaagtctgctgatatggagtacactttctaggggcatcaggatagacaaacatagaagaaaaataatatttgatttgagccttaatggataaataaataaataaataacggggagaaagatgattcctagagtagggagtatctcatgcaaatgactgagaagcttgattaagttaatgtttaagaatgtggcaggccaggtatagtggctcatacctgtaatccaagcactttgggaggccgactcaggtggatcacctgtggtcaggagttcaagactagcctggccaaaatggcgaaaccctatctctactaaaaaatacaaaaattagccaggcatggtggctggtgcctgtagttccagctactcaggaggttgaggtaggagaattgcttaggctcaggtggttgaagctgcagttagctgtgttcatgtcactgcactcctgcctgggtgacacagcaagaccaccatctcaaaaacaaaaacaaaaaacaatgtggcatattaaaaattaaaatcacaataaaatcagagggtacattgtgagaagttaatagcaggagataaggttgaaaaaaaaacttgaacccaggtttaaaagaccttggatcatgtgtatatgtgcggttaataaaattcgatagtctagaaagctttaaatgcaatataaagaggactatcttagttgagcaggcacttattaaaattctcagcataaaataacagagtataggacagaaaattatcttggaaatttaataaaaggttatatattagtcagctcctgctttgataatgtagtataacaaacagcccccaaatctcagttgtttatatgaaagcatgtatttcttgctcatggacttgtgcgtcatcttgtggctttgccatgtgtttgtgggttgggtcagatctactttgagtaattctgggactgggctacctgcggggcatgctattctcatggtagactggaggaaggaagatagataggaagacaatcatacaagggcatataaagcctctgggtgggcgtggcatacgttaggaccactggtgttccattggcaaatgcaagtcacctggtcacatccagaggcatggggagatgacgcttactctgcctgtactgaagagaaaggagagaaggaggacttatgaacaatgaatacaatctaccactgatggtcattaatggcctcaaaaatatcacaaagacatgaaagccctgcagtggcttccaaggatcttcttattagaaatgatatgagggatagagcagtttaccacataccacaaacgtgtataccagcatgtgtatactagtttgggaattcgtagttttgagtatggaagtatgggaagtgaaaagaagggagaagtagaagtgttgggtgtggtattgcatacactggctggagacaggaagaaacaacgatcttctaatataaactttaaaatggtcccagagtaaagatataatagtgatcagagatttcactccatgaacatatgaatgtctaatttgtctcttgatatttaacttttaacatgaaatatttcagaaatatagaaaggtacagaaaaaaacatagtggacacccatgtatagtagatgctaacattttaccacatttgattcaagtgaacctatgagtttatttttagtgttgttctttttaattaagaaaatattacagatacacaaatgttgtatattctactattctactctggattgtctttttttccctcagtgtttttgtcatacaaaaaattttaaaacttttaaataagatgactttatcttttccttcttttttttctatttcttgtttaataagttctttcctactcccaggatcatgtgaatgttttctgtattttcttctaatttaaaaagttttgttctgtagctttactttttaaaaacattttttaaagtttccatctggaatttttgatgtgtttggtgtcagagatataattttgtctttttacatatcaatcagtatctaatagcatcatgacctctacagatttgtgtgtcatctgttgtgtgtgtgtgtgtgtgtgtgtgtgtgtgtgtgcatctttttataagtccccatactcttccattgatctgtttgtttctttctgaattaataccacactataattgctatagcattagaggacattctgatatgtggtatgacagctctccctctccccatcttatcacatgcacacacacacacccacacacacacacacggactgagcatcctttgtcttcaaagttgtcatgactactaatgggaatatttaatcaatttatatttaatataatgatgaataggtttgactttaaatctactatcttgctagtggttttctatttgtcccatctgttttttttttcttttttgctcttttctgccttcctttagaactgagtattttttagtattctattttatctcttttttgaattattgttatcccactttgttttattttcctcagtggttgctttagggttcattctaggcatctttaacttgtcatagtttcctttcaaacaatattattccactttatgtgtaagtatatctaatgaataatatatttaaaatttttataatataaagcctcataaatattttatatgtatactgtcactcacacactatatatcactacatatttgtatatttcccccatatatgtatctccctcatatatatgtgtgtgtgtatatatatatatatgagagagataaataattttacaacagcatacttacatttttccctcctgtcatttgtgttacagttgtcatacttttacttccacatatgttgtaaattcagatcaataaggttttaaaaattaaattattgttttctttcctgggataaactctattattctttaccactgtgctagatttttttttttactaattcttaaagcatttttgcatccatattaataaatggaattaactgtaattttgtttcttcatactatctttccccgttttggaatcaaggctgtaccagtctcataaaataactgggaagttttccatcttcttattctccctgggcatcatcctcacctacctgaactactgcagttgcctcagaaccggttttcgccctctcatccttgtcttacagtacacctttgccccaaattcatttcctacaatgcagtgattcttctaaaatacgcatcccttcatgctgctccctggtctagaacacgtcacagttcatggcttattgtcgtagctcagtaattccttgttttctggggtttctctagcatcatacaggctgaaatggtgtcatgtgattccagaggccaaaaggctggtgtggagtcacggcaactttcctaccactacattcccccttcctatgagtttcatcgtaccaatgatggctgttcatagccgactgcatcattttccatgaaattactggtgtggtgtgatctggggtcgcattcaatgggaaagatttagggaatggtcatgagagtggcctcctggatgcagtaacctgacataccctacattttccctgaacttggggtccggggcaggcttttgcaacaggggtatggtatttaaataatcagcataaaacagctgcccattttaaagctgtctcttcatagaggtcaggacagaactctaggtatggcttctactgacagctactccttcaggagatacaaattatatgccgattctgacacttttgaaaaagaaacatatcaaatgcaacttttttttcccatttcagtttatgcttttcactgttctcccttcttctaaaaattgtggtgtttcatctttctgatgctcttctagaaagtgggctaaagcactaaaatataatcattccagtttcatagagccagacttgaggcttatagatgttgtataagtggctcagggacccaaaatatcttctgtggtgacccttgctttaaatctcagggctatgttttcttagactgtctgagcaccagtttcctcatagaatgtggcagattgaggaagattgtatctaaagcaccaacatagtgtctggcaccatgtcgttcagtaaatattatacctgtgaaatacatcaaatagaggcgccactgctgggaagtgaagtcctgcctataattgagtttaacaattccatagaagatttttttgaatactgatgtgcaaggtgactggcctcatgtcagattctgtgagtaaaacaaaggtaattgagcaatggttcccacccttctggcatcactgactgttacgggatctagaaacatacatgatcagacacgtgaacccacggggccaacaccacagcaggagtgaagaaggagctggaaggggaaggtggggattcagtttgcctggcagggcatggtaagacttcagaaaggaagtgacattggaggtacatcttgaaggatgagtgggatttcaacagacagaggctgtagggctgagcacttgaaacagagggaggacatattgcagccaaacctcggtgaactgacttgggtacgcttctgccagaataagaagaggtcttgaattaatagtcaaacctgatatagcttctttgtcactgtgtcttttccttgaaatgaatggaactttttgattttttatccttacttttctcctctctgggttacagtggcaggttgttttatcttcccctgatgaattgaccggtccagagagcatttcagttatcatttatggaacaaggccaaaatatttctttcacacatacagcgcagactaaatcgtctttttctttatcttttttttttcctttaacaacctccagcctatttgtggcatctgaaaaactttgcggcagcattttacagccatttattgtagagtctgttgctttgggctgctgtcagtgctctgacacaaagtttcccatctgattttgagctggtcaccgtgtgctgttgtagtaacagggcctcctggtgcattgaaacacctggtttacttcacacttgatcactggcatgttcaagaacagatagagctttgtctgtcatttgctctttttgggttagcttaagctagggatgttttattttaggtttttttcttaaaatcagagaaaatctagcttcaaaactcaagtgctaaaacaccaaaatagtgttatagaggcacattcctggggcaggggagaggtggccctcgattaaatatatacgagcaagtatttattgaatctcattttaaggacatttgcatttcatgagaagtgagaggtgtggttgctgccctcaagagacttataacagaactagggagaaagatacagccacattagacaaaacagcaagatgtaatcaagtgaaccaaagcagtatcacatgtacacaggagtgtgagcagagagttaaatctatgtatattcactttaggtcatttataaccttgacctccagcaaatgtttaacaatggttataataatatttcttacaattacacataataacccatccgtgcaaatgtctgtgtacttgggccctaaaaatataacatactgattctaggaagaatgcatattcttgtcactgttttcatgttcagaaggaactcaggggtgggccagttctggagtccatgcagctggacagactctggaaggtgaaggacccttgcccaggaagggctgaaatctgtgctgggcagagtgagtgaagggaaggatgttttgattgaccgaagattttctttaattgaacttgaatgggatgacaagaggagaaaaacctggacatttacttcttgaccatggaaagttttgaagtaaacagaacaccataaaacaaaatataatttgggaattgaggttgaaaatcaacaagtaaggttggaaagagttgttgaatgttctacattcacaaataactaggccgggtgtggtggctcatgcctgtaatcccagcactttgggaggctgaggcaggtggaacacttgaggccaggagctagagaccagcctggccaacatggtaaagtcccatctctactaaaaatacaaaaaattacctgggcgtggtggcgtatggctgtaatcccagctactcaggaggctgaggtatgagaatcgcttgaacccagcaggcagaggttgcagtgagccgagatgatgcaagtgcactccagcctgggtgacagagcaagactgtctaaagacaaaacaaaacaaaaaatgaaacaaaacaaaaaaaaccccacaaaaaacaaaaaaaaaagaaaccaaaccaaaagaaaaccaaatagttagatgagatggaaagagtggaggacagatcttaccaggaaatcctcagaacactgactactcagtgtggatttcccaaccagctagctacagtctgcttgtctctcctgagggttttcagactagtttccaaaaagtcaggaaaagggtagaattccaccttccgttccctatttggagctctgggacagtagctgtcacatgatagtatgcgtcagagtcacctggtgggcttgttggaaacacaggctgctgggtccctgagcttctgattcagtagtctcaggtaaggcctgagaatgtgcatttctaagacattcccaggagacacagatgctgctggtctggggaccacattctgagaaccactgcctttgggtgggtgtgggccatgacctccttccaggttctatacattggccccttggctcatcaaaagggtcttggtctatgctttgatctatgcctttccttcaatgtggctgtaagttttacctaattaaaatgctgcatctggtttggatgatctgattaatatggaggatgaaatttatagcaataagtactcagagctttgctcccttcccgatcaaagcctgaagtttgatttctttatacatatattttaataataatcatcattagtgctgaaattagagataaaatgtcccaatcatcccagtgtatttttagtttctaagcatgagcatttgattattgttttctggcgagtctgtcgtgtaatccagtaattgcaataaaagagaaaagtactttttgctaatatggtacaaatagttttgtccacagtgatcaaatacagagattttccattctatgttattttatacccctctctactcccctgcttcccaaaatagacacataatatatacaactagatttattggagcttctgatttatatgagactatataagtgatttcagtgtatctaggatagagattttgttcccagagtaaaagcttctgaagctgtgcaatgcaaataaaattattttatttattatagcattaacttaagatgcagtcttctgaatagtctagcctgtgtttgggatgtaaatttctcttgcaccctgctgcctttcacgtttgctttcagcagggactatagtttaatctttttcttcctccttgccccgcaacaggagatcgctattatcagctgacactgaagctcctaaaaaaatcttagctcagattctctttgtccatctgcaagctagcgcacattccccgttcatggaaaaataccactgcggtggagctttaagtcactgctgttctgcaagaaataaattttatcacaagaagcagtgggtgcagttagaaaaagtcatctagatctaagggaaggcttcaaataattctcctaattggcctacgtggttcactagtagaaaaacctttcgtttttgtccttcaaaaacaaaactgagagagttccctggagacattagtttgctaaatgacttgcccaaggtcacctggtaatatgaccaagtgaagaattatgggtttgtgaaccgttatattcggtataaggccatattcttttgttactttcttaggaagagaatcaatggcttgtttcagaaagctttgcaaggaatcacttactcttctgccatgggaaaaattgtgtatgccagatgcattttgttcatttttaaagagctcctcaatgctattgctgatctcctagggtaagagaaggacagggaggttagacaaggcaactggtagtcttctaatgcctacagtaattaatgataatattcagactagtttcattcatcaaagcgtatacattacagggtttgaaaaataggcgtattttcttagatgcaacaaaatctactctagctgctgcctcagggtgctcattaccacctttctagtctgccatgggtttggttgtggggcagaagtcagccacatacagaacctcaatggcaaggcaatatgggaagtgcagtcctttgctttaagtctctagtgtagagaaaacatgttttgggggtggaatggtagactggagtgggtttgaataaaccaattggcagtaactgctgcagatagttctcaaatgttattgcttccaatggggtgaactaagtcatgcagtgagccaattctcttgcaaatggctggcctgtcttcaaacggctatcagagaaacgtcaatttcagaatatggttagatacagtgtatggggataattagtagatgtcataatgctatgcaatggtattattcttatttagaaacgaaaattgagtaaatttaattttagaacattctaatttcaccaattttgcttgtccataatttccttaaaatttgctcttagatgacagcatggtgcatggcaaatgcaggctttgcaaacaattagaaccaagttcatatctcagggttgcttcttcttagctacctaattggggtatgtcactaaatctcattaattctcactggagaggatgctgatattgaagcgtactgggagcattcggcccatgaagctctgtgcacctttaatgaaatcaggcttgtatggcacactgcagacactgacaaattgtgtggtagttattctgcttctgacccaaatgcaatgatgccatcatcttctgatcccattttttcttgttcactggcacatttactttccaaactgtactttattattatatatttaatcatgcagtgtattgctttaatattgttcataggttatctcctgtttattttgtttctcagagtgactagaatctctctctgtcagaagagagggtgtgacttcttgctgcctttgccttgtatcttatcctgaattctgattctaaccttagtgcttgcatcagttgttatggacctggatcagggccactgtgtatggttgttcaggttgaacagtgaacaagagccccacgtttcatgggataccagtcactttgaatatttattatatttatcatatacataattattaaacatattatatttattatacatattaggtcttgtcctcataaaatcagtacattatggcaactttttaacaaaaagaagtgaagtgtcttaaagaggggcactgcctcttgactggcacagatgcaacgtatgggcaccacagaggctagcagtggccctggataagttgatgatcatagtgggtgatagcataggtttttaaagttgttcacttattcatatgacaattatttgtttttgtgcatattatgtaacaggcagtattctaggtagttggatatacaattattattataaaaataataatcactatatgggaggccgaggtgggcagatcatctgatgtcaggagttcaagatcagtctggccaacatgatgaaaccccatctctactaaaaatacaaaaattagccaggtgtggtggtgcatgcttgtagttccagctactcgggaggctgaggcaggagaatcacttgaacccagcagaatgaggttgcagtgagccaaattcacgccactgcactccagcttgggtgacagagtgagattctgtctcaaaaaaaaaacaaaactcattatcttagtgtcctggggctgccatgataaattactacaaagagaaatgtattttctcacagttttagagggcagaagtctgaaatcgaggtgttgttagagcggtcctagctccaggttgtaggctttgatttgtcagtccttgatatgtacacgttgagtatccctgtctaaatctctgcgatctgaaatgctccaaagtctgaaactttttgaacaccaacatgatgctcaaataaagtgctcattggagcattttaaatctgaaacactttggttgcaagcattttgaatgaaggatgctgagcctgtatacatatcatagcaatctctgtctccattgtgtgttccctccctgtgtatcactgtgtctttgtatctcttcttcttctccttctcctctctcttcctcctcctcctcttcctcctccaccttttctctctctcatttttttttttttgacagagtcatactctcttgcctaggctggagtgcagtggtgcaatcatagctcactgtagcctcaaactcttgggctcaagtgatcctcccacctcagcctcctaaagtgctggggttacagacatgagccatgatgcctggcccatttttcttcttaggtggataccagtcatcagatttagagcctcccctaatccagtatgacctcctcttaatgaatgttatgtgtgaagacctcccttatttccagataaggtcaccctcacacgtactaggagttaggacttcaacaatttaacccattataatcaaagagcctataagactgtagatttacatggagtaaggcaggcaaataaatgagcaataaatatataatatgtgaaaaaatataccatgtgtgagtgattacaagtgctaggaagaaacatcaacctcaagccataggattgcctgtgtggggaggctctattctaggctgtgtggtcagagaaggcctttctgagaaggtgccattggagcagaggcctccgcaaaagcagcagacgaacagtgtggatttatggggagggatgttccaggcagagggagcctcaaggcctttaggccacagtgtgttgggcatctgtgaggagctgctaggaggctcaagtgaaacttggagagaggagggctgggaaagtgagaacagcaaagaaaagggcaacagatcatgtggggttgagtataataggaggttagaaacttggtgattaagatgggaaaccatttcagagtttttaacagaagagtcacgtgatctgactcgtgtttagaagattgttctgttgctgcagtcaagagactatagagagtcaggctgggcacagaagaaactgcaaaagcagttactgctttggagcaggaaaggggtggtgtggttcaggcagcatgggagccaggacactggccctgcagggagtgaatttcaaggttaagtagcctggaagctcagtcctctctcttcaatgatccatgcttctgtcctggttcttcatctatcttcatctatggcacctttgaggtaggtattgagttggaggctttgctcatcctgtgggtgcaggtttggcagcccagaaattatttttaggattaacagctacatgttgttccaggccagacttcctctaacattacatttccctcaaaaattcattggagctcttctctctcttccttttttctgtcccctcccttctcttccttttctttcttgaacaatttagcaatttagtcctaaatatattaggtcaggtagagcaaagtaagcactgctggagaggggagctgcaatgtcacttctgtggggtcccttctgaaagtttggtgtctcactagtgaagaagagaggtacaaataaggaaagggacaaaactagaaggaaccctgtgttatgagagtaaaactggagtattgctgtgaacctaaatacacagatagatacaggaatatcaaggcagtgtgtatatgtacacatgcatttatatgtctactcccagctttgcccactgagagagtctgggagcaatgacatcccaagaacaatgaacacccctagaatccaattcttggcttctaaatactcatttccactaagaggaaccagagttctttggagcaattgctgaatacaagcagggaaattgcagactgagctagagccctgttgatgctggaaaacaaggaaaagatcaaaaaatgggggacatgcaaaaggatcccaaagtcagccagattgggttcccactgccaaacagggcataaatcgagcataaaaataaataataataatattagtggatgataacccagtgaataagatagaaaaatcttgagtccacacatatgcaaataaacacactgaaggtttgatgaggaatggaatttttacatagttccaattacatcccctcagaatacttattaaatacaaagatgaaaagaataactttacagtggagaagcctgacagagagcaccttaatcaaattatcaacgttatcatcagcaatgggacaagtcgaagtccttagccaccacagtaagctacaagagcaccatgacatcagatctgggatttcccaacaaaaatgcaaacctgagtttgatcatgagtaaataccagggaaactcagatggaggtgcattccacaaaataactggcctatggtcttcagaagtgccaaggtcaagacagtcaaggaatggccaggctgtacgcagtggctcatgcctattatcctagcactttgggaggccatggtgggaggattgcttgagcctgagagttcgaaaccagcctgggcaagatagtgagacccccgtctccacaaatttttttttttaattagcctggcgtggtgatgcacacctgtagttcctgctgcttgggaggctgaggtgggaggattgcttgagcctgggatgatgaagttgcagtgagccatgattgtgtcactgcattccagcctgagcaacagagccagatcctgtcttaatttaaaaaataataaaggaatgactaaagaactgttcccaactcaaagcgactaagagacatgggaactgagtgcaatgtgtgattctgaggggcatgggggacccttttgttgttataaaaggcattatcaggacatttggcaacatttcaatgaagcctgaggattcgatggtagtagtctatcattattgatttcctgattttgatggttatattgtggttatttaggaaaataccctcgtttttaggaaatatccactaagatattcaagggtggaggaacagcgggtcaacaactctcaaatggtccaggaaatagaaagttctttgtactatatttgtaacttctctgttgctctgtgattgtttaaaatgaattcgctgaggtcatggctttttttttttttttttttttgagatggagtctcactctgttgcccaggctggagtgtaatggcacgatctcagctcaccgcaacctctgcctcccaggttcaagtgattctcctgcctcagcctcccaagcagctgggaccacagacatgcgttaccacgccgggctaattttgtatttttagtagagatggggtctctccatgttggtcaggctagtcttgaactcctgacctcaggtgatctgcctgccttgacctcccaaagtgctgggattacaggcatgagtcaccatgcccggtcaagggcatggattttgatccatgaatcagtgagagagacgtaagtacaatgcctgatatttttgcctgttcttgaggatagcatccctactattactgaattcactcacatgtgtgagtttggggatcttaaaatatcccagggggtgctttatgcacgagggatatggattaagtccagggtgaatataggtgtttcccagtgataaggcagctgtgtgtgaaagcaaggacaaaaacaaaactaaactaaactaaaaagaaaagtcaggccagtgtgctagatatttacagctgggtgattgtgatggcactgtccttcctaaagctttgtaacagattaagtagattctctaaagccgttcaggttagagggtgccttgcccttattgctccaccgtgctttttggcagacattgtgaccatgtttagtaattatatttggctccctgaaggtaaaacaggagctgcgtacgtattaggggagaaaaaaggaagcacaagaagaaaggaaaaaaaaaattaaggggcttatgttttatatcctcccagtcaatcccatgagtgaataactacattacaaattttgtctcgatgtggtttttaagcctaaagaatctttctttttctttctttgctttctttctttctctttcttttctttcttttctttctttctttctctctctctttctttttcttctctctctctctttctttccctccctcctccctcccttccttccttccctccctcccttccttccttccctccctccttccttctctccttccttccttccttccttcctctttctttctttctttctttctttctttctttctttctctttcttttattatactttaagttctagggtacatgtgcacaacgtgcaggtttgttacatatgtatacatgtgccatgttggtgtgctgcacccattaactcatcatttacattagatatatctcctaatgctatccctccccactccccccaccccacaacaggccccagtgtgtgatgttccccatcctgtgtccaagtgttctcattgttcaattcccacctacgagtgagaacatgcagtgtttggttttctgtccttgtgatagtttgctgagaatgatggtttccagcttcatccatttccctacaaaggacatgtgggctcctgaacttatccttttttatggctgcatagtattccatagtgtatatgtgccacatttgcttaatccagtctatcattgatggatatttgggttggttccaagtctgctattgtgaatagtgccacaataaacatacgtgtgcatgtgtctttatagtagcatgatttataatcctttgggtatatacccagtaatgggatggctgggtcaaatggtatttctagttctagatccttgaggaatcgctacactgtcttccacaatgcttgaactagtttacagtcccaccaacagtgtaaaagtgttcctatttctccacatcctctccagtacctgttgtttcctgactttttaatgatcgccattctaactggtatgagatggtatctcattgcggttttgatttgcatttctctgatggtcagtgatgatgaacattttttcatgtgtctgttggctgcataaatgtcttcttttgagaagtgtctgttcatatcctttgctcactttttgatggggttgtttgactttttcttgtaaatttgtttaagttctttgtagattctggatattagccttttgtcagatgggtagatttttaaacttttctcccattctgtacgttgcctgttcactctgatggtagtttcttttgctgtgtagaagctctttagtttaattagatcccatttgtcaactttggcttttgttgccgttgcttttggtgttttagtcatgaagtccttgcccatgcctgtgtcctgaatggtattgcctaggttttcttctagggtttttatggttttaggtctaacatttaagtctttaattcatcttgaattaatttttgtataaggtgtaaggaaaggatccagtttcagctttctacatatggctagccagtttttccagcaccatttattaaatagggaatcgtttccccatttcttgtttttgtcaggtttgtcaaagatcagatggttgtagatgtgtggtattatttctgagggctctgttctgttccattggtctatatctctgttttgatatcagtaccatgctgttactgtagccttgtagtatcatttgaagtcaagtagtgtgttgcctccagctttgttcttttggcttaggattgtcttggcaatgtgggctcctttttggttccatatgcactttaaagtagttttttccagttctgtgaagaaagtcattggtagcttgatgcggatggcattgaatctataaattaccttgggcagtatggccattttcgcgatattgattcttcctatccatgagcatggaatgttcttccatttgtttgtgtcctcttttattttgttgagcagtgatttgtagttctccttgaagaggtccttcacatcccttgtaagttgtattcctaggtattttattctctttgtagcaattgtgaatgggagttcactcatgatctggctctctgtttgtctgttattggtgtatgggaatgcttgtgatttttgcacattcattttgtatcctaagactttggttaagttgcttatcagcttaagcagattttgggctgagatgatggggttttctaaatataaaatcatgtgatctgtaaaaagggacaatttgacttcctcttttcctagttgaataccctatatttctttctcctgcctgattgccctggccagaaattccaacactatgctgaataggagtggtgagagagggcatccctgccttgtgccagttttcaaagggaatgcttccagtttttgcccattcagtatgatattggctgtgggtttgtcataaatagctctcattattttgagatacatcccatcaatatcaagtttattgagagtttttagcatgaagggctgttgaattttgtcgaaggccttttctgcatctattgagataatcacgtggtttttctctttggttctgtttatatgctggattatgtttattgatttgcacatgttgaaccagctttgcatcccagggatgaagcccacttgatcctagtggacaagctttttgatgtgctgctggattctgtttgccagtattttattgaggatatttttgtcgatgttcatcagggatattagtctaaaattctcttttttttgtcgtgtctctgccaggctttggtatcaggatgatgctggcctcataaaatgagttagggaggattccttctttttctattgattggaatagtttcagaaggaatggtaggtaccagctcctctttgtacgtctcgtagaatttggctgtgaatccgtctggtcctggactttttttgattggtaggctattaattattgcctcaatttcagagcctgttattggtctattcagggattcaacttcttcctggtttagtcttgggaggatgtatgtgtccaggaatgtatccatttcttctagattttctagtttatttgcatagaggtgtttatagtattctctgatggtagtctgtatttctgtgggatcggtggtgatatcccctttatcattttttattgcacctatttgattcttctctcttttcttctttattagtcttgctagcggtctatcaattttgttgatcttttcaaaaaaccagctcttggattcattgattttttgaagggttttttgtctctatctccttcagttcttctctgatcttagttatctcttgccttctgctagcttttgaatgtgtttgctcttgcttctctagttcttttaattgtgatgttacggtgtcaattttagagctttcctgctttctcttgtgggcatgtagtgctataaatttccctctacacactgctttaaatgtgtcccagagattctggtatgttgtgtctttgttgtcattggtttcaaagaacatctttatttctgccttcatttcgttatgtactcagtagtcattcaggggcaggttgttcagtttctatgtagttgagcggttttgagtgagtttcttaatcctgagctctagtttgattgcactgtggtctgagagacagtttgttatgatttctgttcttttacattttctgaggagtgctttacttccaactatgtggtcaattttggaataagtgcgatgtggtgctgagaagaatgtatattctgttgatttggggtggagagttctgtagatgtgtattaggtctgcttggtgtggagctgagtttaagtcctggatatccttgttaactttctgtctggttgatctgtctaatattgacagtggggtgttaaagtctcccattattattgtgtgggaatctaagtctttttgtaggtctctaaggacttgctttatgaatctgggtgctcttgtattgtgtgcatatatatttaggatagttagctcttcttgttgaattgatccctttaccattaagtaatggccttctttgtctcttttgatctttgttggtttaaagtctgttttatcagagactaggattgcaacccctgctttcttttgttttccatttgcttggtagattttcctccatccctttattttgagcctatgtgtgtctctgcatgtgagatgggtctcctgaatatagcacactgatgggtcttgattctttatccaatttgccagtctgtgtcttttaattggagcatttagcccatttacatttaaggttaatattgttatatgtcaatttgatcctgtcattacgatgtttgctggttattttgctcgttggttgatgcagtttcttcctagcctcgatggtctttacaatttggcatgtttttgcagtggctggtactggttgttcctttccatgtttagtgcttccttcaggagctcttttagggcaggcctggtggtgacaaaatctctcagcatttgcttgtctataaagaattttatttctcctttgcttatgtagcttagtttggctggatatgaaattctgggttgaaaattcttttctttaaggatgttgaatattggcccccactcttctggcttgtagagtttctgtcgaacgatccactgttagtctgagaggcttccctttgtgggtaacctgacctttctctctggctgctcttaacatattttccttcatttcagctttggtgaatctgacaattatgtgtcttggagttgctcttcttgaggattatctttgtggcgttctctgtatttcctgcatttgaatgttggcctgccttgctaggttggggatgttctcctggataatatcctgcagagtgttttccaacttggttcctttctccccattactttcaggtacaccaatcagacgtagacttggtcttttcacatagtgccatatttcttggaggtttgtttgtttctttttactccttttcctctaaacttctcttatcgcttcatttcattcattgatcttcaatcactgataccctttcttccacttgatcgaatcagctactgacacttgtgcatgtgtcacatagttctcgtaccatgtttttcatctccataaagtcatttaaggtcttttctatgctgtttattctagttagccattcgtctaatgttttttcaaggtttttagcttctttgcaatgggttcgaacatcctcctttagctcggagaagtttattattaccgatcgtttgaagccttcttctctcaacttgtcaaagtcattctccgtccagctttgttccattgctggcaaggagctgtgttcctttggaggagaagagacactctgatttttagaattttcagcttttctgctctggtttctccccatctttgtggttttatctacttttggtctttgatgatggtgatgtacagatggggttttggtgtggatgtcctttctgtttgtttgttttccttctaacagtcaggaccctcagctgcaggtctgttggagtttgctggaggtccactccagaccctgtttacctgggtatcaccagcagaggctgcagaacagcaaatattgcagaacagcaaatattgctgcctggttcttcctctggaagcttcgtctcagaggggcacctggccatatggggtgtcagtctgcccctactgggaggtgcctcccagttaggctacttggcagtcagggacccacttgaggaggcagtctgtctgttctcagatcttaaactgcatgctgggagaaccaccactctcttcaaagctgtcagacagggacatttaagtctgcagcttgctcttctttctttctttctttctttctttctttctttctttctttctttctttctttctttctttctttttctttccttgcttccttcctttcttcttctttttcttcttctcctcctcctccttctttccttccttccttccttccacccccgtttctgtctttcttcctttctttctgttcttcttttgataggatcttgctgtcacccaagcttgagtgcagtggttccatcttggcttactgcagcctccacctcccaggctcaagtgatcctccctcctcagccacccaagtagctgggaccacaggcacacaccactatgcccagctaattttttacagtattttttatagagatggggtttcactgtgttgcccaggctagtctcaaactcctgagctcaagagatccaccagcctcagcttcccaaaaaagcatcttgtttttactcgcatgctttgtccctctgccaggacagtagctgtaatcccatctttgccatctagcttgcccccagtggctggtggggcacaagttttatttcttgataaggctgtcatattatggctaatgcttataaatgcttcatgttggggtagagtggaaattgacactttcagccatgaagacctcaaattttgggactagctagcctgtattgcaggctttggtgaagccaagggcgtctcctggaagggctgtattcctttccttctgtacatttccttctttccctgattgtagcaggataagggtgaggcagccgaggtgcctgggctgcaccatttaagcaggcgtcactctcagggttgtggaaatgcgggacaggcacctgagggtgatagcctctttacaagtgtcttggggacctctcgtgccttgccctggttctgggcctgcagcctggccagcagtcatctgagtttacttctcattttcatgtcaagaaggaactgcagatgccaatgctctgactctttcctctgatttccccagtatcacagcttcctttgacaagtagtatttccgggttgcagtaggtgaccgtttcctcacatttttgccaacatgcaagaaaccagatttccagccagcaacattattgtccacatgccgagtgtccatctcctctcctcagccatttttccatcttggttctgttacttgtgacattctgtttccgtgtgagagatcctgcatcagttaggaatttcatacagctctaagtgacagaagcccccacccagtggcttcaacaatttgaggatttatttttctcttgcaacaaggaaggagttctggagggagacagcccagggctggcatggcgagtccctgagaccctgggtcctttgatctttccactccgcccatccctagcacagtttgccgccttctgtttacaatacggctgccccacctgtgacattacatctgtgttccaggcagagtgaattcacgaggaaaaggtgcataggagatgaatgtatttctctagtaagtagctttctcagaagctcaaccagtagctcacacttacatcccattggatactgttgtgtcccctggaaaccctgtctgcaagcggagctgaaatctagttgtttttgttttatttttatttatttaattttatctaagtacacggggtaggataaaagcttggctatgatggagagaatatctattgggtggttaactggtcatccttgtcacagctctgctcggcttcttttgcaaaccggtcacaccatgtgggaaggaaaatagccattgaggtagcttttggtggcctccaacttttatcctttgccttattgtccccaccacaggaagaaatatttttcttttagttcctgtctgtcagtctcaggggagactctgactggctcagcttgggtggcacatccgtccccgtgattatacagggacacgagcaaatgcttgtcatctccaacttatcatgtggagggaaagggatggcttcccccagggtgggacagtaatggagaaaaacagcttgcactgtaagtccacgacatttctgtcctacattttgcaagatgtgatcaatatgtattggcaaagacaaaatgagaggctacttttggtggagagcaaatgatagtcaagacaggaatgtgagaattgtgtatactgtcctgtaccagtcaggagcctagcttggctgcagaagagggctaataaagaatgaaataggtgaggcaacaaggagttggtagttgaaaagcatttatgttctttctagtgaggttgttttgtttagattcttctgcctaaagaggaaatgtgttacgctgaccaactatgcgcctccagccatctcttctacttgtttttgacgttatagttgttagcattgggttacttttgacagaaaaccccaaataatatttgtttaaaatatacctgagtttttttttctctcatatgaaagcacagataggcagtccaggattggcttggtgcctcatggtttcaggggattgtgcagcttctatctttctacttcctgtgtggcttcaacttcatggcttatggaaacatcacactctaggtggcaggatgaaagcagggacaaagcataagggacatctgaatgttgtcccttaaggaaggtccccagaagctgcccaatgacactcccactcatgggtctttggccagggccacggctagctgcagaggaggccaacagatgtattctgggaagctcggctcaaaacactatcttgtgggccaggcgcagtggctcacgcctataatcccagcactttgggaggctgaggtgggcggatcacctgaggtttgagaccagcctggccaacatggtgaaaccccgtctctactaaaagtacaaaaaaatagccaggcgtggtggcaggcacctgtaatcgcagctacttgggaggctgaggcaggagaatcgcttgaacctgggaggtggatgttgcagtgagctgagatcacactgttgcactccagcctggacaacaagagtgaaactccatcttagaaaacaaaaacaaaaataaaaacaaaaccccactattatgtggatgcagaagagaagggatattggagggtgtcagcaggctctggccaggctcagtcctctgctcagccttcacagccagagatcatggggataacaaggtcgtggatctcagtggacctgactgacatgaatctgtatttacaggagcccaagggtatttcttgcagggggtggattatacagctgaaagcagctgcttttacaggattacgaagagtagctcttttccacgaaacaatttagaatatacacagtgaaggaagtctcactaacttcctttaagaaagttgaggtgagaaagagtagacagtttgtaaatggaagttacctaactgacttctgcaacttggggggctttgtagcatcaacgggtcagaatttcttagaggcattcttactttttaggtctcaaatctctgtcatttttcccttacggtatttgcacagtgcagcctgccttctgtgacctacagaagcacattgcatttaacctgaggcttatttgatattacactttttttctttccttcaaatatccacaatctaaattgtgttcagaaagttccgaagagctgtaatcccagcactttgggaggccgaggcgggcggatcacgaggtcaggagatcgagaccatcccggctaaagcggtgaaaccccgtctctactaaaaatacaaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaagaaagttccgaagagttgccagggctctatttaatccattgctcttcttagcaatgcaaattctgtgcacaatgagtttattctccttgagaagataaattcagtttggctccagtggctaaactttgttggacaagtttattcctgtgtgacacctacctggccaagcactgtcatttggatgggtctttgggcaggtaagtttctgtgcacctagaaaccttccctgctgggatcttgtcccttgagctcctcctctccagttataaactctgttggcatctttataggatttactttttatgtggattccattgtctccaaaatgccctttcttagtaactagttgggccatctacaccctctttcggggtacgacatagaaatggaaatggaaaatttgtaaggaattatcataatgttaaaatacagataccttgtcattaaaccattaaaaacaaaattttaaaaaccttaagtgttggaaatattaggattccaatgctccttccacttcctgaaggactcatttctctaacatacttgctgaacaatcctcctaccttttccctgcggcattactaaataattcagattgtttgaaaggcattctcttctatcgagatgcaatcaaatttgaggagtgtatttcattctcgccgaatgcattatatcttactttccataaagagaatccaggtatgtgctattgccttatgccttgaataatatgaagcgaagcgatcactcttatatttggggagtgttttagagtcttcagatgctttatgtagtatcaatggctccaaatataataatgtacaattaagaatcacataggcaggcatttttataatgaggaaaagtgaagttaggagagctatgttcactttccaaggctacatagaacgagtgagcgccaggactgacagttccttcctgctctggatcttgtgggctgtctcctccagcacactgcatgctagaggaagccagcgatggggcaggagtggggcgagcatggcagctgaccccaagatgggcagagagcctgcccctcactgttcttccccgccttaaaggacataatctaacctctggacatggactataatctagcctcttctttattacttagggtaaatagtacgtctactgattattaattaaataacattcttcacctgtacatgttatcacactttagttcttagactgctttcatattcaacgtggagatctggaaaggcaacttgactatcttcattttatgattgaagaagctgaggttgagggaggctaaatggcttgtagttacactacaaacactaaaacagcaaaaattagcattggaactagaacatctgatgcatgttcatgactttgtcctcacagtcatatcctcagggtctgtggagtggtgtgtggctgtggccccttagttagaaggccgcagggactgtggtgttttaggttgtgccggctcttcgtcattttcccttttctctcctgtcccttccttccaggctatgagctatatttgtgccagcaagcagtgtttctctctgtttcagctttttcctactttaatttgtttgttttcatctgttaggatcttagagatgagagaaccaagatgatttggaatttcatgtgagattacagaggatagactcagagctgaatggtagcctatcaataacgttcatacatacactctctgacctctttgttggtctccaagaagcctttcagatttagttcctggttgtgggttgtgtttgaggtaggaggaccttgttgatggttgcattccaattaaatgagatggcagccctcacggtgcctgtgtgcatacaacatgtctgtgttagatgtgcatttgcaagtaactggttatagaacattattttggaatacaacacttgtgaaatctgaagatggttttaaactttgtatttcacctgcaattatcttgtagtactctcagttaggagaaaaatatctcttttgctctgaggattcctcagtatttttagtgactctttgcatgcttgcaagggctgtgagaacaagcccagcaggaaggaagagacatggggggaaggaaggaacgtgagggaagtgagaagaaaacaaaggcaaagtttcatacctggaaggcttcgtgcaccagcgcccacctccggaaaccacagttgcaaatattcttttgtgacctaattttggttctaggtttcctttcctctgtatgtgtttgctacattccattccctatgcaatagagtttttctgtaaagaagtttccaagtataaccttccatgaagctcctcaattttaagaatttataattttccagtcctagtgcttaactcatccatcatttgttttccctcatattttacctgtttggttgcactcaaagtcttcgttgatggatgaaacctgatggtttttaagaagcagaaaataccagttttgtcctcactgattgatttttcttgacagatcacgagtataatttataccagctcagtggcactaatcttgttttgttgttgttcttaaaacagctttgacaataagctgctactctgactttgattcttaagtcagcattaatgaaacaccattcatttgtgttatcagctgtaatagtcaaaaacaggtttaagactttaccatgcttgctttcaagttttgggtggatttctttttcctccaatgcttaaaaggtttagtaagtgaatgtcaggtcaaatgggcgtagctgagtttctcccaggcacgctggctttcctgtggatgtttttgtcacagcagtctaagtgtatgtctttctggcccggtcagggaactttgctgtggggatttggtttaaattcatgtttaatctcctaattttatttttgtggctatagtgcctcaccgagtatactgaggctgagactggacagaaagaccttttttctgataagctcttaatctgtatcaggctcagccaaaatgagttctgttagggctgctatttttagctatgtgtaatagctattgtggtctcacaatacacttgtttatacacagaatatggttttatgcacagaattttgtgtattaaaataataggcaaaatgattacaaataatttcaggtgtgccttgatacaaatcagatctgtatacttgtgttttcctgttgacatctgtcatttgcagtcagtggcttaaattaaaattttttggtcttagggaaaatcatgtgagggtttccctgttgcctctctcgggcagagcttctcagccttgacactattgacgttttagaccagacacctctttgctgtagggggtgtcccgcgcatcgtaagaggtttagcagcacccagggctctacgtactagatgctagtgcctcccctcccccactctcagttgtgacaatcaaaaatgtctccagaccttgccagatgtcccttggggatatagggctgccagagttaacaaatgaaaacacagcgtgcctagttaaatttgaatttcagataaaccatacaaattgtttttattgtggtaaaatgcacagaatataagacttaccattttagccatttttaagtggctaaaatttgtaagtggtcagtgtcattaaggacattcacattgttgtgcaaacatcatcaccattcatctccagaactttcttatctttgctagctgaaactctgtccccattaaacactaagtccccatcctcccctctcccagcccctggcaacctccgttctcctttctggctctatgcatttgactcttctgggtatctcatgtaagtagaatcatacagtatttgcccttttgtgtctgtcttatttcacttagtgtaacgtccttaaggtttgtctgtgttgcagcgcatgtcagaacttccttccttcttaaggctgaataacattccactgtgtgaatgaaccacatctccttcatccgttcatccatagatggacatttgggttgcttcccgcatttggctattgtgaacgatgctgctatgaccactggtgcataggaataattttttagtgtaaatatgtcccatgtaattttagtacatacttttatactaaaaaattattcattgtttatctgatgttcaagttaactgggcaagttgtgttttattttattgggtaatgctacctggttgagaaccactgccctaggactgaactgctatttttttttttttttttttgagatggagtcttactctgtcacccaggctggagtgcagtggcgtgatctcggctcactgcagcctccacctcctgggttcaagcgattcccctgcctcagcctcccaagtagctgggactacaggcatgcgccaccaagcctggctaatttttttttttttttgtattttagtagagacggggtttcaccatgtgggccagggtagtctcaatctcctgacctcgtgatctgcccgcctcggcctcccaaagtgctgggattataggcgtgagccactgcacccggccagctggactgctttctttgcttgggcactggctcagggctccaaggaccgtggtcataccttcccatgcaacttacatatgacttccaagacttccagcacagtgaagagcacatggaaaaatgtgggcaccataacatctacataccctaaatgtgtcagtcagcttcaatttgttctcagtttgggaagggtgatagagatactgacccttccttttgacctgcctcttttccattttattctggtaaattcacgcttattacagcacttacagagcaaatcatattatgattataattttatgatatcatacttttatattatgaatatatttataatatgtgaaatgattggattcttcaaaaagtcaacttaaagaaacaagttgggatcctcactggctacttgtgtcctatttcaaattatttctatttgccctttctgctcctctccccagctttattgaggtatgctggacaaataaaaattttaagtatttacagtataaaatgtgatgatttgatgtatgcatatgttgtgtaatgattaccacaatccagctaactaacatgtctatcacctcactagttacctttttttttttttttttttggagtgtgatgagaacccttgagatctactctttgggcagttttcaagtatatgacacattgttattacatagagtcaccatgctctgcaatagatctccagaatttattcatcttgcataactgaaactttttaccctttgatcaccatctgcctttttgctttttctatcactcagagaaagccagttagtggataatttctacatgattgaggttaatagaatgcggccacctaaaactgtccctgaggcttgggaatttgggtgaatcctgattctgccatgcactttgggcaagtcacataccttcagtctcagtttcctcatccgtgactaaagaatagcatgaatgccttctccatggaatcaccatgagaggtaaaggaaatattgcacttacagctcctgctatgaaatatctagcatctgacagacatgcaccttgtcttagatgtcgagctgcagagcagttttcatggcagaaagagagcaatagttgctaacacgtatgaactgcttactgtgttccaggtactagtctccagtttttacttgtattgttgcatttaatcctcacactgagcccacgaagcttgtcctaacattattccctttcacagatgaagaatgtgaggcacagataaggtacattcatccaagggggtatgtctggcaagcagcagagcagggcttggcattgggacatcctgattccagtgggaatagttgtcctaaccacttggctagatggctgcctgtggggtggtgcttctggatggaacacagggtgcacagtgatgcatttgggaatcactgaggcaggagagtgaccccacccagccctccaggccagccaggataaccctggagggctggagggggacacgtcctggtgagtgcaccctccctctgggttccaggtgagatacccttccagctggccttttgagcccagctcccccaggaaggaaggatgctctccagcaggcgctcctcagagcaccttctgtgttttcacctcacttagaaaattcaacctctaaacatcattgagtggcactgagaactaaagccacaaactcccaacttgagaaaatgcaatatttatacatttaaaacagccaaaatggttttaacatacctatactgattcaaaaaagaagtctgagccaggcgtggtggctcacgcctgcaatcccagcactgtgggaggccgaggcgggcagatcatgaggtcaggacattaagaccatcctggctaacatggtgaaaccccgtctctactaaaaacacacacacaaaaaaaaagttagctgggtgtggtggcatgcgtctgtaatcccagctactctggaggctgaggcaggagaatcgtttgaactggggaggcagaggttgcagtgagtcaagatcacgccactgcactccagcctacgcaacagagcaagactctgtctcaaaaacaaaacaaaaaaaaccaaaaaaaaaaacaaaaagaaaaagaaatccgttttcgctgagccctcctggcaggtagtaaaatcttggacttgagctccctggggccctgtccagttgccctcagtgccctcccttccagcttacccatttaccaggtgttcgaggctgctgccagtttaaattttgtttcaaaaactggccttctctttctttttattctgcaacattttgccttggggcctagaaaggaatccttagtcactgattgccgtaggcggatattacctcacccagtatgggcttccacgctaaagacctctcacaaacacttgcacactttcagactcaccctgcacaaggcacgctgacgctgtttcctagggcttattcccaagaacacgtctctgctgagacttggtttttgttaggatgtgtgtgattccatgtgttccatcatgcagaggagatgctgaaagttagcgctgtggctttcaagatcctcctgtggcgcctttgtatatggcatagaatggtgccaactggagtagcctgagaaccagaaacaagaattctgcttctgaacagcttcgtttttgggccagagaattgtttccaccagaggaggcgtgatgggagcttaggggctatgtgctcggtttctgaagttgtacaacggagcattcatttgcattcatttgacaagtcctgctgtgttcctttacttgttctcttctgtattatgggcttaagggtcgcttatttcaacatcgctatattttccctgaaagctcagtaatgattgaatcacagaatttaaagagcttgtcgtataaatacatctaaagtgaaaaagatgaactttttccccagtgaatacaggcaaccatcaatcaaaggaatgcatcctggaaaagaaaggcacagggtaaagcctgcctcctttgcgggtcccatctgttcttgggaggacagtccccatgtattgctcctgggccctttgtggccgagcacgaacagctgtacatacaaaggaggctgtgtgtttgttcatgatgttggaaccggaagtggaaggggctttcttgtcaaagaaggcacatatgagtgccatagttacgggacaaaaatatttctcctggaaaatctattgaagcctttgtgcgatgttcagcagagtgtgttgggggtgggtgtgaatgtatctgtgtgggtgaaatgaggataatgtggtcatgtgaacaattcaaggcaagaaaagatccggtgatactgagaatcctgattctcctttagagataggagttctctggctattctgaagagtgaagttactgcccatgatgttgcaacatatggacatttgcaacaattttttttttttttttgagatggagtctcactctgtcgcccaggctggagtgcagtggcatgatctctgctcactgcaacctccacctcccgggttcacgccattctcctgcctcagcctcctgagtagctgggattacaggcgcctgccaccatgcctggctaattttttgtatttttagtagagacggggtttcaccatgttagccaggctggtctcgatctcctgacctcgtgatctgcctgccttggcctcccaaagtgctgggattacaggcgtgagtcactgcgcccggcctttttttttttttttttaaatgattcttttgttccagttattgacctagcaccagcatttgtcttatggataaggtgagggcaaaattgcactgggtgtggcaaggtgattctgcacttagaggttcgtgtttatggtgctactgagggactgaagaattcatctggaaacttttggctgctcccctatcctcttcttgctaaatcagaatggcatacagttaaaaatacgggccccaacccgaacacaggatttcaaggcttgctcactgcttgcatgatcttagaaagtcacatctgactccaaaccttcgtttcttcatctgaaaaacggtgacgatgatgacagaactaccacctgcatggtgatgctgtgcactcaggaaggttttagaaccactagagtggactggggctggaatggcttctgtcacagaattcagagttcccttgtactgcagagagtcaagtgcagctgaatggctgctaccagggatattacccagatgttcacaggtcatgaaagtgtgggacaagatgacctcagagcttcccctccactggtgacaacacatgtaacatgcctcctattaagcctgtaatggggtaaattgtatccccaccaatgataagtccaaatcctaacccctgatacctgtgaatgtgaccattcttggattataagatctttgcagatttatggatcttgagataagatcatccttgatttaggatgggccctgaaatccaatgattagtattttttatgagaaaggagtgggagatatgagacacagacacacagaggggaatgacatatgaagatggaggcggagacagtagtgaggcatctcaagccaaggcatgctacgggttgctgacaaccaccagaagctgggagagaggcacggaaaagattctccctcagagcctcagaaggaacccactggactaacaccttgactttggatttctggctgctgggacaatgacggagtaagtttctgtagttttaagccacccagttttcgatactttgtcatagcagcattaggcaactaattccatatctcacccataataaacactcagtgctagcaattggctgccactgtggtgattatcagcatggaactatgtgttcctgaagagaattagttattccatttctatgaatattttcaacccaagattgttgctctcagttaacgtactgaaaatgaacttggtgaaaaagtaaaagctcttctacatatcccatttgtggatagacttaagagaacagaaagcttattatggaataagcaaattaatacctttgggatcaatagagtgtctacagttcaaaaccctatcaaaagtgggtttacgtaaaaaaaactagtgtgttatccatgtgtaatattttgtataatatacaaaattctggaaaggaagactcacaatgccagatcaagtattgcaacgtcagttatggcaggaacaaaggctcttcccagaagcctgtcttcattgtgcattctttcaccagaacaacttgctgtacttaaggcacaggacatttggatctagagatgtagctgttgtgactcaccatttctataaacttggtgactggtcccaggctgtcatatctgtacctgatccactacagggatgaattgacattttcagtggctactttgagtccagatattaatagatcagcctgaaagggaggatgaggcagtaatagcacttttacaagcaatagaagacaagctcagggaacaaaagagaagggaagctccttgaatttaaaggcaagggcagagatttattcctccactaaatctaaggactaaaagcttaggtggagagagggctcaaatgtgaattcacttctcatgctccctttgtgacctcctttaaggaaggccagatttgaggaatgagattttcccaaggggaggaagcattgtcttcatcacttcatgtatttttctcagaaggctattggcctcctggaatttttacttagaattccagatagtccaatgatgctttctaggtaccgtggctttcactgtggtgagagttttggctgcagtgcttttctgtaacccactcacaaagcctttggggatggtgatagtatagggattgtccttccaactagttgctctccaactagaaaggcgaatccctttttctttgagtcacagaggatggagaggctcagcattctcattccctgtttgggtttccacccctgtggccatgcaatttccatttatagccatgtattggcttacaagcctaacaccaatcctgacccaaagcatgaggcactctcacacatttctaggttaagaacactaaaaagcaggatcatcaggttattttttgttatttgtagatttctgcatagcctgatgcttcaacttcccaagacctcatttcttcccagagtagctggagtagctggacctttatcatgttctggtatcaaattctgccttggtaatgtgtacaatgcttcaagaattgcggactccatattactctcctgtgtcatgtagttctctctttgtgaaagccatccttccctgaaacccctcatccacctgcctaccttgccaacattccctgctcctgggttgcccttcattgtgttctatttatgggtaaccatgctttgccaggaaccatgccaagtacttggaatacgaaggaagtcattgatggagaggacacacaagtaagtaaagggccctgataaaatgcgacgagagctaggcacgtggatttttatgcaacaaaggagataggcaaggagcccacgaactagtttccaaatgctggacccccttgatcaggaccttttcggagcaggctcaagtgtctcccaacacctatacctggctggaccccttgccattgtctcaccacaagttgatgctatagttccagagggctgccccgccaggccactctgtcttttgcaattccagggtgggatgtgcattgtctacttggacctaggaactcccttcagcagttctcctgtggacctgtatccaagccaccctacaaagtgagcatgcactctgatttaggaaacttttcttgagagatttattctatagtctccctaacatcccattctggtgtttattccattaatttagagcaaacacccattcagtgaagggccctgaaaggcatagaaaaggacaaagtatcagacttgatttctgctctcagctattaaaactggagaggcaaggcacatagaaagatagggatgacatgatatttaaacaaatgttctacacagtgtttctcaatataatgttcttgtcctgttggggggcttttcagtaagcagtgtcagtgaaagggcagtgacagcaggagatgatttttggttattttctgcataggcatcctcagtatggaaggctgtgcccacctacgtttgaaatgtgcaagcttgattcttctctcttttcttctttattagtctagctagcggtctatctattttgttaatcttttcaaaaaaccagctcctggactcattgatttttttgaagggtttttcgtgtctcttatctccttcagttctgctctgatcttatttacttctcgtcctctgctaacttttgaatttatttgctcttgcttctctagtcctttttattttgatgttagggtgtcgatttgagatctttcccactttgtcctgtgggcatttagtgctataaatttccttctaaacactgcttcagctgtgtcccagggattctacaatgttgtgactttgttctcattggtttcaaagaacttatttattcctgccttaattttgttatttacccagtaatcatacaggaccaggttgttcagtttccatgtagttgtgcggttttgagtgagtttcttaatcctgagttctaatttgattgcactgtggtctgagagacagtttgttatgatttccgttcttttgcatttgctgaggagtgttttacttccaattatgtggtcaattttagaataagtgcgatgtggtgctgagaagaatgtatattctgtggatttggggtggagagttctgtagatgtctattgcgtctgcttggtccagagctgagttgaagtcctgaatatccttgttaattttctgtcttgttgatctgtctaatattgacggtgggatgttaaaatctcccactattgttgtgtgggagcctaagtctctttgtaggtctctaagaacttgctttatgaatctgggtgctcctgtattgggtgcagatatatttaggatagttagctcttcatggaggcaacctcaagtagcattattgttcttttcatccttcctctcctactcacctcccccactcctgacaaaatatggaaatcctgtccctgagtagtcttgttcacaatacacaatctcacagccaaaggaatgtatttttaaccctgagacgccgaaaacggcttgaatcattcatgctgtcgtctattagtctgccgctgtgctgttatttttcccaggcttaatgagccctcatggcactgcgctgcctcagagcacggccgcagcttcaagcacagacaagcctgctctttaaatatgcaagtcatcagcctttcttggaaaatgctatggggaaggtgctctggacaagcaaacagatgatttttgcagactgttctgtagttaatttgggtcatgaagcccactgtggctcaaggagtttaggggacagaaaaggggcttttgaaggattaacaaccagataggaagaaagaaacaaatgaagggtaatcctggttttcttttgagactgacaagaaaaagttgtttgaaaggaggacactccaccattgttgttgttgaaggagagctgtacttctgatgtcccccaggctttgtagtagttaaggggtgagggattgcaggagctgctcaaacctggctgctaatatgacactaggagcctgggtgacacaggggccatggtgccagctgcaggtagcgtgggattgaccctgttagccctggacatcaagcctggagtgagagatggcccgaaaacccctgggacctgatacaagcaagggctttgggatcaaccaggctctcactaacaggcatcactcaaaaagaaaagcatttatttaatagagagtttcagaaaatgttccccttattatttttctttgatttttgaattggaaggcgcttagagatcctgtcctttaacccttgcgttgtgcagatgagagatgtgaggtcagggaagtttagtgggctcagggacgcacacggagttcacagggtagcccgatgcagtgggagggtcgatgggcttctgcctcagagttcttttcaccctaacatttcctgtgcatttgtttacgtgtgccagggatcgctctaagtgctttgtacacattaaacttatctaatctttaccctaactgtgagaggtggctgccatcatttttatttaatttcactttgcattaaatgatgttggcacagtgatgttaagtctgttgcccacagtctcctgcctggaagtgacagtcaggattcaagccaggcagtgggagcctctggagcagccctccaaacctctaccccatatggctcacatagcctctaaaaagggttttgtgactgatctgagatcctaaccattatctatgacttcatattcctgagcagggggcagctggggaagcatttcaagatactcaaggacaaagcacccatcaacatagatgggtgcaaactcaatgctatctagttcgctgcagctgtttggctaaaggaaaacagaatacctgcagagctgatggcttggagactagatgtacaagattacaagccagatgcaagtctagtttctggggtccatctgtgagcagaggtgtgggtggaggcccagaagccaggctaccatttgggattgactcttagctccttacatgcacttaagcagccattcatgaccttttctgcagctcaactgatacactcaaggctgggcatgtccttctgttctagtcattctgcttttggtccacttctatatgtttgttaccaaactagacattgtcttcaagacccactctggccaagtcctggggtcatgtttagtcctggaaggacctccaggagatggaggtagttcttagttgaccagaggggagcaggaccacctgtgctttaaggtcatcctgatttcctggtggtcgttaatacgaaagaagctacaccaggcttgacttctctgagtcagtggtgttcagagcccttgactcaccctggacctgggcttggcaggaatttctctaaccttaggtggatgtatgggtgagtctgcacagcaacttactgttctggtgcatttgtgttggcatgcccatgtaccgggagatgccctagggacttacttatgacatactgacctagagagggtttgcgtataaaattttaacttgactcactggttcctggcagggtcaataaatatttgtggactcactgagtgaatgagtgagtgaatgaatgaaccagtctgctaagaagtgtgagcacagaatatgtgtgctgttctgacacatgatgaccctatcatcctttgaggacctaccatatagctcagttttgacactgcttgtgatttttttttttttttgtctttgagacagggtctcactctatcacccaggctggagtggagtggcatagtcataactcactgcagccttaaactctttgactcaagtggtcctcctgcctcagcttcctgagtacttgggaccagaggcgtgtgctaccatgccagataattaaaaaaaattttttttttatagacaaggtctcactgtgttgcccagggtggtcttgaactcctgacctcaagcaatcctcctgtcttggcctctgaaagtgctggttttacaagtgtgagccaccaacccctggtcccacctgtgatatttttcaccagctcatggccgtggggagcccgactatttgcatacgtgttttttgctcagtactgacacctggtggcagtgtcccaaattgcaagcacagtctctagcattaactcagtgtcaggactttggtgtggcggaccataagaatgggagcctctggagttatgcagagagaagtagccctaccagggaagatgtaatcttgcaaaataacctacctaatgacaatgagtctcttgtcttttcttagggctgcataatcagcaccacctgatttagtggtaagaggaaaggtgctagtgggaaatgccattatttaaaaatacctggagactactgatctagtttaagaccaatatttgtcccacatttgatattagaaccaatagaatgatagaagtaatagctatggtactattaatagctcctattgaggacctgtgaacacactgctggaccctgtatatttagtatttctaatcctcatgataacctaacacatagggattattatttccattttacaaattaggaaatggagctttggtttagtaacatgcctgagttcatggtaggggctggatttgaatctcaatttgcttgacctcaaaggctatgctctttcactctgcttcaagggtactgtgttactccaggggtgccattcacattctagtcagtgtacatggcatttctggggttgtgtgacttgtagccatcctctttccatcattcccactgcctctccaggagccaatcatttatgtctcttctaagctcagtgggtgactgaggctgtgaagacatttaaaattgaataatgtatcctgtagtagatgcattgactatttctctagagttggcatcctaaaattcaaaatttttggtctggcagcctgtgaaaaaaatcgtattttgcctctaattctcaaccctggagagcgccaattagttgtgaagttactttcaaactgaagcccaatttatactcctaataaaaacatccaatgtaatcatatgtgaaatggaggctaatggccctataccacccgagcatcaccatagtgatggtgttgaggataaaaatgatgacaatgacaacagcagcgatgataatagttaaccattgtcgagtacccattatttccttgactccttatagacactctgtgagggaagtaatagtattgtcccaattttcagaggaggaaatgaggtgtagagatgctagttatcttacccaagctcagttgactgtgctggtaagttgtgaagttaacctaggttagcctgagttcacaggctatgctagattaacttcagctagccttgcttttaaccacctacactgacagcctttcaattgtaagaggagctttgggtttttgctttgaaagtagaaacaagtatctagtgataataatatgcctaataattatcctgcacaaaataaataatccagccacttatcaccacctctaaggcaccttctcatcctgtcgttttaaggttttgttcttttggttctgtccccagccaggttttcttttccctccacatgcctggtgtggtgtgagtaaagcatctgccattttgattatggcacacttgctacctcttcttaaaacattcgttctcatccctagtattgtgacattctatcatatctctgatttttaaaaggacattggtgaatttccagaaaaaaaattttccaacctccttttaacctggcatcttttaaaattaaatatgtctctccaaacatattggtggggaagagttggtgtcatgagttaagtaggggtataattacaacccgaaagtttgggggcaaaatggagcagttccctcattggtcagagttctgtcattggcccagcctcctgtcctccacaaatctgagtcagggtgagacaccaagagcctcccttgagaccggcactacttggaaacatgactggctatttctgctgcaggattcctggtccgggctccagcaaaattattgttgtgaacataggccttgaagaggaggctgaagccgagaagccaatattcactcaccttttcaaccttcgacaaggctgaaatttctcccatgatatcactggaaggaagggcagagggagtcaacaatgaagaaagtgggaagagggagggagaatccaggcaggaaaaggggggtgaccgtgcagcaatagctgtgagggcttcccagcagcgttagacacaccctttgcttcagggtcgccatctctgtctgcatctccttcctctccttttgacccagcgtccacttctactttggttagttaaatattgaaataaactcctttacaatgtgtggaagtctcagctcctcagcattgtatcttatgggaatagttactcttcagcctccgtgtgtatccagggcgtggaggccatgctgtggggactgtgtgttaatgtccttgtagctcaagaacagctgctcttaaatggtccgtgctgcggtttagtggacacaacatagcacagataagtgaagaaacaagtcatttttaagtgacgcaaatcacagtagaaatatgcaacttatggaagtgaaatccttttagtattaatttttcttaaatagcaatcctttgtagttgtaagatatgtaacgtatatattgttacctagttggatgaaaaacagctaaatcaatgattgttaggtttcttaggtgaatgatctgtttaataaaattattggaaatgcatattctttattttgatcaggtggacaaattgttccatttcatagttacaccctgacttccatttctgaagagataacccaaaggttactggtggtgatggagggcatcccagtcctcccctcatttgaggggcagagcttaattctggattgtgcttcctccactggagttgatttagagagcggtttggtgaaaaccgaagaaagggtttatctcagagcctcctgctcttgtttgaacacgctgcagggattaacttgtggttgggactgagccagagagataaatgacatagcccttgtgtgctcacattcagagggagctcttgccaaatgggacaacgaaggattgtgttaaagagatttctgaacatcttaatacagcaggatgatacagtctgctctctggactttctggggagcactgagccaagcctcagaggactgtggcatgtcgtgagtgtttaatatgcaagtgacatctaacaggggaaaacaagacatttggaaacaccattgggtggggtgggtcccccgcatttttcagcacggattttttccaacaatctcatatatacaaaggaagtaaattcacaaaagattgggtgttgggggcgtggggcgtggtgaggaaggaggaaagcactaaattttattagagtgcttctcaaaattgagagactgaaatttccaaagcaggaaagattacactgaaagttgggaatgtcttacaaatgtacatattgtcctctacgcgtgatataaaattgttcagcaatagatatttcaggaaacgtaatcagtgtaaaccctttgatgaggaaagccatgcaaacatttttaaacaattgcatccttatgtaatcctggtgttaaggggtgggcttaaaaagccaattcggtgagtagagggactcgtaccttatacagggtttggcgtctaaagctaacacctaaggcataaattaagcacatttacaattgcccttgaaaattccttaagttgcccataaagtacacaaggttttgtgtgtttgggtcttttcagtaatataaatgtggacgtgcacaatggacaacacttaatagaacacacatgcaaaatagaattttccagaatttttattgcacaaaacattcacatagagtgcacctggttgaacgtatggaagttacatgcgcatgtggtatgactgcagttgtggatagacctttttactgcgtcctcctctctagcacctaagtggttcctgtattcttcccaacgtaattaaactgcaggaggaaactggccattccaggtttagacagctgcccctttgaaagagaggaaagtgtgtccatgctggggagaggcagctgcaggaaacgtcctgagcttgtgaaagtctgaccccaggaaccaccctgagctgacctcccaacattctggttcctactcctcaggctcagaccctggttggttcacggccctggggtcatctacacctctttggccttgaccttggacattcggcccagccaccttccactccacttttttttctcatagattcaccgttttcatcctgcccatattctcccagcatccagccaatacctagttttcccagcatctagccccagttcctagttctgctgcccctgctctaggctggtcagttatatagcgttgcttccctgcaggtgaggtggcatgtgacagggtagggtaggtctgacacccctgcactctctctacccacaccgtgaaaaatagtgagacaacagcattgcattcttcattttgaaagaggtttgaatgtttttatttgtggaaggtagatgtcatgaagagttgcataattaaactagtacagaggaaaaactggcagagaagtgagttgcagggctaggtttacatacaggatgacaaacctgtctctaaagatcccgggaactgttgtcacatggtgacagcttatgatggtggctgaggacactgctctttacctttgtgtctcttgtctcgtctctgaatctcaatacctgtaattaagaaggagcccataggagttttatccatcttattttcagatatttaagcagaataaatatattttcacaatcctttgaaactctcttccttcttaaaccttaatgagattccaaggtagcaacaaaggcctttctgatattacctgtacaatcaaaaactgagcttgaacttcctataatttcttctttttggtcaaaggagtcaccctccaactgacatatttataacatgtccctgtgataacgagaaactactcacttatctctgagtctcatgacagaaagagtatcagaaaaaaagatactacaatccttcaaacacacagcagtgtgagacaaaaattacactctaatctgcagttgaacaggttctgtcttccattaaacctgtatccccattttattatatagttgagccagttatatatgactcactgggaaagtgcattttatgatcttgttagaagaaatggtttctctgggatccttttaagccaataattttatacctagctcctcctaaatatctaggacattaacttattagccattccggtgtcaagcctaatgctttttaaatacttaaaacaaataccaggaaactgtgggggttggagaatagattttccataggcatttagtgctttcagagatcagggggatcgatctcaggggatttagtaggaaaagacttgattctctgcttcctctgcacacagagctttcattttatgcaacaggagggacagcatgcatgtgggataaagccaggctgattatttcaaaaccaggctcacatctatttgactgacaaggtcctggcccccggccagggttacagcaccggaacatggtctcttctctgcggctctgctggctgggcctgtgtggaggcgggtggatggggggatgtccaggctgcagctgacagggcacttggagatctcagaaggcagtggaggcttggggactgaaggggacccggcttcgatggggtggggaagcacagcagcttggtaggaaatgacctgaaagagggattcctaaacatgcatgtatgtttgcgtgtgtgcatgaaagcagctgtagatcacaactaatcttttttttttttaattgcaaatcccactcaattcttcaagctttcttggcagcatctgatccagttgatggctttggaaacacttcattcttcattggcttctatagacatctcctcccgggggttcttggcttccctgaccactccatctctgttctctttactggtccttccttctcatccgtcattttaaggttttgttcttttggttctgtccccagctgggttttcttttccctccacatgcctgatgtggtaggcagaataatgaccctcccaaggatgtccatgcccttatccccagaacccggtgaagatggatgttacaaggctaaagggattttgcagaagtgaggaaggttatggatcccaaggtggggagagcatcctggtttatccagatgggcccaatctaatcacatgagcccgtacaagtggaagactttctcaggctgggcacaggaggagccatgaggcagagggagtgacagtgaggtttgaagtgtgagaagtgctggatgacatgccactgcaggctttggaggtgaaggggggcccatgaggcagggcaagtgggcagcctctgaagctgacagcacacaagaagaggaggacctcagcctagggccacaggaaactggattctgccaacaacctgaccaagttcagaaatgtcttgaatcccagagcctccagaagagaacatagccctgcgttcaccatggtttcaacctgtgagactgagcagagagccagccgagtccttctgtgttggacctctgacctacagaaccatgaaaccaatcattcgtgttgttttaatctgctaaatgtgtggcaatgcagtaccacagcgataaaaccaatccacccaccaccaatggtcttatgattctaatagcttcaattaatcctataaactgacagccggtccctattccccattctgctgaatcccaaagcctcacgactttcttctgttaggcaactctgcttggctgtgttaaaaacacatctaaccctacatgttagaaactctgccagctgacaaaaccagaaaccttgagtcagtctggattctttcctctctgttttattcattgtgtaatctcaactccatcaggtcttggttgaaatgtcagcatctcaaatgggtcgcctccgaccacccaatttaagatgacagcccccctcctacacgtaatcgtcctttatgcttatcagcatcagtgtattgtatgtttacttaccactttgcttattattagctgtcttccctcttggaatgtcagcacatatgtgttttattgtattaattctatttaataagtagtaatagagtggtttccaagtgtcaggaactgctctaagcatttttacaaatatccacttatttaatgctgttttttcaccgtcatagctctagctgttagaatagtgcctggcatgtagtagttgctcaataagtagttgttgagcgaataaatgaataaatgaatgactccagcctaacacgaagtcctgtcaattctatttcctaaatacctttcctaacaacccacctttctccatctgtaatgaactaagaaagtggccgtatcattctcctttgtagggcccttgaatggcttccctttgtttgtgggagaaaatccacactcctgcagggattcacacacgtttcttgtcatgccctcagttttctgcctccatctttatttctcaaaactcccctctcatcctctcttgccttccttacatgctaatcttcaatcagcccggacattcagtttccctaatatgtcccatcctccctcttcttccaagcccctgagtatgagctccttaccattggcattccttcctactacctgccctgttctctgcttattctatttttttttttgagatggagtcttgctctgtcacctaggctggagtgcagtggcgcgatctcagctcaccgcaacctccgcctcccaggttcaagcaattctcctgcctcagcctcccaagtagctggaatcacaggcacgtgccactgtgcctggctaatttttgtatttttagtagagatggggtttcaccatgttggccaggctggtctcaaactcatgacctcaggtgatccacccacttcagccttccaatgtgctgggattacaggtatgggccaccatgcctgggtttctccgcttattcttaatattttaactcagctgtttccctcctccatgacaggacacctccctcacctccacctccactgagaaagtgcctttcctggtgctcactgctattctatcttgtcctctgtccttcccctctctctgtgtgtggtaaagactgctttccctgtgcaattctctcaccagtttgcacggttcttgaggccatgagctggagagtacgatccacttgggcatcaagtgcaccagctggcacctagcagggactcagcacatacctgccgagtgagtgaattggtttcccatggcttggtgagccccggccaggcactctcccgagccaagggggacacttgttctgccagtgttgatttgcaggcgcaattatatgtgtaaatgcattttcactgttctgccttaggacccaatttttgaaaattagattttaaatgtcgtattctcctcacttacatcttatgcttcccgacattcagcacataatttaaaatgaaaggcatagaaaattggactcatttagtttactccacttgaaatccatgtgagtctatttttaaattctcctagaccctgtgctcttttagggtgtatttgagaggaaggaagggggtgggggagaaaggaaagaagacactcattgtaagctgttagagatgctgcgtgttattgcactttgttttaatacatgcagttttcacattagcattaccccaaatacaatttctaaagccaaagactgaaattgagactctgccttcaacatttgctgctccatgacgttcttgattgcaatgagaggctggctgtggccagcttgcgggtgcatcacagcagggagctttaacattctttcctctgctttccagctgacatgttcctccggctctgccacacccatcagatggcaggtggggagcagattaagacatgggcattcgcagggtgcacagaacgctggcttacaaacacctcctctcataggcatgcaggtgaacagatgggtgggtgggaggttccccttcacccacagtcctgaatctgagttcttgggttaggatttggtatggcagccttcacattgcacagatatccctacattgggctgctctgcatgcctgcaatgagagtttttgggcttcttgcaggcaggaggtgctgagtattcacaccaaagcttggacatataagacaccagtgacccctattctgctaattcataacactcagccggctcccacattcccactgcctgtgcccatccccgagaggctttcctaccttcctttttctgctttataaagcaacagtgagattccaggagcaaggccagcaaagcgaggtaggagagctcatagataatccaacaaacgtgtatggagagcccaccatggggtgctctccccatgaaacttcaattttttttttttttttagatggagtcttgctctgtcaccaggctggagtgcagtggcgcaatctcagctcactgcaacctctgcctcctgggttcaagcgattctcctgcctcagcctcccgagtagctgggactacaggtgcacgccaccatgcccagctaatttttgtatttttagtagagatggggtttcaccatgttggccaggatggtctcgatctcttgacctcgtgatctgcctgcctcagcctcccaaagtgctgggattacaggcgtgagccaccgcgcctggtctgaaactcgaattctaatgggaaagacaaaaataaaaaacaaaaaatatataattgttaaaaggactgcagaggcaccagtaaaggatcagagagcaaattatcagggtggcagccagccaagaactgtaggggaaagtgccctcaaaggcgggaacatttaagacaaggcttaaaggataagcaagctgcccccacagggagggagcagagcgtgccagacagaggatggggaaagagctcctgcagtggagatgagaaaaccagacgtgtgatctgggggccgggggacgaggtaaccaggggatgagggaaagagggaaaaaacaagcaaggctgaccatgccccacctgaaggttttgggaaggatttggattttattcaagatccagggaaagccagtgcaggtatcaagcaggtttttctgggatctacttccaggaagaaggacaagtataaaaaggtgcaggggaggtgtaggctcctcccctaagagggaacctgctgggtggccctgtagaagacagcagtcatagtttccatcagagctgtgcattcaaccttctctatttcccagctgtgctgcatggaaacagaaaatggcatggccaggccaggggcagtggctcccgcctgtaatcccagcactttgggaggccaaggcgggcagatttacttgaggtcaagagtttgagaccaccgtggctaatatggtgaaaccccgtctctactaaaaatacaaaaattagcctggcgtggtgtcacatgcctgtagtcccagctactcagaaggcccatgcaggagaattgcttggacctgggaggcagaggttgcagcgagccgagattgcaccactgcactccagcctgggcaacagagtgagactgtctcaaaaataaaataaagtaaaataaataaaaaagaaaaaaaagaaaacgccatggccagaggcgccacattttagcttcaggaaactgtgttgaatactctgagttgtaccagcagggacactcccagccgcccataggtccttgtgctgagcaccgggcattgcctccttcctgcttctaccaggaaaattgctgtctgggagccttataacacagactgctggggtttgtgggagatcaaggattatgttccctgtggactagtttgaaaaggttgaaattcagccccttcataatgtcatgctcgtagctaagaaggcttgcctttttctcttcctttgtccattttagaattaactgtggatatcggtaaaagcagcctcaccactaatacatgtggggctggggccgtgatacagcccaaggcccctatactatatatctgcatattttcagagataaatcagtctagtaaatggctaaatatagcatgttctattgtcctaccttgatgctttaaaatgtattattcaggcatgatgaggccaacagatcaggagacagctgccattgaaaagagtttgttactcacagttcccaagggctgggacatgccatgctatgccaggccacatggcgatgcaccagcattggtgaggaggtagagagagtgagggggaagatgtgggcaagagtattgcggtttctgtgagaaggaatgggaaaggcaagacaaccaggcttgggattagctagtttgaataacttccgtggactctggagtatagggggtgtccctagttatctgatgccaggggcaaaggatagtagcccagcatgtgagaccctagtacaggaggtggttgggggtgtgggttctggatttcttggttatcctagcaagggtgtgctcacaggttagttgtttactctttctaggaatgaccctgggaggagcagtccctctagagtcagcaaggccccaagatgtcaaagcatcataaaatactgaaaatgaaaaagaacatgattgttgacgaagaacatgacttgacaatatgactttttttttttttttttgagacagggtctcgctgtgtcacagaagctggaatgcagtgatgcaatcttggctcactgcaacctccacgtcctgggttcaagctattctcctacctcagcttcctgagtagctgggactatggacatgtgccactacagctggataatttttgtatttttagtagagatggggtttcagcatgttgaccaggctggtgttgaactcctgacctcaggtaatccacctgcttcggcctcccaaagtcctgggattataggcatgaaccaccacacccagccacaaatatgacttcttaatgattaatgattaggagaccaggtatgagtttagaatgcttgaattccttggactctatatcagaaagcagaggtgccagagcactggtccactgaacccagcctccagctctatttttctgcacatctctgttttccctcaccatgactgtcttgcagatttgtgcacagacactccagcatgtgtgtctgagttttgtctacctgctctgtggtgggggcttggatgcactgcccagatccttcttctggaaggaagggtcaggtttctgcagctactcccagctgtcagcctttcaggtttgtgggggctaaagaaaatggccttgtccaaagttgcatctggatctggtatccaatcaatgcagaggcataaaagccttgtcccttgtgctaactcggaagaagggctccttggcttcagagctccctgtgggttggctggggcatttgtcagatatgctttgcagctccgtgcaatcctgcctcttctctgcactttcacaggtggtaagcagaagagactccctaataagcatccagggtgttaaactctacctcagggtcagcttcctggggaagcccacccaccacagtccctttccactcactttccttccacatacccttaacgcagcaagccccctgcaccctcaggcctaggaaagcacagactggccatactgtgcacactcagaagcctaagctggcaaagaggcttgcttgagtttaagaagcggaagttacaatcctaatctctgataaaatagactttaaaccaacaaagatcaaaagagacaaagaagggcattacataatggtaaagggatcaatgcagcaagaagagctaactctcctaaatatatctgcacccaatacaggagcacccagattcaaaaagcaagttcttagagacctacaaagcggcttagactcccacacaataatagtgggagattttaacaccccactgtcaatattagaaagatcaacgagacagaaaattaacaaggatattcaggacttgaactcagctctggactaagcggacctaatagacatctacagagctctccaccccatcacaaacttaatccatcacataaataccaaatacattcttctcagcacctcatcacacttattctaaaattgaccacataattggaagttaaacactcctcagcaaatgcaaaagaatggaaatcataacaaatagtctctcagaccacagtgcaatcaaattagaactcaagattaaggaactcactcaaaacctcacaactacatggaaactgaacagcctgctcctgaatgactcctgggtacataatgaaatgaaggcagaaataaagatgttctttgaaaccaatgagaacaaagacacaacaaagcagaatctctgggacacatttaaaacagtgtgtagagggaaatttatagcactaaatgtccacaggagaaagcaggagagatctaaaattgacaccctagcatcaaaattaaaagaactagagaagcaagaggaaacaaattcaaaatctagccgaagacaagaaataactaagatgagagcagaactgaaggagatagagacaagaaaaacctttcaaaaaatcaatgaatccaggagctggttttttgaaaagatcaacaagacagatagaccactagccagactaataaagaagaatagagagaagaatcaaagagacgcaataaaaaatgataaaggggatatcaccacctatcccacagaaatacaaactaccatcagagaatactataaacacctctatgcaaatgaactagaaaatctggaagaaatggataaattcttggacacgtataccctcccgtctaaaccaggaaggagtggaatccctgaataaactaataacaagttatgaaattgaggcagcaattaatagcctaccaaccaaaaaaagtccaggaccagatggattcacagccgaattctaccagaggtacaaagaggagctggtaccattccttctgaaatgattccaaacaagagaaaaagagggaatcctccctaactcattttatgaggccagcatcatcctgataccaaaacctggcagagacaccacaaaaaaagaaaatttcaggccaatatttctgatgaacatagatgtgaaaatcctcaataaaatactggcaaaccgaatccagcagcacatcaaaaagcttatccaccacaatcaagtcagcttcatccctgggttgcaaggctgtttcaacatatgcaaatcaataaacataatccatcacataatcagaaccaatgacaaaaaacacattattatctcaataggtgcagaaaaggccttcgacaaaattcaacaccccttcatgctaaaaactctcaataaactaggtatcgatggaatgtatctcaaaataataagagctttttatgacaaacccacagccaatattatactgaatgggcaaaaactgaaagcattccctttgaaaaccaacacaagacaaggatgccctctctcaccactcctattcaacatagtattggaagttctggccagggcaatcaggcaagagaaagaaataaaatgtattcaagtaggaagagaggaagtcaaattgtctctgtttgcagatgacatgattgtatattaaaaaaactccgtagtctgagcccaaaatcttcttaagctgaaaagcaacttcagcaaagttgctgttatcaatgtgcaaaaatcacaagcattcccatacaccaataacagacaaacagagacccaaatcctgaatgaactccctttcataattgctacaaagagaataaaatacctaggaatacaacttacaagggttgtgaaggacctcttcaaggaaaactacaaaccactgctcaaggaaataagagaggaccaaacaaatggaaaaacattccatgctcatggataggaagaagcaatatcatcaaagtcaccatactgcccaaagtaatttatagattcaatgctatccccatcaagctaccactgactttcttcacagaattggaaaaaactattttaaagttcatacagaaccaaagaaagagcccacatagccaagacaatcctgggcaagaagaatgaagctggaagcatcacgctacttgacttcaaactatactacaagcttacagtaaccaaaacagcatggtactggtaccaaaacagatatatagaccaatggagcagaacaggggcctcagaaataacaccacccatctacaaccatctgatctttgacaaacctgacacaaacaagcaatggggaaaagattccctatttaacaaatggtgttgggaaaactaaccagccatattcagaaaactgaaactggaccccttccttacaccttgtacagaaatcaactcaagatggatcagagacttaaacgtaagacctaggaccataaaaatcctagaagaaaacctgggcaataccattcaggacataggcgtgggcaaagacttcatgtctaaaacaccaaaagcaatggcaacaaaagccaaaattgacaaatgggatctaattaaactaaagagcttctgcacagcaaaagaaattatcatcagcatgaacaggcaacctacagaatgggggaaaatttttgcaatctatccatctgacaaagggctaatattcagaatctacaaagaacttaaacaaatttaccagtaaaaaacaaatagccccatcaaaaagtgggcaaaggatatgaacagacacttctcaaaagaagacatttatgtaacaaacagacgtataaaaaaatgctcatcatcactggtcactagaaaaatgcaaatcaaaaccacaatgagataccatctcatgccagttagaattgcgatcattaaaaagtcaggaaacaacagatgctggagagggagtggggaaatagggatgcttttacactgttggtgggagtgtaaattaattcaaccattgtggaagacagtgtagcgattcctcaaggatctagaactagaaataccatttgacccagcaatcccatatacccaaaggatcattgtactataatcattctatgataaagacacatgcacacttatgtttattgtggcactattcacaatagcaaagacttggaaccaacccaaatgtccattaataatagactggataaagaaaatgtggcacatatacaccatggaatactatgcagccataaaaaaggataagttcatgtcctttgcagggagatggatgaagctcgaaaccaccattctccgcaaactatcacaagaacagaaaaccaaacaccacatgttctcactcataagtgggagctgaataatgggaacacatggacatagggaggggaacatcacacaccggggcctgtcgggtggtggggggctcgggaagggatagcttttggagaaatatctgatgtaggtgaccggttgttgggtgcagcaaaacaccgtggcacgtgtatatctatgtaacaaaactgcatgttctgcacatgtaccctagaacttaaagtataattaaaaaaaaaagaagtgctcccagggacatttgggcaggaaattcccgtgttctgggtaccaagaacacaaaccagaattgaaggggcaaatcttttggccatgtgactgcctcaccatgcagaggggcattctggaggaatctggaagtgagggttctctatcatgatgcccagggcaggggcccctcttgggcaggtccaagggctattctagattgaagcagatattcaatcatttgtatttttcctgtgttaatttttttttttttttttttttttttgagacagagtctcaactctgttgcccaggctggagtgcagtggtgcgatctcggctcactgcaacctccgcctcctgggttcaagcgattctcctgcctcagccttctgagtagctggcattacaggtgcgtgccaccacgcccagctaatttttgtatttttagtagagacggggtttcaccatgttagccatgatggtctcgatcttctgacctcgtgttccacctgcctcggcctcacaaagtgctgggattacaggcgtgagccaccgtgcccggccttcctgtgttaattttttacacatacttgttcatcacccatgtatctatcacctgcatattaaaggagaggagacctctgtgtgtgtcttactagccggggcacgttgtcttagcatctttggcctctaatgagactatgtttataagcaaaaggtgcccagtcaggcatagtgaggccacttgggggtgagggccggtgcctggatgtggacagcatgtgtgtgttttgaggtgggagtaaggcctggagtgatgaatggaactttatagccaacaaaaggctttcctcaaatgggaagttgttctgacctcactttgtgcctctgcttggccaatttggcctttttcctgccaaatccatttggcataaggagcaggcagtatttgggctggctgcttgggaactttgtaagacagttgaggagggcacctccagcctggaaaacactgcgtagtccggatctggctgccttacgggggcgccatccttggccactgagcacaaactacgtcttcctgctagtgtcccagcagctctcccaacagcaacagctcagaccacccatcagacccacaagctcgtgtgtcttttaacagttgcatatgaaaagcctctgctttagagggaaaagtaaattctttccttttgcgaaattccctcagtgaaattcataaattatgtttcatcacaactgggcaacaatattgtgtatttgtaaaaacagagcctttggcataaaacccaagtgggtctgaattttttatttactccttgaaataacttctcccagccccagtctccttatcctcaaaagggatttagagagttattgtgagaattaaacaaaataatgatgcacatggagcatcctgccagcactcagtgtgagctcacttttcctagcttaagaagatcaagtgtggattggggcttgttttaaacacaagttgtttaagaagatagtattccacttttaaaacaaagtcccaaattttcttccttcttctgtctataaaaaagaatgaaaaaaaattctgtgtgtgtgtgtgtgtgtgtgtgtgtgtgtgtgtgtgtgtgtgatgcccatatttcagggaaataacaggagaaagaatcaaagaatgagactgcatattctcagttgcatactactaggtaagacagtaaataggcattctaagcaatttaaaaaatactgtaaattaatctccaggtcacaactctttcagttatatgcgccagaaagcaagaaagcaaacccaaatatgcctgctgctgtcagcagggattgctgagaaaagttagcctgtctttccatttagaaaaagcatttgacaaaggcacgtgagtgggaggctgtgaagtgaacctgcttggaactgatagtgttagctttttactgacctgctttccataccgcaagcatttggtttttcttttgtcattgacttgtgcggatttattagactgtgtgcttcaagggtgtcaggagattgcatgtaggagcaggtctgaactgggaaagtgagaattaccatattagatgatacccaattaactagtgacaggcacagcaggtaaaatcggtacctgggctttatctactataagcactcgccacatagcaaacatttttaaacctggtggagcttccttactcatttctcctttccttcatcctgcccactctcccttcctgtctaagcaaggagctgtgtctacctatgtaagtatcaagacagacaggtctttgagatgtgctccagggttcaagggcaatggggcagaactctctgagggtggtgactcactgggaagcaacagccacacaccaccccacaggacaaaacagtggaagtggaggcatcaacatagttcagaataattgattttacttttttcatggacaactgagtcacaggatgatgtcccagttctgaaaacactttctcactctctgttctttgggtacctttgccagcatgaagttacttactataactcagcattctcactcgcgttactcaaaggtgaaaagctggaagaatgagttaatcttacttccacattcaaatgtggctattagggcagtgatggaagctcagagcctgtgcttttggacaggctgatttcctgtagctactctgtcttcctttggtgtgggatcatgtagtccatctagtgatcataatgtaagcttggagggaaatgatttggaaataattgggaaggtaaaatgatatgacatgaaatgcctgctattctaaaacacaaatcttattttatgtgcaactgctgttttggattatccatgcctcctcctgcatcagctagcatggaaaatcctttaagatctctaactcagtcacttcctcagggagtcatgtttaaaccccctcaagctgggccaaatctccctccatgacgctctgagaatgactgctgcttttatcattgaatctaacttgttgcttttattagtcatctattgatgtgactctttctgttaccaagcctgattttcttaagcccacgggcagcgtgatattcacctctgtggccccagtgcctaacatggaatctggcatgtgttaggcatttaaggaacattagaggcagggtgtggtggctcacacctgtaatctcagtactttgggaagtggaagtgagaggactgcttgaggccaggagttcgagatcagcctgggcaacaaagtgaaccctcatctctacaaaaaaattaaaaaaaaaattagctgggcacagtggctcacacctgactcagctattcaagtctcagctgttcaagagattgaggtgggaagatcacttgagcccaggagttcaaggctgtagtgagctataatcacgccactgcactttagcctgggtgacagagcaagaccttgtctcaatgtctcaaaaaaaaaaaaaaaaaaaaaaagaaaagaaaagaaagaaaaagaaaaaacattagatgaatgtatgaatgacagtcaggtataactccaaagagaaaccctttccctgttaccacttattaaatcagtaggactcatatctgttaattttccttctctctgtaaacatcttatcaacatcagagaaaaagagacagagaattaacaacaacatactgaacgatgccctgacaatgagaaatgaatcccttgctagtttggtaatgatgcatttatttggctctggatctagagaatttatattgagtagtcaaaagcctgggaaggactgaactctgttgaactcagaaatcctctcttgagagttctagctaaactagaactaccacagataggtgatagcagaatgctatatttgaaatgctgcaaataaataaatttatacatgcaaatcaaaatcttttagtaaaatcacacaattaacctctcactggggagaaagagccaatgtagatatatgctttagaaagttgttaatcattttctcattgcaacctactttgaaatcaccttggcctattgtctctcatatatatatgtttatatatatatatatatatatatgtatatatatatataaacttattttacacaatgtagatttattttatgctgatatactagtaatgttcttccctacattttacaaacaatgagattttcatttattgatggctggtctttgcaatggtcagtactctttgtaactctgactttttacagcacagcctttggcctcccctgaatttagtgtctttgaacacctgcttcattttgttggtgctgagatttcacatctcatgtgcactaactgctgtcatgttatatgaagttgaagtcatgtgttttgtaacaatgagctctggaactatcccttactggcagtgtgactttgaaccttactgctgctccatttaaccaactgtaaaatggtgataatggtagagctgcttcactgatactattatttagttcatgtttagaataaggtgtttaaaacaggtcttgcaaaagaaagtgctcagtaaaatggtagctaaattgatatcacgcgtgtccccacagtgggtctccaatgtgacagtcaatatcatttgcgtatgagcagacaaaactctctaggttttaggggttcatggttgatatttcctttttgcccttcagtgtgaaatttcactcacgtaggacttcatggaaagaatctaccatctttcaaggacttacacaatcttatgccatcctacctgccaagacattccagctgcaagtccattttcctgtattgctgactttcctgggtcttttcaggattatgttacctcttcatcctcatgcatgatttaattatccgaacaaaggttctttcattcactcgaagacagcataataccttagatatttgaaaatttctcagagttctaaaatttctcctttgtctttcacatcttccttctgaaagattttactaagtgggagttaattttatctaaattgattcttgaatattgatctttgaaatctgatgacttattttcataaatgtaggccaggtctcacttggtacttaatgttaatttagaaaattccaataacgtggctaatgtttgacaaactttgccattaatgctaaactggggaggtccctttggcttccattttcaaaggtgagatcgtatcgtactgatcccgtctgaggatgccttccttattaattgagggtggtggggctggagtttcttcaaatcactggtccattcaatctgatagcaagtctgcctgggtgttactcatttcccatgctattttcatgtcaaatactgctgtccccttatgcaagggatacaattcattgaaacctcgttggacttcctcccacttaacattctcctaccttccgtgttgacattcttctaccttccaacttccgtgtttacactgaaaaagctgttgctgggtagcttggttattttttttcccatcagactcatagggatatttttggattattggttatgatgaatatttatggaaaatgttgctgtgcactccagtgagaaatcagtgttaaagaggctggtcccacagctatctctgtgtccctggaagccgtgtcctttttctatttaattagtgccaagtatatggtcttgcatgaaggaggacccagattgaactcctgtagcatgatgtgtgtttcatgcactctactgttttcactgatttatggcatttaattatcaatctgttaatccaagtttttgtttaattggattcatcaaactaattgtatgaattccactctgttatcatggcctgaacctgaatatcagattcccttaataaacagaaacagtgaatgtgttcctgcttcttcctgatcaggaagggggtctgcagtcctctggtcttgtttgtttcgtagcatttcattttgtattcagcatttctttgagcgccctctttgcttcttggaaccttgccttactaccattgccattctcataggtccctgctctactggacctaaaatggtagggaagaaaggaagaggaggggagtaagaagagaggaaaaggtgagctctattctccgtcagcgtgtctgtggctgtattgattcggaagtttaaaatctaaactccctgtctacagtcttggcctgtcttgaaggttgtgagtcaacttagtgaatacatgcaaggtacttttaggctgtctggctgggagataagttgggtccaaagaaagtaatagttcaacatagcattctccttagatggcagcctccaggcaagaagaaaagcccatggctttgcctggaagttcttgtgcaggtccagcgtgtcaccaactggtgcttcagacactgagatgaggcaaatacttagcattcagtttcttaacaaagtgattaacttgatagacatctagattctttttaaacataagaatatggctttcttttcttcaggtggtgtgtccatttttgtccatcggatagaaggtgctatcacaatataaatggcgcgttgcgtacgatcagcaagggcttcttaagttactcccacttccttagtgatactgtccagtctcattgcttcaaacgccaatcccaaatgtctctgttccagaactttcccaaactccagactcagatatccaacctcacacttgacatctccactgaatttctaaaaacttctgaaatttaacaaatccaaagccaaattcttgtctccccaaacccatttcacttctcattcttcccatctcagttgatggcaatttctgttttttttctggtggcttagggtaaaaatctgtagtcattcttgacttttttttttttttttttggaaacagagttttgctttttgttgcccaggctggagtgcagtggcacgatctcggctcactgcaacctccgcctcccacgttcaagggattcttctgtctcagcctcccaactaggtgggattacaggcacccaccaccacgcccagccaatttttctatttttagtagagacggggtttcaccatgttggccaggctggtcttgaactccagacctcaggtgatccgcccacctcagcctcccaaagtgctgggattacaggtgtgagctaccgcacccagccaacttttctttttcttacacctggcatttgacccaccaggaaagctattgtctctacctttaaaatatatctaaaatctgcccacttatcactaactcctgctaatgcactagtttaagtccctattgggacatagaatatgatactacaaagtacagcaccttggaaactgagaaaacagcagaagcagaaagggtactctgaccatctgctgtctttctgtgtgagctgatcttaaaggactctcttgcttaccttccctgaaaggtgagcataagacccttatgtgacagttgccctgccccccaatgtggagggaaggaatgctacacagaggccaaggagattctgaacaaacagccatgctgagctccagtttatcaccattagatcatgtttttgtccaatcacgtttctacacagctgtccatttttcatatgcttcattgaacctaagcacaaaaatagacagttttctctgggtcttggggtcttcatctctgaaggctcctatatcacataaaactttggtcacataaatttgtcatgcctttctcttgttaacctgtcttttgttataggggtgtcagccatgaccctggtgatgggtgagaaaaaatattctacttttcctcctccacatctccatcatcttttcctggacgattgcactaacctcctccatgtctttctgcttccaccccatcctcccttatggtgtattctcaacatagttgctgtaggtcaatctcatttttttcttctacagtgtttttccattccactcagaacactcaaaatcctgatagtggctttctagttactacagctgtgcaacaaaacatccccaaacttaatgacttaacatcaccattaattatgtgcaaaattctgtgagtcaggaattcagacagggtatagtgggggggacttgtctccatcctgcgatgtctgggtccctcagactcagaggcactaaccacctgaaagctcattcactcaggtatctggaggttggtgctggatgtattctaagaccatcacccaggttttcagcttaaacacctacacagggcctctccatgtggcttgggcttcctcacaaaatggtggctgggttcccaggacagagagccacgcagaaactggactctagcctcagaagagttatagaatcccttccatcatactcagtgggttggagcagtcacagcctgtccacattcaagaagagggaaatagtctttacctcttgatagggagtggcaaggttctggaagagtatgtggtaccagaaatattgctgtggccattttgagactatagtctaccacagtggcccgcttgattggacctgggttgtttctctgccttcatcttttctccctatggaacatttggctccggccacacttgctagagcatgcagatgtgcttctgccctggggccttcagactgcctactccattcacaagatgcctgttgatgccctcttccctccctccgcaaacttttatggagtgtcatttccccagtgatgccttccctgaccactctacagccccttttcacttgctgtctttttttttccccttaaatccttattgtcattaccaccttctaatgttttatggaatttttatgtttattctttagcatcccttgctgccagaatggaagcactacagaagcaggaatctttacctcttctgtccactgagctatctcacatgcctagaacagtgtgtggcacataaatatgtatgggatgtgaaacagagagggcgtttctggtttgggcatttggaatttgcaataattgctccagctagcacaactaagtttgtgtgttagaccagcataagtcaataaaaaaagataccaacttaaacagttgttttcattgtgtaaatgtctctttttatcttttatggactaatgaaccagaatgtttaattgttttaatttccatctaaatatttagtttctttatgaggaatggcagggtactttttccagttccacagtccctcaccttacacatacacgttgactgaaatagaagtctaagaatccccagacactccagtagcatgaatctgggcagcctggcttctgtgtttccacattctccaactttagagtacatgagcccttcagcataaataacccttcagaataaaggttgtaataaaaacaatgataaaacccacaataacaataataatactagtaatagacatggcagcaccattgataattccagccaccatttgctagaaaccccttggctgcaggtgttcttccaggcacttggtgtgcacgtctgttagttattatcttgagaggaaggcaccttcattcctcggatgagcaaaaggggagaacttgttcaaagtatatcaaatctcttttatccgtaaagtgcctctttgatctgctgaaccatagcaatcattcattccttcaacatttggtaattaggaagcgctgagtttatctcaaagagtagctgatctcatcactcattggatgttgagcagttgatttctagttactggcagaatcccatgtttatgtttatttctcaatgaaaggttccacaatcctcctctacccctagtgtggctcttctggttcatctgtaggatgggaatcattacactgtcaggttctctttccctgtattggacaaccgagccaatggctatcagttgggaaaggtaagagatagagcacatgtcatccagtgatagactatcagtgagctgctttttaaagactacagcaaggctggctcagcgctattgctccagcctctgactttctcctgcagagacactcagagccccggaatcctccccaactcatgacttcaggcagccactccagtggatttgagtgttttccaaacatagaatgttacgattactagtggcttgacctcaatcctttggctttgagcttttagttgaatggtttttattcaattgtgactgcagttgcattaactttggatttcctttttttcccccagaaacaagtgtgaaggaaaatactatgaagtacatggaaacacttaagaataaactgtgcaggtaaggataataatttctgtatttcagactccgtagcacatctagattctttattataacagaatttagttaaatcgatgaaaaaggctggccagtttctctaataaattaacaaagaaagacacaaaaaagccttttgaaccccatcagtgaaagagcaggtgccagccctcatcttgtcttttaaaaagtaagtagattaagatgtttaaaagtgtcttggagagatcacaggagagttttcatgttccataagagaagaatcttctttactatattaaattcagaattcattccttagtctgtttttcccttttttaaactttagtgtttgaggggggtcttaaggattttaaggcggtttatacatggtttggaataatatagaaatgcacgtcttaggttctgttttgaatcctgaatcaaaaccagcatgaaaatttctggttgctttttttaaaacccaattaggaattcatctttgagaaatgtcagggatgctgcagcatgacaagatgtttctggcttttgtggatgtgtgcttaggaaaataaatcccagtcatcagaatctgttcctaattaaggcaacaagtactagagtggaatatgcgctttcttccctggaagtcatttagttttatggagaccattttgctattattttggaatttgttaagtaactctttagataggctatgccttaagcctttgtctgctaggacgctgtcttgagctaaaatgctgcttttccattaagagatgttgagagggcctgccttgcagagccctactcttcagggtaagcaaggcactacaggatttattctcatccttggaaagccgtcctataacctcctgattgatctttccctgcttcccatgctcctagacttgggaagaatctatgacacaggtggttagcagaggtgagcagaatgaggagagcttgcacctgggtcagatgctccgctctgagtctggccttcctcctctcgcatgtgttcggggcagatttctggcacatccttcttgatctcaactgcagctgccattgttttagccatcagcacagcacacaccgtaagttacattaggttatcaggcagccagtggtagccataagcacgtgggtattggtaaagagacacccatttaaattgcagctctcccacataaaaactgcctaaccttaggtaagtgctcactttctgttcagtttgttttgttttgtttttttagctatataactggaggaaaggtacctacctccccagctggtgtgtgaatttaaataccatatgtaaagcattcatgtgattggtagtaggcacgcattagtttcctttaccttcttcttatttatttatttatttatttattttgagatgaagtttcgctcattgcccatgctgtagtgcaatggcgctatcttagctcactgcaacctctgcctcccaggtactagcgattctcctgtctcagcttcccaagtagcttggattacaggcagtgccaccatgcccggctcatttttttatatttagtggagatggagtttcaccatgttagtcaggctggtcacaaactcctgacctccggtgatccacggccttggcctcccaaagtgctgggattacgggtgtgcaccatcgtgcccggccacctccttctttatatcattagaactgattggacacttatgagtggaaaaacacaaactgcttttcctctgttctcacacaatgcaataatcaacacagaaggcttctgtgatgaaatacatgagggtttctccccaccaaaaagtaagcaatcagttctgctgcagataccagctgggtgtcctctaactcatttccgacaccagctacctggagacagcatcagatgccacaggttgagggctcagtcccacaagactgccccacttacaatgccaatggcaagcccaggttgttttgcctgggcttctgaccaaccaactagaaattgggattcccatgatcccctccttgggtttgattaatttgttagactggttcatgaaattcagaaaaacacttatatttactggtttattataaaggaggttacataggatacagaagaagagatgcatagggtgaggtatgggaaaggggcaccaagctttcatgccctccttgggcacaccatcttcaaggaacctccacatattcagctatctggaagctctctgtaccctctcctcttgggccttttgtggggacatcactggataggtgtgactgaagtatggacaaccatgtagcaatgtgattggacagaaactgtgacctaccacaaatagactgagtgggaaaaccccacagggcctgtgtgttcagattccccagcttctctgtgcagcgtttcttccttcaggtgtgggacaggactccttctgaaatgagggtctatgacctacagtcagataaggtaggtcagagaatttctttccttctttctttttcataagttcaacttttattttagattcagggggtatatgtataggtttgttatatggatgtatcgtgcgatgctgaggtttggggtatgattgatcctgtcactcaagtagtaagcacagtacccctggaattagttttcaacccttgcttcccttcctcctctgtcagtctccagtatctattgttcccatctttatatccatgagtacccagtgtttagctcccacttgcaagtgagaacatgcagtgtttggtttttcgttcctacattaatttgcttagaataatggcctccagctacatccatgtttctgcaaaggacatgattttattctttatatgactgcatagtactctgtggtataaatgtaccatgttttctttatccatttcaccattgatgggcatctaggttggttccatgactttgctattgtgaatagtgctgtgatgaacatacgagagcatgtgtctttttggtagaatggtttattctcttttggatatatacccagtaatgggattgctgggttgaatggcagttctgttttaagttctttgggaaatctgccaactgcttctacagtgactgaactaatttacattaccaccaacaatgtataagtgttcccttttcttcacaacctctccagcatctgttgttttttggctttttaataatagccattctgactaatgtgagatggtatctcattatggttttgatttacatttctctgatgattaatgatgttaaactttttttgtatttctgttggctgcttgtatgtcttcttttgagaagtacctgttcatatcttttgcccactttttaatagagttatttgttttttctttgtcaaattgtttaagttccttatggattctggatattagacctttgttagatgcatagtttgggaatattttctcccattctgtaggttgtctgtttactctgttgataatttctttttctgtgcagaaatggtttagtttgattaggtcccacttgtcaatttgtgtttttgttgcaactgcttttgaggatgtgggcatatattctttcccaaggctgatggaaccataaaagagcctgaatatccaaaacaatcctgagcaaaaagaacaaagctggaggcaacacgttacccaacttcgggctaaactgtaaggctacagtaacaaaaacatcaaggtgccggtataaaagctgagaatttctttatggtcagctccaagacagaaaggcagggggagattagggtatatttttagtttttatgaactgcctaggggagaaataacagtggatgtgggagttatgagccaggaattgtagatgaaaacctatatacataatttcaacagtcatgcttggaactcatcctctctccctccatgtcagctcctcctcctgttcatccagcccaatgcacggcccaccacccacctggctgcctgggtgggcgggcaccatgggctcatgctggctcaccagcctcctttctcactcagttcccagtcttgtcagtcttgcctctttagcatctcacaagcctgcctacctttatcacactgacattgtgggcccctcttctgatcataatagcaacttttcctgctttgctgttccactgttgccctcttaccaccttctccaggtggttttgagtaagcatcttaaaataccaatctggtcattgcacaaggctgcccgatgtcctaagcataaagcctaaatgccttaccatggttcatggcattcttccatgtggcctctgcatgtacttgattatcacccatcactaccccatcatcaccctattgtagctgatacttgttcccttatgcttcccaatgccattgcatttttttttttctggaaagaaactaatttagaaggggacatggttaaggagtatcatccagagaaatattcgattgaatcatgtgaaattgctgatatttcaccatttttgacctagaaaaatgacaatttcatatagttaacccaatatttagggatttgaagtcatcttcagaagggtcagatgctgtggctggtctccttgcccttgacacacaggcatagtttgctcccccacccctctgcatgtgccctggtgggcctctcccagcccacccctcaccctcaccaggccttcccattcagccttcaaggtttagatttctcctctgtgcaaccttccctgactaaccaagactgagtaatgtgcttgcaatgatttattctcactttccaagtgctccttgacaggtattataatgtagcaggacaagccgcagacaaaactcctcagacgctgagttaaagaaggaaaagctttattcggctaggagcttcggcaagactcacgtctccaacaactgagctccccgagtgagcaattcctgtcccttttaagggctcacaactttaagggggtctgcgtgagagggtcatgatccatgtgagcaagcagagggtacgtgactgggggctgcatgcactggtaattagaatggaacagaacaggacagggattttcacagtgcttttctatacaatgtctgaaatctatagataacataaccgattaggtcaggggtcgatctttaactgccaggcccagggtgtggcaccgggctgtctgcttgtggatttcatttctgccttttagtttttacttcttctttctttggtggcagaaattgggcataagacaacatgagaggtggtctcctcccttaataagattaagtctgccttgttcaggactgtattctcagtgatttgccagtgctggatggtacaggggttcccaataaacatgtattgaatgaatgattgaataaatatgtgaattaatgcaaataatttgtaaacatcctaggctcatcttttgtcatctccagcctctttctctgcctctccagccatgctgacgttgcaaagccaccttgcccctggcctcttgactcacataccttagctacctaggatcctgccacagtctcaaatgaccgtgatagtagctggcccttcctgtagcctggagggctcttttcatgctatttcaagctattatgaggcctgggtcagatttgtgtgaactggtatggtgtaaacaatggaacagggaggagaaaaagcagctaggagtctgcaacccctctggcagtaggcaattctattcccacttcagaacaggaggccagagtggatgctgcaaaagcctggtgaccatcaggctctctgtgacagagcccagtagttatggttgttttcagacactctgtgggctccactgataatctgtcaccttcacagttcctttccaagaggatcaacattttacaataggaaaacagttttaacacctgacacagtggtgcatcttagtgactgcttgattaacatctcaagttatccattaaagaagatgaaaatctttacctgttcccactgttcagcgtttcttggtcttacaggattttagagaggaagcagctgagaacagaatggattgctccttttccattagaatgctggagagcatatacttaaagatcagagctaagaaacctaaatctggctagtcaccattttggggacaaattcaaatgatagcactatctttgttactctttcaaagtatacagagacctgaagacccagatattgaggcaaactcaggtggactcaagatctattctctatcaagtatatcaagtgagttagaaagtgaggaagtatctgatgctggcagtggttcaaaagcacatcttgcataactcaaagcaaaaagtggacaaatattacatgaggacttttagtgtatgtttaaataagggtttgccttgtaatcatctgagttataagttagatgcatgtattcctgttcctccttctacaaaggagagattccatttgtggattttttttccaatttccacctgttttaggaatatccctccttctccttatccatagccaaatatccaggagggtgactgcggtcagtacctggtcattccatagaggctttcctctgcattcccatcactactacctgcaacttggcccattaaataatctcctaacagcctctcttccctcctggctcacaacagtttagtctgctcttctcccacagccagaatgactttattaccatcctgttaggctcctttcgcatccagcataaattccacagtccttgttatgtcctcctcctctctgccccttgggctcttcatgaggtggttccaggctactggtccaacctcatctctgtaatcctcatctgcaccaggtgactgatgctccattctagcccatttccctacattaactgtgctccacagcagcacctttgcagagccctccccgacctagcccctgtgctcacactcatccttatgactcagcacaattgtccttctctataaagcctttctggcctcctgctatttcctgcatggtacccatagtggtagccatgtacacgaatgtgttgcattcactcagtctgtctaattctattagactgtgagctccttgtagatggagcctttacttttcttatattccaagtggtattctaaggtttccatgccttactttccttgtattctaagtggttgtcgtgctgtttggcatgtagtcaacagacaaattgtatttaatgcaagaatgaatggataaatcgcaattttatcttgttcctccttggaaatttatttgcaacttgattatcttgacactatattctcaactattacattcagaaagtcaaggcaacctgagaagatacagtgcccaaatccatttgtcttgccatcaaatcttagtggtatataatagaatagaaaaaaacgactcttaaagagcttgacccacttactctcactccttcagggttattgtttccagaggtgagtagttaagtgtgattttctcctagcttgttttctcttatggccaaaccttgctttagtttttattttctcaattattacatattatctgttatcttttttaaagggtcaaatgaaatattcagaaggctttactttatagatgggttcctgttgaaatggatcttatatctctaaccattgtacaggaggaattcattattgcctgatggcaaactcatgtctctggaccaagtgggccaagccctccccctgaggatgggtgtagtggttccatttaactgatggaatctcttgtatgcatgactaatgtgaacatttctcttctttctagaatctcttcattctaactctactttttttcctgaagttcaacataaaacctttaccacgaactcttgagcacttggtagattataagtgatgcttgcgtccttgtcctctagtgaacctttaccacaaactctcgagcacttagtggattatagctgatgtttgtgtccttgtcctctagtgtgttcctcaagtgtttgcttccagtgtgcatcacacttttatcatcagaaaagacaaacaaaaaatcttttaactctgttttgaacatagaagaaagtagttggatacctccttggaggcccttcttagctttagaaggaactgtcaagaactcaatggtcttatctgaaatttgctttgaaatttagagattgatgtatttttacaaagatgatccagttctctttttaaaaactaatgtttactttttaattattaaaatttcaataggacagcctgatgtggaatgatagccaggtgaactcaccctgctaatgaatgtccagaggtggccagcagggtgagcagcacctgaaagaccaaggtctgttccctcacccaaggctcccagagcctgtgtgtcatggccaaaagagactgtaaactgccaactgctctcaatctaatgaagacgggaaccggggtcaaaaattggagcaattgtttccaaaacaggtgcacacaaaacagtttactggagtgtgggaagaacatattataatttctattttatgcttcaatttcatccatttatattttatcttcaaaaatgttttatatgtatgtagtaatacatgtataccacttgtgaaacaaatattggagtttcataattttcttactgatgagtgcacacagtttaaattagagagtgttgaaaaaatattcatttacttatgttctaatattaaaccatagcagtctccataaaatattcactgtcggatttatacacttttgaactttgaagctatttgactattttgaccaattttacaagagaaacaatgatttacattaccttatcagtttgaaatgcaaactgtaagaaaatataaagcgcttaattctacaaagttaagtgaaatcattaatttgataatcattgatttttgcatttaacttttaccttatctcatcagaaaaatcttaagtatgcttaaaataataatgcataagctaaacatacgcagagaaaaactgcataaaatataacaaaatggcgtgaattaaaaagagtaaaaaaggaaggaaaacaaaggtaggaaaaacattagtaacactttgatggggattagactcaacaccatagtagttcactattctagacactcaattaagtattaactgatatgtatataaaactaagtaacactttacaatgtaaaatgtaaatgatataatttataattaacttttctgcattggcctattggtcattataatactttccattctataagaacccatgtaatgaattttaactcagaaataactttcccaggaaatgttcacttgtgatggaatttagtttccagagtactcagatcaattcaaaaaatctgcatgcagttcttcggagagagaaagcagagttccatcttctagaattccagctccctgtgttaggaaagcctttccttcaaaacaagaaaagaagccgccaaccccgaattggaactggcctcttcacatctggaccacaacatgggaggcggaggcaactcttcccttctcggtaccctgagcagacgtaccagtcacagtaattaatataaaaggtgtccttcctcttgaggcatcacttttaaagcaaaaacaagggaggctgaggcaggagaatggcgtgaacccgggaggcggagcttgcagtgagccgagatcccgccactgcactccagcctgggcgacagagcgagactccgtctcaaaaaaaaaaaaaaaaaagcaaaaacaaaaacaaaaagccctctcacacacacacaaaaacctgtttctgtttccctatgtaatgaagacccctgaggttggcagcagtgttgtccaccgccaactccctgtggtcgatctggaagcttcatctagggaggggctcatgaaggggcctcatgagtaacccctctcctgaggattgttattttcaagtaccagctctggaatcagatagtctagattcaagggtggccatttctgagctgtgggcctttaccaggttaatgcagctcttaaagacttgattttctgtcataacaatgggataacagtagaataagataaaaactatttcttatatataataagggattaatcaatgatcactagtatgtactagtaggaattatggcaccatggaaattatgaaaccaagaaactctacattaaaaaacaagttttattttataaaaacagaagagaataccttatcttcctggtgaaattgtggggagcagagagatgtttgcttgtagctaataccctccattaaggatctgccaaacctcctgattatccaaacactcagcggtttttttttttttttttttttttttgctgtctgccctttggccagctgttagcacctgctgcagagggtgggaagaaaaagaaatgaggtaattgagttcttgctaatggctgtgacagaagatttagagccttcagtggttcctacagtcaagtggcagggatcctagagcacactgctgctctcagaatggatctggcttgttctggagtttttgagattgacagagctcaaagttcccaggctccagagctcaggtgctggggaggatttcccatcacttctgagatttggggagctccaaggcccctcctcttgaccctcagtggagctcaaaagaaaatcgtcttgacctcagagacagcattttggggtgaagatactccaatatacttgtttctttctttctttcttttttttttttttattatactttaagttctagggtacgtgtgcacaacttgcaggtttgttacatatgtataccagtgccatgttggtgtgctgcacccattaactcgtcatttacattaggtatatctcctaatgctatccctcccctctccccccaccccatgacaggccccggtgtgtgatgttccccttcctgtgtccaagtgttctcattgttcaattcccacccatgagtgagaacataccatgtttggtttttcgtctttgcgatagtttgctgagaatgatggtttccagcttcatccatgtgcctacaaaggacatgagctcatccttttttatggctgcatagtattccatagtgtatatgtgccacattttcttaatccagtctaccattgatggacgtttgggttggtcccaagtctttgctattgtgaatagtgctgcaataaacatacgtgtgcatgtgtctttatagcagcaagatttataatcctttgggtatatacccagtaatgagatggctgggtcaaatggtatttctagttctagatccctgaggaattgccacactgtcttccacaatggttgaactagtttacagtcccaccaacagtgtaaaagtgttcctatttctccataccttctccagcacctgttgtttcctgactttttaatgatcgccattctaactggtatgagatggtatctcattgtggttttgatttgcatttctctgatggccactgatcatgatgacttgtttctttctttctggtgttttccttggagaaagcaaaaatattgccctagagaatggcatggacagaaaagaagaagaaggaagattagaagtgaagccctgtgggcttgtctggtgagggccctcttcccaggacttagctgcatgggaagaatctgggtagcactacaaggatggaatccatggggtcttagttgcctgtcatcattttctttgccattgataattcaacacttaatcaaatgcggtggtgtttttgaaagatagcctgaagaaaaagatgaccatgactttcactaatagaatagaaaatagacaggagattgattatcacttaaaagaaaagggttcattaaacaggttccactgtggtttgcgcaattcaacccaaagtttctctgctgtaaagcaatgataagatcactctgcccactgagatcaattgagaaatcaaccaatatttaagaaggtctgagacttggcaaggtgcccagtgactgagaaaagagggttcctctttctttaagttggcagaaagacattcagctgtgatttttacgtggcctgagctaaggaagagactgagctaaggaaggcagtgtcttgtgtaggttatatccatggtgctctatgagcctgtgcacccattatccccagatatgtcaatgtgcttcacagtgtgcacatttcatggcacctgttacagttttaaaaagacagtttaattaattaatggtgaatgttcaatcttagatggtttttttaaactcaagataaaccattatagcttgagtgtttttgatgcatttggctaggagttaggaaatcttaaagaaaaattaattgctgtatcaatggaaaccccagtaggtagataacaaatttgtcattaattaaatgagaagactttttaatgattcgaggaagcgtcgtcaagattgtatgatagtttaatttgctaacatggtatgaacctgttagcttcagacacatgattaataaaagtaaaacccctcatggaatttctcagatgctcagttctagcatgcagtcatttttgagacttgctcaatgtccttatctcactttactgacagttctgcagcagccgtggcaaatgtaggttagacaaaatattacatgcaacattttctatgattcattttgctcctttttccctcttccccttcctctccagccaccctgagtcatacaacagctgtgagaacattagttacaagggagcgagctgcagacactttaggtgctgggctgtatcccattatatctggatgctgacaccaggatgggttctaaatcccttatcacaactgcctcaggcggaaaacatttttttttccttctgttgctgctgatgtaaagatgaagtttctcgagctgagagaattttatgtgatcgtattgtatgctaagcctcagaagataattctgtagctcccattcatcacaaaagcagggactttcagttgtgcttctttaagaaaaaaattccccagtagaaatcatacaatgatttagcggactaagaaaaagaagagaatcaccaacaggatgacttgtgacaattacacgaagtcatttgactgagttatttcctttattattctgtaaatgggaaaataacgaacatgctggttatcagctgtggttttgcaatggaggcgttccaccagtgcagagcggtaattacgctgcccggtctcactttgcaaatgaactgaagcctgtctcttttaattgactgtctgtctctagaattttcttgatttattgctgctcagtagaatttacttttgttttgttgatggcatttgtcaactctagtagttaccaaatggaaattgttctagagggttgctttggcataagtgtgctcatttgtgtggcttattggagcatgaaggagagatgtgcttctgtaagatgtcttgcccttctgcctgccagaggggcaggggctcacctggagtatgtttcatctggttccttagatctgtaagtgactatgaagcctttcaactggaagagtttagtcaagtgtaactgtatgatttcggaatgaatatggccccatctttgtttcccaggtggtgagtgtttagggcattatatagcagctgtgatgatgagagcttggcttctcatctccagctatgttagtctacctaggaagaaggattcttctctaagaagaattcagtgggacaatatccagagatacaaatctcaagagacagactcctgaaaacaaattgactgctcatttggcttcagattccatgcataaatctccagctctgactgttaatcacagccactagacctcacgacataggattttagaggcagataaagaaaatggcagttgatgtcttagcctgttgctatgccagtctatgatgaactagcactacctgaactcaagagtaagaaacaaatgaaactggttataaggtttaggaaaaagcaaataagctgttactgagagtggtgaccatatggtacctatagggtacacgggccctctgtgaaacccgtaatattgggctgcgtctcctctttcctctacaacctgaccccatcgcctcatttgatggattccagtcaattgtaattttgagaattgtaagactagtatactagtatgccaatgtcttgttcttttttttttttttttgagatggagtctcactctgttatccaggctggagtgcagtggtgtaatctcagctcactgcaacctctgcctcctgggttcaagcaattctcctgcctcagactcctgagtagctgggactacaggcgtgcgccaccacgcctggctaatctttgtatttttaagtagagatggggtttcaccatattggccaggctggtctcgaactcctgacctcgtgatcagcctgccttggcctcccaaagtgctgggattataggcgtgagccaccgcacccggccgccaatgtcttgttctttaaaggaagaataaatacacatttagaagatggctacaacctcatgcaaaggtctcgaagcagcaagttgagggacagggcttactggtccaagagtaacttcaggcagggaagccttttcccatgtccttcaaattgaccacatcacttggatcatgaatgctgttgatctggtttcaaaacataagaacaagcatcttcgacaatgcggttgataaacatcatcaacaacaacccaccgaagcatcagttgttttgtcttgtccgtggcagtcctgcattcagatctgtattcactgtgtgatcacatgcatttttcctaggcctataataggtttccctccgcatgcccaaacagtggagctagcatttttttaaatttacaaacaaagattgtaaaattctaattgggagtgggacatcctttttaaataaatagtcgtattaatagtaatagcaaggagaccatctagatagtactctattttcagggctcaaaagtgaaaagctagaaaagccagctgtttaagcattggcaggcaagttatgatacggagtaccctcctcacacccactccaaactaatgtgtcatctttctctgaagagctgtggctgtttttgtggttctgagttgacggggatttttttttttcttaaagaggtacatgtttatgtttgcaacatggtatttcttgcagccatactcctcaagtcaccatctccaaagctcacacactaaacagggtcaagtgagtcaaagcagcaggagagaaccatgattggggtgtctgggactagaatggggagggcagcatgtgcgggtgcggggctggccttcccgtggtctcaagagtgggaggtgtgagtctctccctggatgtttagctcagcatcacctcagagtttgagcttgactgaaaacaacaacaataacaaatatgccgaaatatgatatcatttaaaataaacccaacaacctttaaaaattaacattattccttaatcggaccattttactggtctttttttcttaagtcaggaaaataaatgcaagcctatgtgcaggtcctcaaaaaatgtgaaaataagcctagtaaaaatctggcaagagatgtggtttcatcagccacctcataagcagatcttttcacatagattttaagagagaaagttggtttatctgcactttagtggatgcttccgtttgcttaacttccgtaataagaatccctagaaaaacctggagataattagcagaagggcggaagcatgaatttaaattcttatacccacacttaattttgtcaactttatgatttgctaaccagtgctttttctgccagtttctttaagtctagcttagtattataataaaaggaatcaataataccaatctatatagtaattttcttcaagaaattcaaaatcctatggaggaatttaagaaatattttaggccgggtgtggtggctcacgcctgtaatcccagcactttgggaggctgaggctggcagatcacgaggtcaagagatcaagaccatcctggctaacatggtgaaaccccgtctccactaaaaatacaaaaaattagctgggcgtggtggcacatgcctgtagtcccagctactcgggaggctgagacaggaggattgcttgaacctgggaggcaaggttgcagtgagctgagatcgcaccactgcactccaggcctagcaacagagagagactcaatttcaaaagacaacaaaacaacaataacaacaacaacaacaacaaaaaacaaagaaatgttttaatatgagaaaacattttgcaaaagaagacatacacatggacaacaggtatatgaaaaagggctcaacttactaatcatcagagaaatgcacattaaaagcacaatgagatatcattgtaccccagtcagaatggctattatctaaaagacaaaaaataacagattttgatgaagatgtattgtagagaaaagaagacccttatacactgccggtggaaatttaaattagtacaacctctgtggaaaacagtatggggatttctcaaagaactaaaaatagaacctccatttgatccagcaatcccactactggaaatctacccaaaggaaaagaaatcaatgtatcaaaagcctgcacttgtatgtttatcacagcactatttccaacagcaaagatatggaatcagtgggtgattggataaagagaatttggcatatatacacaatgaaatacataaaatgcataaaatacaaatgcataaaaagaatgaaagaatgagatcttgtcatttgcagcaacatggatagaattggaagtcattatccgaagtgaaacaagccagacacagaacatcaaatatcgtgtgttctcactcctaagtgggtgttaaaaaatgtgttcacatggacgtagagagaggaatgatagacgatggagatttggaaaggtgagagagtgagagggggtggatgatgaaaaattacttatgggtacaatgtacataatttgggtgatgggtaccctagagccctgacttaaccactaggcaatctatgcatgtaacaaaattgcccttgtaccgcatacatttattcaaatagaaaatgaaatattttagcctatgctcattagtttacttatgaagcatctacatggctcactgcactttcttcctaagttctctgacttctgaggcaggaggtgaggccaggcagcgggcaactgtgcttccctttctcaccaggacaggtgccaggagcaagggacctaactattttggtgcaaagtgttcattaatgggtctgtgaatcccatctccagctccagcatgactccagggcctaacattaacttgagaacagtatacaggaaaagggatgtttttgaaaatgctgattatttcatagcctctgggtgtcagccgtgaatctcactttaagccccgctagggatcctgttgccaccactgagcagaaaatgcagtgcttctgtgaaggaatggggcacagaacagtcaccgctaatgtgttcctgaaaaagccggggtgacctttcttgtggctgcttcagaggatgatgtcactttgggacagaaaaaggaagatctctttccagttcacataggataataagagttctgattcttagttgcatgttgaagaacaaacaaggagcatagacactcatcctggggaaaaagactatggaatctttggaagctgagaggccagccacttactttcctgggatagagcttttataacccccgtattgggcttaactccatacctttgacgctaaagttgttcactctctggggaaaccatcaaaacaatcaaacagaaacaagagcttttaaaaatggaatatttaatacttatggcacaaataccttttagaggattgcaatgatcatggtagagagactgattcagacatttttcaaatgtttgttggaaatgtctgaaaatgacaggcagtgatagtatcaataactaaccttcatcaagatatctgtgcatcggataatctgctatatactttaaagagattatgtgctgtatgcctcccaacaacccaatgaggggtgagcgctattattaacaagaatatgtaaggcaactgggactcagagagattcagcaccttgccaaaggtccaacaggagttcctttagcaagacttaaaaaaatgattactgtggaaatttccaaacatatacaaaactagagaaattataatgagccccatgtatgcaccttataaattcaacaaatttcaatacgtggccaaactagtttcagctatcctcccacctgctttcctaccttattagttttcttttgctgctgtaacaaattgtcacaaacttcatgacttgaaacaacacaaagctattctcttctagttgtggaaaccagaaatccataatcaagtccactggataaagtcaaggtgtccacagggctggttctctctgaaggctccaggggagaatccatttgcttgcctttttcatctcctagtggccacctgcactccttggcttgtggccccttcctccatcttcaaagtgcctcactccagtctctgcttcttcattgcatcactgtctcctttgacactgattctcactcttctgcttccctcttataagaaccttgtgattacatcagatccaccagataatccaggatcatctccatctcaagatctttaatttactcacatctgcaaaatactctttggcatgtaagataaaattcataggttcccgggattagaacatggacatatctggggagccatgaatctaccacccgcaccctagcaccaacaggaatattttgaaacaaatctcagacattttatttaatccataaatatgtcagtgcatgcttcccagaagataaagacttaaaaaataactgcaataccattatcatacctaaaaacattaataagaattctttaatatcatcagctatttagtcagtgtttcagttttacctaattgtctcataattttattttaacaaatggtttattcaaattgagaaatgtttcttaggtctcttttaatctgtcagttccctttccttttcctttacttccttctttgtaatgttgagagaactagattgtttgtcctacggaatttggcaaatgtgttcctgtggtcattcacatgtggttttttttttcctgtattttccataaactggtagttaggtcttgagacttggtcatatttatggccgagaatttgattttatggccaagaatgcttcatcaatagtatgactttctattgtaccacacggggaagccaatgtctgttgtctccctcctgtgatgttaaggttggttgctgagttgaggtgttgagcactccatccttcttgtatcaaattccccatcagctttttacctacattggtgattatggcttagattcattacttcatgagggggggttacgacatagtcataatctaattctgtcattcagttttcatttttagccagaattcttatataaaaaaataaactttcctctatttgattatcttgaggtacaatttatgaaagaaagacaggagaaatgtctaattctttctcctaatgcatccatttgcagaatagtaactggttttctagcatcctacaaggatgaaaaagtgtttgtgtatgaatgtatgtgcattagtaggaagtcacggtttcgtatattcgtgatatttcagttctttgcagaagttattctttttcaaattgccccatctttagccaatgagagccccttcagattggctacagactcttttgacattaacctagaaacttcattgttttctgatgtaacaaaatgttttagactcatcttgtatatttactgtcccaaatatcaaatcagtgtttactccaaaaaagcccgtgtttcttttagtaggaaacggtatttagagaccatactctaaatcctgtagatcaggggtctccaacccccgggccatggaccagtaccagtccgcggcctgttgagaaccgggctgcacagcaggaggtgaacagcaggtgagtaagcgaagctttttctgtatttgcagccaatccccattgctcatattactgcctgagctccgcctcctgtcagatcagtggtggcattatattctcctaggagcctgaaccctattgtaactgcacatgccggtgatccaggttgtttgctccttatgagaatctaatgcctgacgatctgtcactgtctcccatcacccccagatgggaccatctagttgcaggaaaacaagttcagggctcccactgattctacattatggtgagttgtataattgttttattaaatattataatataatagaaataaaatgcacaataaatgtaatgcgtttgaatcaccccgaaaccatccctaacccccttgatctgtggaaaaataatcttttatgaaaccagtccccagtgccaaaaaggttggggaccactgctgtagatgctcagagctacttggccttatcattagtcgaatctagaaaattgtgtaccaaaagaactgatatcaccggtttatactgttattttcaactcaaagttaatattacatggttttacttaatttatgttatattatatttgtatttattttctcttatgctgaaaattttggttccaaatatcctcagtataatgacatatatatatatataaaagcatatgtatgtacatatttctctctatatatgaaataatatatcctctctatatgtaatagtatactgatatatatataaaatatactaatgcaaatacacatgtaatagtatattaggagtataatatatagatacatatagttttataagaataatagtgatgttattaatactataaaaacaacttaagatttaactacagtttcttttgttcttaagataaattctactagagatgtacagttaaatcgcagagttttaaaaccactgtaattaattccccttagtgtaattaaaccaccaactcgatgcatagttagctcaatgcaccaataagcttatgggcttattagttttattttgctttctacttagtgattgctatttttaagcatatgtaacactaaccttatggttcaaagtcaagtgtataaaacaagatgcattcagagaagtatgactcttattctgtctccaacctgacttttattctctcttctaccttccatctatagagaaccattttaattcaatttttatccttctactgctttttaataatttagccatagatattcataatccccggttaggcaaaaggtgtgggactaaacacactgttctgcatctggcgccacaacttttgaaagtaaaactccctaggcttgggaaatagaccattatttactttcttactgtagacctatcagtcgttctatcagaaaagggtcagtcctgcaaaaatgggaaaccagaatcctctttagattttagatttttcaggggtgtgtttgtgactcacactgtgatgatattaatgttttactcattataattccagtataccaccccaaaatcccccaaaacaaacaacagtcataattaattgtatgcactgattttggacatactgctttattttcagccagatggtttgccaaaaaaatatttttctatgttactatgtgataattataaacatggttttaatagtaattgatgttccagtaagtgcacatactataacttgcttaccatatttcattgaagggcatttggttggtttctaactttttgttatatgatagtttaaaacactaatttctctttgctcaagagccctgaagctttgaactgatggggactgacaccatttagctaaaagatatcttgttcttactttcctggggtcctttttttgaggggtggaagtgtgaggaaacatggagatcttctcaacccaaagaaagccttttactcaacaatttcaagagaagaaaaatatgcaaagtacaaaagatgaagatagaagggaaaatcgccttttatattaggttaaatttttgagatagggtcttgctctgtcacccaggtgggagtgcagtggcacgatcacagctcactgcagcctcaacctcctgggctcgattaattatcttaccttagcctccaagtctaggtccacaagcacacaccaccatgtctggctaattttaaaattttttgtagagatggggtcttgcaatgttgttgagactggccttgaactcctgagctaaagtgatccttctgcctaggcctcccaaagtgttgggattacaggtatgagccactgtgcctggcctgaggctgtttaaaagaacaaaaatctttataaaaagtttcattgctgtttcttttctaaaataagttgtctataccagtggcatgcaaaatgtatcatatcagatttaatatgtgaataatgagggaaactgtgactttggacagaagactgtcgtagactgctctagtagaacagaatcttagctaatcaccatgcagatcccctgggttttagagttcatactgatcctcaactgggggctaacaatggtttctcatttatcattttcccctgcttgttcagcattctacttgaagccacagagaatgatggagcttacatatttcctttgataagatgaagaaatgaaaacatacattaatgaaaaataattccagaggttttttggactataggagttaagaggagctgaccagtgagcctgtggttgtccatgaaggttctgtggggtagagtttgaactgtccctatccagaatagtaggagggacagagatgcttatgagtgaaggccgcagaacaaggatggcatgacttgttcatggggctggggagaaccagtctgaccagacagaaagggttattgtggtttgacggtcggtgaaggttgttaggtggcctttggccacataagagagtgttagaaggtagacagattattttaagtgtgatgaaacaagtagcagttggtatgtagagaagtggggagaggtttgatgaaaagcagtgtgttagaaagacggttggcaacactattaagagtagattaaaaaggaaaaggaatgtgaaattagagagaccagaaaggaacctattatgataataaagtcatgattccatggaaagctgaccagaatgatgatactattagagaagagagaggagaagtaaggccaattttttctttaattaatgagtcttagtgactgaatgtgggaaataacagagtagtgattccaggattttaagcgtcggtgattgtgagaatgggcaatgcaaagtattgattaaatcagcagcattagggttgggaactagattagaatgggagggggatgatatagtgaattcctccctccctccctctctgccttcctccttacctttctccttccctctttcttttcttccttcccttcctctcttccttccttctcccctttatttcttcttatctttacatcattatttacttttacatttagcaactattctattccctggagctctggtaccaataaacaaaagaaacaccatcttcgctctcttgaagcttacatttcattaagcagagtggcagataaaagaacaagataactcagatagtcatggtgctacaaagaaaataaaataggcttatgtgctagctggtgattgaggctgcagggactggacagtactactttagactggagcttctggaaagcgacttaggggaaacactcaggtgtcagccatgtgaagatctggtgacatttcaggtcattgcaggcagaaaaaaacaaatacgcaaagataagaacagccttggagcgtgtgaagaacaaaatgaaagctgagggcatgggagggtacatcgtaagagcaaggaggtgaggccaaagtgtgtttcagtcaaggacagatcaggacacagaaaccacctagtaatttaaacagggatggtctaatacaaataattattaattttaacagagaactggagtcatgagggattcaccagtaggaagtaaagacaagtctaaaaaatgtaagagcagcagatatatgaagcagctaccacccataggactgagatacagggtttcctgcccccaagataagaccagacctggttagagacagcatgaccatggcaaactggatagccaagaagtcagtgtcatgctgcagcagtgtaacctgctggaagtgccttctggaagaactttctgaaagttcttcatcaccctccatgatgccaaggaaagctgttcatagggagttgtttcaccagtggcaatctgctacgaaaagggcttctgggaaatgctggcatccagatgctggggaagctgcccagacagtagaagctgaattctggggaagctgtatgcttgcaggagtcagggggtgcagaagctgagtgctggagaagccactgtatcacaggagctgggtgcagaggaaacaacgcgtgcttcagaggctgggtgctagaggcctgtgcatgttgtaggagcagggtctagagaagccatctgcgtttcaggagctggctgagaacacactgatatgggcccgggggtggggtgggggtgggggtggggggaggtagaggagtggcagggagggaggtagtgggtggggcagtaggggagagggggttggggggttggggggaagggttgggggttggggggagggggtggaggtggggtgggaccctttcctcctgcaaggcctttctagctccctctactgacaaaacttaatactgtgtcagctagcaaagaaaatacctaaagggatcagctaaatttttgctgagcagtcaatgtacatttggagctgagaggcaataaactggcatagagaagtagcaatggctctgatctctgagggcctcgcagtcgtgttgatgattgtattcatttagatgctggttgtggttagtgcttgacattttaactaattttttcttccaattccaatgaaatagataattttattattcccactttacagacaagaaaactgaggctgagggaggttaaatcgcttgtccacaatcacatgctagtgcggcatggggccaggattcaaacatgagcagtcagtctaactccaaatctgcccccagactccataaagtcattactgatctttgaacagacagataaatgtatcaggaaagataaatacttaaaataactttgcagtcagtccttctgtaattaaatcagccacctctattttacagattttatgaatttagaaattttagttacttttaaagtaaagtacaagtttaccaggaagtacaaattaaaataaaacgtggagaatacaacacctttcaaaggaaagtagagaaattggatgattgaggtaattagaaaataatattttgagtatagtttgatggatttcaggcttcttcagcttgacaaaaacagaaaagagggggaaagttcaaaaatattattatggatttgaagagatgtcactcagaagatcttgataaaatgttcctcatccctagtggatggggggcgtgggtggcagggtacaaaacgaaacatggaaccagtgatgggcttttaggaaattctatatggagcttttaccatgcaccagacctcaggctggggaccaggggtacaaggatgagtaaggcatctggccttcccttaaggagcttgttgtctcatggctgggacatgataaggacattactacagacatacatgaagagctaaaggaataatatatggaggaagaactagttctgcccaagggggaagtcaagggaaggtaccaagaaagtatagcatttgagttggatgaagaactggccaagacagctgaggaaagggagatgtagattaggggccgacacaagtaaggggttggcaaggacatgaactgaacggggtttgaggaaaaagcttagcacggggtcaagaacgtagattttggggttagagtacctaattctggcctcctcaatattttctagtttcatgatcttggtcaaattatttaatctctctaaatttcaatttctctgtctatacaagaaaataaagtaggccggccatggtggctcacgcttgtaatcccagcactttgggaggccaaggtgggtgggtcacctgaggtcagaagttcgagaccagcctggccaacatggtgaaaccccatctctactaaaaatacaaaaaaaatattagccaggcatggtggtgcatgcctgtaatcccagctacttgggaggctgaggtaggagaattgcttgaacctggaaggcggaggttgtagtgagctgagattgtgccattgcactccaacctgggcaacaagagtgaaactccatccccccacccaccaaaaaaaaaaaaaaaaaaagaaagaaaataaagtagtacccccttcagtgtgttattatgcagactgaatggtatgaaaagcatgttttcaccattactggcacatgctcagttaacgttttcctgccattcgtagcagcaggatgaggagtattgaaaaggctaaagattagagttctgggaagaataataaggattagatgtcagaaagtgtgtcatgacatatttgtgtgtatgcgtgtgggtacacagaattttgaaatagttttcaattgaagcctttgtttgtaaccagtagcacagggagatgttcagttttgcacataataatgaatatctgttatgtctgttagccatttgtaactactattgttgtttctgtcatctccagtaaagtgtttctgtattttcacaaaaatgagcaagacctaccacaaaaaattatcaggtaagggtgactttatgggtcccctgctgtgtatttgacaccaaaatgactcatcacatgagttcctaagtgctatgtttggtttcagtgtagaataggagattgtgtttcccaggtagaaaaggagactttgaaatctttctcataaaatgcgtgaaaatctggtgccatcagatcatgagtcttgtcatcaggatgggactcactcttggatccatcaaccagctagctaggtaactctgagcaaataccagatgctcttcagcctgtgtcctgatctgtaaagttgagatcataatagtaatacttcacagtgaaattgtacactagaatgaaagaatgcataaaaagtgcctcgtaccctgccacgcacagagagggtgatacacatcggtcccctcatccagcatcttctaattcacccctccctgtccccagcttctcctgtctggggatctcaagttgggaatggtcatctttggatgaagctgccatgtttatgtggacttagaggcagatattctattgggaattcaatggatgcataaggcagtgtaggggaactgatttttagggagcaatatgaagtcagagaaattgcactcttatctctacttacgttcctcatggtcccttttattcttttatgacaaatgttacttcaagctacagtagtgttttcaccaggggctgaaggaattgatggagttgttttctttagaatgagccgtaacatccctttgttcacagagattgtaaatcctgcatctttcagattagatcatgtatgttcaatatcagtaggaaacaaacagagaagtaaatatttgctacaaaatgtctttctgctgccttgaaaatgagtttcctaaatctgacatgtcagttaccctgcttcatctgtttcacatttagagtcaaaggaaaacaatcccccacagcaaggagcctgtcacttcacttggtgtatccagtgaagataatgtgaccacagtgcagtgggattgaatactgataaggatgtggcgggccatgcttaaagtttggtgtctcattcaaatgactggctgagagatgaaaagaaaacaaaaattaatccccctcctggaaccttatactgattcacttagtggttggttgctgctctaaggtctgtctccttttccccccattaataatcataatcaaatagccattattggtttttggcaacagggtaattactttctcgtccttattttctgggacagtcggtctgttcatgagaaagggcggttgtgcaatcgttctccctacgtcaactctgagaagtcggttgtgccctgcagatattgatgtcagcctgtttgctctctggtggagtgaaagaagaaaataattttattgtgctatttttagacttcaatttagattgcagcctttatgatactttgtgtactggggatagaactgttgatgcagaattcagctgtgagatgctctaggttctacctgcccctgaaagatttttttcgcttagcctgaatgccttagaactattcagtcacattgccttcatcgtcagctgaaagctgagccatgacaatagggttaagatgcactttgtattgacagtgtttgccgatggaacttgctgccagcagtctccaagtctgcaatttgcctgtaaaggcctaatctgatcttttatatgcataaataatcagcaccatacaaattctctatgaacaaaatgagtttattgaccattcttgcttttctaaatagttttccagaggtgatagatgaaagccagacaagaaaaaaatatttctttgctggatttccttctgaacaaacaagaaggacccaggtacctgggactccaggtatctttttctcagctgggatggaaggccatggactaaagcagtcttcctagttctttggtattagcaatgagctggtcttaaacttcaaagggatctaagaaagtgccagtaatacctgtctgagcttgttttgtgacgtgtatgttaccacatgtattaaaattcagatcaatttgcatctaaattatatgagtgcatgtgacttggcaatccagaagctgtcaattttagtttataagaacctcaacttgggcctggtatggtggcttacacctgtaatcccagcactttaggaggctggagcaggtggatttgaggtcaggagttcaagagcagcctgaccaatatggtgaaaccccgtccctactaaaaataccaaaattagccgggtgtggtgacgtgtgcctgtagtcccagctactcaggaggctgaggcaagagaatcacttgaacctgggaggcagaggttacagcgagccgagatcgcgccactgcactccagcctgggcgacagagtgagaccctgtctcaaataaaaaagaaccgcaacttggtccttgctactccaagtgtggactgcagaccgacaacattgacatcacatgggtgtatttaaaaatgcagaatctcaggcacttccccaacctacaaatcagcacctgccttttaataatattccccaagtgattcataggcacgttaattattttttaagtcacaaatctttttaaaaatctactatgatctgaatgtttatgtctccctcaaattcatatatttggacctaatccccagtgcaatgatgttaagaagtggcacctttggtggtgattaggtcacgagggtggagccctcacgagtgctgattagcgcctgtataaaagagggcccagggggctcccatattcctttcaccgtgttaggatacagcaagaaggcaccacctgcaagaaattgggaacttaccagacatcaaatttgctgtccccttgatcttggactccccacccttcagaactgtgagaaataaatttcttttgtttataagccacccagtttatggcatttttattatagcaactggaacagactaagacagaatcccataaaatctgtggaacctcttcccataaaaatgtacctacacacacaatttgtatataatttcaatggtgcaagttccgtggacttcaatgacacttccattcattggaagcagagagcatgcctgagggagcccccaagtgccatgtgccccgaacaatgctgacccatactgctccttgattgtcacattgaccaggtcttcaccttcatgcccagaccttgtctatgtaagcagcaccagcctctggggtgtcccatgtcagcctcagcagtccctttcatccatgtggctctcattaaccagtccttgctatcattttccttgcctggctactctggtcttttgctttctccttccccagtttagggactggtgggtacaaacattttagaatgaccatgaagtaatatcagttagctgaaacatatctatcaagattctttcctacccaggtcaggctcataaacagatgagatggagaaaataggtcttcctgctgtttcagctgacggtccacccatgctgcaggtcctgctggaagttcacttctgtgttctggtctgtgctttgatttcttctaatctttggtgatggcataaagataacgcaatgcaggctaaagaaaaccctttaagaaatctgttcacttactggcggatttgcttatcataggcatgccctgaccttgaagagtccttgctctggtagggaagcgcatgtacatggatgattaaaataaatgcttcatgtcaaaatacaggtacagaatgctattttgctacgaaggaaagaataactagcttttccaagaggagtgagggagagcatcaaagagagctggcttttaagggataaagcagacattgcctgagataagagctatagaattgcttattgtgagaaactacagagttgggaagatcgagatgagacaggcatatgagcagaagtgagagacctggcaggaataagagctagcacttagaccctgcttgctgtagggcgtgcacaggtctaagtgctttatatcaagtacctgtgcagttctctccacagtccaacaatccttccattatggatgaggaaacacatgcgcaccgagttcagtatcttacctaacgctgtgcgactgcaagcggtggagctgggctttgaacctatgcagtctggcttctacactacacttccaggcagagggcatctccctgtgcttctgggataaaacttgcagcactgccttgtctaggactcaagaggcactgttttctcctcccctactggttctgcagtctttccaactctttccacttcatcaatgagccatgtccatcctcacatcactatgtgtctgtgtaatacttagggccactgagttatggggaaaaagagaaatggatatttcttagtattgtctggtggttctgttatctcacagttcatggaaaccagatcactacaggcacaaggcattaccatcagtctcagagaaggcctgacaccctgttatagatcagagagtcctggccaccactaaaggtcttggaaagacacggggaaggcaagcagaagcacaggtggcctgaagacatctccttccggccaagagtccccctgctcatcccccaccccacccaggcaccaccctccacagctaaaggtgtttatgctgtaggaaccctgtggtggtaggagatcgggggtgatagggctgcttggataggaaacatatgtgattgttggcactgctcttcatactgttgtcaaattcctcactgcttctgtgtacttggggtgacagtctgacagcctgtgaggtcagacaaagcccagattacttccctctcgcctttccgtctcgcacttgtgggctgccattcttaaaggagtcacgtgtgggctttctttgccagaagtaggcatggcttacatcttttgggtttgggcactggaaatgactctgcttcccctgcagacacaccctgatgaggctgcaggccactagctctgctcctttttcaacatcagaaacagaggctgaccattgctgggacatttcccttctcctgctcctaactttgtcatagacgtctcctgaactgcagttactgtgtttggaggtaacatcatccccttctttggtttgtgggtagggaataccagatacgagggagagcatccctaaggccttcacctgacaccagtcctgcctgtatgtcctgcagttctcatggtaagccatcagcctcgccaggcggcacctgtgtgccaagcagcatggcttattcattgtcttctctagaacacagaatagtttggggacatttctatgttttctttctccaacagccagatatatgtgtccacttagctgcacataattattgtctctctaactctttgacctacacatttgtcagataaaatattttgggtgagagcttgttagcagatctatttccattccactcttggcatttattagcgagccctcttcgggaagccgtatgttctgagaagtaggaagaataacgcattttacctatagtgcaatgtctggccagcgcctattctttctgggttgagctgctggaatgtattcaggggataagctgagaggcaatttacgaggagtgctctctccttgtcttgctcctgcttccctttaaaattccttggctgcccttagtgtggcatgtgtttccatttatcctatagttctcaagactcaatggagctcttgtacttctgaagggcacttactaggaagcccttctccctgacgttgagcttgcactgatcaaaacggggggccccacaaaccatcacagggatatctatgcaaagagggaatgtttagcaccaaagttaaggactgtgcatgctttggcagaattacaaaaggaaaaataagtggacaaagtatgttactttttttttattattatagggtgtgtgtggtttatttgaacatcaacaaaaacacaacagaaaggggtaaaatgtaaaggaaaagcccctttgctgtcctccaaccctgaggaagctgttagcagttttaagtgcatccttccagaaatatctccctcatgtatggacatatatgtcctttagttagttttagaaaattcaaatggaatcataacagaattttgttctgtgccttgccgtttttgcttaatttttcttggaggtctttcaactttaagaggtaaaaatggctgtatgatatgtaacaataagtgtggctgattccaattttctccatttggttgtttccagttatttctcatgctgcaatgatcatccttttttatatgtctcttttaccttgtctgaatattcctgtagagtaaatgcctagaagaggaatagctagtgaaaaggacatgtgcattttaaattttgaccaatattgctgaattactttcctaaaaaaggcagctgacgtatccctcacctttaaaacagcaaactatacaactctcagacctttgtctccgaatctgtgcatctttatattggatgcaaatcacgtgttgattggctggttttttttcttcctctgccttttttgcttattttcttttgggatatttgcttttttacttcttgactttcaaaactctttgctggttaataaatctaactcatagaccatgcaacgtgttagaaatatttttttctaatatgtcatttgtattttgactttcatttatggcacgtttgccacataagagtttaaattgatatgggtctaaatttttcactgtttttcacttttggatttcaggtttgtgtttgcttagaaagtttttccccacttcgagtcagtcaaataatgtaaaaattttcatttagctattgggcagcttagaagccaatactagactggccaaatagagtggcatgttgagacttaccctgagattttagtttttaatgcagcgaatccattgggatcacttataaaaaaggattttaccctattaatctttactagaatggatatttttaaacttaatttttttgtgcttctcattgtaggagtcctttgaatgtagcttccctgagtgttcattcagttcattagttattgagttcttatagtggatgacatcttgctagtctataggcttcatagggttttaaaaaatgaatacgaaatattcccaaacctgattaattacatacagtagaagagggcgtctgtagacaaaacccagagatcaaggcagaatgtaacaactctcttgagagtactacaaaatgccatgtggttcagagaaaggacatcacatatggttgtgaggtcagggaagaattttatattaaagtgacatgagccttgagatgggccttgatgaaatggttggatttcaatgggtgtggattttagagaaagggcataagaagtatgcatctgtaattagaaacctgtgcatttgttctgggaagagtgagaggtccactttgcaggtgtgtggagaactcacaggggtgcaatgaatgagtccagagtagggctgagggcatcttgggaaaggcctctgagaattttactctccatttgaaaaggaataagaggcattcacgtttttggagcaatactagatgggatagattggaagtatgaaatatttgaaggcagaaaggcccatcactaattgtagttttcctggagtaaagaaataaaatgcttaatgtggagtagtactggaaatggggaaaagcagacctgaacaatattctcagtttataatctgtaagagggtactggggctgaggaaaataacaagtttaaaaatgaccaagatttctagccttcatttggttcactctcttaacatgcattgagttcttgctttatgtcagcactgctctgggcgcttggactagaggagttgaggagttggcacgagacaggatccctgctctcaaggggccacagaaaacaaacaggccaggatgatggcaggtataaggaaaccatgaaaaaaaatggagaaattaagaagaagggcttgtttgatggggagccctgataactttgattctgtgtcttaaaacttcaattcatgcttcatataattatcaatttaattattgctggtggtgttctctttctctcttcaccctggtatactacggagtgatacaggaaaataaattgttattcgaattttaaataggctgcaaagttggaaagcactttaaaatctgaggctggttggcttatccacaacaggaaagggaagtatgttacactaatgatgagaatagatctttgatttctgattatatcttagtttcttcacctgtgaaatagagacctgtcctaaaacagtccttgtactttgctcacagtttggtgagtcataaatttgggaaggtcttgcctgggcatttctctgcacgggcctgcaccagggctgaacgtgcacaatggctcactggtgtggctggcaatggcaacagctgtcagctgggatcccagagggggccactgaccaggcatgtagtccctccagcatgacagtcttgggctagatagactccttgcatgacagctggcttgtctcagagcaagtgtcccagaagaaccaggtggaagctacagggcctttccctaccttgccttggaagttagatggcattactccctctctgttctattgattactccaaggaaggcaccaaggtcagcccagattcaagagaggaggatatagataccagctctttattataggaatgtcaaaagagtaaaggttatgtttttaaaacactacaatgtagcaataccatcttacctcatgaggttgtcttgaagactaaatgaagtaatatatgtacaacccttagaacagcacctgaccaaaaattattaacaatggtgatgatggtggtgctgggagtggggatggggatgaggatgatgaggatgatgatgagtagctgcactgcctttctgcaaaatgtcccttgttgtctggcaggttgagttttggaaagaatggttttacctaatttatatttcctataactatgaaggggattgtcatcggttaattgccttaatctcatcaccttctaactaacaatccagggaggggttgctatccattgtgttctaagggagacctgaatataaactaaattctattaggaagggcaagacaagaaagagagggtagtttcaaccaacaatgacctctacatgttcctcgttaaatactctttcttatattacatttcttcctttcatattatgaaatggcattggagaagaagactaaaatttccaaaagttcagtggaaaatagtattactttttctttcttagaaaatagaagacaaaggaataaaatttaaacatgtctaataacaacattttttttttctgaattggaggttaagttgcccagggaaaaacatgcctacagacacatgaggactattctaccttcatcagtttgcagtggaaaatttagtactattggccattcacatatcagatattttacaccatcatataaaaagacctggttattttctttttttctttttttatttattttattttattattattatactttaagttttaggatacatgtgcacaatgtgcaggttagttacatatgtatacatgtgccatgctggtgtgctgcacccattaactcgtcatttagcattaggtatatctcctaatgctatccctcccccctatccccaccccacaacagtccccagagtgtgatgttccccttcctgtgtccatgtgttctcattgttcaattcccacctatgagtgagaacatgcggtgtttggttttttgtccttgcaatagtttactgagaatggtgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagtacctgtttttccctgactttttaatgattgccattctaactggtgtgagatggtatctcatcgtggttttgatttgcatttctctgatggccagtgatgatgagcgttttttcatgtgtcttttggctgcataaatgtcttcttttgagaagtgtctgttcatatccttcgtccactttttgatggggttgtttgtttttttcttgtaaatttgtttgtgttcattgtagattctggatattagccatttgtcagatgagtaggttgcgaaaattttctcccattttgtaggttgcctgttcactctgatggtagcttcttttgctgtgcagaagctctttagtttaattagatcccatttgtcaattttgtcttttgttgccattgcttttggtgttttggacatgaagtccttgcccatgcctgtgtcctgaatggtaatgcctaggttctcttctagggtttttttggttttaaggacctggttattttcaaagcttccaagaaatggagtaaaatactaatgccctttaagtgaacatattaataaatcaggaaagagagtttggttataagagctgaaactctaggcatctgtgtcagaactcagtatttactctcctaaaatggatagaaacctacaaactcactgcctaccctctcccagagcaccattccccatagaaaaccccatagaaaaacactaacatgcctgggtctcaggaggattcaagccacactcagatgatctcctagaccccattttacttccaactggcaggaatcacaggaatggtgaatatcaattctgttctcaagaacttacccccaaacactgaaattgtatctgctagctgcctcattactggttgtgaaaacatcaccaaagatcttgcacagttcaagtagctgtgagtccttctcttcaataattattactaatgatctaattgttttccctgggcagaaatagcaaagcttctgaagacttcaaaatcaaccactactctctttagcacaaacagatcaataagcaggtatcttaaaaatccaaagcttgatgaaattattatgtattatgaaattacactgtaattttaccactacatattttcctcagcactcagcatagcatcccctcaaactggcttccaaactttgacgtgtgcattctaagagaagtttggggactaccctcactcagggtgcacatactctgtcccatcaaatagcaaatagacacaaagttacagtattccagtcattatactgcagaaaattatttacagaagcagcaaacctttcttaggaaagttataagctaggctgctggctctttcctttgaatccagcctcgctcacaccgtagaagccagagcaatgttgatggatctgtcaagttcataataaaaaataacagagaactcctcaggtaactgaaggtgatttggcccacgtgtggggagaaaacagatgacagcgtggagggggcttttcagacatgaccttttcttcctccttcacattgctgaggaaggccaatcctacctaggtgcttcaagaaacaaacccctgctggcagtgaggctcggggttttgaggctagacaagcagtagcagaggagcactgcctgggagggggtcaagcagatggccaggatttcagcatctccatcctccctgttccccaaggggtaggtaattacaattgagggagactatatttctgggagcacagatgattcccccagaggctcttttccctgcaccctcctaccacctgaacccactgggacctgcacaagtgagggccttggcagtatccacttctccaaagacccaagaccagcctaagtagtaaatatgcctaaggaaataagaactcatttggaaaataaacaagactgctttggaggacaactgttaaaaaagaacggtaataaatggaatggctaaaacctgatgaagcatggttattgaagtagacatacaaggtgttcaacacacatatcaaatattccccaaagataaggaaggatgttggaaacatgacataaaacatgaagccctaaaaaggagtcaaatggaaaatcaaagaatgcaaagtttaattattttaagtttcagtaaatgcattgaatgccaagtggattcagctgaaaagccaattggcgagccagaagatctcagaaattctcagaggacaccagcaatagtcagagagagggaaaacttaaaagataaatgaaacaatatgaagaatagcaatatgaagatcaacattcatataaaaagaatcccagaaggaaggaaaacaatcaatagaaaaatggaaggaaacatatgagagaaagattgagaaccgcccagaaaaaggaaaaggtataaaacttccgaccaatgggcttagtagagtgcaaaacaggatagaaaaaaaggtgatgggcatacctcaataggttgtaataacatttatgtaaaacaatgatagagagaacattctaagagcaggtcaattattaaaggatgagaactagatcgacctcagacttctcaatagaacacataatacaagaggctatcaagtaatattttcaaaatgtggaaccaagaatattaaataaaaccattatttaaatgggactatgagacctggaaatacttaaaagatttatcatgcacaagcttcttgggaatattcttagaggaagtatttcaagaagatgaaaagtctaggaggacagtatgagtggtgtcacagagtatgcaaataaagcttagcaaattttttactgttgatgacatacagaacttacaaatagaacaaacaacaaaaatatattttaataaaaatctggaactaaaatatagcctcaaaatatatatatcaatttattgcttcagcggtgggatggggtagaatgagagtgaggtgaaaatacattaaagcacttttcttcttgtttgcgaggaagatgtagaaattgaaaagctcagcaaatttatatggaaaaacataaatatgatcttacagatacaaaggaaactaccagaagacaaaaatataatgtataatttttagaccaatagaagaagatttgatccacccaatggaaagtaggaaaagagaaaaaaaataaaatgtttaaaaagtaagggaggattcctggtctgggaaaaaaggcatggaccatttctctctgcttcttcccactaaatgcaattctaaatcctgaaaataatgcaagagctaatcaaatgagaactctgaaagaccgtgagaggacagaaatctgccttgggactgcaggactagagagaaaacatagcttcagggcttcctacatacctacttcatgaaaaaagatgacctagacctggatttcctgacctccaaccaagcaaccaaaggcagctcagctaggtttattcctgccctggatttggagccctgctaacaataagcagccaggggagagctctccttccctcctggcctccaactcccttcccctcccagagacacctggttagccaggagcccctggcaagagggaccctgccacaacagatgcccagcctgggaagtgttctcctctcccctccctgccccaccaggggcaaggggaattctgccacagtaggtacccagccagggaagtcttcttgtcctccagagtctgagactttacacccgcaccaagagacattcagttacctgacctggggggaggccccttctgccttctgccccttcagctagcaccatcagggaccagtggaagttctcctagagccagatgaatcaagcagaaaaacaacaacaacaacaacaacaacaacaacaacaaaacaaccaactccaaaacaaaactcgaaggcaaacaaatgaaaggaaccacactgcaatggcttcaaaaataaaaattccattggaaccacatatagaaaagtaggacgggacctgcatgataaagctaaacagaattccctcataaaataaaaaaattaaatggaactcaacgttttttaacataatgacccacatgcccaagatataattaggaaccattcatcataacaaaaaccaaggatatcacagcttggatgaggaaagagaatcaaccgataccagcggggagatgaatcagatgttggaattatgtgacaagaattgtgtatggtcatcatgaaaatgcttcattaaactattacaacaaatgaaaaaattagaaaaggtcagcaaagatatagaaatttttttaaaaaccaaatgtaaattatagaactaaaaatacaaaaacagaaataaaaatctcactgcataggctcaattgtagagtgaaggtgatggagaatagattcagtgaaattgagaacagattaatagaatttacccaatctgaacaagaaacaatggactgaaaaaaatgaacagagcctctgggctctgtgggacatagcaaaagatccaccatttatatcactggattctaaaaggagaaaaggagagtgaggctaaagaatatttgaagaaacaatggctaaaagctccccaaatttggtgaaagccataatcctacagattcaagaagctacacaaatccccaggagaataaataaaaataaatccacactaagacacataagaattgaatttctgaaaactaaagacaaggaaaaatccttgagaacacccagagagatttactacctatagggaaacaaaatttcaataacagtgaatttatcatctgaaactatggaagccagaaagaagtggcacaattatcaaatgataatagaaaagaactgtcaacctacaatcctacatccagcaaaattatcctttaagaatgaaaaggaaataaatatattcccagatgaagaaaactaccgtgtatttgttgttagcagattaaagattagctagatgaaattctctgggaggtacagaaaggaatatagaataaaaagagtagaaacacagtagaatatcctttacctcatgtgttttatgtattgtattatggtgattgagacaaaaattttaatgtcatctgatacttaagacaatagtattttattttattttatttttgagatagagtctcactctcacccaggctggagtgcagtggcgtgatcttggttcaccgcaacctccaattcccaggttcaagtgattcccctgtctcagcctcctgagtagctggaactacaagcatgtgccactgtgtccagctaatttttgcatttttagtagagatggggtttcaccatattggtcaggctggtctccaactcctgacctcaggtgatccacctgcctcaccctcccaaagtgctgggattacacacgtgagccaccacaccaggcaataatattttaaagtgcagaaggtagagattgaaatggaagggaggtttatttgcatacttaaagtagtaaaatattggtgccagttgatggtgatgccaccagcatattgtaatacacagagcaattattatgcaaaatatacaaagagatataatccaacatattataaataaattgagatgaaaccctaaaaataggtccataaaaatatgctcaaatgatttttggcgaaggtataaaagtaattcagtgaaggaacaatagaatttttaacaaatggagctggagctattgaacattcatagggaaaaagatgaactcaaactaagtctcatacttcatgcaaaaattaacttaaaatggatcaaggacctaattgtaaaatataaaactataaaacttttaggaaaaaaaaaggagtcagtctttgagacctaaggcaaggcaaagatttccaagactcgacattagaagcacaatcaagtaaaaggaaacattgataaactgaacctctttgaagtaaaaccttttgctctgtaaagattcatgtgaagaagatgaaaagacaaactagtgactgggagacatgtttgtaaccatatatatctgacaaagtattagtatgtacaatgtacaaagtctcaaaacccaacactaaaaaatattgagtagaaaagaagcaaaagacataaaatacacctcactgaagaggctatatggatggcaaagaagcacgtgaaaagatagtcaacatcattagaaatgagggtaatggaaattgaagctgcaatgagataacattacacacctctcagaatggcaaaaacaaaaaaaaattataacaccaaatattggtgaggatgcagagaaacaagatcactcatgcatttttgataagaatgcaaatggttggccactctgaaaaacagtttggcagtttcttataaaactaaacatgtaactatgatacaacccagcaattgtgctgttggacaatcatttcagaaaaatgaaaatttaatttcacacaaacacctatgcacagatgttcatagcatcttttattcataatatccccacactaggagtatccgagatgtctttctgtgggtgaatggttaaacacactgtggtacatacctagcatggaatactactcagcagttgaaaaggaataaacaattgatacacgaatctccagggaattatgctgagcacacacacacacacacacacacacacacacacacacacacacaaaagccaatcccttaaggtatctactttatgattctgtttatacaacgtttttgaaatgacaacattttaaaaagtagtaacagacttagtggtctccagggactagagagggggaggcatgggacgtaggcaggtgtggttataaaagagaacatggagattcatgtgataattgaattgttctgtatcttgaatgtggtaaggggtacctgaacttacataagtgataaaatcacataaaactatgaaaacacacacacaaggggaactctgacgaagatcagtggattttatcaatgtcaatactctggcatgatattgcactactgttttgcaaagtgttaccattatgaagaactgggtaaaggtacatgagatctctctatactctttcttacaattgtatgtgaatttaataaaaagaaaaagaaaaatagaaaaaaagaagggaatttttttaattgaaagacttggctaaaatcaatgagaaaacaccaataattacacagtaatgagagtacatgggttaaaaccagcaatccaaagataaaatcttagaatgggttttatacaattcagcaaatgttttatgttggagtcattttaaaaatatgcaaataaactgaaaacatagaatggtaaaaagataagctgggtaaatttgaattaaaagagtgttggaataacaattttagtatcagacaatttaggctttaaggctaaaatatcatcaacaatgaaaattgtcacatacagaaaagaagcagttagaaaatttaatgattggaacccctaggtatctaacatcataatctgagactcataaaacaaccaataaaactatgggaggaaatagaagaatcaagaattatagttggaaatttaaaacactcatttcagaaactcatagatgaagcaaacaacaagaaaaacaaatatataaagattttaataacataatatgccttcactttccattcagtgaacacaatgctcattctttttggacatatatggaaaatttacaaaaatcaatgaagtactaggtgataggagaaccctcagataattttatagagttaattctcaaccagtatgcaataaaattagatattaatctaacaaaaagggaggtgaaaaaaatttattctatttagaaacgaaaaaacatatcactatacagcccttgaattaacaagggaaccattaggaaagataatgaaaaggctgtctgtcaaatctgctggacaacaatgctgtaaattctaaaaatatatataatgcaattacagaaaaatatttcaaattgatagattttgtgataggcccacaagtgtttgttaaattattttccatatttttctgtatatttaaaatatttaataattaaaaatttaaataaacatatattggacatggttaaaatattactcagacaaaaattaagagctttaaatatgcttattataacattaaaatttcaaaagaggaaaatatgaaaaagaaaacaaatgagttaagtgtttacagaagctaataaaaagtaagataataaatccaaagaaatggggaaaatggaaatataagataagaacaaatcaatgaaatagtgaacaaagatcaatatgaagattaacaaaggaaaaattagttctttgaaaggagtaataagatagcaaacctttgataagactgaataagataaatcagaaaaagaataagtaaaacacatactgaaaaggagatctacgaacaagtaattttttaaatactttttaaaaatatgaacaaacatgtaacaatacatttgaaattcattaaaaaaggattaatttatataaaggatataaaatattaaaatggcagaagaataaatggaaaacttgaatagaatgtaaaagttaaagatactgaagtggtaataaaatgtctccttcaacaaaacccttgggaaaatgatagggaacccgagaaagaagcaaataggcaatgaatatgaaaagataattcacagaatagtggagaaatacaacttcaaacgagatcccaccttttacctattagattggctaaaattaggaaaatgaaaaataccaaagtgcccccaactgaggactgttgtttctagtatggaccagaccccattcctgcactcctgctccagtgcatcgctcagaaaatctattccctccctccctcgctccatctctccctccctccctccctgcctccctccctccctcccttccttccttccttccttctttccttccttccttcttcccttccttccatccttcttcctttccttccttccttccttccttcttcccttccttccatccttcttctcttctttccttccttccttccctctctccctccctcactccctccctccatccttccttccttccttccctctctccctccctccctccctcctcccttcctcctttcctccttttcttattatattttctttctctttttgttattttatattggcatagacataaaatacatacatcatgaatgtactgcttgatgatttttcactcatggaatcctcaccatcaagaaataaaatacttcttgtacacaagaagtcccattatgcctctcacattatgagccaccatgcctagcctattttacttttatttttgaagaaaattcaaataattgcatagttctagattgccagttaatttctttcagcattttaaagatgttttattgtctcctagctttcaccacttctgtcatccatatttttgttcctttgaagttaatgtgcctttcttttctctcactgcttttaagagttttgttctgtctttgattttagaagtttcattatgatgggcctaggtatgtgttttctttgatcttttcctattttgagttgtagtgtttcctaaatgtgtggtttgatgttctttgtcaatacatgatattcttagctgataatctcttctaatattacttctgcctaattccttctttatccttccgatctcatcatttatggacatgggctttgagagaatgttaattaatatgtccaaaaaaatagggaacatgatggagaattttgacagagaactggaatatataaaagaaaatcaaattaaaagtatctgaaacttagaacacaatagtggattgaacagcagattcgagacagtagaaggaagggttattaaatggaagataggtctgtagaaaatatctagcatgaagctgtctggatgggagaaaatatatattttcattgaaaattcctgattttggttttccaaaaaaaagtcaaaattttgtcaacattgaatttacattcctcatagtttcagtgtgcctgagctgatgagttgttgatgtgctccatatacagggatatgtactcccaactagccacagtcactcctttctattatcttctaccactgaggctgaatattagttgtcatggtttatatcatcccttccctgctccacacatttacattgcgtgctgggcatgctatatatttgagttcatgatccatgttgaagatgccataaagacccaaaaatgtgaaagagacttggaaccgggtaacaggcagaggttggaactgtttggagggctcagaagaagacaggaagatgtgggaaagtttgtaacttcctagagacttgttgaatggctttgaccaaaatgctgatagtgatatggataatgaagtccaggctgaggtggtatcagatggagatgaggaacttgttgggaactggagcaaaggggactcttgttatgttttagcaaagagatgggcagcattttgccccagccctagagatctcgggaactttgaacttgagagaggtgatttagggtatctagtggaagaaatgtctaagcagcaaagcattcaagacgagacttgggtgctcttaaagcagtgcatttttatgcattcatgaagagatgatgtgtaattggaacttatgtttaaaagggaagcagggcataaaattttagaaaattcacagcctgatgatacagtagaaaagaaaattccattttctgaggagaaattcaagctggctgcagaaatttgcataagtaacaagcaaccaaatgttaatccccaagacaatggagaaaatgtctctagggcatgtcagaggtcttcatggcagcccctcccattacaggcctggagacctaggaggaaaatatggttttgtaggctgtgcccagggccttgcagctttgtgcagtctcaggacttggtgccctctgtcccacacatggctaaaaggggccaacgtacagctcagcctgttgcttcagagggtccaagccccaagccttggaggcttacatgtggtgttggacctgtgagtgcacagaagtcaagaattgaggtttgggaacctctgcctagatttcagaggatgtatggaaacgcctggatttccaggcagaagtttgctgcaggggtggagcactcatggagaacctctgctagagcagtgtggaagggaaatgtggggtcagagcccccacactgagtccccactggggcactgcctagtggagctgtgagaagagggccaccaaccttcagaccccagaatggtagatccactgatagcttgcaccatgcacctggaaaagctgcagacactcagtgctagcccgtgaaagcagccaggagggggactgtaccctgcaaagccataggggtggagctgtccaagaccataggaacccatctcttgcatcagcatgacctggttctgagacatggagtcaaaggagatcatttcagatctttaagatttgactgcccagctggaatttggagttgcgtggggcctgtagcccctttgttttggccagtttctcccatttgggatggagcatttatccaatgcctgtacccctaatgtatcttggaagtaactaacttgcttttgattttacaggctcctaggtggaagagacttactttgtctcagattagattttggacttggaattttgggctaatgctggaatggattaaaactttggggtactgttggaaaagcatgattggttttgaaatttgaaagggacttgagatttgagaggggctggggtgaaatgatatggttaggctttgtgtccccacccaaatttcatcttgaattgtaatccccataatccccaaatgttaagggagagaccaggtgtaggtaattgaatcatgggggcagtttccccagtgctgttcccaggatagtgagttctcatgagatctggtggctttataaagggctctttccccctgcgttctgcacttctccttcctgccaccatgtgaagaaggtgccttgcttccccttcaccttctgccatgattgtcagtttcttgaggcctccccagccacactgaactgtgagtcaattaaacctctttcctttgtaaattaacgagtcttgggcagttctttttagcagaatgaaaacagactaatacaatagagtctagcaatagagtggagaacaacatagttacaagctctgccctcagggaaaagaaaacaataatcacataaataattagaattgtcataaatactctgaaataaaagtaaaaaatgctaagagatccatcatattttccagttggaaggcagggaatgtttctcccaaaaaggttatttaagccgagttctgaagataatatgatttagtcagatgaaggcctggttatatgtgtgttgatggagaatggacagagagagttgatctagcctggaagagttggacaggtctgaggattcaaagcaagtcagtagggctggtaacacatatatgagcagaaactgtgttgtattgggctgctgagtctggaaaaatacataggattttggatgcctttgcagaccaagcagctaaggaccagcacatttcatggtgacttgatggtgtgcaaatttggtccctctgatgaatcttctagttgaaataatttatcactgtgaaattaagtcatcaagtataagatgaccagctgacttttagccaggtagacaagctatcgacttggtatgatgaaacatcactgagttcatttttatgcctttgtttcctctctgtctcagctgcaagtgtccactgcttgggaaagtgtgggaagctgacttggaagcttgtcgattgcttatccagagcctacagctccaggaagccaggggaagcctgtctgtagaagatgagaggcagatggatgacttagagggagctgctcctcctattccccccaggctccactccgaggataaaaggaagacccctttgaaggtattggaagaatggaagactcacctcatcccctctctgcactgtgctggaggtgaacagaaagaggtctgtccttttcacatggcctccagaggggacccttattctaaggggtgctttgggaccatgctccaaatgggaacaataaatattgggaaggcttcccattgagcatataaacttttaaaagtttcaataactcttgaatatgattacaaaataaagtagaatttttgtagaagtttgaaatatagaagagcaaaaaaacccaacttttggcatatttagttccattttcattctaatttagtggctagaattagaatatgcagtctaatatagaattaccatatatagcatacattatatatgtcatatataatatagttattatattcactatagattatatatgccatacatgatatttaacatatatactatacattatgtattgtatgtcatatatgatgtttatatatttagaatctatatattacaatatattattatttatttgaatgaaacattcaaatatatgtatttatcccattaattgtttttaccaaaaccagatcataatgaatgtttataatgttcttctttcataaacacaactaaagtttggcctgagatatatgtattacaaattaaaatatggttttatttaactttctttttctctcccctctttcctctctcccttccccttccactcctcactttcctcctcccaccctaacaagagtcttttccataaaaaggccctaggaagtttttcctgatttcagtgccatgacctgagtcttcagagctctttgttggcccaggttcacaggtgttgtgagtgtggaaaggaaatagcatggagaggctggaggaacttgacacatggctttcaagtctcatggttgatgttagatgttagctgtgcttcctccctgggtctttgccaggactcaccactggtgggtggggaaattgccacctccccaggccagccctgccagtctcacatcccatctgcaggaccatggccttcagagagcagacatttgtgttcttagtcactgcctctggactgcttagaaaatcgatccttgatcctatatttggattccatggtcttataagaaagcaaccactgtcactctgcatccttgctggcccagtcacaggctctacgttaatttatagacatctgaactcgtttgttaacccaggtgctacaggtggaatcctccagcaaagcctggtctccaatgctctgggtagaggtgttgaaaagttaccacctgctgcaagtggatggcttgaaagaatattctggggtggagggaagtgccacctaagcaagggtttattcctgggtggaagaaactgcaggctctgggaatgagtctttgaaggtgtgtctggctttccaaagtgagctaccaggaggagctcggtgtggggcagtcagaagccatgccaggtatgtgatggagtccctgggtcattgattctgctggaggccaggactgattcagcagagatccctttctcctgtagcggagaaaaatgaatatctttcctttacccatctaaaggttctcagctgaggcacctatacagacagagtaacaagagaaaaatgtacaaatgtgcttaatataaaatttacatgacacaggagcctgcaaaaatgaagacccaaagcaacagaaaccagtgtatttttatgcttaagtttgaagaatagcagacagatgtggagaagtataattggacaaaaggagtatgatttaatggcaataaactggggggagcttagcaaggcctgtttgctcggattcttcgctgcatccctgtgtcttcagagataaggatactcctttcctttgggtataggttgtacactttaaagatgagggtgttataatctactttagaggaaggtcagataattatttatggcctgcttcaggaaagaatggctgcagaaggtcagagagactttcctgcttctgctgttcctcaaatgccaaggtgccatattttggggtagtgtattctgaaccccatcactctctccctccctttctccctccttctctgccctgcccactgagccctgagccctccaggttctctggggacagactttcccaggcataggaggattcgttttcctgcatagcattataagcacctgtcaatttcactatctggctataagaacacagagctatatttgttgaaaaataggaagcttggggtcaaggatgaaaaaagagtggagccttatcctaggtcctgtggtggctgctgtttgggtgctccaggggtcccccagaaagcctcccagatcctctccaccaattgaaatgctgaggatgtcctacatttatttgttgctttcttgggggtgagtgggtgctttagaggggaccttacagcttttgctggctttcagtatcatttccctgttcctgtatcgcagtgctggatttattttcacagagagggcagccgttctctgaattcatgagtgccatggattttaagacaatgttttctgagaacggcaaaattatggggccagaaaacagataaattgttgccaggaaaggggaagggactcattacaagagcaacaggaaggaatttggtgcgtggaagttgggggcggttgatagaagtattctctctcttgattgtggtggtagttacgtgactgtgtgtatgtctaaatccataattttacatcagaaagagtgaattttactgtgtatgactttataacaattattttaaaaagtttttttaaatgtctacctatttaaaaaccgggctatagatgtttgagtcagtgcttttgtctcagggctatcaaaacgcagtgtggcctgctggaaagagcacaaggcttgagtctgagtctgccgtgatcctcagttaggcctcttacaggccgcatctccacatctgttaagaaaaacaccaccacgacataagaggataatgaaaactatctcatgaagctgtgatgaagatttaaataaaaggatgcatcacgaagtgagagacgcatacctagtagaggctaatttgtgttaacttttgtttctatcactctttctggcagtcacaagcatctctaaaatgctttttgcatgcataatgctagcaacagctatttgtttgtatgactcagtctccaggcttaactttcccttttgcataaggagtttgggggtgcttgagattgttacattttcctttacatgtataatatactcactttttgtcaagaagtagacatgagcaatgagttagtggaagatacccagtcagagaaaggtttaacgaaggaaaactcccgtttgtattcgggtccaggattttagactacagaaggtatggggaaatgataacaagggcctcattaggaaggtgcttttgttttcctgcctgtgttttccgggagccattgaagtctgggtactttgcatttatcctgtggctaaaatgtctattcgctttgcagctctgggttggttttgctttagaactccgtgctgggtctgaccatcctatactggtttctctactgaagcttgatgccctgaaggcagtcaatttctttttgacccaaatcttccatgaaaaattactgacttcttatagaggtccacaggaagatgagttttcaaagcctttcccgtgcttatctggccaacgtggtgatgtgcattctggtgatactttgttatcacaagggctttgtcgttgatcgacaccttcctgggtctacggtccttgccaggctgctgagcaccattcccccattttacagctgggcccattaaggtgaagcaatttgctttggactttgttacagaggaagtcagcaacagggctcagtgccaatcttagcatgaacttcctcgaattgtaagagcccttttcttttccagtttcatgacagctctcctccaagcctttctgaggactctggaaactatcagctgctgttggccctggttcgtagatgttacagaaattgaatgggggccagacaggagccagggaaatcagtgagccaggcttcctccgctgtgaagtggctcttttgtacgggctgttctggccataatacctgcgtaatttttttctttcctgtctgcaacctagcctgcggggtgctttctgtttccattgctttttctacataatgggctccctggacagtaccactctcccagacttctcatcccagctgcttcctttctgagccagtagctctcaccaaagaggccaaaagaggacctggcaatgttgagtcattgcgtgcagtatgtgagtagccagtgtgtgaacacagctgcagtgaacggaattagcaataagacacaacgcaaccaggtagcctcatttgttcagattgaggtcttcaaaaagcattttaagtttacgggtggaaaggtgtgatacctttcctcagccatcattaagggctaacactcctataacaaaaacaagttaacgagaaaaacataacacatttatttaatcagagttttacatggcacaggaggcttcagaaatgaagacccaaagacccaggaaaaactatttttatgctcagatttaatgcagaatagtcagctatgaaggaatgtgattggacaaaatgggtatgatctaatggttatagactggggggtgagcggaccagcaagccctgtctgttcagattcttcttggacgctctgcatagtatttattcctcttgggtatggggccggactcctctaaatggagggccttcaagggagaaggaagagagtgacctttctaggttttatgtttgctttgagggagaggagtcctagtttctaagactggctttgaggaagaggaattctggtttctatggcttgcatccagggagaaaaaggagtgtgagaggggagggcaagagaaggcagagagatcttgcttctgaggccttccaatctcctttggttcaaagtactcaggcataccaaagtgtcacacttaggggtatcatactgtgagccacaacataaatatctccattcctttttactcaatttcacataaaaaaagctggaaaaggtgatccacaatgaagatgtttgtcctccttgtcttaaactgatttctatatctagaaatgtctttattgggcaaaagtgcttcctcttcagccataatgggtgcagatctgattctttctcttctctgacacttactggccctgggacagctggaaactcactttgactctccaaggagcacatccctaaatgtgtgatctcttgatatctctcccacttttgaaaagaactgacaagggaaaaatgttcacttacccatcagctggttttgctctttttgtttaatgtctttggggagaaagcaaagagctaggacatgaagaaaacttctatctccactacattttgaagttttgcaaacccagccatctttcccaagagcagagcagtagaagcaaccaggatgcaaccagggttggtaattggttggttaattaaaaagtcagaaaagacagagagtcataaaagatgatgcatgcgtattttaaacctttttgtttctagctgaaaacatgccctctcatttgctattcattcgatataggaccaagtatttctgtttgtagagcctgctgattggcttttcacatgaccctcgttgtgtaaacctcacctatcatgcatcattaacagtttccacttttggtgtctttaaagtgggctggaaacgttaagagcacttgcaaaacaattctcagcctccccctctctcttaaatgttattgaatctttccaaggtttccagcttgctttttatggaaacaagcacttgttttcacattaatatttcatcgctctacatagtatttatttagattgtataattaggatatttaaatataactggcctacagaagtgaagaaacaaatgcaacttgaccaatagaaacagaactgcgcaggcttaccaggaccctgcccctggcctggccctggccactgaatttgagagagaaagcagagtccagggacaagctggcaggtggctaagagaggtgtttcttctgttcagtgagctggctcctgcttgttctctcagttaattactgtcatcagcttgtcagcctccttcacctgcccaagggaaggaaggggactcctctgatctgctggcttctccttctttcggaatatggtggaaccttgctccatgctccagggcctcacggtggccctttttccactaattaaaaatagttcagcgcttctgaggaaaacaacctcagggctcttggtgacgccgttcaccttggaaattccttgtcattcactggtgcagtctgagggatcgatagcaggatggcgtctgcctgaatggcaaggactcattttctgcgtttgtaacagaggaggtgttatccaatgaatcctcagtggtgtcctgggagtagctgagaatttttgtaatgtggaaaatcagatagcaccctgccccctcatcacagctacagtgcatttgatttccccaccactgggcagccagggcagttaaagtcaagagcttccactccccaggagcttccggtccccccataagctggtcgtgagctattcctgcccttcctaactaggagcaggcaggagatgaacactggagttccatgaagctcctgtgtgaaattatcttacctctacccaagacttactgcactgcctttttcagtgaatcgtttaatgccttccattctgaatatgctggtgtttctgctttgccagccattggtcattccacaccccctcctccacccggcccccaggtatttcctggaaccattgattatggcagagcagatcttattttgctcatatgattaggaacctcaggccaacaagcttgggtaatagtgagagaaaagaagagtggtcctttgctcttctttgtctgagtgccttttgagggaaagagtagataccaccaaccatagcatctctatctctttccagcaaactacaggggtgcctgagactttagggtgggaagcaagctctcacttggaaggggtgacatccagaaccaggattaaacgctgacatttaaaaacagtaactatggtagtcttaatagttgcacagtttacagtgaaacacttagagttcaaatttgttttactataaagtgaacatggatggagtttgggatttgattctgtcttcatagtttccctttacagttcaatatttcttagctcaaagaacacattcccttaaaaggaatccctcaaaccacttttcatttttattttcttatacaaaagggccttagggttggatgtccctatccccagaatctgaatccttttattaaagggactgtatctaggtactagccggtgccatgaatctcattttggattcaaatggattattttctcagagggttctaatgaagtctggttttattcagatttgactatcaaactcagtgtgcttaaagaaaagcagttcacatcctcttgcatgatcgtgtaatataaactgtagcttttcaaaggttgcccttcaagtaaactagaaaccacaggccaattaacatatgccaattagcaagcaatttcttcttctaacaatttgtttggttctgttaattacttttatttagagcttgtttctccgagccaccttcaaaacaagcatgcagatacttgaagacaattcattgcttgctctgacctaaagagatctaaatatttcagatgctttctttaccactgacgacatctggatgcttttaaaagaaatacgcagttactcagggagtaaccgtataatttgaatatgtggatgaatactcgtatcagatagagtaataaagatatacccttaatgtctcaattttgcctctctgcttattggcatttacacgactgtagaactcggcatttatatgaaaagacaaacaccataaaatctatgtcaaatacatgtgaaatatattctttgtgttgtgggcaggcatttgtttgaagtaaatattctttttgtagataatattttaaaaagaaagacaaaaccatatcgcattcctgaaatgtatttaccaagcatgtattttggaaaacagcccaaaggaacatatttaaggcagtgattttaatactaaactaaggaaatagtttgatgcatcagctaagctcatggatgggggtaatcacatctggtttacctcaagccagaggagaaggagtgagacttgacaatgtaacaaccattatgaggctcaagtagcgtttttggcttgtaagcatgtatgtgtgctgtgttcaattttatgttttaaatttttttaaaaaacttaaatactgctatagccccaaaatatgtaaaatatgtaaacagttggcttgatggccataagggaacacctgtccttttttttttttttttttttactgtgtagcctgtgactttcactgcaggaattaaatatttttgtggataggcaaatgtacttttgtggataggtattgctgatgccttattacacagccgaaggaaataaggatctgggtaagcagttgagtcacggcaaagagtaccgtatccaaggtggaggttcatgctagagctacaggtactaacccctcccctgcaccactgatccctagcaagggtggaagtaactgatgacttctctgcacagcccccagcacaatgtctgaaagagagacctaaagggtaactgcctgttttctcagattaatcttagaatcctagcagtacttgttacttcagtttggagatttttcttattctatttcttcacactcttacagacttcacatagcccctccctttagaataactcttgacagcattttaagaaatagactatttaaatcatcttgatccagtgactcaacccaaggtgtaacccgtctgctcaaatttgtggcaaatctccattgatgataacatttctgcaaatgtatgctctgttaggtgtggaagcttttcctaagtagaattggcagccacagtagtacctgcctacctagcaatttaacttaaacagtttccttttccaaaggtattttctattcagaatagaaataataaatatgatttcctcatcactctagatacagcctgatgagatattgttaccagatactttctcttatcaaaacaaccattattatttcataatatattccctaccctttgaatataagctccagttctaaaattttaaatgttggtatcttccacatgtcatagggaaagacttaagccttgtttatgggaactataactgagtaaaaatgtccttggagaccctggtcatggaatttgtgactgttcttctactggggcatgtggtttagacatctgctcaggctagcaactgaatgcttttctgggtatacacttttatagaaaaatgttttttgaaagtcactttaatgggaaaatcctgcccaacaaaggaaatcctattttctgtttttaaatcatgctccctgagttgggtgagcaggacagaaatttgacatcagctctaattcaacacagctgaaaatttctgcccaaacattcaggcctacgggttttgatcatgaggtgagttaagcaaattatatttgaaatattgcctggctgagtcggtgctactgaatcatacccgtgtggagggacagcagggaagatggtagggctttattggaggccaataaaagccatgtgtgtacagcagtactgtggagagccccaggaccccatggctgtccctgtggcaagaaaattatcccagataaggctgttcttggctgcactgaggcaaaggcatgtgctcagcatccagaaaggttcttcttgttggttttccttcctggctctttatacttgggtgaaatgatctcttggaagtgtagtctgaaaaacagcatagcttcttccaagttctcataagatacaggagtctccattcattacttcaataagcattactgagcaccttttatgagcaaggtaggacgacggaggcagggccaggacctcatcatctggtgagggagacaggcggttacacacacagggaggaactcctcctacccagaagtaggcagggttggagattcgggattgaagcgttcctggaagaagtggaatctgcagagttttgaaaagagggggtgttaggtgtagcaatcagaccatttacctgttataactgcttttcattctgacccacagggaaaacaattattcctagggttaaatgatgggacggatgttcagaaaggaaaaaaataataatttgaattgctgaaaggaccgcctgacaagacaaattactggagagtcttcaaagacactttgaaatgccgagcaacctgtactttaaatgatccgttcagaattgcaaatcctacagaactccatttctgctaggaatcccagtggctttgtagtgggtggtatttttaattatcaagtatcagtcttgcaggctttctcttttttgtcacatttgatttaaagtacaaatgggagcaaaagttacaaattgcacacagagagacactcagtgtgtgaaattgtggacatggttcagaatatgtttatttggaatccgctgaggtgatgggagagatgggactggatactcatgttcttatttggaaaggagacattctcgccgcctttcccatgtgcccgcttgcttttctctgcttccagcctgatattttatggacttgtggatgagaggtcctgtgcccatcattgcattccagattgtcatggctgttatcattgtcacctccactcattatgcctctgagtcctggagggagcatatccctttaataagactgaaccctccaggaattgagactttgcagagttctgagagtagaagggaagagaacaccatgtctacaggtgctggctgtttgcttctctgatttctttccatcaccactttgcccaagttacatgactctttggccaggtgcggtggctcacacctgtaatcccagcactttggggggccaaggcaggcagatcacctgagatcgggagttcgagaccagcctgaccaacatggagaaaccctgcctctactaaaaatacaaaaattagcctggcatggtggtgcatgcctgtaatcccagctactcgggaggctgaggcaggagaatcacttgaacccaggaggcagaggtcgcagtgagccgagatcacgccattgcactccagcctgggcaacaagagtgaaactgtctcaaaaaataaataaataaataaaaaataaaaggattcttcaagcctcttttcttgtatgtaaaagaaggaattgaaccttgaggatggttcctaagacccctaccaaatccagcagcattctctgcttctaggtattaagattctcagggaaggtttccgacattcttagtagccctgaaggaggcagatctttgtaaatgcatttgctgtcctgggaaacaagatggtgttaagataaggaagctccatttctcttgcagttataacccaaggcagagcctcctgattaatacacctggcttacaactcactattttggcttaaacagaaatgtcagtgcttccaaagctttcactgagacaccttctttgaaaaaaaaagtttcttttattttaaaagaagcaaacaaactctcttcaacagctccctttatttacttatttatttatgtagctttctatgaaggcttagcaaataaaacagataaaattagaaattgaggtagagttgacagtaaaaacccttttcctcctaccaggggatctctgcagaataaggcctaaagcccactggtttgagagaacatcctccagcaaggtgctttccaagcaagggaaaaactagaagtagtgaaatacacctgatgcttcctgcagagactatgccatcctgtgtgaccgtaacatataaacatcacataccaggaggacatgatcatttaaatagacagcaatgttgtccttcagtctaggcaatgggtgtgccccaaggccagtgtgagggtccgggagacaggaatctgtatatttcttacctgcctctcatgatttgagcaccttgctctgctaagtgtcccctgaagaaagagccacttctcccaaaggtggaagaaagtgaggccctgtgggtcgtattgcactcagatatgttggactcactgtggtatgtcttcctgcggaattttctaggaaatttttactgtacttgttctatacacacacacacacacacacacacacacacacacacacacaaccctcagaatatgtgcctgtactgttcaataacttacacattgaactaggagccagggatctgggattactgaccagtggcagtggtcacttgttgtaatgtctttgttgcacttcccagcctaatggccatagtgccctgcatgggtaggagttcccctccctgagagaagtctgggcattagcactttagtgagcttcaaaaatctagtcagtcaactccctaactaggtaccagtgaagatgcactacctgctagcattttgcaatagttttatccactcatgcgaggttctgtgtagggacaacccatgtaaggcccctgttttacctactatggctgcatcaaaatcaacacaaacttagtgatttaaaagaactatttatgatattcgtggatctgtagatcagaaattggggtggggcacagtgaggagggtgtctctgctccacaatgtctgggtgttagctgaatgacttgaagacaggggctgggaccatctgaaggttcagtccttcccaagtctggctgttgactagggctttagctgaggctctcatccagacatctacaaacagcccgtccatgtagctggggcttcctcacaacatggagactgggttccagggtgggtgatctgaaaagacatgtcaccttttatgacctgactttgcaagtcaggcagtgtcaccttcactatgttccatacattgaaggaatttcaagggccatccaggtttaacaggagaagtaataaactctgttttttgatggtggagaggcaatattccagaaaagtgtgttgctatgaccacacctacactctgccatacctgggcatggcatggaaatggccaaggaagttttgcctagtccctcatttatggactaagaggcaggacctgggcaactttgcacagctgatacccatggttcttttttttttttttttgagatggagtctcctctgttgccaggccggagtgcagtggtgcgatcttggcttactgcaacctccgcctcctggggtcaagcaattctcctgcctcagcctcctgagtagccgggactacaggcctgcaccaccacacccagctaatttttgtattattagcagagacagggttttaccatgttggccaggatggtctcgatctcttgaccttgtgatccacctgcctcggcctcccaaagtgctgggattacaggcgtgagccaccgcacccagccaatacccatggttctgatcccaccctgctctctctggacagacagatttctttggacagaacagaattttttaccagattgatagaaatatattaatctaccctctcatcagctgtcaattctcagtttaggtctaaactaattctattctcaagattccaagtgagagcattatagtaaaataatacatctcttaagtcatatctacccagttcacattcagtatcctctcagttcagaatcagaagctgtcagaccaacaagtagaggttcctgcacaagcctgagagagatcctgtaacttgtgccttggaaaaacagccccacgaaagaatgccagacagatcttctcttagcaaacatggtgacttgagctctctgaatttgttcccttatgctacattgtttgttttttaatctctaaaaaaactaaaaaaaatttcaggtaaattttcttcctttttcattatggtttgaattagggtttttgataactttttttccaaattttagggatgttaaaggttcaggaaagtataaagaagaaaataaaaatttcccataatactgccccacaaataataattataaatattttgatgctttgcctatttgagttatttcatcatcattaaatgctcttttattaaaaatgactttaatggctaaatacaaatctgctgtaccagaacttatttaactattccctttattgtttgacaattatttcctctttcctatacttttaatgccatcatctttgcatgaaaaatcttttatttctatttgatatatgtgataggcattcttccatgcttattacaagggcttaataaaagttatttcaatttaaatgaacaaattatttctttttgatagattccaggaaaggaaattattgggtcttaagatatgaacaatttaaagcgcttgttatgtggtctgaaattgctttccaaaatttatgccattactatcaatctgcacgtaatttaaaaaggaaaacaggcaggaattatatgtttgggggagaaatgtaaaactgtattttaaatttgtttaatttagctctgatttcatatttgttgtagccgtaagatgaagattgagtcatttgatttcgtttaagggtgttttaaattccttggttttctgttctgagtctatgctttttctctctttaagtgtgttttcagtcatatatattttcctgctaacactgtatgtttctccttcctgtatgatttgtggtttcatgactgtcaatcattttttcccagatgttctttttcttagtgtctcatttatttcatgtgtgatgacggtgttgctcattatccagtgtctacacttctgtgtaatctcctaccctcaatttcatatctttgattattttagggtcagtaaaaatatatatatatatacacacacatatatatgtatatatgtgtatgtgtgtatatatatatatatttatctgtgatttttatgtatttgctgtcttctcaccactgttatggtcaattttgagtaaaccttcaagggtgcttcacactaaagttcctttaattgtgtccatatgtccccacaattgtatgttattgccactagatttcttttctatatacacttacttgcagtaaatgcgtatagtcattctgtagcttgtagctcattcttcagtatactagacttctccaatatttacaagttatttgcagttcccattagcactattttattctaaggtagttggccattggcatgtaaattttaaagctaatatagcaaaaatcaaattatatacttggatttaattgttatttgtggaatctgattataatattatataatgcataatctccagactttttaacagtgactattaccgcacctgggcattttgttgttattgttgggtattcattgtatcttttgtagtaaacttgtagtttaagatgaatacgtatcttaatagtttcccttatgcaatttttttttttttgagacagcgtcttgctctgttgtccaggctggagtgcagtggcatgatctcagatcactgcaatctccgcctcccgggttcaagcgattcttctgcctcagcctcctgagtggctgggattacaggcgcccaccaccacgcccagctaatttttgtatttttttagagagggggtttaaccatgttggccaggctggtcttgaactcctgacctcatgatccacccgcctcagcctcccaaagtgctgggattacagctgcgagccactgcgtctggtctgcaaaaattttttagtgtatcttctaagcttttcactcttagttaaggaaatattatctttacatttaagttttaattctgagctcatttcttgcttctccccctgctttattctaagaatctctatcttctgttctcattttcttaaccttgtttattgttttcctttacaagtctgtggccttctacatgcccagcattcaactttgggccctgggatgaatgactaacccatggcccttacctcacttgagtggacacagaacttatcagaatggttgcactacaaggtgaaattattatttggggcctttgaaggaaaggctgggtttcagagaagagtggggaagaatgcatgggcaaaaagaacagcatgagagagggcaacggggttagtcctattggcaaagcttagcttgcctttaggagagttgaggggatacagctgaaccatgggctttgtgcgaggtcctatgaagacagagtttagactctgctctgtggtggtttcgtgcaggaaagtgacataaagaaggcccttttctggctcatagaaataagtttgaagggaaaaagtgagagaaggaaggagctctaagacttaattgttcattcatcaaatcgatcaatactacgtgcctgtcatgtgccagatactatgccaggggctctagggatagcagcaaaaagacatcatcatcctgctctttttttttttttttttgagacggagtctcgctctgtcgcccaggctggagtgcagtggtgcaatctcggctcactgcaagctccgcctcctgggttcacgccattctcctgcctcagcctcccaagtagctgggactacaggcgcccgccactacgcccggctaattttttgtattcttagtaaagacagggtttcaccgtgttagccaggatggtcttgatctcctgacctcgtgatccgcccgcttcggcctcccaaagtgctgcatcatcctgctcttatgcggcttaagctcccatgtatggtggtggtagcggcggctctatatgcagtatacacctcatggcacttaaattctagcattcagggactgtggtcagtgtgtaaacaaatgttcagtgccctagtcaattcctgtgtccttaaaggaatattccctttgtccttacaggttagcccagttgctcctgtgacccctctccccactttttttagaatccctattaaattttgaatttgcccattgatacagctggaagattcagggtttctgtttgataaatccacttcgggacttgacatactggaagcagcactttgaaatgaccagacaagggaggtggcctgtggaactgcatagacaaagctcattctttggtcataacttgaaatcagttcacaacttctcaagtttgatacccaggggagacacaggccctagcacaattctgactgaggtgcagaaactgggagagctctttccaggaagcttccctttgtgttctgtctgtgtccacggcactaacaagtgatcttgttttccccctctcgccaggaatcttacatcctttctgcagaacttggagaaaagtgtgaagacataggcaagaagctattgtacttggaagatcaacttcacacagcaatccacagtcatgatgaagatctcattcatatccttttcatcttgcagatgaagcaaggcaaagttattttataaaagagagtctttaaagggtagtttttcatgcctcagaagatggcaacaaatagatgctgccgttatttatagcacagagcacctcagatctctgagattatcaggtatgaaatgttttcgctctagttttcagtaagcaattcagtattttttttcttttttcttttttttttttttttttttttgatgccttggctggagtgcaatggtgtgatctcagctcactgcagcctccacctcctgggttcaaacggttctcctgcctcagcctcctgagtagctgggattacaggtgcccgccagcacgcccagctaatttttttgtatttttagtagagagagggttttgccatgtttgccaggctggtctagaactcctgacctcaagtgatccgcccgccttggcctcccaaagtgctgggattacaggcttgggccaccgcatccggccgcaattcagtatttttaattgctaaatccaaccactaacaattaagttcagacatgcacacgaggaagccaaagaaaatgcagtttcaagtgagtgtaaatccagctctgtgtggccctggtgaaggaaaacagttgactggctcgttttcctacgagctttttcaataccaagcgtcctaaatccacctctgaatttctttatctagcaactctacctagtaatgggcagtacagtaacaaagcaaacaggactttagattatttcctttcaacttctaaccatatacacatggttgaactcaatttagtcctttctgcttcccggtgatagaatttcttgcaccagacttaatatccttggtgtcacacctacaaacaccttcatcaaaactagctgctagtgagcaagatggcctgagaacatactggcttaggtatgcatccgtatgaagcactccattctgtgttgatctgtggacgcagtttgtcactggttagttctgctgagagcaaatgggtgggtacccagtggatgaagggatatgcagccctatatcctttcagttatttaatcacaagttgacacttctctagctaaaaacacttccctattcattcatctttctattcagtagaatgtcttttattagatgcgtttgtggcaaatttagctattttggtctttgcttgtcattgctgtcttactttttagaattccagtttttaccatactttatgggctgtgtgtgtgtgtgtgtgtgtgtgtgtgtgtgtgtgtataagtagctttgaatggccaaggattaatcttagtcataaatactcagatctgtgatttaatgatagagccaatgctacacttccttccttgttataactttacatttttgaccttgtttattaagctgggcagaaaatttcttcaacttaatctgcaatgattttcacattgctttaggtagattttgaaaagcagatattctgttcttcataatttcctgcctcttaaaaatcttgtatttaagctattatcagaaagtttcccaaagaagcatacaaacatagaataaggatggcgtttttatttattccatgttcatgggatcacaaatctttgagcacgtgtaagggggtatggcttccagcaaatgggcaggtgatggggcacagaggaggagtccgctgcagagagtcaatggatatgaaggggttcccgttccccagctcagcagatgggcagttcctaagtgggttgtacctctgtcttcaggtagcagttctgagggctgcagtcagggttctgtactggtctcttattgtgaaattttctaaaaggttagtttgattctggggaattggatcttatttttactagagctggggaggcagctctagtaaagacccctgaaaaacaaggggttaagcagtatttaaacaagatccttttagtttttccacagctgatccaagccagatttaatagcagcgggatcatggacaagtgataatgcctctttaagcattagggttcccatctgtaatgtcaggataacatacacctctaaggtttttatgggggttaaataaggctatattcataatgtacatttaatatagccatgggtaagtgcatgattttaggtagaaaagtgttatccaagtccatttgtctcacagttcttagtatattagtcacaagctccaagaacatcccatttatacacaaaaagtttcaaggtagattgattcaactattttgtaataaatgcttgaaggaatcaatcagtaactccacagtggcttagatgaaaagtcatttaattataataaaacttctataaatggatagggattattatccctacttgacagtcgaaaaaaacaaggcttgggaacaacttggctgacacaaggtcatttctgatgagtagcagaacttttcagccacaagccccatggtcctattaggcccatcagaaagcagccattgcctataagtaaatggacaggtctgttccatggaacacacaattactttaaatttttaagctataataaaagtatttcactgatgttatgttttttgagaatttcactgatctctgttgtgataagcggagaagcactggtttaggtactgaagtcagctctctccctccctccaataaaatctacaccacgatatggatttcaacccagacttttcttcgaatcccagtcttctgtcactgattgagaataaatacacagaaggtgtctttgaattcatacaaagcagcacttaaatttgagtggaacattatgccctaagatagaaagacatgtttacaaggctctacggaggctcccctacacaaaccaaagccgttgtttcaaattagagcttatctagagattcagagaggctgccagaatcctccagccaaactctgactggtttgtatttccatgtttgatcaaagatacaatgctgagtgtggctgaaagaaacagcttgttgtcaacaatacagaaggattgcacagtgagtgcagtgttttgtttgattccattaagcatgctgccagagcctactgtgcatgtgaggtacccaattaatctaagtccacattggaatgtgattaatgtaagcccacattggacgtccacgtctgaaagattcaagccacagatgctaccatggatgtttattctttgtgtggaaaacactcagtttttgcataaaccatgtgtgtacataagggctattagtgtggcatcaacagaggttaggggtgggcagtgggactgagtttccaaataggtccttgtggcctcctgatttaatatccgagttatgggcagcctcatgggtgtctcctacttttattaagaagacactgattgaccaatccaaggagggagaggaaagagcctttgcctcttcatcgtcctgacaggctcaccaaattacatgtagcatgaccaaagaacaacacaaacccatcagctactgtggcagcgagtgtctgaaaacagtctgcaccattaattgggagagctggtggtggagaggtggctcacgcctagtgcctgagaaggggacaggaggtgtgacttcacggccagtcaagtcgggacttccaggagcattagtgtgagtctctagtgcattttcacagtcatctggggtcctaattagcagtatgttttgaaaaacattttgactgtgtgcaaggtctcctccacgctcaaaatattgtaaccaaaagccttccaaattaaggtggatttttaagcaggaattttctcattttcttcctccttcaatttctacaacacactttcaaaggaaaagaagtacacctgtgatatgtacatttttggcatatttcaaagccctcagggcagttctgcctggccctcagtcatagacgaggtagagacactctgattctatttgtggttgtatttacatccatgtctgggaagcccttatggaattctgtttctctggttatttggagtgcatggtgcccaattgtttagttttggtggtgcttgagggcatgctctaaatacatccaggtttgtgcacaaataccacagctccgtaggacccttgtttagttcaactttccaaattttagcgtgaacagacaaaggtaacgagagttttgggagactgtcctgcctccttggagatgttttccacttctagagctgaggggctggaagagggatcatgaggatcatggagctccactcatgtagtttatagataagaaaatccagagcctggccaggtgcggtggcttacatcttaatcccggcactttgggaggctgaggtggatggattgtttgagaccaggagtttgagaccagcctaggcaacatggcaaaaccctgtctctattaaaaatacaaaaattaactgggcgtgatggtgcacacctgtagtcccagctactccagaggcgtgagaattgcttgaacccaggaggtggaggtcgcagtgagctgagactgcacactactacactccagcctgggcaacaaagtaagacactgccaaagaaggagggagggaaggaaggaaggaaggagggagagaggagagagagagagagaacaggaaggaaggaagggagaaaggagagacagagagagaggaaggaaggaagggagaaagagagagagaaagagaggaaggaaggaaggagaaagaaagataaagaaagaaaaagaaagaaaagaggaaggaaggaaggagagagggaaggagagaaaaggaaaggaaaaggaaaagaggaaagaaaaggaaagggaagggagagggaaaggagaagggaaaggaagagaagggaagaagggaagggagaagagacaagggaaaggagaagggaaaagggaaaggagaagggaagggagaagggaagggagcaaaagggaaggaaagaaagaaaggaaaggaaaggaaagaaagaaaaggaaaggaaagaaagaaaacccagagcctaagatgacagtatctaaagctttgtgtgtgatgggctggtgcagatatagtagtcacagttctttccttaggctctcacttggctttggagtgggacggggaagagttggagccccacagtgggtgggggagggcaagggcgtagacacagggctgtcctgctgctggctgagcacgaggtgggcttggcacaaggtaggcaacacagagtttctgtgtacaagcatcaaatcctttgaatcaatcttgggtatagtcaaggttttcctctttgctcttgaaagactgtgatcctcatggcttttccatgaggatctccagtaccaaattctccagcactatgggctgtagtggctacccaggaaggaatggtggtaagaagaaataatgtagcaaaagagtagcactttcaaaggataagagagtcccttatctgaaatgcttgggactagaagtgttttgaagttctgctttttttcagattgtggaatatttgcattatacttaccagtggagcataccaaatccaaaaatcccaaatctgaaatgttccaatgagcatttcctttgaacatcacgtcagtgctcagaaggttttggattctggagcatttcagattttggatttggggatttgggatgctcaacttgttctattgtttctttttgaatcaaactaggtcagatgaaccgaagacctaaatttgactaagccattgaaatgcttacttggacacttcattaacagtaaaacactcaattgttttcttataaaaacagaagactccatctaaagaattccaggatcttttgcaaatggtaccccaaatgacaatattgccttatcatctattcctgaatgcacctgtcctgctgtcttactcctttgctaattgcaaacacagacattttaacaagttacatgcttacctaccatgtggatagtctattccaaggaggtacagaatggccttgggttccaaaggtgttttaaagatgttaggatgttcatccctgcgacgttgttataatgaatctgctaattttcttagataccacaggtacttggtggcatatctgttatggggggcagatacttagctactcaggtccctaaggcacaggcttcataagaattattctgcttttttgaggcctattcttgcaattaggtgcagttagcacctctattctagttttggaatttgcctaaattgtcaatagttttggaatttgcctaaaatttctatttgcctaaaattccaattgtttttcagctctttgacaacaattaaggtcaaggtcaagtgtttcaatgggcttcaactatgagcttattggattagtgatcagaaaatctgattatagctactacttagccttaagatcttgcttagatgtatcaaatgagatagtttatttttctgtaagtcagtgagaaaatgttgtaaaacacttttttttaatttatggttcaatatgaatgccagacttatatctgttttctactcagcatcttctcttggctaataagcttgtccaacttaccctgtctaaaatccaattccctccctcctctaccaaaaacaccaaacgctcattcctagtcctcttcttctcaataaaatacagatgtgtttttctaattatttgctcagataaaaaatcagggagtccttcttaatgccttttccattttccatatcccacatccagtctgtcaccatatatatgctcttggttgtatctgcaaaacacatccagaatctagccacctctcctacctccactgccactgccctgttcaagccatgattgtttcttgcctgaactattgcagtggtctcctaactggtcactctgtgcttccgcccttatcctctttaatccattctcagcacagcagccaaactgacgatgtcacccctctgctccaggtcctcccacggctcctcccatctcactgtgaacacagcacagctggacataactaccaacatggcgcctgtttactttctgctgcactcataggtatttatgccatctatgatggcagtgactttgattcactcctgtgctgctgtgtccataacatttgttaacacacagtagaaactcaggaaacatttgaatgtttgaatgagtgaaagaaagaaagaggatctctctctgcactttcatttctcccaactgcttaacagggaaatgtttccagtggtttattttataaacatattgatttaaatatgaaagcaatgcatttccattgtgaatatcacagaagtatggaaaataaagctgtttccctcccagtgcctctacctagaggtcactactttgtcctcctgaagcctttttctagagctataaatggcttatctcaatagtcttgtttgcaaaattaggatcattccatataaattattctacaatatgctttcccccaccccattctgcatttttttttctggggacttttccatttcagtacatccaaaatgctttgtaactcacattttgtaagggatcctacaggcaggttggttagagagaagtactttgcaaataaaatgtgattttaattattattttgatgattattacccctacaggctcattaaatgaggtttctaggatttctggtgtctaaccctgctttgacagagcctaaggtatttgttacatctgttatattaagaaataaaccttaaatctcatgatgactcacaaaagacactatactctcacaaggaaaaaatatttctttgaaccctaaccctatgaggaaggtacaagattcagtattttacaagtagaataattaagcattgattgatttgctgagcttaccatagctagggagttatctcctcaaatgctggttttctgacaccttctgtgttagcgattgttgtatgagcggctgatgtgttaatttagttatagactaacttcatcctttgcttttgtaacttctcactccttatttttaaccttttcagtgggttctgccagttccagaagatttatcagtttttaaagaaacatcacattttggttcaagttctctctctaaaaacctttgtcatcatttagcacattacaaatagtggcatgtagtcccaggctgcatgtcaaaggtaattaaatctcaggagttggtcaggattcataaactgcttaagctccatgcctgctcttcacagatgtggcatgactttgtgattaaattccagtttggtattcagtctgggaccacttatgcttttgcttgtataaagtggtatatgttttcaataaagattagcggaactatgtaagaaatggaagcaaccaaagcctcttaaaaaaaaaaaagaaagaaaggtaaatattggattctttcctcccctgatcaccctcctacccaactcccattttcctcaagttcaaatgcaaggagagaaccctagcagtaaatgcatgtaaattacgcaaatgatagagtctggggaagcttcaagagggtgaaaaactgccagaacttttcagggtggttcagcacgtttgcttagaagagattcatttccatcattcccaggatcctctggagttccttgttcaaaaaagaaaggaggctgggcatggtggctcatgcctgtaatcccagcactttgggaggccaaggcaggcagactgcctgaggtcaggggttcaagaccaatgtggccaacatggtgaaaccccatttctactaaaaatacaaaaattagcatggtggcacacacctataatcccagctatttgggaggctgaggcaggagaatcacttgaatcccggagacggaggttgcagtgagccgagatcgcaccactgcactccagcctgggctacaagtgcaaaactctgtctcaaaaaaagaaaaaagaaagggaaagctttccacagtggttcgtaagggtgtctttttctctttttgttgcattgacattgcactttgggaaaaccacattgtagtgtaggtggtctgtaaacagtcagactccctttcccaaagctccccattccctccatgtctgatctagtactgttgtagtggtctggcttcatgtgatgacttcagcatatttaggtggtgtcaacatatttctactttctcccttggtccctgttggatgaaagtggatcaatttgcttgttaaacccaacgctcaccctgcatttgccttagagttgttctgactacaagtaaaaagggaaaggatgaactggatgacgtatggacagaaaaaccactgttggttaaacattcccctgcttgaacacccagacgagaacccgtttcttaagagaactacagccttatctattactgtttgctaagttctctatgattgttttctccatgtgagaaataactttataggttagaaaactaagagcccaacagcttaagaaaagaaaagaaccaaccaaccaacccagaaaaagcaagctctctttgccctttgatggactctatcaagtcttgagtgcccttcctagttcctgggaatatactaacagataacagcaggttagagcctggagaggtttcaaagtcatcatttcaagagaaaactgaggctttaactggtttgcatagggtgacaaggctggttaatggtgaacagagaccatgttaataactgagtctgctccagtatgcctctccctacttatggcaaccccaaatcctgtatttctcaaggagattttgatttcaagcattctaccctttccactgtcaagagtatttgcatctgacagttgccccaccccaacttggggcttagccggagttatggtcacgccaactgcatatcattgagcatctgagttgaccatctgtctctgctaagagctgactcttccatttcctttttaagacctgacttgagagagtcaatacctcaggcattgtagaaattgcggtcattctaaaatataaaagtgtaaagtttatattaatatttaattcatacaattggaaagaactttaaactgcaattaggtgtcagtacccatctgcttccagcaggctcacacgctcttcgatccctcggaggccgcagagggccacgatcaccttcgaatgtgctccttaacaatgtgcccacagtctctcaggagggagctccagatggtgaaggaaactctgcaggccatgatcctgcagctccagccagcaaaggaggcgggagaaagagaagctgcagcttcctgcatgacagctggtgtccacgaagcacaagcctgaggagtgacgggatgggggagggaggtgggccaccatgtttggacccggggggctgctcttccctcccccgccatagctaagatgcctgaatcaattacggagatacagagccttgaggtctttcagtggaaaggtggttcatgttcattctcatcagtgtgaaactgaggagtctgcaatttggaatatggagagagagactgatttgctgaatttccttctaaatgtcactcaaaaatttcttttccatgtcattcttgggaatgtcttccacaggatttgagaatagtttcatctcagcccccattagagagaagttggggtgaattctggaaaaatgtctctttttcctgtgccatttgccttctgctgcaacgaaaatatttcctgattcaagattctataaaaaggaaaccaagcataagactctgtcatcatacctgttacacgttcctacaggtgcacaatctaagagagctaattaacctcagagtctggagttaacagcttttcaccttacttctcctgtgatctaatattatcttagaaaaattaatatgcaatttccaaaagatattttggtaagacaacaacctcccagtgatatgccacctttcaattttccttttgtggcaatgattgcatctgaagaaaggatccctgagagtctctgtttcatcaggacattctgaaatttacccacagtgaggctgtggatggatcaggggacctgtataaaatgtttgagcctgttccattttcccgtggaacctgtttcactcaatgccaggcagtgcagcatttaggaaagcagtgcagtactcagtaaggcagtgcagtactcagtaacacaatacagtactcaggcagtgcagtactcagtaagacagtgcagtgctcagtaaggcagtgcaatactcagtaacagtgtagtactcagtaacagtgaagtactcagtaatacagtacagtattcagtaaggcagtgaagtactcagtaatacaatacagtactcagttaggcagtgcagtactcaggaatgcagcacagtactcaggcagtgcaatactcagtgcggtactcagtaacacagtgcagtactcagtaacagtgcagtactcagtaacagtgcagtactcagtaaggcagtgcagtactcagtaacacagtgcagtactcagtaatacagtacagtactcagtaaggcagtatggtactcagtaaagcaatgcaatgctcagtaacacagtgcagtgctcaataaggcagtgcagtgctcagtaaggcagtgaattgcttagtaacacagtgtagtgctcagtaggacagcatagtactcagtaacacagggcagctagtactcagtactataagtactgagtacttatataggcaatgtagtactcagtaaatcagtgcagtactcagtaatgcaagggcatttcaggctcctgctgggctgcttctttggcccagctgggactcctattgagacagctgcaaaacaggctgatttcaattaggcagcacttcccaaagtgcactgaggaaggtggccccaagagaagctctctaaacaaaggagtaccctctctggtcaagtacctttggtaaatacaccataccataatatctgcttggagaaccacaatgcacattagcatattagtctgagagagaacttatagtaaggaaactcacttgattttatctaacctcaaactttccaagtttaatggatcgtgaatttttttcatgtaactcctattcatatcccatagatctagtattgtacagcactgcattctctgaggaagtcccagtccaaactctgatttacatcactttagaaaccacactcacacttttgcagagtgttgagcttaataactacctgccacagattggtaaatttaatccagtggttgttctgtttgtgcttctgttctcatttatgtgtttagggatagtgaggttcctgccttcactaggatccacggatatgagaccatttttgtcatttcctgaagtcacactggcgtttccagaaggcatctggtgctttgctcagccttccatgctgtgcagcacttctgtcctcagtcaaggagatggccatgcttaagccagcaattggctggggtccaggaaacaaagcaaaagcacaatatgtgaatgtgctgattgtgttccctatggctttatctcgagcaaaatacactctacatattttaataataagtataattagcttgttcctggacttcattttcaatgatgaaccaaattcctgaattatttataattgtgtctaaagaaaattatgaactggtcacatggcacttggaatccttgagttaattccagtgaagcaaaacttgggaagagtcaggattggccacattgccaataacaaattcctacttcgacatatgtcttttcaaaaagcctcccagacacaagacatcttaaccgtcactagcccaagtgttttgtattactcagacaccatcatgaaataattctgtgaggtcatgatgtatttgaaaattctgcaagttaataactgccttgaattgtttgaacccgaaataagggttctttggtacctctagtagatagtgtgttcatttccctgctgcaaattttgaagtatttgggcaggtgagtcatgttttaaccacaagccataactcatctgttgtctttgcttggtcttagagtatcattcagaaagtccgctaagggccagcgtgcttcttctggctacacaaccttctcaggacaagcccactgtcttaagccactttgaccctgggagacacaggactgtgtatcctcaatcatactatacagcagtttttgtcaggggaacataaaaatatccaagagaggttagggcttagatttaaaagcatcaaaacaacaacaatggaaatttatgttggcgatagccaagaccacaagcaaaagcacatactggaaatgatgagttagaatctgatttgactgggatgttttatgagaatgtaagtgtgatattatactgtctgccttgctggaatgctggctttcaaatggtcacccatttttctttcactggcctgagttaggacatgctatcagtaatagtcccagttccatccaactttctgaaatttcatttttttttttgagatggagtctctctctgtcacccaagttggagtgcagtggccccgcaatctcggctcactgcaacctctacctcccaggttcaagctattctactgcctcagcctcccaagtagctggggttacaggcatttgccaccgggccctgatgatttttgtatttttagtagagacagggcttcaccatgttggctaggagggtctcaaactcctgacctcaggcgatccacccccacctcggcttcccaaagtgctgagattacaggtgtgagccaccgcacccggccaactttctgaaatttcaaaactgaattgatccttctccaaattagtatatactattggaaacttgtctttccctgcagtaaggctggtttccccaccccagaaacatgtaacggttggtaccatgctaagcccttgccatgctaagccctttacagtcatatcctataatccccatatcaaccttataaggaaggtgtttgtagatgatgcaactgagccttaagaggactaattccctttttctaaggcacagagctggtaaaatgtgaagtaatagtgaacctaacagtcagagacaggcagcatgctcttaactagtgctcttcctaaagttcctttaatgtccttttgagattttgagccatggaacttacttgttcacctggctaagaactcatggccactgtggaaatcttggttagggagtcaaagaaactgagcctggggcaaacgaggcttcccacactgccaggggagcctcactgtgaagtctaggctcagacaggcatcaacaaacctattcaccccaccatcatcctgatctaaccattccccagtcatcccaggaaaaccactcacagcctgacactgggctgactttcttgaagatcctcatccaattggtgtttttcagaagtgttccaatattatgaattctgtgttgtggagaaaagcaaccatgcatttactggtcaatgccttcttgtatatgtaattcaatacttttacttttaatatcctcaccttatctaatctttgaattttgtcatgtaatttattgcttcattaaggttactttttgttatacaaaataaaagctgatatccaaggcatggtgcatcttgatgattttttgtcctttgaagtatggatgatagaaaaatgtatcaggtttattcatctcatctttctgttacaggatgattaattgtacagttacatcacacgaaacatttataataaagtcatgctttagaattgcacgtgtttactttcagatatcagcaaatcagaaaatcatgaaatattctattcccagactcctagattaaggaaattgaaactaacattaccactagagttgggaacaagacaaagatacccacaataccactgaaaatattttactggagatgctggctaatttagttaggcaagaaaaatatagaagggttacaatttggaaaagaaaaaataaagctttaatattcacagatgatgttattgtaagctgaaaacccaaaagaatcaacagaaaaacgtttacacaattaacacaatcaaaatcaacaggcttcatatatgcagacaataattggaagactgagtataagaaaagaccccattttcaatagcaacaaaaagcaagagaaaatggctaagaatatatttatataagaaatgcataagccttagatgaaggaaattttaagatgaaggacatgagacaagaattgaatacatggaaagacacattaagcttttggataggaaggcatcataaatttaaaaatttccatcagtcaatttataaatatttcctgatcccaaatgggacaatagatgtctagttagcccccatatgcattctcccattcatccttttagccgttctgggtctagacacttaaactgcagaggtacatgtgtgcagaattgcaggtgtacatttgtagcattgtttgtaaggacaaaaatgagaacaaccgacattttcatttgcatcagttggagactggttaaataaattattgtacattcacactatggaatgctttacagttgctaaaaaaaaatctttgtgtacatatgtgcttgtctctgcagagctatcactggaaagggatccaggcgacttagtggaaaaaaaatgggaaggagacttacttttctgctctatactattcttttaaacatttggtaccgtgtgcatatatttacctattcaaaaataaaatcatttctttaagaaaaaagtcataattaatgagcctgagagtaggccctcaagtagggcagggcacacaggctgttgaatggttgcccaggtctccttgcggcttatgcaggattcatctgctatttatttacctactgtgtgcccagcactgtgctagggtatgcacctgatattggtgataaaaaggcaagtatgaactatgacataatgtgatcagatgattttaagttgagaaggaaattgatatggttaagctttgtgtccccacccaaatcttatcttgaattacaatcctcataacccccataatctccgtgtgtcaagggaaagaccaggtggaggtaattgattcatgggggcagtttccccagtgctgttctcatgatagtgagtgagttctgataacatttgatggttttataaggggctcttcccccttcactcagcacttctccttcctgccgccttttgaagaaggtgccttgcttcccctttgccttccgccattattgtaagtttcctgaggcctccccagccatgctgaactgtgattcatttaaaactctttcctttataaattacccagtctcaggcagttctttatggcagtatgaaaacggactaatacagaaatgaatcattatcattgaaacttttatcactttaaagacaagagattgattttgttctggccattttcttgaacaactacatctgggggtgtagtactgaaaattcagcactctctggaacccacgttctctcccttctgggttagggaataacatcaagtctccttcctttgagccctggatcaaagagacctgataggtgattgattgtgtgggcagaatggagacttgggaaatggagtcacattctgcccttcattgtccctcaggaactacttatgccctcattgttttatccaattttaggtgtgcttttaaatgtacatatcacatacacttttccactgtggaaaagacacaaccacaaactccagcatgaagaacagcccagttgacctccctcatctttacaataggacaaaacagcttcttgagttcattggaaacaaagcctttcctacagggatgagaccttttcccattgtttatttatttattcactcaagaaacattgaactcctactataaaaattgcccttcctataaatgaatgaattcaagctacagaggttaaaaggcttagagaaaattatccagcaagcaatgaaaattttgagtgtcgactccagggacgcttggttttaaatccatgcaataaatcattaaactacacacagacacacacacagcagtttaattaatgttgagcaacaggtttttaaaaattattcctcatttgatttttatttgtgataagaaaatgtaaaataatcatttttaaagattcatgcatagcccactattctcacttttccagcccttgtttgtacaaaactatattttcaacaaactgtagccagcacatttttattcttcttttgtgtttaatattacggtattttccattttgctatataatcataatcattgttttattgctgcataatattctatcaaattgatataccatagcttagctattcccacataattggacattaaatccttccgatgttttgttgttacaggtaatgctgctgtgataacttcatgtgtgtagcttttcctttcctttaaattatgtcctgtgaagagattcccaggagtgaaactactgaaagataagaaagagtggtatagttgagatgaaattagcattaggaacagaattgaagacaaagatcagcccagcaatggcccattcccctgcagggagaattctcaaccagatattgactggtttaattgatttcgtggtgttcctgctcatcatgaatatatccacaataaccacatcaggtgagtcactgttggacaattcttaacatttacgatgagcaatgtcgatcctacagctatatcgtattgatctccttcgatactgctctcgttggtctgtgctcctcctattttgtctacagataaaaagtgtagagtcatgaagaatccaggatttaaagactagaggtctggactgaagttgtcttctacttagcacttgtgtgattttttaagctgatcacttaccttgttgatcctgcaaaatgaagcctgtctttcagggttgtggaaaaactcaaaagagccaatacatatgaaaatctttttttaaaaaaagcaacatatacatacgtacttcaaaattttttaaaaatttctgctatacggagtgaacagaaccaatctgaagcaggatgcaacccagtcaagcgagaacactgtactcaacctaaaaaagtgactctcaagaggtacctggtaattcaggtagatttcttaatataaaaaggagtattttcaatttctggttctgtagacccaccttccccaaacttcacaatggtcccagacacttgggagaacttgaatgcttgagatgcaaagtgctttgggtaacttctatttaatctgctcagctcagcaaagctgtgggtaaatattcaaaaacacccaagggtttgtctagagcaacctccccaatctggggaattgcacacagccagagcttgcttgggatggccttagccacagtcctccttccactgcctggcccctgcctgtttcacatcatccgcccgtaagcaatgtggtaaagcagattccagtccctcgtgaattccccaaaggtgcatttcaatatgaacccccttgatttgccattctcttttgcctctacctaactttaataacttttccctaatttttaccaatattttccacttggggcttttattatttagatgtctttttcttacctcatgtatttgcatttcctttgtagaagagaaggggagagtggcagttcctgattacttgagaacttcagggtgagttcatagtgcttctaaaacacccttttcatttactaacccgtaagagcaaggctgaggcgcaggcattgatttctgcattctgtgaagggcttctgctcctagcaggacaacagcatctgtaacaactacaaagccaggagcaccaggaatgcacacttagctctgcgttcgtcccagccttcagtaaataaaaaccccatgccaccatctttctttgcctggatagaagcagcagatgctttgtgctggcccagagaattccttttttcacaaatgcaatgaataagaacactcgacagaggaacacaaggagaactggagggaagttgttaatactcgctttgggcaaaaatgcttgttgaggtaggaggaagatgttttaaaaaatgaaaatggcaataaatcaatgcactcttacaaaatatgggaggagagaatgagaaaataacaatgaggccagagggaggcaaatgacatgttgcaacctgtgagaaaaaaaaaaaaaattaacaaggtctttatgtaatggcgtgtaccacacaatgcacagaaaaccatctctgatttattagtttcccatgagggaagttgagaaatgcagaaggcatgcattaaagggttgtcttgctaggcagagttttgacttttaaggacaagcgtagaaaggcatctcttcctggcttgaggagctggcaattaccagggagatgcctgccttgagatttgacctgagtaaaggcatctggatattttgtgcctgggaagatttgagtccttcctgataatgaggaggctgcgagggagattctcagcgagtctgcaaagtcatggtgaacttgtttcttttgtattccaatgcactccttatgtcccactagcaggcaggaggctctgggacaaggcagtgtcggggtcttaggcctggtccttgtcctcagagtcagccctatgccaggtatccagtacaaagttccaaaggcaggcagggcaccctttccttccataaggtttcaaccttagtaaaatctcagcccaaattttaggtttgggaggagaaaaaagtctgccctaagaattgatagccttctctcagacaggcttggggtcaaatttactgactctgtggtctagaaacccccaagctaagagatacatgtgaaaaatggccctggcaggggaaggattgatctcaagcaagtgtcactgggggagattaatttgagtagccacatggggaattaaaaactgattcagtgggggagggtagggaccaacattaaatcatttaggtgctctccccagccccaccctctccctactccccctttccctctcttgttaaatctcttccttgtagaaccattattcattcatgatggtcatgggaaatcttagccactaagaagattgctataatcgctctcaacctgcctacaccctatttgtcactttgttttgctatcaagaaaatattactcactcttccttgatatttttttctcagtcataatgagatccctctctcctgtagaggaaggaaaggattttcttgaattactgaaagactttccaaattacgaaaaacattaacaaaggcagtcagaatgaaagctttcttccccagacattgcctgaggcagacatgtgatgcccccatgtcagccacacaaagttattggggtaaaatgtatggtttggttttgaaacatgacagacagctggacacaactgtcatgatgggcattttccacatgcccatgacaagagggttatatgcgtggacagaagggctgaaagattcattattgtctataccactaccacagaactatgaaacttgactatggagacatctgtgatatttcacaaggacccagtactctcaggcatgactgcaccattgggctcttgtatcacatactcactccatagcctccatggtatggtttctgttcccaccacttcattaaaattcttttcacacatgatctgccaaatccaacagcattttatctgccctcattccattctacattttagtacaagtgtgcagtgtggaaactaatctcttccttattgaacctcctttctctcttgggttccgtgacactccattcccaatagtcttatcctacatccatctttctgcatgattactctttcttgtgcttaaaagatggatactccaagtctctgtcctagatctcttctctcatgggcaatttaatctgctttaacaagttttacaacatctccacagtgattattcccaaagatataatattcattgacaatattgattggacactcaccacatgttaggtactgaattgaaccccaaattcaaagttgtgtatggttccgtaccctctaatcattctccagttatgccctcttttctgagctttgattctgctggacatttccatcacgactgttactgaactgaaccacctggggcagcaaagtcaaacactgacattgggatttgcagggagacaacatgaggcatttattgcagaacatcaggtgaggagaatcagatagctcatgcttaagactccaactcccagatggcttatgaataagagttttttgtttgtttgtttgtttgtttgtttgtttttttgacagagttttgctcttgttgcccaggctgtggagttcagtggtgtgatctcggctcactgcaacctccagttcccaggttcaagtgattctcctgcctcagcctcccaagtagctgggattacaggcacccaccaccacgcgaggctaatttttgtatttttagcagagatggggtttcaccatgttggccaggctggtctcgaactcctgatctcatgatccacctgcctcagcctcccaaagtgctgggattacagacgtgagccaccgcacccggccatgaataagaatttttaaggacagggaggcagagattgtgagcaaagttgtaaatcaatatatggagggtatacattggtttgacctaaaaagaaaggatacctcagagtagggatccacaggctataggtggatttaactattttatgaattgcaattggttaaggaagaaaagctttgcttaaaaatttggggtcagtaggaagatgcgttaggtctggctcctgggtgtaacctcctccaggcccctcaggaagaacccagtttccctcatctgaagtctctgtgccagcaggccacatctttcatgtggtgggggtccaggtttctgaaaaacaactcaaggacatgttaagatgctatttttagtttctatagggaaccaaatattttgcgactaactttcttggcgattgttttaagctactactaccttcttatttctcaggttgctcacttacttctcaaggataaggtgccttgaatttcccatgaaggaactcaagattttcctttatttccaagcttggtggggcgtgcccagcaggcccctaagaggagtctctgttccatctcactgcctcatagacatctcaagcacattatgtctaaaaccaacctcatttttgtttttttttcctcacaatctgcctaccattcatctgttccttacctcggttctcggcatttccgttttccaggagatactaattggaaccctctcgattaccttttgtttcttcttcctcatctcatattcaatcagtcaagtcctagtgcctttagcagttgaagtttttatctctcattctgtctaatctgtagttcagattcttatcttctcttacttgagcaatcatggtaagtttctaattggtttccctgtctctaaatttctgttaatctaaattcatggccaaagttatctttctaaaccaatgatcagatcaggctcaaaaacctccagtgatttttctattggctaaagaatacttgttttattacagaacaattattatctgtcatcaaactatactttcagattcatcttgaatacctcctttctgtttttctttttcttttttttttttttttgagacagagtcttgctttgtcacctaggctggagtgcagtggtgccatctcggctcacttcaacctctgcctccctggttgaagcgattctcctgcctcagcctcctgagtagctgggactacaggtgcatgccaccacgcccagctaattttttttgtatttttagtagagactgggtttcaccatgttagccaggatggccttgatctcctgacctcattatccatctccctcagccttccaaagtgctgggattacaggcgtgaatcactgcaccaagccgaatacctcctttcaattgctctggatgactctgcattcctaactttccatctgttttcacagggacctttgttcatagctgtgaaccatagccttgaatcttggtctttacccatataaattatgctcatttgttaagagtgtgtgggaagacaatcaagtaagagccctaggtgtttggcctgaggaagtgggcaaatggcaaaactattggctgagacggagaaggttttagtgaagagaagatacttgtgcagaggttgtggggggcaggtgggagtgagggggagtatctgtagtttggccatgttgagtgtgagacattgattagacatgcaaacagagatgctgagtaggcagtatgagtttaaattgaattgcggctgggcgtggtggctcacgcctataaccccagcacttttgcaggtcaaaatgaaagaactgcttgcagccagaaatttgagaccagactgagcaacatagcgagattccgtctctaaaaaaaaaaaataataataatagaaaagaaaaaaaaaaaaagaaatacctgggcacggtgatgcatgcctgtagtcccagctacttgggaggctgaagtgggaggatcactggaccccagaagtttgagaccacaatgagttatgattgtgccactgtactctaggctgagtgacagagcaagaacctgtctcaaaaataaataaatagatctggggagttttatagattatatatatagattaaagtcacagaactatgtaagaccaaataaggatagaagagtatttaacagagagagaaagccaatgaacacagctatggccactctaacatttagaagtctgtaggggaggcaaatccaacaaatgaccttgaaaaggcaaaattgacaaggtaagaggaaaaccaagtgggtttgtagagttctagagaagaaaaccttcaaagaaagagcagtgatcgaccaggttagatgcttcagggagcttgaataagatgagataatgtactgactactgacctcagctaaacataggtcatcaatgactttggtaggagcagaatcagtgggaaagtgggacaaagcaggggttagggtgctggtaatctggctctccaaaacacaaaaacaaaatcctgatttatagcatttgccaatttccatgaaataaatattcccaaagagctggtttcaagctaacaacatgacatcactgaacccaaaaatgggaagagatgccgcaataggttcttgccagcagctccagcacacgtgggactgaagcctgactctgtggacacaggacaggagaggcagtcatgggaggcagcaagaattaaccacctttgggaggagttttgatcaagggtcagtaagctttcaaatgatttgcacaaatcaacttaatcctaacaacagccctccaaggtacttactaatatctcccttctatgggtgagaagacttaaacttatggatcactacgcagaaggaggatatgttggattccctcagtccagatatcaaaccaagtaatgttaacaggaaatagaaacatctttcttcccttttcttggtgtcctgtgataaaaatagagcaacttttagctaatgctcaagctaatccttttctccttctattattattcactgtttagatagacacagaaagaagacatcaacagaagtagctcgtgtttaacatgatggaattctcataggcagtccttgaagcagtgtgagctgatgagcattacactgtta

SEQ ID NO: 186 - DNA, 34744 bp, Homo sapiens
tagtagagatgggctttctccatgtggtcaggctggtctcgaactcccgacctcaggtgatctgcccgcctcagcctcccaaagtgctgggattacaggtgtaagccaccaggccaggctgattgtgaaaaatcttaaaaacctttacaacaactcagcaagggctaggcattgttaccacccaccccccctttttttattttgagatggagtttcacccttgttgactgggctagagtgcagtggtgtgatctcggctcactgcaacctccacctcccaggttcaagcaattctcctgcctcagcctcctgagtagcccaaggtgcctgccatcatgcctggctgatttttgtatttttagtagagacagtgtttcaatatgttggccaggctggtcttgaactcctgacctcaggtgatctgcctgcctgtgcctgccatagtgctgggattatgggcatgagccaccgcatccagcctgttaccccactcttaagagtgaggaaaccaagctttagagaaggtgagttactcacctagtgttcccagtggggtcaggatttgaacaccagatgaattccagagcctgtgttgttctcaccgtatcagacagcctctgtctgtaaggatcacaaaggcaggaactaaaacagggctgggcatgacttagacaatctcttaggaactttgttttccgggcccatcgctgggggtcaaggcatcgctttgctcatgatggaaaggtgtcccaggtctgcaagtacttccagcaaggcttctgcttccctggacatcgtggagatcaatgcaggtaagtccctcttcttcccctctggggagtggtgttagggtgggacactagagagatcgtcccttcacaaatcatgtatcttcccagagctgcttctcccaactcagctccaagttctaggctgagctggctctgagccccggagggctgtccctgtctcctcactctcttcttccccactacagctgtcagcacccaaagacccccagccccctggagtggggtcgccgccattcggagccacatgtcactctgccagggccccacctaggactggcccgcaggggatccgagcccacctacctgccctctgtggctgtgggctggggctgggccagggcctgctggggcatggagcctgccctggaggggctggctagcaaggctgaggaggttggcggcagctcctggaagtccctgccttcatcatgtgagtcatcaggggcaccgcaggtgggcataagtgggcactgacactagagctcgtgctctgcctctgagcagggtttatgttttcatccattccccttcctcttcaagattcccagctggagggaaattttcctctagttctgttgctttgtgtgttctaaaagcagaataccatggtaccaacagagtaaaaccccctagttccaaatgccctatccctatacccagtagctgtgtgatcttggacaagtcacttaacctctctgggccttggttccctcatctacaaaacggcattgataataatacttaactcacaggcttattttgagggttgatatgcttagcacagtacctggtacagagtatgcactaaatgttagtggctattttttattttatttatttatttatttgagacagggtctccctctgtcacccaggctagagtacagtgacgctatctcagctcactgcaacctccgcctccagggttcaagcgattctcctgcctcagcctcccgagtagctgagattacaggcatgcaccaccatgcccagctaatttttgtatttttaatagagacgaggtttcactgtgttggtcaggctcatctcgaactcctgacctcgtgatccgcctgacttggcctcccaaagtgctgggattacaggcgtgagccaccgtgcccggcctggctattttttaaattattgctctaaatcaatgttattcagaatataaagaaatttaagtcacatatgtaattttttataacagctttattgaaatattcacaaaccaaaaaattcatcaatttatacaattcaatgcgttaattcacaaagttatgcaaacatcactgctacccaattttagaacatttttatcatcccattagcagtcagtttcatcctccccgctcccagcctctagtatccactaatccacattctgtctctgtggtttggctgttctggacttttcatatgaacggaatcttacaatatgtggccttttgtgtctggctgctttcattgagtgtgaagttttctaggttcgtccatgttgtagcacgtatcagtacttcatcttttttttttttttttttttttgagactgagtctcactctgtcgcccagactggagtgcagtggcacaatctcggctcactgcaagctccgccttctgggttcatgccattctcctgcctcagcctcccgagtagctgggaccacaggcgcccaccaccacacctggctcattttttttgtatttttttagtagaaacggggtttcaccatgttagccaggatggtcttgatctcctgacctcgtgatccgcccgcgtcggcctcccaaagtactgggattacaggcatgacccactgcgcctggcctattttttatttttgatagagacagagtttgccatgttgtccaggctggtctccagctcctgagctcaagtgatctacccaccttagcctcccaaagttttgggattacaggcgtgagctaccgcgcctggccctattttctacttatagcaggtgtcaactcagacttgccccatttcagttgctcaagagccgcatatggctcttggttactgtattgaacagcactcttctaaatggctataggagaggcttcttttttttttgagtcagagtctcgttctgtctcccaggctggagtgcagtggcacgatcttggctcactgcaacctccgcctcctggttcaagcgattcttctgcctcagcctcctgagtagctgggactataggcacatgccatcacgactggctaatttttgaatttttagtagagacagggtttcaccatattggccaggctggtctcgaactcctggcctcgtgatctgcctgccttggcctcccaaagtgctgggattacagtctgttttttttgtttttgaaatgaagtctccctctgttgcccaggctagagtgcaatggcatgatctcagctcactgcaacctccgcctcctgggttcaggcgattctcctgcctcagcctcctgagtagctgagattacaggcactcgccaccacacctggctaatttctgtatttttactagagatggtttcgccatgttggccaggctggtcttgaactcctgacctcaggtgatccacccacctcggcctcccaaagtgctgagattacaggtatgagccaccgagcctggcctatatgagaggcttctaattctgactggtctctaatccacttgggggcaggacgtgggttaccacagagtcttgcatgcaggaaatgctcagtggttgcctcaggggtgagtgaatggatgcagttttcccaacagctgctgacagggatcacggccactcccaggagtctctgccaaagttccaccttgtccgagagctcatggcgccacttcagagcctggaccttgaggtgcagcaggttgtgggtgaggggtggcaaaagatggctttctggccctctgggacacccagatctgctgggggagggcttggtggccactgaggctgaatgtgggcatgcgggtggagtgtctgaccctacctgtggctgcctgggaagcaggacagtcgggatgtggtgtgtggcatctgcatggacaaagtgtgggacaagccagaggcccagcgggtcttcggcatcctgcccaactgcacccatgcccactgtctgggctgcctgcgcacctggcggaagaaccggcaggacttcccgctggatgtcatcaagtcagtgtcatgggggtcccaacagggatggagggaaacaccccagtgaggaggctggcctgggggcctgtgactattctcccacattctactccactgctcagggcgtgtccacagtgccgtgtccattccagctacatcatcccccacaagttctgggtgagcaagggggcccagaaggagcaactcatcaggaacttcaaggctcggaccaggtgaggctgcagagggaacgagactcagggttagggaagtggagaaggtagcccctgattcattctggttcagccatggttcccagccagtgaatccccaaagccctgaagtttagagtgaccaaaatggcaggtgaaggcatgaactattttcatgatttcagaaagcccagttaataaggccaggcatggtagctcacacctgtaatcccagcactttgggaggccaaggcgggcagatcacctgaggtcaggagttcaagaccacctgaccaacatggtgaaaccccgtctctactaaaaatacaaaaattagccagacgtgattgcaggcgcctgtaatcccagctactcgggaggctgagacaggagaatcgcttgaaccctggaggtggaggttgcagtgagctgagattgtgccactgcactccagcctgggcaacaagagtgaaactctgtctcaaaaaaaaggaaagaaagcccacttaataaacggagagtggctgagatagcagaaggaacaccagggccaattttctcttctaacttggctcagaatcaacttagagcaactctggttctctctgcaccatgagaagccttgctttggcttttatttccaatttgtcataaggcaggaaagtaaactgatatgaatacatgttatttgcttagctgctctttgaaaacatggggtggctgagaagggggctgaaaggcagccttattggataggtctgaatctcttggggagggtaagcacttattcaaaatctggaattagctgcaattccaagttcctaactccaccttcccaaagggtttactacacttgatctatgcaaagtgtatttgggtaaagggagggataaagaaggaggcctcgtcttcacccaggagatagtcaggcgtgttctggagacacctgtgaacgctaatagctgcatcaacaaaattactgaaggaaacactaactcgagtgactcttacagaaggggaagtatttaagctgtgcatgggaagaacagggttcctcaggaggagaaaaaagagggtgtcccaggcaaagagagatggaagtgaggaaatacagttgacccttgaacaacttaggggttaggggcaccgaaccccatgcaatcgaaaatccatatagaatgttgttgttgctgttgttgttgttgagacagagcctcgctctgttgcccaggctggagtgcagtggtgcaatctcggctcactgcagcctcagcctcctggctcaagcaatcctccccagtagctggtactataggcgcgcaccaccatgcctggctaatttttgtattttttgtagagacagggttttgccatgtttcccaggctggtcttgaactgctgaggtcaaacgatccacccgcctcagcctcccaaagtgctgggatgacaggcgtgagccaccacacctggccatgtataacttttgactcccccaaaacttaactaataacatgccgctgaccagaaccctttcggacaacataaagtcaattaatacagattttatatgttatatgtattatataacataatatgtattcttacaataaagtgagctagagaaaagaaacgttaaaatcataaaggagaaaatatatttactattcattaggtgaaagcagattaccataaacgacttgatcctcattgtcttcacattgagtagaaggacgaagaggagggaattggttttgctgtctccaggatcttgtctgcgtataagctgccccaggcaattcaagcctgtgttgttcaacagcaactgtactggcagctgggccaccagttggaagtttcccaaggggagcgctcaggactggatgtgataggagatggtgtagatggaggtttattgtgtgacaggctttgtatctcgtaaactgcatgaggcagggactcttactatcctcatactgtagaagaagaaactgaggggctgggcacggtggctcacacctgtaatcccagcactttgggaggctgacggggaggaactcttgagcccaggagttgagaccagcctgggcaacatggtgaagccccatctctacaaaaaatataaaaattagccaggcatgatggcacacgcgtgcagtcccagctactcaagaggctgaggcaggaggatcacctgagccccaggaggtcaaggctgcagtgagcgtaatcatgccattgcactccaacctgggtgacagagcaagaaccctgtctcaaaaaaaaaaaaaaaaaaaaacaaaaaggccgggcacggtggctcacacctgtaatcccagcactttgggagggcaaggtgggtggattatctgaggtcaggagtttgagaccagcctgagcaacatggtgaaaacccgtctctactaaaaatacaaaaaaattagatgggcgtggtggtgggtgcctgtaatcctagctacttgggaggctgaggcaggagaatcgcctgaacttgggagatggaggtttcagtgagcccagatcatgatactgcactccaacctgggcaacaaatgtgaaactccatctcaaaaacaaaaaaaagtctggtatagtggttcacacctgtaatcccagcactttgggaggctgaggtggttggataacctgaggtcaggagttcaagaccagcctggccaattttgtgaaaccccacctctactaaaaatatgaaaattagctgcacgtggtggcatgcacctgtagtcccagctactcgggaggctgagacaggagaattgcttgaaccccagaggtgggtgttgcaatgagccgagattgcaccactgcactccagcctgggtgacagagcaagactccatctcaaacaaacaaacaaacaaaaaacccaaaaaacaaacaaaataaaccagaaaaatgaaaggaggttcccagggccgctgctgttgctggctcagagactgagaagtacagaaaggggccccttaagatactttactgccatctgctggaagatagaataaatgtaaaagctacactatgatgctagtggtgtccgcttagatgcggggctttggtgctgtgtacaacctgcccaaccttatgtgtcagccttgagtgccccttgttcttggggtaacaggttttgaaggtgatggtcgtcgtcttctctctcatagccagatccgatgccggttcttcgtgcgagggaatggccgctgccccttcaaatctgagtgtatctacctgcaccagctcccagctaaggctgggacctccggtcctccctggcctgagagagtgcaactggcctctgggagtgaggtggtaaccgcaggggtatggggcaggggaggctgctggtcatggcttataataaatgtttgtgataaatatgaaacctatggatggtatctatgatgctaatatggtgcctacttagatgtggcacctttgtgctatgtacaatctgcccaaccttatatgtgagtcttgagttcctccattcctgaggcaaccagtgttgaagttgatgggttttcactgatttttctctctactcccaggtgctgggcccagcattgttcctaaggggtgctgagccagaggacaatgtgctcttcacagacggtgccctggccatgaccttctggggttcagaactcctgcaggaccccaacagttcttaccatggccttctgtaatcaggatcaacttgaggaaaattggggtgaggggaaggagtttctaggtggtaggtctttcccttttagggtttggtgggggggcaaaagtagcaagccctccacccccatgaactgcagcagtgacacagctggggacatggaggaatgggggagggctcctggaatgaggaaggttcaaaccctcttgccagggccttggtttttaactttgctcttttgtagaatgactctgaaagaaaaccaataaaatgcacctaagttatcattgctggtgtctgaagagtggtccgctcatagcccagccccactgccaagtgcaataaggctgcttctgcattcaatctgttgcaatattacttgtcacttagcttctggaaaacttcacagtgcatttttgcattatgaaaatagtaataacctcatgaatcttgtgaaagggactcggggatccaccagggtccttgagccatgtttagaacttttcctccctgttccctttcaggtggccagaatacagaccttggtgggtgggagccacagccactcagagtaaagctgtaggtgaggatgcacagggcattgcaggctttttagcattcttggccctgcctgctattcatcaggtcccactcctctaacagcttgtcattcgaagacccaaaacatcccctgtaaagttagagctgcttacctgaaacagaaggtgtctggaagaaacttctttcttgctattttggcatttgcaaagcagccattatctaagaaatatcactagtctttcccgacatctcccttgaaatcattttggctcaaatggagatcagatcaagctcaagatactcccatggctttccatactattcagagtgaaagcccaactcctttctgtgacctcaggcctcttaagatctgacctggttcccactctgatctcaactcctattactatccagcaagtgccctccgttccagccatgcttttgccccagagcccccccgccctccacagggaggactgaaatggtcttctcacagacttctatctggcttgccaacctcatcttcacattcatcttgcctgaccaccctatttaaaagcacttcgtgctgtgtgtcggtgttatgttctttttgaacacatcacaaacattgtttaattagctttccgtctctccccagttgtgtgacaatgagggccaggatctttgttttgttcccagtatccccagtccctaggtgctcagtaaacatttcctgaatgaagggctgtgtgtggcagcagagctgggacaggaaatacaagctagcccccaaagcaaggtttaggaggcactgtggggctcttctcgcttatttcctacgctttgcagtgatcccacccttggctggaagccaagttctccagcggacttccttaaactgaaccctaggaagtggagccacacctggccccctataaacgacccagagcaaggttactgcttggtctttgggaggaagttcagaagaaagtctttggccgtattaatagtgttaggttttactgtgaccatgtcattctcagggatgtttgtatatcaaatactatttctggagaggactgaaacccaaatgatagcacttttggcctgtggaagagatgaagctaagtggggtggtaaattgtggtcaaattctatggtgaagtccatgacaagcaacatgccgtcagcgtaaatacagcgcgggtcctctagcacaacagaacccctgacatccactccattccactactttggggagtgatgaagaaagggagagggttggggtcgtcagcggcggatccacccctccatcaacccccgcccccgccccgctccaggctccctggcccgacaccgcccacaaactaaccacttgttttgtccacgccccctcccatgggcacgccccaggccttggccccgcccacctactccggctggacttgtgcccggccctgccccttgcgaccggccctcgcgccggcctcacgttcaggctccgcccccggccgcgcctccctccttccctttccgacagcgcgggaacggctgcggcttcgggcggccgggtttctccggtctcccaacgccgaggagagcttgtaacaggcgctggagctggcccgccaccgccgcgtcagggacggcgctggagtcctccgttcccctcagcctctgagctgaggccccacaccagagtagggggcggcgcggcacccgtgccccggcatggcgacaccggacgcggggctccctggggctgagggcgtggagccggcgccctgggcgcagctggaggcccccgcccgcctcctgctgcaggcgctgcaggcggggcctgagggggcgcggcgcggcctgggggtgctccgggcgctgggcagccgcggctgggagcccttcgactggggtcgcttgctcgaggccctgtgccgggaggagccggtcgtgcaggggcctgacggccgtctggagctgtaagtcctcgcccgcggccccttagcaggtatgggaggcggggggctgtcgggggaacgacacacacagaggtgaaataagccccttcagcgacggcctgccgcgcaccctatgagcaggggcacccttcactgagcacttgctgtgtgcgggacatcgaggatccgggaactcgaggcacacgccttctgttcgctgtaaggtatagtgatgataagtggaggcaaatcacttttgatcgcgtacttccatctctaaaaaactggactcgtacgtccagtgtaagtatacttatgtataaagtgtacacatgtgttaaaatacgtacattttaaagtacaaaaatagatacttaaaacgtgatggtggaatacgtatccgctatcctggtggctgtatgctctgcttttcaaagcataacgttcactttaaggcaagattgctttctctaagaatggtaactgtgaatccatattttagtgttcttgataatttctggctcttggatgacattgaactttttttttaacctctctgtggctgacgaaggattcctactaggagcagaggtgtcggccctgccattttatttggttgtgtttctgttattgatattatctccaattttttggcaggcattcttttaagccacgtgcttatttgtgaggacaacttttgcttaaaaaaaaaagagtacagtatctacagatgcacttaactagcaaagttaactaaaacacacagaaaaatgagtgggtgaggtgccatgttcagctcctagtggggccagccttccactcctcttggatacccctcccccataatttatgctggaaaccatccagatgctaaatatttctaatgcttaatttcttatgttttagataaataggggaaaatgggagttccaatattttcttcctacactccactttgaatttctttcaggagatgggtcaggagaacttgtctgaatccccaaattggaagctatagaaatgtttgcccagctatctggcttattctggatagagtaaggagagggcagggccttaacctggggcccctggatagaagagtatttcagcacaattgatttcctttataatcctagatattttatcaaatgcatttaacactcattctgatcacaggtctctggcactaaaacaggttaaaatttcctggagtagggtcttccctatctctctacccccaaatatcctccccaccacaaattagccatcttttaaacttaggttttttttgtttgttttgtttttttttttgacggaatcttgctctgttgcccaagctggagtgcagtggcgcaatcttggctcactgcaacctccacctccagaagaagcaattcttctgccccagcctcctgagtagctgggactacaggcgcgtgccaacacgcccagctaatttttgtatttttagcagagatagagtttcaccatattggctgggctggtctggaactcctgatccacccacctcgtgatccacctaccttggcctcccaaagtgctgagattacaggcatgagccactgcgcccagcccatcttttaaactttgactctagtttttctctctcacatagtgtctatattccacaaagaaatagttgtctttttttttctgcctcacatcccaagtgcctctgtgttgacaaacggccctgcaaaattatgcatagggaggagtagagacgtgaggggtggtgggctagatgctgccatgacttgccacaccacgcctcaggtcacgtaggatctgggtttgtgcctcagcagaattacagatggttacattgcatcatgggcctctggagctctggggaatagtgttgaatctattttaagaaaagctgggtgcttgcaggacagagcattggttctgcttaaactcctggggctccaaaacaaaagatcctcatcccccgtctttcccctttggctctgtgcatactgtttggaatctgtaaagtgattccttctgtttcaagtttcatctctgggaagccttctgtgtccacagcagctcttgctgatctcagcacacttagagagttaattcattcaataaatgcgcaacaagtgcctgctctgggctggcgctgtgctgagtcctaggacacagaggaaggaaacactaccttcaccttttaggaactcacaatttggtgaaaggaacacaagagctggacagatgactgaccccgagagttccaggggattgccgagggcagccatagggctgcaagactaagcactgcacagcatcctggagtattatttttacctaaaatttgggaaagaacttttttcttcttttgtgtaaaacaagcatgaatctattatagagtaggttccaatatgaattttgagctgaaacagatgacagaggccaaagaatagggcctgtcatatgatagatattcaatgaacacttgaacagttctcatctttcatgttgtccctgtctccatccactgacttttttttttttcctttttttgaaatagtgtctcacattgttgcccaggctggagtgcagtggcatgatctcggctcactgcaacctctgactcccgggttcaagcgattctcctgcctcagcctccccagtagctggaactacaggcgcatgccaccatgcccgtctaatttttgtattttttttagtagagacggagtttcaccatgttggccatgcaggtcttgaactcttaaccttgagtgatctgcccacttcagcctcccaaaatgctataattacaggtgtgagtcaccacacctggccaacatccactgactcttgcagatactgcgtgccagcccccatctgtccaccgccatctagcccccagctctgcccagtctgccttgtgctcccttcagccaaacacttaactgcttgctctccctctgctacccaggaaaccactgttgctgcgattgccccggatatgccagaggaacctgatgtccctgctgatggccgttcggccatcgctgccggaaagtgggctcctctctgtgctgcagattgcccagcaggacctagcccctgacccagatgcctggctccgtgccctgggggaattgctgcgaagggatttgggggtggggacctccatggagggagcttctccactgtctgaaagatgccagagacagctccaaagtctatgtagggggctgggcctggggggcaggaggttgaaatccccccaggctccagaccctgaagaagaggagaacagggactcccagcagcctgggaaacgcagaaaggactcagaggaagaggctgccagtcctgaggggaagagggtccccaaaagattacggtgttgggaagaggaagaagatcatgagaaggagagacccgaacataagtcactggaatccctggcagatggaggaagtgcatctcctattaaggaccagcctgtcatggcagttaagactggcgaggacggttcgaatctggatgatgctaaaggtctggctgagagtttggagttgcccaaagctatccaggtactttggtagggagactgggtttagagtgatctttcagcagtggtggctttatccatggggaaggctgcttgggacactttttcccaatggagttgactgtagttcctggaggaagaaggaggaaggtagggttgagggaatgtagcctccactctacagactcttttttttttttgagatggagttttgctcttgttgcccaggctggagttcaatggcatgatctcagctcaccgcaacctctgcctcccgggttcaagcgattctcctgcctcagcttcctgagtagctgggattataggcatgcgccaccacgcccagctaattttgtatttttagtagagacagggtttctccatgttggtcaggctggtcttgaactcctgacctcaggtgatccgcccaccttggcctccaaagtgttgggataacaggtgtgagccaccacgcccagccactccacagactcttaaggaggggtagggaagggagttattggaggtgggaaatgtgtcctaatgatctataatgtggggttaaagggtgccaggcaagggagaggctctggagccacccctgctaccccgtcatatgtgggtgggaagaatcatgacagcatccagtctgcccctgcctcctagtctgaggcctgggtctacccccatttgggttggatgcagaagacaattctagacagctaggtttcacatggaccttgtctagtttgggttcttaggcacttttcaagatagagacttcatgttcttgactttttttttttctcctcgagacagggtccctctcttctcccccaggctggggtgaaggggcatgaatataactcactgcagcctcgacctcctgggctcaagtgatcctcctgcctcagcctcccaagtagctgggattacaggcatgcaccatcacgcctggctaattttttatatttatttttgtagagatggggtctcaactagttgtgcaggctatcttgaactcctgggctcaagtgattctccatcctcagcctcccaaagtgctggtgtgagccaccgcgcttggcctcttgactttcttgaatcatctttgccagctagctcccactgacctggggccttttcagtagggggagccagaaccgggcttggggtcatgctgcagggggagggacgtagcagtgactgggctctcctccacaggaccagcttcccaggctgcagcagctgctgaagaccttggaggaggtgactggccccacagtgctcaccatagcctttcttccatcttctacccagaccccaactatgcccaaggaaggcccaatgcagtgatatacaagctggctgggggagggggactggagtaaaggtctgaggacagtctctgaaggagcttttcttgaaccaagtgtagacttaccatctaaccccaggtaacttcctcttctctggtagtgccttccaggatctcaggccactccttctgccacctgaaggggtggcttcagtgacttgtcactgagggctctgccagccctaacatgagatttgtctccccaggggttagagggattggaggatgcccccccagttgagctacagcttcttcacgaatgtagtcccagccaggtgagtccagatgactgcctggctctgaggttacattctctgtcccttatctttttctatttaagtttatgttttcctacctcatgtgggaaatgtgggaggggattttgttgttttctctctcagcgataggggtcaccctgtgtagtatcttttagcccttggttccttcccctagggcagctctcccagactttctttgccctggagtatctttgccctgctctgtctgctgtccagttgcttgagacagcctagcagaggcagagtgcatgtcccggtgtcctctctccccccgcactctgtaagcagatggacttgctgtgtgcccagctgcagctccctcagctctcagacctcggtctcctgcggctctgcacctggctgctggccctttcacctgatctcagcctcagcaatgctactgtgctgaccagaagcctctttcttggacgggtaggtgtattgggaggtactcagagtgccaaggacaatggggaagagcaactgggccctcagaagggtggtacttgagagaggggattcccagccttgtagacatctgggctgtttgggcagcctggggcaaggaaaggatgcctgcttaactggcagggcatggacccccaggccatctacccacatggcatctaacttttttttttttttttgagagagagtgtctcactctgttgcctaggctggagtgcagcagtggcgtgatctcctgcctcagcctcctgagtagctgggatcacaggtgccttccaccatgcctggctaatttttgtatttttatttatttatttatttagagacggagtcttgctctgtcactcaagctggagtgcagtggtgcaatcttggctcactgcgacctctgcctttggggttcaagcgattctcctgcctcaacctcctgagtagctgggactacaggcacccaccgccacacctggctaatttttgtatttttagtagagactgggtttcgccacgttgcccaggctggtctcgaactcctggcctcaagtgatccagctgtgtcagcctcccaaagtgctgggattacaggcataattaagccaccatgcccagctggcatctaacttctctttgggcaccagaacccttctagaagctgatcaagggactttcagggatttgggaactgagcaagagaggtatgtatcttttccaatgggtgggtccatgtgagttctaaataaaagaacttggttttttttttcctttgtaacatgtatcatcatctgaaatgtgcatttgataaatgctgttgaaatgaagaagaaaataattaattttttcctccctgttggctgtagatcctctccttgacttcctcagcctcccgcctgcttacaactgccctgacctccttctgtgccaaatatacataccctgtctgcagcgccctccttgaccctgtgctccaggccccaggcacaggtaattctggaaccagccccaggcccagtagctctgccctcagtgttctcagcatccttcaccccagagtggccctggcaggagttgggtattcagtgattaaagatgcctgctgcttccctgacaatgcccctgtaacaggctgggcattctgttaccgcctccctgctttctgctgtcttctgccatttccccccagacttccccttctgctgtcctctacccaggtcctgctcaaacagagttactgtgttgccttgtgaagatggagtccctggagccagatgcacaggttctaatgctggggtgagtgtgcaggcctccgtgctgtccccactgccacctgttcccccaggctagagtgacatcacatgtgttgggccctgcagggaaggcttaccttctctaggaagccttatgtgtatcatctcactccatcctctttctcctttatgagtcctctttgccttttgttctcacgatgcactttctactcctagttattttttaggggatccttgtgtctcactaccaaatactttgttgtcagctcctggggctcttgaggttgtgacctccctggcagttgtatgagctctgcaacagtggctgctggggctggtgccagcatcaagaaggctctgactacccatttttttttggcggggggtggggggtggggacggagtcttgccctgttgcccaggctggagtgcattggcacagtcttggctcactgcagcctctgcctcccaggttcacgcaattctcctgtctcggcctcctgagtagttgggattacaggacccaccaccaagcctggttaattttatgtatttttagtagagacgggatttcaccatgttggccaggctggtcttgaacttctgacctcaggtgatccacctgcctcggcctcccaaagtgctgggattacaggtgtgagccactgtgccccacccctgactacccctttgttggctggggatcttggctgtccccagggccttgccctgctgtgggagttggagcagcagatagatactcaggcttgggtgggaggccaggcatttttcactagggcctctgctttgcagacagatcttggagctgccctggaaggaggaaactttcttggtgttgcagtcactcctagagcggcaggtgagcaggctgccctggggaagagtggacaaagaagtgctgcagtccttggaagcacacggggttcctgggtttctgagtccttcagtgcatggagggtcaagcaggacagctgccctacagcagctgcctgagacagtgggagagccctgggccatgcaaagctggtagcagagagctgagcacatggtcacttcagctccacctcttaccagctgggggggccttgggggtgggatttttgatgtgtgtgtgtgaatttaattttatttttgaataggtaatagattcatatgttcacaaatttttttttttttttagatagagtctggctttgttgcccaggccgaagtgcagtggcacaatcttggctcactgcaacctctgcctactgggttcaagcaattcttgtgcctcagccacccaaataactgggattacaggcgtgcgccaccacgctggctaatttttgtatttttagtagagatagggttttgccatgacctgaggccagaactcctgtggcctcagccacccaagtaactgggattacaggcgtgcgccaccacaccggctaatttttgtatttttagtagagacagggtttcaccatgacttgaggccagaacttctgggctcaagtgatctgccctccttgacctcccaaagggctgggattaaaagcgtgagccaccacgcccagcccatatgttcacaattttaaaagctcaaaaggatacagtgaaaaatattccccttacttctcttccctaaccatccagatttccctccttagggctaaccagtattaccagtttcaggggaatccgcccccctccagagataccatctatatgtggaaacatgtctactcttactttccctcctacttttttggaaattgcaacacaccaaactcagtgccctgtaggttgctttttttacttcacagtatattttggtgatttttttcatatcagtacctgaaattctgcctcatttgtttatatcttagataactgacctaacttctttttttttttttttgagatggagtctcgctctgttgcccaggctggagtgcagtggtgcgatctcagctcactgcaagctctgcctcccgggttcacgccattctcctgcctcagcctcccgagtagctgggactacaggcgcccaccaccacacccggctaatcttttgtatttttagtagagatggggtttcaccatgttagccaggatggtctctatctcctgacctcgtgatccaccggcctcggccttccaaagtgctgggattacaggcgtgagccaccgtgcccagccctgacctaacttctttatgcctgtggtttcctcatctacaaaaggggagatataatattaatagcacctaccatataagactggagtgaggtttaaatgagataattggtgtaaagtagtcagaatggtacctgatgcacagtgtttattaaataataataataattattattttttttgagacggagtctcactctatcacccaggctggagtgcagtggcataatctcggctcactgcaacctctacctcctgggttcaagtgattctccagcctcagccccctgagtagctgggattacaggcacgcaccaccacgcccggctaatttttgtatttttaatagagacggatttcaccatgttggccaggctggtctggaactcctgacctcaggcgatccacccgccttggcctctcaaagtgctgggattacaggcatgagccaccgtgcctagcataaattattattataaagagacaggtgattaaggtggcagtgtctcttgggccctgggtcctttatatctttaaccactgaaccagatgagggatccttggcttccccttggtcctaatctgagcctttgcaatggtagccaccattttctgagacctgtgtgtcttatgtgcattatctcatttaatccttttcacagtcttccgttagatatcctgagcctcattttatagatatggaaatggaggtttaggttggttaagttacctgcccagggtcacctagctaggaagtggtggagttgggaattgaatccaggactggctgaatgaagagcccaagcctttcttgtgattactgctccatctcccaatgtgtgcaggtggagatgacccctgagaagttcagtgtcttaatggagaagctctgtaaaaaggggctggcagccaccacctccatggcctatgccaagctcatgctgacagtgatgaccaagtatcaggctaacgtgagtattgatagggccttggggctggtcctgctggcagggctgccctgggcctgccacaagggtgtatgaatatgtatgtcagggataaaaccctgagtgctggccaggcacggtggctcacgcctgtaatctcagcactttgggaggccgaggcaggcggatcatgaggtcaggagttcaagaccagcctggccaacatggtaaaacctcatctctactaaaaatacaaaaattaactaggtgtggtggtgcacgcctataatcctagttacaagggaggctgaggcaggagaattgcttgaagctgggaggtggaggttgcagtgagctgagatcatgctactgcattctagcctgggcagcatagtgagactccatctcaaaaacaaaaacaaaaacaaaaaacaaaccctgagtgctagccagagaaacaacaagttcaagcccaggactggggaatgagactgcttaggagttcattcatccagccaacacttctttaggccagatgctgtgtggggcactgggaaatcaacagcgaccataatgcaatccctgcccttgagttgaccccgtcacctaaccccaggctagtgagaggggagaaataaaataaacagataacagatattagaagtaagatctggtaggagccaggtgagaggtgtgcaaagggcatttggtggcaaaagaagaggagcaagtgagctttgtttgtggttgggaattgggacgggcttcctgacttttttttttttttttgagtcggagtctcgcactgttgcccaggctggaatgcaatggcatgatctcggctcactgcaacctctgcctcctaggttcaagcgattctcctgcctcagcctcccgagtagctgggattacctgccaccacgcctggctaattttttgtatattttgtatttttagtagagacggggtttcactatgttggccaggctggtcttgaactcctgaccttgtgatcagcccgcctcggcctccaaaagtgctgggattacaggcgtgagctgtcgtgcccagacttcctgactcttaaaaggtgaatggtagtcaagagccagagatgagaggaagggcatttcaggaaaaagatacagtgtgagcagtgagtgtctgaggggatctgcaagtagttcattgtggatggagcctaaaaatgtgagaatggatggtggtgggggataagattagagagctaaagtactaagagctattatttctacagtacctgccatgtctcagtcatggttcttttattaaatttaatttttcaaaaatagagacagggtcttcttttttttttttttttttttttgagacagagtctcactctgttgcccaggctagagtgcagtggcgcatctcggctcactgcaagctccgcctcccgggttcacgccattctcctgcctcagcctcctgagtagctgggactacaggcgcgcgccaccatgcccggctaattttttgtatttttagtagagatggggtttcaccctgttagccaggatggtctcgatctcctgaccttgtgatctgtccgccttggcctcccaaagtgctgggattacaggtgtgagccaccgtgcccggccgagacagggtcttcttatgttgcccaggctggcctcaaactcctaggctcaagcaatcctcccatcttggcctcccaaagtgctgggattacaggcttgagccaccacacccagcctcaggcgtggctctaagccctttacatatatgaacttgctagtttattccatgtgtcagccctgtgagagatattcttttttttttttttttttttttgagatggagtctcgctctgtcgcccaggctggagtgcagtgctgcgatctcggctcactgcaagctccgcctcctgggttcacgccattctcctgcctcagcctcccgagtagctgggactacaggcgcctgccagcacgcatggctaattttttttgtatttttagtagagacggggtttcactgtgttagccaggatggtctcgatctcctgaccttgtgatccaccctcctcagcctcccaaagtgctgggattacaggtgtgagccaccgcgcctggcctgagagatattcttattattccgtttcatagatcagaaaattgagactcacacaggttaaagtaacttgcccaaggtcacactgccaggactagtagcattttttctgtacgtcatggtgaggagctgtatatatgtatgtatgtatgtatgttttgagagacagagtcttggtctgttgcccaggctggagtgcagtggcgcgatcttggctcactgcaacctccgcctcctgggttcaagtgattcccctgcctcagcttcccaagtagctgggaatacaggtgtgcgccaccacgcccagctagtttttgtattttttagtagagatggggtttcacaatatgttggccaggctggtctccaatgcctgacctcacatgatccacctgcctcggcctcccaaagtgctgggattacaggcatgaaccatggtgcccagccaggagctttatttttaactttatcttgaaagtcaggtattctgggctattgcctttgtacccttatgtcgggggtgttacaggcccatttgatgatttgatgtagaccctcccagaaagatggaagtatgaacatgcttctgttgcacagtttcaggggagctcctgaatcctctggagatctaggcagaaggacctccaatgtgaggcatcaggagtcattcaagggccttcaacctgggagtaacttcatcagatctgtactattaagaagcatctggcttctgtgaggagtgggattggagggtgaagatacagggcctgagacctgtcaggaggttgtagcaacagggcagaaagagaaagtgtgatccaaaaggaaggtagctgtcacagtagagtgtctgtgaacctcagttttctcctctgtaaaatgggagggtcttgaggattatatacagcaatgcatatatatgatgtatatgtatgtttgtatatggattgatgcatataaagtgctgccacatagtaaacacacaatgattgtcaactgttactaatgtggccggcttagtaaattgtgcagctagtatttggctccaggtctacctcgttaaccatggtgaaataatgagattagattgctcaggagtctcctcctctttccatcctcctggcctcctctctcctcaatagagcccctggggtagtcgggagacgggagggatcagttgctggagtcctgacatgatttttccttctccccagatcactgagacccagaggctgggcctggctatggccctagaacctaacaccaccttcctgaggaagtccctgaaggccgccttgaaacatttgggcccctgaccatccaccaagggaccaccctcttggtgctccatcaccagcttcctgaagggcatttctttcttcaccaccttgtcttgagccctagcctgaggataaaggctgagcctggccatcccagattgcaactgcctccctgttacaggctgcatagggaatattggcttcccagccagcagggaggctcctgggctaagggagctcagctatattttctttttcatttcttttgtttttgagagaaggtattgctctgtcatccaggctggagtgcagtgatgcgattgatcatggctcactgtaacctctgcctcccaggctcgatcctcccatgtcagcctcccaagtagctgggactacatgcacatgacactatgcccagctaattttttattttgtagataatatgctggtcagggctggtcttgaactcctgagctcaagtgatcttcctgccttggcacccaaagtgttgagatttacaggtgtgagccaccacaccaggccagagctatatttccaaaggctgctggccccaggcacactcctcatcaattctcaggctgcagggacaaactttccgatagggctcagtaggatcaagccgacccagagtgggcatgggatgctccaggaggtctggggtaccagtgggctcagatgaagctcttgtgctcatgtatattatgaccttctgtgtttttgtttctgacttgaataatttatcaatggtgttgaataaaagcaagttcaataatgtctttttcttttttttttttcgagtctgagtctcgcactgtcgcccaggctggaatgcaatggcatgatctcggctcactgcaacctctgcctccccagttcaagcgattctcctgcctcagcctcttgagtagctgggattacaggcgcatgccaccatgacccgctcatttttgtatttttagtagagacgaggctggtctcaaactcctgacctcaggtgatccgcctgcctcccaaagtgctgggattacaggcgtgagccaccacgcctggccaatgtcttattagaagcagtaccttccttcccatgaattctgggtattgagcccatccgcaccccctccacttccctgctcaatgacaaggaacatctttttcctggtgaggggaagggtgtagggtatcttattcaccctctgagggccaaataatgtgtaataccacccaccccatcctataggagctgcccccaccaggcaggggggtaggtgagaatgggcatcttaaaggtgggagtgactcagtctggagttcgggaagggttttgggcagatgaatccgaggagagatctgaagggctctgggggttactgtggctaagaggatgagacccattggacagaggaaagagcagagaagacaccttatgggtgtgcagtgctgtgtgcctgttttacatccttgtattcctgtagcacctggctagacgccttattcatagcagtcacacttaaaacgtagatgttatcaaattaactatcaagtgaaagttcacttaaggactttcccagctcttcccctctgcaggcgttgaaaggacaggaacagaactttccggacacttcccttaccacgagtccacgttagagcaaggtgctgagggagggaggtcgggccaggcttccttttgagaacataagctggtgcggagggcgcgaggggagaggggtttgagggacaagcgtgccggaatccacgctgtcagtgaacatcactgggctgtaccagtacgtgtgactaccgaagctcgagccccgaacccagccgcttccctaggggtccagcagcagcgggcgcgaatcggcacattaccgggggaccgcggggcgctcaggactgcgacaactctgtgggttaccgcgccggcctagcggcccagcgacgccccccagcggccagagaaggccgcgcttctcggggttggcccacccaaccgctctgcgggtaggaccgaggagcaaagcattatcgcgagatcagggccactatttgagcgcatgcgcaagacatgctagtctcttttccggttagcgcggcgtgagaagccatgaggtgagttggtcctgaaagccctatccgcgttcatccgcgccttcaggtgccccgccgagggttcggatcctgtaggccgcgccgcggacccttgcgccacctgcgccgcggggcatttctcaaggcgggtcggcctgcgggtcgcccttcctaccaggtccgatcactgagagcctccctcttccaccggggcttgggtctgggtctgagctcccgtcgctctacttggtgtccggaatctacgggggagtccgccgtgggccgcccgcccgtctcgaagcctagacctcggaggcttccaggcagtccgagcgtgtggactccgcggccctgagcgccctgtcgcttctctcccgcagcagcaaagtctctcgcgacaccctgtacgaggcggtgcgggaagtcctgcacgggaaccagcgcaagcgccgcaagtgagtgccgaccctggggcacggcgcgggtggcgagggccggcgggtgcttaacccccctcctctctcgaaggttcctggagacggtggagttgcagatcagcttgaagaactatgatccccagaaggacaagcgcttctcgggcaccgtcaggttggcaccgttctgatcccacccagccctcagtgcccccgtgcttgcccctcccctgcaggctcccgctgagccggaggcgggcacgtcggtactgatgtgctagggtagttcagaccccctgctccgggcaggcgcggctggacggacccccaccctgggtcttaaaacatgaggggaggcgtgggtaggcctcggccgagcccgccggccagcctgagaagccaggctggctgctggtgaatgtgaacgctccgggtaaggctcggtggctgctgcggtcccagacccttcaccggcccttgggacccagggctaggcgtaacctgttggtgctgtcccccaaaacgcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctgggtgagtccggccgctgtggttttgcatgtgagatgtgtggtgggggcggtagaaaggcttttctgccattttcgatttttaaatgatgaggggcctagaatagcaaaggatcggcggtggttgcctagcttgcctgagtgctgttttagctttggggtggtttgatgtttgtattgctatgaggattccagttgatgagggaggccaggcattgtaagttgaccagccaggtgctggtgaactatgatttggaaatctttacgctgcgttgtttaggcagtggcattagactgcttttacaggtaggaagcagacattcccagttgtcacgtgtccagggtccacagctaagaaataggcagaattcgagcccaggcagtcttgaccagagcatccgttgtacagcggttatgccatggatcatgggtcagcctggttttctgagagcatgttttgggaccagtgaaggtccagaggactttctggaaaccgtttgggctagggaaaagactgaggcggggtcttagagagggtgctgcttggaggtcacttacatgattgattcaagtgcgtttctggcctgccacatttgaggtgtgccttggtgaccaggttctaagcaatgccaatggcttcctctctctatcagccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgagtgggtctggcgggttgctatgggtgaaggtgttggcagggtctaaatcttatccaagtctctaaatatgccagtaagagcacccaccaggattgaaacttttggagtaaccctggtcttggcccgggtccaagtacctgctcaccaggccactgggggaggaaggacaggccatctgctattcgtccaccaacctgacttgatcctctcttccctcctcccaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagttccctctgtctgcctgtgattgagggtggggggtggtttgtcagctgacaagtgagggccttggcactgctgatggctagttgtgtagtttgtcactttgatgatggatagttgggtactatagggaagaggatgtttttctgccatcaaaatcaggcagtcttgcatatgtgatagggttgctaacggcattgaagctttttgacaggattggtccatgtaaatttaaaataaggattttagtcagcatttctgtgttaagaagaccacatgtggagtatcctatgctttgggttagtaatgagtaaatgttaaggaaaacaaggcacagcaaaccagtacaaaagtataattaatggaccttgttttttttttttaaatggagtttgtagcccaggctggagcgcaatggtgcgatctcaatctgtgggtcccagttcaagcaattctgcctcggcctctcaaagtgctgggattacaggtgtgagtcaccatccccagccagatcctgttaacagtattccaggtccttgccccaggcaggctaagccccctccttttctgaggcatttccctgttggcagttcttgcctctagcacccagtactgctttaacctttgactaaaatgagcttagtttgactttggtaaataggggaacaagttcatccctgctttttttttttttgagtcttcgctccattccccaggctggagtataagtggcgtgatctgggctcactgcaagctccgcctcctgggttcatgccattctgcctcagcctcccgagtagctgggactacaagcgcccgccactatgcccggctagttttttggtatttttagtagagacagggtttcaccgtgttagccaggagggtctccatctcctgaccttgtgatccgcccgtctgggcctcccaaagttctgggattacaggcgtgagccaccacccccggctgagaacggttattttaaagcataaaagcagtgcttaacaatgctgtattttggctgggtgcggtggctcacgcctgtgatcccagctacttgggaggccgaggcagaactgtttgaacctgggaggtggaggttgcagtgagctgagatcgcaccactgcactctagcctgggcaacagcaagagtccatcggtggtatgtgtgggagtcggggggtcgggggagatgctgcatttctcaaaacaagccttccctgtccctgaaatgaagaacacagggtttttactctgagcagcttttgcttttttagcttttaagaagttaacagcactttcttggtaagaaaggtataaaacctaatgaggatgagcagtgaattttggttctcaagacaggtccagccagctacttgttgtggttatttttcttttctttgggcttttctgtattttctgaacctcctgtgatctttgcaatcagaaggaaaagggaaacttcagcttaaagcaaaagcaattatctgaaggctcgtgtgctaatcgcccacagatgtaatcggtgtccagtgcagcctccaggaatttctgcttcctggacccctcctacctactggggctcggtaccctcccacccatccagcaggtgacagtttggggctcctagtgggataccaggcacacaacgtggagtcaggcagaccaggttggaatcctgatgttggcagtgactggctgtgagaagtacatttaacatgtctcaagttctcccgatctgttaacttgaaggttggactagaatgacctagaagactagattctagagggttgccagatttagcaaataaaaatgcaggatgtccttagtattgcatggaacatacttaaatcatctgtttatctgaaattaaaatttaactgggtcatccccattctgtttaaccctttattctagagtctcatctctagcctgccacccttagagcaaatacagtttcatcctgtgacaagtgagtccaatcagttcacccatatttaactgcaggagaaaaagctagaacagcctctttgggaaaatgtttgcttaaagctttttttttttttttttgagacggagtttagctctgtcacccaggctggagtgcagtggtgcaatctcggctcactgcaatgcaacctccacctcccgggttcaagctattctcctgccttagcctcctgagtatttgggactacaggcgtgtgccaccacacctgcctaattttttgcatttttttttttttagtagagacggggtttcaccatgttagccaggatggtcttgatctgacctcgtgatccacccgcctcagcctctcaaagtgctgggattacaggtgtgagccactgtgcccggccgctgaaagtcttgaactatctctgccccagccctctaaggactgtggtctgtccctactgtggacaggtggctcaggacagcagggctttccaggcagacatgggtaggtcagcagttgtcacctggggagagcgcttaccctccttgagtcacttagggtcagttgctaacccctaggctttggtctgtgttgtgctggcttatcagggggccctggagcttccatctcagtcaatgtgcgaccttgagcacatcacttcccttaggtgacctcaggccagcacacacaagtgctcagctggaagcaggagggagtgagggaaatgttgagtgtgggtaggccttggggccccccaagagatgatggcattgcaggggttggcggtgatgacacaccaggacctaggaggagccctcacctgaagctgttccaatccaaaggtctggcacacaagtggttacatgactgacccacaaacaaataactttaatttttttttttttttttttttgagcaggagctgggcctttgagggcccctgctccaaccccaagctgcatttatgatataacccatcacagctggattttaaaaatacacaaaaaaatatataatatacattataaaacctaggtggggtttggaggtggcctgagcgatatgcaaacagtgaggaccttcaggaagctcgggcagggtcgggatgaggaagggaaggggcacagtacttcatatgaaactcataaatacccacaggtggctgctggacaggcccagctggctctgggggcctgggtgttaagaagggacagcaggtgaagggttaaccttcagtcccagaactgggtctgggagctgctactctaggcaggtagattgaggtggggaagaacctaagggagcagtgcccaccaagggtttgtcagattcaagcctcaggcaagagaaaaatcaaaagccttctgctactctctccctctgggcctctggtctgcccagaggctgggactccttcctctaccttgctctcaatctggagggtgctggggggtgccccatcttcctggggcccctggctggcttgtgggctaatgaggtgctaatggggtctagtagctgctgtgctcccttcttcatgcccagtctgaaacaggtgctcccctaacccagcgcccctcgatgaggctccactccacactgcagagcctctcccctaccctgcggccagcccccgccccagggaggtagtataaacctgggctctggggacaagcagccctggatgagaactccagctctgcccacctctcctgtgggtccctcaacttcctggagcctgggcacttcatctgaaacccagagacctacgctcgctgtgcggagtctgaggaccacacaagccatgcaaggagtctgggcaccaggcctgggacacaaaggggcaaggaagtgtgggcccctctgtcctcagtccaaccccaaccggacactcccagggcctctgctcactgactcccttggtctccatcctgccctcacctgcccatcatgctcccccaagggtgggtgggggtacagtggccacacatgctggaggctgaaggtgtcccctatccccacctctctgaggtcacgcgaggctgggcagagcagggtgatggtgggtcagcgccccggacaggctgccccaccgctgagccctcctctcctctcttctcccacaattaaagcgcagaacagtggcagggagtgtgtgtgctggggtaggtggggaggcctcctgggtcctgggcctgaggcctggcaggtagatgaatcctcaatcctggacccccccaggggtgccaggcaggtgtggagaggagatgctcaccctgcatccttaaggaggcgcagagggcaccctagtctttgacgagcttgtagacatggtgctgggccccgtgctcactggtggagacttcgaagacaaaagcaatgacaagcagggtctcctgggagtcccggctcgtgaccacctggggggtgagcaggtaagagattcaggaggtcagggagaaaagggccacggggcagggggctgaacagaccattctcctttccggatctatgcctctcagccaagcgatgtgtctggctacccaacttggaggccctggcctgtgggactccccacgacccctgctgcccccatacctgcaggatggtgaagttctccagcacgctgttcatcatgtacttctcgggcaggtgcttcagcttgtggatgaagttgatcatgtactcgcacatgggcgagcggtggatacggtacacaaagcgcccgttctccagcctggcatactcagtctgcagagaatatggagaaggcgtcactcggcctgcctgctcccagccccaccaagccacccagagcccccactcacctccaccttctctaccacctgtttgccaaaggagcacaccttggtggagacgctgatggtcatgctatcagcagagctgtactgagagctgaccccatagaaggctcccgggccctcctggatggtgctgttgaggtcggcctgggcatgggggtggggggtgttaggtgctggcagagaccagaagtattcccgccacaccacatcagagtcctgcccaaggatccatctctggcactctgcccacaagccatgaggatgcagcagggtcagaggtcaatgcagtgggcctggatgttgcacctctggggtggggaagggggcttggagcagagaaggccagggggactcacccagaacttgacaaggaagaaggcattagggggccccttctcatagagctccttcaatcctccctttttctcggggaatttgtcatagatctggcgcacatctactgcctccaggggtgggtctgagaaggcggggttcgtctggccgatgtgcacaaacaggtgtttgctgtactgtggggagggcccagacagggtcaggagagtactcaggcttgcaggcccgggggcggggaagggagcactgcacaggtatagaattgcctagggcttcctgaacaggccagacccccaacccccagatcctgagttgcagccctggatcacccggccggcctctccacaattgtgcaaagcctcaccctcacccccaaacacgttaccgtgtcagggtctcgctgcacctccatgaaggctgaatactccaggagccgcagccgggaggaggcaatggtacggtcctgccacacaggcacagaggcagcagctgaggggagcggggccaggggctcataacctgggagggcgagacagattttcatctgcatggatgcatgcaggtgcttactgacaaagctgcccccagcttgcaaaggtgccccttttgggaaggaacatgagttggattttgactcccctactatgtgtccttgtacagtgtacaacctgcacaaccatacgtggtggccctagtagtatatatcaaaaacatttccttgtgtgtttaaacagaaaacacagagaagtaaaaaagggaaagaacaattacccagaatcccaccatctagaaagagaaagtcttgttaagatttcagtgcatttccttatggggagttttctatccatagagatgtgtgtaaatgtaggttttggtggtgtgtgcttgtagctgtgtattggctatggtttttttgtttttctgagatggagtttcactcttgttgcccaggctggagtgcaatggcacaatcttggctcactgcaacctccacccactgggtttaagtgattctcctgcctcagcctcccaagtagctgggactatagccatgcgccaccacgcccagctaatttttgtatttagtagagacggggtttcaccatgttgttcaggctggtctcgaactcctgacctcaggtgatccacctgcctcagcctcccaaagtgctggggttacaggcatga

SEQ ID NO: 187 - DNA, 75959 bp, Homo sapiens
actgaaaggaggctccggaagaggacaaggctggaagtggggaggccaggtaggaagctattggaatactccagatgggggatgatgaaggtcctgccctgaccaatagtaggagaagtggaggtaaagaggagggaatgactctgagaaatgccttggaagccacaggacttggtgactggatgtgaagaggaagggataaggagaaccaagggatgattctagtttctagagtgactgggtagattatggtgccaccaatggggagaaaatgcagaggtggagcatgttatggatacagaagatggcttgggctggggacatgttgagtgtgccatccctggaggcccacaaacacgcacatgggatccaggtcccacacaggatagtagtgggagccaccatctcaaaagtggaaggtaaaaccatgagagtagatgggcttgtccgagagcacagatgacgaggacagagtggggcaacgcccagtgcttcagacaggacagagggagatgagatgagcccacaaagactcatgaaaaggaaaagttaagcaggagaacagaccggcagagtgtggcaggcactggcgccctgcccatctctctcagtgttcgcctctaaaggtagaagcctgcttactgccaacacctgctgtttgcctgaggcttttttcctggccgtggaaacacccttggctccagcccagagcaggccggaagtgctggagagtgaatgcgcctagaaggaggacgcagcccacgatgaaggggaagttggtggatgagtaccctaaggcctgcgtccgtgggctggcttgtgtgcggtgtgtgttacgcacgctcaagtcctcagtgggactgcactcctcttgctgacagtgggataacactccctttattggctgccttcccttcattctccctgccctgctcccccactggtatttctgggaccacctcccaaataaaccacttatgcttgaatcactgtcagagtctgcttcagggagaacctaaactaagacaaacatgtcatgaaaaccaaacaaatagaaaacatgaaggtgttctcaccaggtaacttttgtctctggagggatcaggtctttcctgtcccaaggggcccacctccactctcataaaagaggccaatttcttgtctggtccgaaggttctcagcaggggactttccacattccctggctgagcaaactctaacatcaagaaatccttttgtagtcccagctactcagaggctaaggcaggaggatctcttgagcccaggaattcaaggctgcagcgagctatggtcatgtcactgcactctagcctgggtgtcaaagtgagatcctgactctaaaataagacagaaaaaaataaatactttcctgtctctcatctcattccttctgtttttgcaggagctgctgtgtactgcaaatgctcagaaagattcctcagccccgagcccgccctcgccttgtacccctgattcagtactcttcttttccagcactccaggtggctttcacttctttctattcatcatatctccagccccgtaggtgttctctgcttctctgtctgcctgcaatccagagactggctatgactgcttgccagtgtcccacagggagacggggggctaggtgggctggaaatactcccagtgtacccctgacccaccctgctccccacctcctacctctcaaggcaggaggccaaggggaatcgccttgaaccagtcttcttgagagggaaagggccctcaagaagccgtatactagagcaatgaggtgatcactctggtgtgtaacaagccagggtatgaagacaggtgctgtacttacataattgtggaaccgtgtatgaatttcaacctttctgagctttagtcttgtcatttatagaatgaagataataatactatcaacctgatttaggctgggttcccacataagcagcccctgagacactattccattgcgaatggttgatttaggaggtgaaggaaataccagtagaaaagtggggaagtaagacaaggaaaggaggcaacaaagtatatgttaccaagccagctacaggatgggctcagtcccacagaggaaaccctgggagtatgcatggcacacatgactcggagttatcccacaaggggagtaagggagtaggggtatttatataccagttcccatcagttatgggtggagggctcccccaggaagtgttagttccctggcacttctggtctcccacacagtggaaaagtgggctctaattcccaaaggaaacccttaggctaggaaagtcaggcactagtgattggaagccttaggggtgaaaagtcacagtgcaccagacagggcaccaacaagtatctgttgcatcatcttagaggactgttgggaggtgaaatgaggtcatgtgtggagcgtgcttagcacagtgtctgatgcatgggtggttcttctttaagcaagacccagcttcagtttgccttcagctgcctggctccagggacttcctgctgcctaacaaccttgagagaggtcctgggggctggagagccatggctcaagagcagaggggactggaggagagaagaccctagggcacatggtgaagaccagaaagaagagggggtgcaggagaaccaggaaggagctggggcctggggcccaggcctggcatagaattacaaggatgaggaagtgtgtgagccccactccatggacccagccagatgccacacacaataagggatgtataaagacactcttatcttcacttatttctactctacattcattgcctctgacatttggagcactgctttctctcaaaaacaaaataggactgttgtgggaatcagagatacatattaaaagtgcctggtgaacagttgatgctcaacaggtggcagctattttcaatgtgagtctacctgggctttaacttccctccttcatatcccacctcaccctccagtgccagcagctgagactccaagccccaggtcttccaggttccatggggaaggaatacatcctctgctaagcacagagttctgaagacatcctaagtcaacaagcagaaagggagccagagtagagatgagaagaatggggagcacagccctctgagagaaggggatggctctgagggaatgagagtcttccttgtcccattttctacccaggtttcccccttgaccctagctagctctttccttgcgatcactgaagacacagttattacatatgtcctacaacatgcagctgatacctgcaggacaccaacttgccctaaagcgttaggctattttttgttttttaaactttgctctaaagtatcaaatcataatcaaatcaatatgcatgtactgtgcagctaccttgcaaaagaaattaagctggatgcaatgagaaatccccaaatgactgaaattgtgggtccctaaattaaggagtttattatctagttggagaaatgaggcataaaatggctaaacagttaacaaacaatagggtttgttaaaagttactgggagcttattaaataagttagctaacaacacattataacatcaatgacataggagtgctaaagagcacctggaaagaggcagaagtgggctgggttaatcaagaaagaataacagtagctatagtctatccaatgcctaaactgagaagaatcctacatgagccatacttgtcctcacgacctctctgccagagtctcatttttcttcccatcttgcagttgagtaaactaaggttaagccccttgcttcaggatttggggctagaaaagtgacagaattgagacttaaatccaaaagtcttcaagtggatggaaaatgtgggatagctcttaaaagataaggaagggccggacgaggtggcttgcacctgcaatcccagcactttgggaggctgaggcaggagaattatttgagtccaggagtttgagacgaacctgcgcaacacagagaccccttctctacccgggcatggtagctcacacctgtggtcacagttaatcggaaggctgaagtgggaggatcagttgagcccaggaggttgatcacagtgagctgtgattgcacctctgcacgccagcctgggcaacaacgcggaagctccgtgtccaaaaaaaaaaaaaaaaaaaaagatgaggaagaactaaatgaaggaaaaaggaattcttttctctgtgcccactcctggggcttctgctaccctcatgcatcctccaccccatccccacccccatgggtggggtgcatgggggagggataaggcactgggtctgctctcttggcccctctctgtgtgtcctgctctcttcctgcacagaaatccctccatgtagggatctcatttgacctaaagatgctgtgttccaactagtgggaaattgctcactgcttgtcaagctatcgcttatttcctgatctttaatgactgattttccaccaatcagcccaaagtcccatgcccaccaccttttggacaaggcctgagtctctgactccctaaacgtcccagaaggaactccaaatacctccaagggcccaggcacccggtcagcctggcacctagaaggacaagccagcctcgccccagtcctgggggccctctcctccacagcccctggcacagctacccacactaccatggtcatctacttggggcaatatggtaaactgataagcctcccccagaggtaggagccccgcttaaaaccgaggaagcctagagagtgccttgaaggttcctggcacggttcattaagatgtcaacccctaatgaaatatttctttctttaaatcatcattgatcttggggaagaggagcctttgtggaaaaggaaaaggctgtccctctcctatccctccctcacctccaatcggcacagatcctaggtctttcccagtcagaaagattgggaagcagggaatggaggaacagtggggagatgggaaagggaaaagattatggagcagaagaaccacagggggaaggagaggcacagtggggagggaggtcacagaaggaagcctactgcagcaaggagaccataatacccaaatatccactacaatcgaactgccccatcagtgggaggctgggtaacaaaacaagatgggacacactgatatggtagaatcctctccagcagcctcttaagtaagtgacctagagacacacacaacacatgcaacaaacatgtagacattcatctcggcagcatgaagttcagcaaaacacaagtaaaaacaaggagcaggctacctttcatttaaaattttaattgcttcatactttactatgccccaaaagtgaataaaaataaataactaaaacaaaagaaaattttgagatacccaagcaataccaaaggagtaagagtagaaaacttacttgggaaggccaacttcagaaaaccacaagggaaggatggagaatgggaaagaaggagagtcacagaaaggcctatattagcaatgatttttacatgtttcacttttaagcataaaatgtatagctcaattaatgtttacaaagtgaacacatgcatgtaaccaactcccaaattcaaaaagacccccagaaatccccttgtgcccctccgtcacacccccacctaaaacagccatgctcctgagttttaatgccatcaattcattggattgggttttgaatttcctatcaatggaatcaaacggtgttttctttcgtgtctggcttttatgctcaacgttggatttgtgagattcctccatgttgttgctcgtggcaatggtttgctcattctcattgccaaggactagcccacggatgagaagaccgtggtttagtcacctattccattgttgacagctgttgtgaatagtgagcacatgcgagtagatggcctagcattctggtgtatgccttttggtgaacatatgtacatatgcatttttattggcatatacttaggagtggagtggagtggagttactgtattatgctgataaagtgggttttatttttgttttttgttttttgagacagagtttcgctcttgttgcccaggctagagtgcaatggcacgatctcagctcactgcaagctccacctcccatgttcaagcgattctcctgcctcagcctcctgagtagctgggattacaggcatgtgccaccacacctggctaattttgtatttttagtagagatggggtttctccatgttggtcaggctggtctcaaactcccaacctcaggtaatccacccacctgcctcggcctcccaaagtgctgggattacaggcgtgagccaccacacctggcctatgctgatgaagttttattcctcaataactaaaaaatagtttttggccaggtgtagtggctcatgcctgtaatcccagtactttgggaggccaaggcgggcagatcacttgaggtcaggagttcgagaccagcctggccaatatggcaaaaccccatctctactaaaaatacaaaaattagcagggcatggtggcatgagcctgtagtcccagctactcgggaggctgaggcaggagaattgcttcaactcagaaggcggaggttgcagtgagctgagattgtgccattgcactccagcctggacaacagagtgagactctgtctcaataataataataataatagaaacataaactgtctgggcttaggtttgttgggaccatgggaatgaagcaaatgtttctagatgtacacaccactaccaccccaacctactcctgagtatcaggcctgctgctaggaacaagctcatccatcagcccacttcacctccacaatagggtggcggctgaccttgggaaagggcgtctgcttcaaagcaggagacctgggagcaagtcctcgccacactacttcctagctatgtgaactgagcaagtcatttgacctctcttagcttcacctgcagaagagtcaccattgctggggtgataagctgaacagcacgttattcgactgcctggcaagcatttaataagtggcaactcatgatttgcagttttgtgaggtcagcattcgtcattttaagtgaggaccctggagctcatcaaggggaaaataagtaattatggaaagcatgtgaggaacacattaccaggctagaagttttgcccatcctccctcccaaacacccaaggaggcctcccaacctcccaattgatgagtgaggtgatgagtgagttaactgagactcaaacatcatgtaacttgcctgggtcacacactggttaagtgacagacgctgaagttcaacccaaggctgcctgactctagcccctgtgctcttaactatggcccccctggaggggccaagccatgagccttggttccggccaccgccaaagcacctgcacctgccctgagtcctgtgaaggaacaaggacagaaagaggaccctcctgcctgctcccggtcactcccactttggagccaagggctactcttttcaaccttcttaacgaagctcttgcaccaggaagaagggctttggactggcttctttgatttcggggcatttgttctgtatctttctttggggaggctttgtcttcctcgctaaaatgccctttaggtgaagacaagacagggtcttttgatgccttgagcccccactgtagctcacagggagctgggaactgaactggcctggagatgaggggtaaactgaactgaaagtgaagcatttcccagggcaatccctctgggcaagtgagcccatgtgtaaggtacaagggctgctgcaggaaggggatgggaaaaacattcagtgaaccagccagaaaagggctggagaagcccctcggaggtcacctcattcaatacccccctacagaaattctctcttttgtctccaaagcccctagttctcaccccaccctcagcctttgctgcaagaaggataggaaggagaactgaggacatagtcactggcccagctggtctgacacaaggacttgccactccaggcttggcctagggctgtccacacaccatgatttccaccagagctgggcctcaacagaaggtaaatcagatagtactaccaagggctttctttctcccagaatatccttcccctcagctaacccacaagcaggcagtgtcgcttcagagaccaccatgagcttctttcttgtcctcactgaagtggctctagttggaatctggctcatcactgaccagcagctgtgtaagcctgggcaagttacttgatctctttgtgcctcagtttcctcttctataaaatggagataatacaaatatctccctcctggggttactgtgaagattaaatggctggtgggtggtacgactcagatgttagctgttattttattcttatggctatggttatctcagttgccacactggaaaggacactgagatatccacataaatggcacttagagtcttccctgcacaatttcacacctagaaatctaaaacgctccagcaggacctaagtatgcctgtcccacctgcccaaaaaggcaaatacataaaatgtggacctgtgcaggtgtcactaacattgcagaaaagggacagaagtgatgaaaaacaacccaagagggtgcctcctctctgaggtccccttttctttcaaggaccactggaacggccaagaaatcccctccccccaggcaactaagcatcaatccttgcagctccgaccccacacctcaggcttccagctcccactccacaggggctcacatactatgccagcctcttgtccacctgcctgaggatttagggccaggagaggcttcaagagccactgtcttcttgtcctgatcccacaacaggatcctcccttggtcatggggacccggcatcactgagctgggttggggtacttcatgaggacccctgaggcctccttcacttctccccacccccaacacatgcagacagatgggagatgtttccggcgtgtgtggggcggggagggggacgggtattgagatttccacgggactctgagtggtgcgtctgctaacaacacagccctcccccttgggccgtgggcatttcctcacccagacctccccctcccaacccaaacacaccatcgccgccaccaccacaatccctccagtccccctgggcaaaagcgatgttcagagacgcggggttttgtttacaatctaatttgtccggataattgcctcaactttgcacttcactttgcccgcatggctctggccttgggccccttcttcactggttcgcagagcactttacgggaaattccctttccgcagagggaggcagtgcgcgccagggggtgaccgttcacaaagccctgaaggggcctccccaccttctaccctcggctcaggaagcccacccccagcccccacgcagtggggagcaggagggaggccagacagggcccgggcctgacactggctccgtctctgggcccccggccactccccgcgccgagcgcagcccgccgggaaccagtgaaccgtgtgggatcaggacttggccgtaccttcagactccaggggatggccggggtttgcaagcgccccataggattagtccgaggccagggtgaatccctggggtccctccacctaccatctttttcagatctgccgcctcacgtcttctccccacgttcccatttttcctcccctaaagtttggtgcacgtggttttctctcgctctcagcgggctgccaggcggggtgaaagttgctgcacctgctttaggcgaattatggtagcactagaagttggtctcccctccctccgccgcttgctctctcgctccctcctccctcgctctccgcgcgctccctccttccctctccaccctcctcctcccccgccccctcccgccccgcccgcgcgccgcccgctcgcagccactcgcagcccaggctcagtcgcagcccctcggagtccggagcccgccgtccctgcggaccggacagtgcggccggcggccggcggccgggacggagcccccagcccgcgaggagggcgcggcgcaggcggcggcggcgcggcggggaggagcccgggccggaaccagggctgggccgggggcggggacgccggggtccgggagcccgggagccggagcgagctgacgagcgtcgcggaaggaccgggaaggaagagcggagccggagcgagccaagcagcccacaaagtgccatgccccggcggggttgaggcgcgcggcggtcggcccggcgcgctgggaggacgcccgggagctgcgcgacgcggggcggcgcggaagggcagccccggcgggcggcggcgggcccgggctgcgaccggagcgagccccatgccccgcgcgggctgacgggccggagcccgcacggagcggccgggcgggacaggtaggtggcgggtcgggcccagggacgtgggtgggggctgggcgggcgaccagaccaactccctcgctcgcgcactctctcgcccgctcgctggctcactttgtgtttgcaaactgcccgcccgagacgcgctgggcgccgggcgccaggaggagccgggcccgggccggcgcactttgttccagccagggccggccgtggcgcactgaccccgcgcagccgcgacattccgcccctggcccgggccccagcgggccggagctgcctcgggaacaggtgggggctgtggcgcggcgggagtgggggcagccggaggccggggcggggaggggggcggccggagaggccaccgaggcccgcccttccccaagaatctgggccccgccccctccccgccgggcctctgggaatggggtgtacgggggcgcgaccccctccccgccccgagtcagacaaagaatacttcccggcccagactttccagagctgggaagggaagtggctccccccaactctagtcggtaccggactccccaggacgcgccggagacagatgaaaatgggggcaagagagcgggggatcgcggtcctacccgccgtgtcgtctctggtgaagaggggacttgtcttgctgaggtcgcacctcggaagtgccagggccagtcagccccttttccatcgctcggtcagctcggggatagagcggaaaacttcttggggacttgagagcgtctggaaatggcccctgtgatttgtgcgccggaggtggagggtggggaaacgatctggctgacacctctactcacccgctgtggagagagctcccgcttcaccacttaaggggggaagagagggcggccacgggggcccggaggccaccagggaaggagcccggagtgaccgagcaggacccccccccgccccaactgaggagtctggtatctcccctggacaaccccagcacctctctgaccggcggcgcttcagcctcgggctcctcatccacgccaaacaaacttccttgggctgcgtcagagcacagccagtggcgctagaatgcgacctggggtcccggccgcccccataaaggaccgggtaatttcgcggaatgcggattttgagacaggcccagacggcggcggattccctgtgtcccccaactggggcgatctcgtgaacacacctgcgtcccaccccgatcctaggttggggggaaagggtatgggaaccctgagcccagagcgcgccccgctctttcctttgctccccggcttccctggccagccccctcccggctggtttcctcgctcactcggcgcctggcgtttcgggcgtctggagatcaccgcgtgtctggcaccccaacgtctagtctccccgcaggttgaccgcggcgcctggagccgggaataggggtggggagtccggagaaccaaacccgagcctgaagttgccattcgggtgactcccgagaaagcccgggagcattttggccaatgcgggtttttacctgaacttcagcatcttcaccccggtttcggagacctgcctagattcgtcccagcacgcactgtttcgggttcgggattgagggttagggcagcacacacagcttgaggggcaattgttaggactggcccgagtgcccgcagaaagaaagagcagcggggttgtcgtatggcctgtagctgcgggaaggtctgtgccggtcccactgtcgaacccagaagctcactttccacagaaaaccagggctgaagggccccctgaccgccatgccctgcgggcaccgggcattttgagctctcccccaccccctccccctgctgcgaaccagccggtaggtgcaggggccgaaggccaggcccagtggacccagccgcctgaaggggagccacggcctcagaaaacctctgcccgcccccgcggaaaaccgctgtggggaagtctgaaggcctttttttttttttttttttttcaacttgagaaacttttgcctcggggttttggggctctgttacctggtggctggagggaggatactggggctctgctcttggtacctggacagcttgttggctcccatggtgccctttcgatctgaaactcaaaaaactgtgagttgggggagtcactcacactctagtcagtggggcaaggtggcaaggggaagaggtggttttgtggttgccccctctcagcctccacacccagggccagggtgagcgctgaatctctcctgcgggacgggaccctcaggacccactttatcctggctccagccttgctactaagtttgggagaccatgggagccttctctcctggcaccaagggctgggcgcctgggtggagttttctgtccttctccctgtcctggacaggtttcccaggagttacggagttggggaacccctgagccctggagagagaaagacctgaccccagtgctggagaacgccagggccagagcatttgcaaagggtcccacttgcaaagggacctgctcctgtccctttctgtgtagggatcttcctcacacctagacgcccccagcccccttcctctgcctttagagccgaaaacttccgttctggctgtaggcaggtaggtcccttcttgccaggaatgtgcatatcctgctgggcccctaccccaaacatacctcttccttggtgggagggaagcagagggactgggagaggaaggcttgcttttgatccagtaattcccccaaatgtttgctgagcccctactctgcctgggcaggtcccaggctgagtactggggtacccaagcagtgaaggctggggtctgctgtctggacctcagattgttggggtaggagagacagatatcacatggtgggggggagggtggaggggagaagaatgggaacagggtgtctgtttcagaggagagttgtgaggtgcaaggggagggaagggttgtctccccaggaagccttccctgcatcttaacccttcctaccccactgccttggcggtttcctgtctctccagccacagtgcaagccccccagtcccatcctaagcaggcacaatgtctttattttttgaatagcctaaactgtgtgaaataataatttcttccatccaagaaactcctcacagtttcccttctcacagatcttaccacgctccagcttccctagaccaaggcagggcaggtactatttttgacaggactctcaggctccgttggctggaatgacctcctcagatttggttccagaactctggaacccagagcaaggaactgaggcctccccagggcagaacatgtgtcagagtggaaaaggctttggaacttggcattagagatgggactctggagaacttaattaagctcttcgaacctcaattttcttacattgtaaagtaggtcataatacccaccttagagattctgtttgggagttagatgagagagcagatgtcaagtaccttgcacggtgccgggtgcatggtagtactgatcaagggatggcgtttattattaatttgctagcactgccaggccacatgttggttgaatatggaaatactgaagtattaatcttcattttatgggttgggaaaacgaagtccagagagaagaggcaacttgtccaaggttacacagctacatggtagcacagctggaactaaaatatggggccctcgactcccagtataaccagtagggcttgagcgtgtgctgtggtgaagggagaaaggaagggatgggaggagctgccattcctccctccttcctccataagcttggcctaggccgcctgccttctagtgtgaatactttctcttttccctttaagtggagagggggactgtaggtgcagaatctggtgtttccacctgcacacaaccctggagcattccccaggcactcctaaggttcttgtgagacacacataaatgggagagagaattccccagaatgcagaggaggaaaaatgactgataacccctctctccagaaagggagatttctagggtttggaaaccctagcctacacgtccttatggaagattttggcagcaagtctcagaccagtttgggacctatcactgaatggatcatctcaaagaagcaaaaggaaactccccttgagcctgaagttattggctcccttcagcgttgcctcccaggattctctgtggaaatacacaccttcagtccactgccagttccaccaagccgggatcacagcgggaaccctctttcctctgaattctgccactttggatgctgtggtcttgtgagatgttgctcctgggcccttgcagagcctggacgcagggcacacctgcctgatctagaaaacaagagctcctggcacaaaaggtacacatctggacagggccgcaggtgttggaccgtggagtcactgttgctgtggtgtgtcgcccgggctggacatgcctgggcctggcgaatgccctccttgccttgatcctggtcccaggatccctcttgagatcagggtcttttcccggctgtccctctggcacagccctgcaccttccttctctcctgtctggatggtagccatacagccgcctgttccctgaatcccagctgctctgcccacctccctgggccccatgctctggccaactggagcctccacagccaggcctgatggtgggtggagccagttgatagtgcaagatagaggtaaatggtgtttcctttcctgctgcagttctgatggtctgtgacccaggctaccatgtaaatggaaaatggggcgacatagtgggttttcctcagactaacagtatgtagaatagagaccatccggcatttgttcaaggtaggcaggactggtgggagcagaagttactcaagtagcagcaaaggggtggcaaaatgatggcgacttgaaggtagggtggcttagggaatggagccagggactcagtagttgtatccatcctacgaacacactgtggagcgcctactgtgtgctggaggccaggctggtgaagggcagcaggagggacccggagaaggggtggctcacatgcaacttggaaaatcagaaatagaacaagggccggagcacagatctgtgggcactggccacctgagccagcgtgggtcctgaaacccccagctgagacaggacatgtgtgccacccagagagcccttaggagggcctccccgtgtgaaatgaaaccagggggtgggaggttggggtagcttccgttctcatctcctcagcggggcttccttggattccattcccggctggctttacgtttctaggagaacatttctatggagacccaggcctaaagaagttgcttcaaaagagggtggcggtgtacttcctcctttcctttggggttcccctgcagatgcacatccgcatcctggaaggaaggggtacactagggagagttttggggagatatgaaacatcaggatttgtgggagacccagcgagaggctgcggctgtaagcactcagggagcaaagcgccaggctttttgaggctgcgtctctggatgggagctggagaagctggatggtcaggccatgctgagggtgtagagttggtccactgagagaatccctccttcaggaagcctctgagctttctttcccagagagccagagctacctgtttcccctccccagctgagcgctcgctttggattgttccctcagtgagtttttacctttttaactgagcgcatcagttccagttgctggaagctcctgcatgtctgagacctgagcacagggatataacacaaggggttttcggcactcaccagacgcagagaaaagaactgcagctgggctagctcgggccggcagctggggatccggaaacactggaagaggggacggctcaggcagcatggcagtgtttagccacagagaaagctgcccaccgattgtgctcagagatgattttgtgggtctaggcctaaacagtctgtacccacacgggtacatgatgagggtccccggtaagcccactgctgccaacttcctaactcactcttcggccttaggcatgacccgtcttctctctgggcctcagttttcctaactgtacagtgggtgaagaggacacctgcagccccacatcctcgggctcaccatcctgaagctgtgggttgggagccaggcaagaagagacctgaaggtctcaacgtacaccctctttgttccaagggcatcgggagcctacttccatgggtccttcttgaaaggggtgctgtggagctcggggcagaggacactatgacccatgcaagtctcctccttcccaattaggcagtggagcctgattaaaaggggtgctgcctgccccctcccacccgatccccatcgacgagatttcccttcatcagaatctcacattctccagaaattaatttgatgcctcatgttatcaattaattgaatctcgttgggagagagagctccgcgaggtgaggcgagcttcagcttggcccttgtgtgccgccatcccccctccccctcacaccagggcagccttctcctcccccattcctttttttctgcctttcttttaattgcacttattttctaaaataaaaccactgctctgtgcccctttgcccagtttggcttggatggatacccatggactgggtactggctgggatttgccctttcagaggtgggggcaggaggacttcccctcccctggaccctgtctgatctctccttaagtaaacagaatctcaccctttgggaatttggccgtgatcctgtgtgctccaggggcttctggtgagaaacttaggaggactaggggagggaggaagagctgggaacagactgcaccctagttggggacagaggaggtagagaaggaccaagctagggaccttttaaccctcaggattttgtcattcagaagctgctgcccctgccagaactgatccattaaaacacagggcagagggcataggtgtgtggtacctccaagcctcccaacagtcaggtcagatatctgcaggaacaagccctcagcattttcaaggacacttggaagcccttgctctgccccctgcatggaagatgggggaaggaagttctaataggacatccctattaggaaacctgggaggttgttgtggcaggtagagctaggtagtcaccaggccctgactgaggaactgtgctttgccgtttcacatacctccttgttcttatccccacaacaaccctgaaagattctccaggcagtggtaattatcactctcatttgataggtgaagtacccaggcccagagaggttacctgacttgccccgagtcacagttaactggaacttgcctttctgaaatgctggccataagggctgaggtcacaagtggactaacttcatccctgctgagttttgttgacccacacacagttcattacaatggtaaatttcacataaatatccccacttctgctccttttgaaaaacccaagccctgtcaacactgagcctgcatttctgtgtggaaaggatggactgggattgagtggcagctgcctcctcgtgccctcctcacctggcctcctaagtgaccagcctagcccctgaaggcattttggttagcagctttgacatggagattcacctgtccccagtattcctcaaggagaatctagtgtgggacagtgtctgaaggactctgcagggtctagccaggcacagtggctcatgcctgtagtcccagcactttgggaggccaaggcaggtgaatcacctgaggtcagtggttcaagaccatcctggccaacatggcgaaaccccatctctactaaaaatacaaaagttagccgggcgtggtggcaggcacctgtagtcccagctactcaggaggctgaggcaggagaattgcttgaacccgggaggcggaggttgcagtgagccgagattgtgccactgcactctagcctgggcgacagaatgagactctgcctccaaaaaaaaaaaagactgcagggtctgtacaagaagatctcagagagaggacctataaggacaccctgacccaaatctaattcccacacagctacttaataactgatggtgggatgggcgcagtggctcatgcctgtaatcccagcacttgggaggccaaagtgggaggatcagttgagctcagtttgagaccagcctgggcaatatggtgaaaccccctctctacaaaaaatacaaaaattagggtgtggtggcatgtgactgtagtcccagctactcgggaggctgagaccagaggatcacttaagccaaggaggaaaggttgcagtgagtgagccgagatcgcgctactgcactccagtctgagcgacacagagtgagaccctgtctcaaaaaaaaaaagaactgatggttgtgggtgattctttttgccttctttctaccacagaggttaggtctttgtaccataaggccttgtgtctccgggggcctgtttcaagatgaaatcagcgcatccctgccagggtgagcccctctatgataaagtcatcacttgccccctacatctgaggaaatgaagggaggggccaaggcatgtcggggcaggctgggcagaacagccaggggcccagaaatggccatactcagtggtttgtcccaggccctctagagcccctcctgtgcccaaaggaaaccctggtgccaaaggcaccaccagaaccaggctccagatggccattcaggccctgggcgaattgcccctaccccttaaccagcaggccccccacataagacgtcactatttaattagccgtctctgattaaccaaacttggcattcggctcctcttgccctcatctttcccagctccgaatcaatggctttgatatgctaattagggagtaatttaatttcaaaaggccgcaattaacaagggtgttgtggacatgctgtagttaagcggagtaatctaatttgcattagtaacaagcagggactaattagaagcttaattagacacttagatggctcttatgtttactttcttaatgagatggagtgggatctttggttctctttctttttttccccctgtattgttaattcttttttttggtctgtgtagtaggaaggggtattgagggaggccaccttgccagggcctgtgggagcgtttcagggatggagccagtaaaaggtaaggtggagggtggtggtaggggtaagggaaggcttggattccagagtgactcggggagttaggacgcggggaggagcactggtttaggagtcaggagagccacctggtttcagtttggctcagtcacttagcagtcaggtaaccttgtcaagtctttggcatctttgaagtgtggttccatcctctgtcaaaatgagcgcaaaattgcatgggggagagaggagggaggggctataggaaagcactcttggggactctgtgaatgttttttttttttttttgaaatggagtctcgctctgttgcccaggctggagtgcagtggcgtcatcttggctcactgcaagctccacctcccaggttcacaccattctcctgcctcagtctcctgagtagctgggacttacaggcgcccgccaacacgcccagctaattttttgtatttttagtagagatagggtttcaccatgttagccaggatggtctcgatctcctgaccttgtgatctgcccgccttggcctcccagagtgctgggattacaggtgtgagccaccgcgcccggcaagcgaatggtttttaacaataaaatatattcacaaattgtgtgccgaggccttgctgcgtcatggctcagctcagaagccacctcctacagaaagccttcccagagcaccccttactccctccaggctccatggtccccagtgtctaacataacatttgtaaagctgtgtgtgttgtgtaagacagaagttctcaatcctggctgcactgggaatttagaatgcttggaaagctttttaaaatatccacgcctgggtccagttccctgaagagtgcgatttaattgacttagggtgtgccataggtatgggttggttggttttttaaagctccccagatgattccgatgttcagaaggaaaacttacctgcccattagtctttctcctctctccatttcaagcccggcaaaagcaaggattacgttttgctcacctccatttgccccaaccccagtgcccactgtgctcagtatcagctgcaggtgaaggctccctaccccactctgaccttagggaactcacccagattcgacagggcctgtagtgttgagttgcaaatgccttattcaggctctgagaatctcctggagaaggagctgaggagaattgagggaaatcactaaagaggttagggcccgagagtcttatgagatgtgactgcttgctaaagaagaactgggcaaaattggtatgaattttatgggcatcagtttgggaatgaatatatcaagaaccttaaaaatatgcagttccaccttctaaacatgtatcctatgcaactagtcaaaaatgtagagtatcctgttcccatagagtatcctgttcccatttactgcagagtcatagtaaaacatagctaacagcctagatgtccaactctaggggattggctcaatacattctggaacatgcggcccattcaagcaactgtgtgaccattagaaactgttgcttaaaatatttgacagcatgtggaaatgcttatgatagtaagtggtgagtggaaaaagacgaaaattgaaaccatgtatagattatgacccaaatttcactttttaaatgtttatatgccaaaagagagtgagaatggattgaccagaaaggctatatatcccaaagggctagatctctgtagggtaggattatgagtactctatttttttttctttttttcaaaattttctaccaggatgtctcttacttttaggattcagaaataaagttatttggaacttgggagaggacctggaacagacagcacaggacggcagattcaccttacaaatcgaaggctttggtggagcctttcagataggaatgtctttgccctgccacttgtactgatctcctccgagcacccaagtgttgtgctaagaagccttgaatggtccctagagttggggtaggcagcttctaggatgtcacagtcattgagggagactcccaggccaggaactcaggcagagatgggggtacagagggaagtccagcgtgccagcctctgacccacacaatgaggagtgcccaaggagggcaggggcttggagagggattaagcctactctcgaactcacagagccccatgtgtttggggagagaaactgctggcacgatcagggagccaagcagtgcgtgactcacatcacccacctctggcttcaggacctattctggagctatagccacattttaacccatgggtcttgactcactttcttcaagtgctgaaccaagggctgggagaggggggtgggatcaatttttaaaccatagcccactcaggtgggttgtagcaagactttctggactcctgtaattatagtcactacccttctctaaacatcttcctcatgcagtgtgtcttatttgataccactgcaaccctggaaggaaggtgtactggcattggccccacattacagataaggaaaccagggctcagactggtgacctcattcctcaatgtcacaaaggtagtaagaggccaggaagggttagcagttcatctggcaaatgagtggctggctaagtaagccagaggcccaaagtggccactgccctgaagccctccccttacctggagcctgaagccagaagccagtgggcctctggggccagggctgaatgggggaggctggtccctgggactttggattgggaagcatcctgcagttacttgtagggccagggctcgttgctctgaaaagccctctgttttatatctcttgacacaagtaagatatagcaggatagctagaaacaaacaaatagagaaagaaggaactagaagacatccttgtgctctggtatccacatgtgtatctttttatataatctagaaatgtatgtatttcaaaggtttttcattctggaaaagtctgaaaccgacgacccttcttttgtaaaataaaggcctttgcgtatgttctttgccctgcattcattgtatactttgcctggccagtacctactcagccttcatatctaagcataaatgccctttcctggcaaaaggaggctttccctgcccctctccacttaccttagatccccatttatttcctgtactcacacttgatagaatgtatctgacttgggcttctccatttacttgtgtatttagttaacatttgtacactcttcatgggaacataagcttcacaagagcaagcctgtgtcctgctctgctggagtctgcatacacagagcctggcacactgtaggtacttaaacattggtcgcaccaatgaatggatgaagggtcattgctggtgaaacatgctcctggccaaccactggaggagagagaagcatgactttgttcatggctaaagccccactggtttttaggaaacttgttttgaggaaaaacaagtgccaggtttatctagaaaaaaaagagaaggggctaggacctccattattaccagtcgcccttgctgagtcctttacctgcagctctcagagcatctaaggacactgctgcactgccttgttcagtagcgtccacatttcactttccttcaggtagatccccagtgcttagcttaatggggccctaaatacatgttgaatgattgaatggcttttgcagatatatcatctagttttgcccagcaggaaactcataactaaagttagtgttcatcattggagccccattgcctgggacaaccaccatcagcatcacctaggaacttcttagaaatacagattcccaggcccactccagacctgttgggttagcaacttctgttggggcccagtaatctgtgttttaacaaactctccaaggtaactttgatgcactcaggtctgcaaccccctgatttaacgttgtggtccgtcattctcatcttctactccgtgctattgtattttaagaaatcttacctcttattgcaatctgcttcctaatctttgttggaattataaattataaaagagatggctacatctagtccagttctccccattatacagagaagaaaagaggagaatcaacttgctccaagtcactctagtaggccaggtgcagtgtctcaggccagtaatcccagcactttgggagactgaggagggaggatcacttgagcccaggagttggaaaccagcctgggcaacaaagtgagactctcccccgcaccaccaccactctgaaaaaaacaagtcattcagtagtaaattggtgttagcgctggggctagacaccaacttacagggtcaggctgtcagctgggccacgtcctgctgtctcccagactatattataggtttctggagaactggaaacgatatcttatttaaattccaaccgccaccattgctctgggtacgggctacctgtggtcgttccccacccgtgtctcccttaagaactggggcctcatctccactccagctgcgcgtgcacgtgtgctcccggcaggacgcgcgcccaggagcgcgctgggggctgccccgcccctctctccctcccccgcgggtaaactccgggcatccatcagtctgttaattgcactaattagagatcgcagaggtgttaattggaaaaccctggtattgtgcctgtttgggggaagaaaacgtcaataaaaattaattgatgagttggcagggcgggcggtgcgggttcgcggcgaggcgcagggtgtcatggcaaatgttacggctcagattaagcgattgttaattaaaaagcgacggtaattaatactcgctacgccatatgggcccgtgaaaaggcacaaaaggtttctccgcatgtggggttccccttctcttttctccttccacaaaagcaccccagcccgtgggtcccccctttggccccaaggtaggtggaactcgtcacttccggccagggaggggatggggcggtctccggcgagttccaagggcgtccctcgttgcgcactcgcccgcccaggttctttgaagagccaggagcctccggggaagtgggagcccccagcggcccgcagactgcctcagagcggaagaggcagccgcggctttgacccagcttccttccgacggcatctgcaggagcctctaggcctgacataggctccgaggtgccctggctcccccacggggaatgctgagggttgggccactaggtcctgcctaagtgcaggacctgagcctcagacaaatcctggacctgccaaaataactcggcctccggtgctatctcccatttgcccccaacatgtggtaggagaggcatatggaaagtctggggtgggggataagagcccagtattagcgaaccttagacccctggccaatccctaccttattgtatggaggcagaaagagcaccccagtgacttgcccaaggtcacacagctgagcctagaaaccagatggtctaattctcagagcctctgccttcctgttccgcaggtgttcagctgctccttgctgaggaccttggtggctgggggaggagcatggattgggaagataggggtgtgtagagaagaaaggaggacctcttggagcttgcccctcattaccagaggaagcagctcagatctacactgggtggagtccactgtgaaagggacccggctgtgactccagcagaccgaccatcagtgcctaccagtattcacttaagtactgtggtttcatgtccacatgccagactgagagtgagaagagaccttcaggaccacctatttgtatagagacagggaagtagaggctcagagaaaagggaaggcagaggattcacaatggtgtgtggctgagcccaggcccctgcctgctcccctagccagggttcaggctcctgtggacactgacttctcctccataccccacacccttgtagttacaggggactgataatcaaggcctcccgccagcacccttccccatcctgtctttagctgactgggtcccaggcacccagagcctgctcacccacagtgcagggagcacaccggtgctgtcgcggcgccctgtggagaggtgggcaggagacatgaggctgctggtgtgctcatccttggcgggcaggtatcccagggcagaggtgagaattcagaaagcacttcggagtgcctgtcatgcaggtttggggggtatgttgttaggtgggcgggagcatggaaggaggtgtatgggtgtgtgtcagtggggtaaagaccctggagggggcagagcatgccacatgggaattaatgccattcacacaccctgcggaaatgacttttcaaatgcatataatctcaagcatgcaaatgagaggcttgcttcaccctgtttaatatgaatgatcggcccctgaatagctattattatacaccacattgcagcaattatgttgttcactgggtgttactctgtatgccccccccataaaaagaaaagaaaggagcacctctgtctgcatcctcctccttccttctttctctttttccaaacttactgtctgatctgcaactttatgatactccttgagtgttggaagggggccactctccctaaccccagggaagtaactgccagattctctttcctttctcctttgcatgcatacacccctgaggctctggtctttgtcccttggggcccaggagttctcagatctcagagaagctagacttggaatcagagcaggcagctgctttccaccaccagcagagccagggttgggggagaggcccccctccctcctgtctccccatccccctcatgtaactgaggcccaggcccaagtgggggaaggtgctgctggctgggtggtttcaggggagggtgatggagccctgtgctgtggcaagtggaggatggtgcccaccccatccatcatttcaccgccactagccctcaggctgacatggccattaaggcctgagaccgagtgctcaatctcttccgaaccatcactcccatcctgcccttactccagcccagctcctctcagaacttaggagtggagcagtggctgggttgggggaagagcaagcccttgggaacatacagagaaattcacaaatacagggcacccaggaggccactcagacttactgggacagtgacacccagagtcacagatgaagaggggccacaggaacagggatgtggcttctgtggaccccttgctgttctctatctcctcccgactctgcttccagccaggatgaaagctgagcaaatggcttggtagagtgagggagaagagttcttctggagtgaaaggagagaatttgggagtgggagggaaatgctttggggagctgctgccttggggaaggaactagagaaatcacagtccagtctctttccgcagtttctcattgttacctacaaggccctcatctgtcagtcgggtcagggagaccgtgtggttatagggtgtgcctaggccaaaagagatcgaattgggaggaaagaaactggctggcttccacgggccttgctaaatgctcatgtggcttctatccctcgatgatctctgtgcaatctgggccaagtccttgacctctttgggtctcaatgtcctcacccttacaattatggtgggtggagaaggcgctgatcaatattgggggcttgctctgtcaggtgccatgtgcatgtttattttctcctcaaaagacttggaggctgggatgaaatatacttggctctctttatccgcaggttccacatccgtggattcaatccaccacagatggaaaatactgtacagtatttgcagtgtgcaggacccacagatagggagggccaacttttgtatccataggtcctgcaggacaaactgggaggcttgagcatctggaaattatggtatccacagggatcctggaaccaatcccccataggtgccaagaaacattgtcctaccacagacaaggaatctgagggttggggagtttaagatggatcaaaaatcagtagtggatgccaaccatggtctgacctgtttgactgaaatccatgttcctctcaagggactgtgactcgggggtagttggggagcccccagaattttagaacagcttttcatactaaagatattggaaccttgtcaggtgcagtggttcatgcctataatcccagcactttcggaggccgaggcaagtggatcagttgaggccaggagttcgagaccagcctggctaacatctctactaatggtgttgcgtgcctgtagtaccagctacttgggaggctgagacaggataattgcttgaacccgggagacggaggttgcagggagccgagattgtgccactgcactctggcctgggtgacagagcgagactctgtctcaaaaagataaaatgaataaattaattaaattaaattttaaaagctattggaacctctatgagttataagaagaagcttaggcctccacctcctccttactgtcctgaccatcccaaacacataccctctctttctagggggatgtttcagccactccttgagaggcatttctggggtcaggggatccagaccttgactctttgccttgggtatgtaacctaactctctggaccttcggtttttccatctgtaaaattggcgtgataactctctcccacagttctcatgaggagaaatcatggttcctatggagagtgagttaaccttactgagtgtctacttttgaccaggtgctaggctgagggctttaaaatggaagatggaaggtggaaccagggcttccttcactgcacacctccatgacgaagcccagtgtctggctcccagtaggtgctgggcaagtggcagccttttttatggaagaataattgttgctttggaccttctgtggcctggggaaggtcatttgccctgggatgggagcaaacacaaagtccatttcaggtgggggtaggaaggcaataatatgataggttcctagtgaataacttttgtctttgctttgttggtgtaggtttaagacccagacgggggctaggcactgtggctcatgcctataatcgcagcattttgggaggctgaggcaggcagatcacctgaggtcaggagttcgagaccagcctggccgacatggtgaaaccccttctctactaaaaatacacacacaaaaatttagctggtcgtggtggcaggcacctgtaatcctagctactcaggaggctgaggtagaagaatcgctcaaactcgggaggcggaggctgcagtgagccgagatcgcaccactgcactctagcctgggcaatagagcgagactgtgtctcaaaaacaaacaaacaaacaaacaaaaaacctaaaatagcccttcttcatgtcattattataaacagtgcaaaacctcaactggggcaaaaaatcctcacccagaggggcagtgcaagggctttgtctcctcccttccccaccccagcacgaggtctcctagaagtcaagaaaacatggttgggggtgtggagccacccctcacctggggggacatcgggaggagccacattccatcaggcatcccaggagcagcctctgggaagttgaggagaagtagatgcccagctactcctgtggcgatggttatgtttttgggggtcagcagtcactgccctttcagccttcagcctcagcctctcccctgtgtctctcttcctcctccaggtaccgctagagcgacatgatggtggaatctgcctcggagacaatcaggtcggctccatctggtcagaatggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggtaggaactggtgcgccttggggtatctgggagcgggagaggggcactaggctgcattccacttcatcctggctgctggagcaccactccctgccaggcagcctcactttaccattcttaagacagtccagcctccaaggactccctgtccacccacccattctggtggccaccttgagcctaggctaccacagcattttcaagagatagaagtgggactcggaggtctgagatcatgaagcttgaaactgtcccagaaatgccaataagaagagacagacacacaactgggcagcaggcttgagattggcatgttggattggtgggcactccactcttcacctgcacactggctaggaaactggctaaatgaacagggttaagagggtgctgtgcacacagggggatcttcacattatttctgttgcaaaacattatctgcctccgagtcagcttgggcctccatttccagcagtgaagagaggcccaggcagctgggtaaaggccaagagaggtaagcaaagacaggcctccatttttagggctcaaactgggaatccctgtctgtgtcttatatttcctcttccaccctaaagtgcagagttcgggagtttaagaccaacctctctgaggatctagaggcactaggatgggtctagatctggttgggtgatgacagagcaggggtctcatgtcctggtcccacctggggaaaaagggagagtcatgctcaacaagttgaggagaaccttcccagccaacagccctggccttgggattctctttctctgatttgactctgctcctggaatcactgctggtggtgccggcccttgagtggggcagggggcggggtatgctaggaacatggagaagcagggctctgtgtgtacctccctgctcagtagcccactcctgcctcatgcgtgcacacgtgtgtgtaccacagtaccctcatgtgctcctccatggccctgctgtctctcccaagttcaccctgggactctgcactccttctcccacagcccaacttcataacccttaaggggccttttcccatcatattccttggagccagaagtcagactggaagcaacaccatcagaagcctgactcccctgcacagagctggtcagccagcgctaaagcaggaatggaagaaacctggtttaagtcccagccagcccattaaccagtggcatgaccttgaccaagtcatgagcctgcctgagccctggcctccttggcacctaaagtacagagttgttaggatcaggtgcaatttgggtgtgcaacacatgcagctcatttgttgatgtggatgtgagtggaacagaggacttcaaaaatcactttctcttgccagcagtggagactggagcagggaagggcctgactcccttccctagggagatattcttcaggagtttgctggcatctcccaagccttcctaagcacgttctctggggaagagacccacagagtctgtgccatttgctggggacagaaggttaaagggcaatatcctaacctttaccaacataatagcaaaacacaccccaccagaaatctccaaggccacccattttatatggccagctcttccatctctgtgactgtgcagacagagttatgaagaattttaaatgtaggggttggggagtactgaaactggaaagtttcttttaaaaaatttctgaaaatgaagaacggacacagttctctggataactggggaaatgtttagggtggggaaagacagaactgtctgtactgatcaggtttcttggttctgcgttgcacatgagccatgttttcccatctatattccacattccagttattcctgtttgttttggggaatatcccacagtcctggaaaatcctatatctgtttcacaaataaactggggtggggagttggaggcaggcagagggctgttttatccatttgggctcactatgggcagagtgcccagggccaaggaacatatttgagacttaaaaaaggttttgttggctccaaactatgaaaagaaccttgcaaaattaaaattacaagatttccaattaaaatgaaatagtccatgggctattcctctgccctgaatgtgtgaacgaggcttttgggggagcttcaagggtaacattttctggtccccaacaacaaatgttcctacttgtaggataaacaagtatgggaaagagagcctggccctttgggttcctgctccttctcaacctcaacctgaaaggacttagaggacaaaccaatgcctttcgtctctggtgctttggggtcttcacatatgctgtgttgttatctcaccatccctgcaaggtggatattattattccagtttcacagatgagacagccagaggtaggcactgagttgtcaagatggcacaataaaggctgcgtagacctcactctcccagttcctagttcagggctcagcacacctgcccctttgctgcttctccatcacacagtcgctgtgggaaatggaggcagcgaggcctcgagcatagtggatgctaaggaaatgtctgttgatgagtaaattagagcatttcatttccaacctgaaagggttctgtgatagaaaagcaacgctgcccgctggccctaagtagccactctagtgccatctgcaaactcgataggaagtggggtaggagagggtctgtggaccacacgctggtcccattctcctcgtactctctgtggctctccaagctcctctgcctttgtctgtctgttggtccttgtccctctgctctcagtaaacaagccctggaaatgcaatcctggcctttgggagtaatgagttgacagagaggagagagataaacagggcgagtcagaagtcaggcctgttacaggactttaggctgaaacaaacagtgctgaagagggtggccacgtcactttggaacaagagcaggcacttgtttccatgcaacgagcaggctgggagcttgtttaaacagaggctggggggtgacctggcttggctgccaggccaggtctgactagagggagagggtccttggctggctgccccatttcagccctcaaggcccagcttccacctccttcatcccagcctggtcattggtgagtgacagagccatatcacctccacgctgtctttggggctttcaccaagtctgcagtcttatgccctatggggaatctgtctaccctgaggagaaggtgcaggaagtacagtaggctctggagcagtcagtcaagctgcaaacacaccttcagtcttactttgcactgggctccgtgccggccagctggcattggtgatccccagctgctgttaaagaataccctagaccatagacacacccgtggcccatccgtcccctccctcgccaaggcaaatgcttctaccacagtgcccctccctgcattttaccctatgggatggctcttttcttcgaaagttgcccttgtgttttattctaatctgatttcacttgtatgaaaatgttcccagtgtggggattttctcagggaccccacaaatacccttaggactctctctgataggggccatgaagcctaggagaagtgtgtgccagattttgggaggggaggtcttgggggctggtctgggtgcgctggccaagttggggccaggagggccgagctggtggggtggaggcaggcagagccgctggcggcggtgctgaggccacgctgaaaggcgtcctgggcctctggagtgcgcactcccattgtccatgggttgcgggggtgacaggtcagcgagggtcacgggagggttgcctagcgtctgggaactcccactgcagttgccgtggcaactgggccaaatcccatcccgttcacatcctgtgaggagattcaaaagggttggggggctttgcacattaatgggcttttacctcacccccccttcaaagagatggggggaatgtcaggcagttgggggaggggagaagaagaatgggagagatttttctttccttttcctcccccatctgggcctcctctgcccaagctacttagagggatgacagcaggggaaggggaggattcagagggtgaatttgccccccaccaccccctgacacacacacacacacacacacacacacacacacacacgcagtcaacagttgtctttggtctgcaggtccagggcccatttctcttcaggactgctggctgtgtgccccagattctactgtttcctgtctgatcccacaccttctgcattctcctttttcttctggagaatgagcccctcccgtggaggagccatggcatggagggagagttggggcccgcactctccagaggggaggcttacggacatcacaccagttcataccagctgctggggaatgctcagaaactgccctttcctccttggcctgacacagtgagagaaggacaggtgggaggtgggaggagctggggagtgctgtggctgggagagggccttaaccatcccccttgttgtacccctcccaggtccctgagagccaaagaccgccctgtttcctatgttggaaaattcccctaggagggcagagggcggggctggggcctggaggagggatctgcagacccctgctttcttgggactaaaaggagccagcccactctaccagcaggagagcccccagcttccctcctaatatggaattctgaaatccctcttcttccctccctcacctccccttcatggcagaattcttttccctgctgattagaactggggatacagaggagaatttggggaagggagatgaatgttccttctgagaaaggatttatcttgaggattgaagtggggaaggctgcatcctagggtcacctcatcagggcagaacttggcctggaaccctcagtgggagagctggcttttcccctgggggagcacctttattctgagaaggcccagtaggaatcttcaggacgagaactgcatcccccaccaccactgcccccactccaaccctacattgcagaggtggctagagtgaagcggctcagaacccaaaccccagcacagacccacttccagagaactccacagatactggtgggagggatgtatgtctggtagccacctccaaatgccaccaagaatgaggaaagtgatcacgggaacttttgcatcactgccactcggtcacccaccaccaccttggtgatttcacctccttgctggaggtcagagagttccttccaggcactgaggactctccccctcatgacaccctgcagagctggttttggctgcaggagctggatgagccctgggctgcatcattgctagaagcaggcagaggccgggcactgctggtgcgaagcctgcctgagtttgagagcagtggttcagggaatggagagaatgaaggagccttttgaaggatcgcagttcctcatccacgctgttgagttcagctgtaaattctcatctctctgaggccagaaactagttccttatagagaggaggcattttcaaggcacttggtagggaaggcgtcctgaaatcggggctgtacacccaggatgtgagtcgtctcccacccacgtgggcctgtctgtgtctgtgcgttgctggttttcattttaatggttctaatttgagaatgcgccgatgtcatttttacgaggttggtgtaaaaaaatttacagccttttccaaaaagcttttttttcccaagggaaaaaagtgcggaataacttcaggggttttatggtctcctctccccaccttccttgtcccccctctctgtgtaatttcatttttatgtctctttgctggaggacaaagcctggctggtcaagaactttcctccccccaggtcagttccctcagtggtcaggaccactaatctctaactcctccttcttgtacccctttcttccaccctctggtccctgaggagttgcattttgaggggtagatgaagcgatattccttctttactttgaaccagtgagtgcttattaggcatccattgtttaccagcagtaagtatctaccccgaaagactgtatcacttcctactcaaaatccttcagcgatttttcaagtgtataatgaaataaaaaatcattgtccctgtgtaatctggcacctgcacacctctgggacttcttctcaggccactcttctcttggccacactggcttttcaattcataatgcacccagcttttcccacggcagggcctcgcaccatgtgttccctccacctcagatactctcccttggaagagttgcctcctcctgatgttgtgtctcctcagagaggccttccctggccacacaccctagagccagccagccagccagcctccatgggacactcgccaccagctcagagtttgcatgtctctttgtgtagtgtctgtctcggcccattagaacgtgagccccgttaaagatgctgagtccccagtactgaggacactgtgagtgccctgtggggcttaataaccactcattaaattgttaaattaatagtcatgctgtggttctggaggtaaaggtaataggctttcctggggatgcttttctggctcagaatggggcgaggtgggccagcaccctcaaatacccttctagtcccttcttttcctaaatccagccagttcccagtgaaaattaattatggagacaatttagataagattgaatcccagttttgccaaaaccagccagaggcagacaaaggaagtttggagtttgtttgttttggctgcccctcaccacaatccaaattaaaccagaatttgctagtacctcctccatcctgcccagccagcgcttggtttctcttccctgtgcagagcccagtttcaggtctggtacattcaggttctgcttttgccactgtgtcccgttgggcaaatcattgcccatctctggatctctgtttctccatctatcagtgaactagaaaatacctattttttgacccactaaattgatattatgacccactactgggccatgagcagcaatttgaaaaatactggactagataccctctaacacttgcagctctccaggggttgtggcccaagctcttcgacttctcattctcaacagcctttcaagcttgtctccctgattatcacgtccctgccctcctgcacacacagagaataaggctggcaccccaacacagatctgggatcctccagcctgctgaaaggactggtaaatagccccgcacctggcttcctgagagagaatgacccctctcccaccccccactccaccaaccccgaattcccagaaccagaaatgggagtgtggtcctatcctggaggggagagagagaccccatagcaccgagacttgtttttctattcatagcagctccctgttgccctcaaagctacagcttcattctccaccatcccaaccgccctccctggatgccatccgttataagccatttgttcctaattgcggagatcctgctaatgacttctgaatgggggatggggggaggagagttcagcttcattagcgagactgagttcttaagcttgagggggaatgggggctgggctggaagagggtttggttagcaaggccttctgggtggcaccaggcaagtgaccaggagctgctggtgaaagatcaatcatcataatagcgttcgtccaggacctactgggtgcctggcagtgtgctaagtactccatgtgcacagtcccacatgctgttcccaggaaccccatgaagaaagtatggggttgttccagttttgcagaggaagaaacggaggctcaaagagatggtgacttgcccaaggttacccagcatacggtggagccagaacttggatccagatctctcttgacgtccatgcatgaatggacagtacacctcccttagaggaaaactggacatcatccccaaaccacagagctggacatttggttttcagtccaaggggtagaaggaggaaaaaaatgaggttcaagaggccaaatggctcccagttttccactctgcctaagccccctcttcctcctcccctaggttttccataatggcttcttcctggtgtgggtatctgaacacctttctcacccagggctgtgtttgggtatctcttgcccttagggaagggaaactgagcccagttttcccctggagtttcctttcttggtcttcttcctccacctccaccatcttcacttccccttctcactggagggctgaacacatgcagattagggggaaggcagatttgaaggcctcgctggactgtgcatgggatcatggagacccctcagtggagtaagccctgagcagtcagaggtgtttggactctgccacttcctagctgtggaacttcaggcctcagtttccttgtctgtaaaatagggatatcaatacctgctccacctagctcaatgttgtgaagcttcaattaaatgtttgaaaaagtgctttgaaaactgcaaggcaaatgttagctgttaagtttagtgtcagcctgtgccagcctcccgtattcagcctagactaaaatgagttttgtgagtgggtatcacatgtctgctgtgtgctggtggttggagatgggggttcacagctacagttgacaacatctgtgctttcaaggaggccccagtctggttggcatattcaaagaaagtggggctggggatctgccggagttaggacccattatttcccacgtctctctgaggtgggcagtccagtgatctccaggccgcagtgccagcaggcagtgtgaacacatctggtgcagcagcgtggtcgatgtgaccctcctcgttcaccgtgttaactcgcccttcagatggcgagactccagttagtgctgccaccacctctgggaagccttccgagacttccccaggtagaagaaagccttctctgacccctggcactcacccccacttcaggctgactagtttcttatcattcgtgttttgttttgttttgtgttttgttttgttttgttttttgagatggagtcttgctctgttgctcaggctggagtgcagtggtgccacctcggctcactgcaagctccacctcccgggttcacgccatcattctgcctcagcctctggagtagctggcactgcgggctcccaccaccacgcctggctaattttttgtatttttagtagagacggggtttcaccatgttagccaggattgtcttgatctcctgacctcatgatccgcctgccttggcttcccaaagtgctaggattacaggcatgagccactgcgcctggctatcattctttatattagaggctatcatcacagaacctgagctgtgagccctgggggggcagaggccacattctgtttctgtgtatccccagcccctagcctggtccctggcacgcagcaggtacttcatagatgtgagaagagtggtgagtgaggacccatgtatgagaaggaatggtgggaagctgagggaggggagccttggccagacctaaggtcttacctggctctcatctggcctggtcttggcaggaagaaggaaaggggttgtgggtagggggtgtagggggaggaagggcctgtcacagggagggggaggtctcaggaatgagactgcaaggccttgccatttttttcctgtaaatcatgtaatttcatgctccaggggaccacaaagtaagagagtcagtggggagtcaactcccctggccaccccccaccccaccccaggagactgagcagggctctgcccccaactgcccccaggagcccctccctgctgttccctcctgtcccccggggatctggagtgtgtcatctccccaccccaaccagtgtcccttttgggtcgcctgggctggccagcctctctgagccatcttcttcccctacccttgtgccctggcctctgacccctgtaccccctcaaccctactctacctccacctttggaggacaaagagcacttgtcagtagacctggaggagtttgtaaaagcaaggtagtagaggcaggggctccttcctaatgaccacctgactccctgcccttcctcacccgcaacccccccccccacccttcctcctctttccgcagagccttttgacttagaaaggtcagatttctgctttctgaagtgaatctggaagaggagaaacatcctgtccccctctggaagcccagggcacttctctgggtgtgacatccagggaaggaggtggggtgggggtggcctgtgaggagcacaccaatctgagctccaggtttgctgcaggacaccttcccgtcaataggccagtgcatatttagttgccctcctagggtaaactagatttaaagcctcaggaggctcggctgtttgcactgatgatgaacggacgcgaaggtggttgtgtgtatatgcttggtacacagtggtcactctctttgcttgttgagcgatgatgggtggtgcagccatatcccaccttaaaaggttttgccttgaaggtgcttgtggtggggtaggagaataggggcccatacagaaaaaacaagtgtatgtgtggacagatgtgagagagagccacaggcgggcgcatttcgtctaataagtgcgcagggcacgaggctatgttggggagaggctggaggaggtgaagtggagaattgtggagagattaatgagagccgaagggagtgaatacttcccgaatgccaactggatgccaaacattggtcctttaatccccctagtaatttggagatgggtagtttcccagttttgcagataaggagactgaagtgcagagaactggaataacttgcccaaggtcgcagctggcaggccgcacagctgggattcagacccaggactgcctaaggttggagccctgtgtcaagggcttagacacacctgcactggctcccaagggggtcttgagcaatctggaagcagataaattttgtgctgctgaaatgtggattcagaacttgccttcaaacctcccactgaagcatagtgaggacatagagggcttgactggcctcatagataatttcctgggccctcctgacccctcactcctaccagacgtctcactgcccatcagtttaccttccgggcccctcctactccttgactgtcacactgacccactggagtgattcctccagcaatctccatatgcctcccactcgtatgacccctctggctcagttcagtctaagccactgtggccaccaagcccacagcacgatggtccatgcatctctgctgatagtatacctttcagaacttaatctaattcctccagcagcatgcatgtacaatccttgaactcagaaagtcacacggtactcagaccttgtgccactgaccccagggctcttccctcatcctcccaactgtgtgctctggctccacagtgaatgctactttttagcccccagactgaccacccagtaaggcagttggccttggagccaggcttcctgggctcaaatcttggctctgatgccgcctagctgtatgatcctgggtaagttacttaacctcctggagactccgtttcctcatctgcaaaatggggcaataatccctaccttacagccttacagaggaagattaaataagctcttgcctgtacagtgcctgacccatagtagatgctcaacaaatagtactgatttactaatgccctgagtcaaccccctttattttcctctaagagtccctttttgaccatgggcccttccatttgctgtccccattgagtcctaacaaaacttcactgggtcccaggctgagtctgtagaggctctgatccctgaaccccaacagctcttctcagtgacttctactacccttaccccaagcccttatggacccatgaccctctcacccccaagaccttccaccttaccctgatctccttctccttactgccccaaacactccctaatccctggatcccacccagcctcccaggccattgctgactcagcccctgtcttgcaggctctccaagtggcccggcagttcctgctgcagcaggcctcaggcctgagctccccagggaacaatgacagcaaacagtctgcctctgctgtgcaggtgaggaagagagcaccccgctggctctgggttgggctggagtgtgggcctggcacagagggagggcaaggacccgttggagaactgctcttgccagttccaacaccaaaaagtgggcaacttttcaaaggaaatacagtcactgcaggggtggggcaaaaaggcttcccactttctctcgtctccacctgatcagccagaccttccgctagcttagcctctttgtccctgtcactcaaagtttgtctgcagctctccctgtctctttgtacctctctcactgtttgttctcccctgcctcttcccttcagggtctctcttggtcacttctcatgtttctgcgtccctgtcggtcactccctctgtccctctgtgttcctgtgtctggggctcagcccctcccaggccatctctgttgctgcagtcacgtcaccaagtccccccttctcttatcctccccccttatccctcatccaccagctctctcgcagtctctccatgcttcctgtctcttgatgtctctctgtctcttttgttttcctttgcacaatctgcccttttttccccttctcccttccctccagcttgccagcccatctggctggctgggggaggggagatctgtggggggtgggcggggggtgggggagccaggccttctgtttaccttttgtgtcacaaagaacttgggagaattgcagtctgagtccgggttgggtcactactcgggcagccactcccctccccctctgcccagcagcccgggatccatgctccccccacccctcccccagcagagggaggctcagaattggggaagggattaagccaggctttgaaaggaagtttatctaagggaagaagggtgagtatggttggttctgagctggaggtgctctggagtctggggctgggtgctgagggaagtgaagaggagggtggggtgggtgcagggtgctcagagaaggacccaggaccaggctttgtcctgggtggagattccagtgctctgacaaagtctgagttttatgtaaaacaagtttatgtttggaaaaagttcaaggtgcccaacagatgtgcagccttaacagtaaccctcttaaaattcttgaccctaaggagacaaccctcaaaggggaggagctgggcaaagatcagggcgtggcctggggtggaggaggggaagacacaatctggaaagtcaataaagagaggaagagaaagatctcatcagaatgagatctaaaaggttctcatacccatgctggtcaggattgggcctctttaaattaatgatccccacatacaatcccagggtttgaagtggtccttgggcttccactctgaatcctgcccgccctggacccagcttagaacaggaaggagtaggctggacaacagcaaacgttcccccaaaccagaaaggggctgctgacccaggggtaggagggtaggagcttgatggtagtgggagggactggggtaagacatctagaaggactgctcagctggggattaagggtcacagatctgaaataattgagagctgaagggagactatggaatcttccttaggaaactccctccctccaaaataagagaggcctagaggtttcagagtcagaaagacagataaaatgatgtttttctcaggccttctctctccttgtctcattacttccaaaaattcattgattgattcattcattcattcaacaaatacttactgagtacatcccaaactaacaactgacatatacagagtgcttaccatgaagtgtagacactaagcgctttacagctatctcatttatcctcacagtcctatgggagaggtgctattctagccccatcttgcagatgaggaaactgaggcccagagaggttaagaaagttgtccaaagttatacaacaaataaaagacagagtgaggatttgaacccaatagctccagaactcacacttttttttttttttttttgagatggagtctcttgttgcccaggctggagtgcaatgccgtgatttcagctcaccacaacctctgcctcccgggttcaagcagttttcctgcctcagtctcccaagtagctgggattacaggcatgcaccaccaagcccagctaattttgtatttttagtagggttgtatttttagtaggttttagtagcgttgtgtttttaggttttctccatgttggtcaggctggtctcaaacccccaacctcaggtgatctgcgcgcctctgcctcccaaagtgctgggattacaggcgtgagccatcgtgcccggccagtagaactcacacttttaatctctgcattgtgacgatcccttgtgcttggcacaatattggtaataatgccaatatttccctggtgtagaagcctaggccagatggttctcagggtctcagggatatgggggttcttggggccatggagccatgcttccccaggagcctggattccctacctatattgatccctctatttcttctccaaccctgaataccttccttgccttctgcccctattcctaagtttattatctccaaggaggtcagatccttgtcctgaagtagggcccagggccttgaaatgttcttctatgagctcaagattggtgaggggataggggagagcaaggactgggctccccacccgagcagaagagtgcatcttgagcctgagtgcagtggataatgaagggagatcaagcgcagctcctttcccagggctccccacagaacgctgctctgctccccagcaggattttctgcccacgcacctcccagccacgttcaccatccctctcctccagagccagcttcagaagagtttccaaaactattgtcaggtctccagctccagcctagtgaggggccctccttccaggcctggaccccaccagggagagacctatcatagaaggcagcacaggtggccgagagttgaggacatgatgggggcaaaggtggctggggccttggcttcgtccatccccatctggcattttcagaagttcttctttatatctcactgctatctttccttgctgcagctgcagcccaggattagtttgaggacttctggtcatttgcaggagagtttaagccaaaccaaactctggcctgatctccccacattgccccccactcacagggaccccatactcaagagacaatttgggttcttgaccctggcaccaaattgcattcgttcccactctcagccctcaaataagcttcctgtgtgtcaggcactgtccctgttccttccagtcagaccgtccagccgagcacgctgtattcatgggtgggtgcagggtccctgagggaggggctggaggcagctgccggcgtttggcccagggctcacactgccagggcttaagttagcacttagctgcccagctactctccagatggtgactcatgggccctgctgagcctgctagctgcagagcgcccatcctgaggcatctgagcctggcaaggggccagcgggacaccagaggagctccagctcagttctcagacccccaaggggcacaaggagaggtggatgaggtcaaccaactcaggagatcagcatgcggcagccacttcccagaccctttgtgaccccagtgggccacctcgagacgagtgcacaccatgtaatccatccagatctctgtagcagcctccataggcagctgctcagccaagtggcaggaaaagcaagtgccaaggaggccttccaaggtcatctcttccattcccctgcttccaaggaagaaaggcccgaggaaggaaaggccacatccttttttcacatgctcctgtcagtgactcacagtcctggtgcctggaaagatcttctgagtgtctggtctcagtctttcctgttgcgggccacgttcgtctctagttcagctctcacagcagtgagaatgagtggcctagtgccttggtcctcagtgacctttgtcaggcagcaccctaaggcacaccaggggaggagacagagaaggaggggaaagggaaaatccagaatgttttaaaaagtgattttcttcacgtttacatagaatttaatggcgtacaagtcactttcacccctgctcccactgtcccttccgggtcagggtcagggcaggttatttaacctctctgggcctcagttttcccatctcatctgtgagatgttaatgatgatggcaccatcctcacagggttgccgtgaagattccatgagatacacgtgtaaagggcttagccaagtgccgtgctgggcacataataagcagtcagcaacgtctgctaatgatgcagggagggcaggtgccccaaatcccagttagccgaccgggaaagtgaggcttggtgatttcaaggctagtaaatatcagggacaaaaaccaaggtcacctgacccagaaatctagggctctgagctcacctgcaccaagatgcctctctttgttgggcacccccttgggaggaggaaagaaaggacagtggtacttgttccatgtctttggatggcaaaacccaccttctttgagcagcctccccagctgcctctggaacacccaacaacagacttaggggctggctctggagttgggtctatgccgttgtctgcctccaaccccaggcccaccacatccacccctgcagcctggctttcagagagtccttctaggatacaaccgtagagtaggaagttagcctttgggatctcagcctcatcagccccctcagcctccggacgtcccacctccacattctctccctaacccttcccaagacctgccctgcggtggggcaggcagcataggatgtgaaaaccctgggagctatggagtatgcagacctcagcttacatcccaaccctgccacttaaggccaccagactttcctggtctcctcattggtaaaaatgaggttaaaaaacaacaacaacaacaaagaacaaaaaacactcctaagggcatatcccccactggcttagaggtctcttggagccttcattcacatggtatgcccatgactaaagagctaggtgttacccctcccaggcccatgtggatagagatgggctgggataggggagtaaagcccaggggcagggacagccgccagtgatggggtgagcgagaggtgttgggagccatgggattccccaatgtccttggattcactgtacctccctggttgcttctctgcctggggatttcctaatccatggcttaaggggtggttcaaggctgagtcctgcctctgccaggcattgaaaagagatccaactcctcctcccctaccccacaggtgaggctgaggcttgggagagggtcccctgaggacctagcctgtcacagcctaggacaagtccctacacagcactcctctctgactgggctagccctgtaaccttcccttcctgcttccgggctggcagaggggcctctgaggtgccagggaaggcatttcagctcaggggggctaacacttagtgtacctaccatgtgccaggcactctgccacaacttgggagtgagagaggaaattagagaagagtcctgtatgcatggggtcacagagtggagggggcggcagacagccccatcagagcacctgtcctgctaatacaggaacaagacaaaatagcagctgagacctgcctgtccatgactgcacaagcctggggggttcaggggaggtggggctgggaagagaatgatgtcattgcttttctctgaatcttttccctgtagctggattctttgggccttctatagaggcctgacccagggcagggggtagaaagctgttctactttgagaatcctgaatgttccagcctagaaggaatcatctcttacagcatagtctcttatgttttatgtttgaggaaaccgaaacataagagagggcaagtgacttgctagagtcacacagccagctcagtgcagagttaggagcggaagcctgccctgctaactccctgcctgccattcttcccaccccaccctagacatagctacacacatgcacacacattaggaccaggatggcaccaagagcgctctgtgggcttcacctctggccactgtgtgtgccgtccaggcaggtgtgccggggtgtgtgagaggagacaaagtgcaggtcctcgtgcaaggtgggccacgttttgaatccttcccatgctgtagactgccctcccagccaggcctaccttgcaggaagtggtctcaaaatagactgcgtgagactatgggtggcctggtatgctgtccctccccattactggggggaaccagccaaagcatgggttctactgaccagtgtcactacagcctaatcttcctgctctaaggacagcccgtcctatgataatagccaacccttatgtgcacttgctgtgtgccaggccttgttttaagtattcactgattagtccttatggtgaccttaataggtaggtactatcactgttttcgttttagagataaagaaaacagacaacaggaaggtaagtcactgtccaaagagagagacagccagcaggcagcagagccagaattggaacccaggcagcctccctgggagccactctgccacgctgagagtggggccctgggtggtgcctcctcctgggttggggtccaggggacagggctaacgggccgaatcctgcaggtgcctgtgtcggtggccatgatgtcgccgcagatgcttaccccgcaacagatgcagcagatcctgtcgcccccgcagctgcaggccttgctccagcagcagcaagccctcatgctccagcaggtgagtctggccccagggcagctggtccctcctcctctgcctggcctggctcctcccaccctgtttacacctcaccaagggcccaagctgtcccagaaaccagagagactgctcaggccagactgatctgcattcctctagggtagtggggagaggtcaaaggtcaggcatctcttatggtggccctgcccccacaatactccccggtcctccctccctgcatgctggccccacttctatctcctgaacagggaagggcaaagtactggaacattctggcacgttgtcccctgtgacctgctcaggagatccaccaaaagcagggagggttcagagctgtgggaatgaaactcctccatcccttgctccctccctccgcacccagaccctgctcagggcccctccaggctgactggggaaagccagaccatgttttagggaaactcccttctcctgcccccaggagcccagatgggacagggctggggttgtggggatagcagtaccctgccagtggtaaccctcctccacccccccagctacaggagtactacaagaagcagcaggagcagctccacctgcagctcctcacccagcagcaggctgggaaaccgcagcccaaagaggtaaggggctgtaccagggcccaccaccgccctcaccccctgcccagagctgggtgtccagagctggtcaggagggaattgccttgcaggaatagtagaaaaatctagaaaaggctgaggaaggggaccaaggatcagtgtgggggaaatggggatggtggttcttacgtgtctccatctcccctcatccccattcattctttctctccttgcctcgtgttgttgtctctgtgcacatgggtgtagacaggtgtgtacgtgtcacccccgtgtgtggtgtctgccgggccacgctcatgtgccttgtggtcgcaccatcttcctgcccccttgtctctttgtgacccagcacctcagccctcccctccttgtcctgcgaatctctgagtccctcagcaaaccacctccccttacctcagcctgcccccagcttcttccccttcttcttatgacttgcccagccacccctcggtctcctctcagagctccccagcctacatcccctaccccatcggagcttctataccaggccctggaggcccttctcccctgggtcccagacctgtgcatctctcctgctgcccaaccgcagccccaagctctaagtttcctcttcccagaaggctgccctgacacccaggaattctccagcacccccagtctccccctcagcagtcttgtaattgctgtgttatcagcaggtaaatctctaggctaagtttatcctgtgtctctctattgaatagccagcccccaccctaccccatgcttcccacccccagcaggcaggcagagacatctctgcctctcaacccacccaggacatgcttggctcatggggctcaagagagacttgctgacagcctgacttgtcagtgcctgtgtgaagaactgaatgggtgggggtaggtagagtgggtgagccaacgagtacagggcgcctgggcagtggtgatgtgactgttctccgagcctgggtcccagtgagtcccgtcagactccttgattctctgtatctaaaaagcaagagaggaaaagagctgggggagagaaaactccctccccagagcagaagggggcaccccgggcatgtgggaagggtgccctccaggcaggagtggcccccagaatctgacaggctcatcgatcattgtgatgaggcacccccaggcgtgcacagctgcggtgcagggagctgaagcagcggaaggagggaggcgggaggagggagggcgtcgtgctgcgtgtctgggtctggctgtgtgtgtttgcgcgcgtgcgtgcgtgcgtgcatgcgtgtgtttactgcgaggaggcatgcagccttatggaagctgggccgggagcagagacactgcagctgcagacgccacaacgacagctccaggggctgacaggccctgggagggggtggccgcggggtgggggccagatggcatgcctgaagctgatggcacccctctctgcccgccccctcgggcccctcaccaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaaggtgagcacccgccactcctcccctcccagccccaaccccacagccctgcctgtacgcaacagctggcagcccctgttcttggggccaggtagaaagccgagtgttcgtggggccctgccagcctcccctgtctctcccacagcagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacaggtacaggggtccaggctgggaggggcatcaaaggcctgcctgggggtagacctggccccccacccatgagggctgactgtgagggagggggtggagcccacggaccggaggttcactccctctccactccctctcccggggtgtacagatggtgcttggccgctgggaaacctgtattggggcagaaatgtcaccagcaggggagctggtgctcagctgactacagggccgctggggtcttcagggtccctgatcggccacctccctgctgtcctcccagctcttcccacgaggagacccccggctcccaccccctgtacggacacggagagtgcaagtggccaggctgtgagaccctgtgtgaagacctgggccagtttatcaagtaggtgtcacccccagcccctcccccagcagcctttccccacagggcctctcccccaaccctgcccactagcttgccccttctgggagccctcctcactagctgtactactgtcctcactccagagggttctagttctttctctgccccccacggactccctgatcacccactccctaccctgtctatatttctgggcctgcattcccctgactccatccccagcgcagggtgcgggtaggagaaggagaggacaaacataagcattactcctccccccaccctcccctgctcccctccagcctcagccccggggagtgatggcgagtgacaggctgagggccgcagacaggcagggcgggaggtggacgggcggctggcagcaggcggccagctgccacagccgtgccaggctctgtcactgactgattaactccgctgtctcccagacccttgcagcatcagggtcaaacaaattgttttcacgcttcgtcagaggtttacttaattagttcatttgcaattagatctctctgtagctgggattttagcaaagacatcaaaggaggctgacgagaagggagaagccttcctccattgccccgtttttccacctctttctcttctttgtatctcttggtctgtctgcttttcaggccatgggtgggattagaggataggatgggaggatggtggcagcagggaaaccggagccaactttctctcctcctctcttccccttgaagacacctcaacacagagcacgccctggatgaccggagtacagcccagtgccgggtacagatgcaggtggtgcagcagctggagatccaggtgtggcccggaagatgctggggagggacatggtgggctccagcccctgcccacccacagcactgacttgctaggtgggctctgttgggagggtctcatggaagggtcctatggtcaaagccaccatcttatgctttctaggtcctaatgaccatggttgtgaggtgaggacagctggattctgaggggtaaaccaaggttgggggcgtctctgctgggaggtccagaagagactcacgctacatagaaacatcaaaaataattattagcagctaacatatggagcacttactttgtgctgtgctaaatactttatatagctcaaggaatcctctcaacaaccttatgtggtgggtaccattattctccccattttccagatggagaaaacaggcacacagagctaaagtaacttgcctgtgagtggcagagctgggattagaacccaggcagcctggctttcccaagggagtatcccagctacttgagaggggacactcagcagcacagggttcccaggaagcaactcagggcagctcctctgtgcttacccatctccctccagcacctagcagagcatcctgctgtgagagggtggtcatgagagacccattgagtttatgaatggggtgtctgagccattcatcagttcctgcatctgcattcagtatgcaaggccctcacacacaagtgccactgcacaaggcacagtggccgcccccccgtgggtgggtaggaagaagcctcccaacatgtagaggcagggataagctccagccaggacgcactgggagggctcaaatggtcaccatccaggggagaaagggagaggcttcatggagctggcagcccttgaggggtagagcattgctgaggcctccctggagcgggtcacagagggagcatggatgctgaggcaaggaggcgaatgggggtgggaatcggcggccttctgaagagcctggcggtggaggggtgggacaacactgcctccagggttcagcctcccgctcacctcctgctttgccaccctccacagctcgccaaggagagcgagcggctgcaggccatgatggcccacctgcacatgcggccctcggagcccaagcccttcagccagccagtgagtgctgctcccctccccgcccctcccagagccttccacagaccctggagcctcgggacccccaccctcgggcactggtctcagtaccctccccgttgctcacagctgaacccggtccccggctcctcctcattctccaaggtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcaggtgagggtgggctgggggctgcagggcgacagcagcgtgaggctgtttttcccatctgagccccatatctggctacctcatcctctgcctgtctccccagagctggcccagaatcatgagttctacaagaacgccgacgtccggccccccttcacctacgcctccctcatccgccaggtgagcagggcaggtaggaggagggtggggaatggcacacaggctgctcccccagcccccgccacacccctgcctccaggaaggtcctggggccaagcaatggagctgtcccgctccctctcacgtggcggtcttccctctctgctgtgcggggctctcctgcaggctgggccctgtcagcctgctgcatagggttatgtgtctctgggggtgcacacactgttcttcttactgacacccaccgtggcattcatgtgctcatttccacgtacacagcccgccatgatagactcagggtcactcttcgtctctctcctttgtctttcctccctcaagcccatgatcttcatgtcaccaatgttcacatagtattcacactcaagcatgaacttacatcgacacatatgtcctccctgatacccacacaggcatgtacaccttcacacacattctttctgtcacacacacactgtgcttagggtaccttttgccaaaatcaggataaattccaaacagcctccaccccgtggacatctctcccaagaaagacaggactgactgctttcaccctcggtgcagggccaggtactaaaggcattttctctccagaagcagctccaatccttcttgtacaaatacatagcccttggaggctcctgccctctttatccttggccaagctataaccagcctgtccctctgaggggacccaccagccaccacccatcttgttatccacacatttctgagcaggtcttctcacaaagtgaactcggggctaggcagaagggagaggtactgggggagggaacccagggctgtgacccttcgaggcccaggctgacggtccctttgcttgttccttccccgcaggccatcctggaaacccctgacaggcagctgaccctgaatgagatctataactggttcaccaggatgttcgcctatttccgcagaaacactgccacctggaaggtgaagcaggccccttccaccttctgggccccagtcacccttggacctgccatatcccatggagaccaaggctgcctaacaattagttccctaaaccattagtcctgcagaaacagccacccaagggcccagccagggctgcatgcccacgcccacctcagcaggggctgtggattgttccataaccttttaatgatcccttccttccagcctggtgctgcctcctttctgggaagcaatccttctctagggtacacccccaagggccccaaagacgccagccccacgaggtagggcctctaggaattgctaatgcccaagcttgatacagaagcctgggccgaatttcacagagaccctaagggtctggataccttggcttaaggtacatgttctgaagcctgaggtggggctaggaaagcgcaggtatagacacacggatggaccaagagccgtggaccacacattggggcactgacggcactcacagccctccccagctctgccatccctggcaggaagataattgtctccatccaattagtcatttcaacaccttcagccataagttttcctgggagagcagaagcaggcaagagggggactctagaaaaatgggagacagatgctggggtactaggccatttatttttctatagccaaaaggggggtgtgtgtgtgtgtctgtctgtctgtctcaaggtgggaaggtgatatctaaattgggagagtgggcggggcggggggaagaaggagagagtgttcgcccctgcagggaaggttagacgcggggaaggactccctctcagaaccttaattggatccctggctcttgagtccccctgctggccactgaagaaactgcagttaaacgggctacctcccccaatcccactaggtttcaacaagtgttactgaacccctcctccccaccagcgcccaggacttggtggggtctgcacagtgcctgcctaccctttgccctgggattatgctaagtgcagcagaagggactgcatcatgactttcatatgctcatacccaattcccaaagcttgggagagaagctgggaggctgttgggacagctgctgtaattggctgtgagtgatgtcattttctgccaaccacattcctgccctctttctgagccagcagggcttgcttgggaccacctggtccagtctccaacctccaagtcagttcagataccaggtttttataaatgatagagtcctacaaacataagggatgattataattattacctaatgtttaataaagcatattaatcttttgcctttaggggtagtaatatagagcctcctttccataagacagcctcctttttgggggcaaagtactgctaagccacctaccttccttccttccttctgtcttacctgtaatgccctgctgcaattttctaattctctcttctcttgaggtcaggttaggtgacctggtttaggtgacttccttaaactactcagtgaccatcctgaagccacccccctgatattctaaccctgccgcccttgcccagcccagcctttcacatctctgtggtgtgttcctcctagttcttcacccccatctcccctcacctagtctagggtccagtaagaagcatctgggctggggaaagtgaacgactaagtgggtgactttgccagttagcagtgttctgctgctgcctctgtgcctgaggccactgcctgagccttcctcatggcacagcagaatccatccagcttgaggtccactttgaccttctggtttttttcagccaaatgcattcatgttacttgggaaatacaccatctacacccaactctgcttcccttccacctctactttccactcatttctcagcccctcaggtcatctctgctcctctcccgaattatttgtgctttcttctttcccttcttcacctttgctggctcccaccctgagatactttccacctcagaccagggcagaagggttgggagcgggcatggtgtgggcccagccagctgccgttcatccagggacagagctgccatctgccaagctgatggtccttgctggccctccccgtgtccatcccctcccaaggcccgtgttgtgggcccgtccttttgtttacgaagcccctgccagaccccttaaattgccgttaatgtttcagcgtaacgaattagtctctcatcacgaatcaggcttcgaaatgagggaaaaaagccccggtgaggccatcctcggaaattggggtcattctcatttgcaaagcggaggatcggagccccgtaatgcgggcaaatttattccgaggcaggagccccggcgtgattaggccctttgtaattatcgctccaagagattccactccagccgcccgcctccctcgtggattagcaagcgagtcggaaaaatacacaggatttaattagaggcaaattaaaattggtaatgaaatcgggccagttgcaagtggcaagagttggaagggagagagggagagggatctccaggggcacgggctgcctgccctacccgctttcttccccgtttagaaatgtaaagaggagacaaggatggggacgaggcgggggaggctaagggaggacaggtaacagggtccagggatgcaggcagggatggtgataactgggagctggccgtgggggcagcacagctgagagaggagggtgcagggacaggactgagggacacgatgaggtggggcagactagggccctagtccgggctcccatggtggtgaggggggaattgggccaagcaccccgccctcgcccaagcgtcctacaaaccagatgacctcaattcttgaagttatcctgccaggaggaggtgggacagacaaggtgacttatcttctttctctcctctttctgcctctgggttgtcaacccacactctcctctctccctgtttatttcaacaagtatgtatgaggcctttactgtataccttgtgctctcaaaatataagctgcctgttctgagccacagccaaagcatggctcccagactcctgtgggtcagtggaggtggcagtgagggtttatgagctctttcccaaacttttaaaagctttgtggaaattctgcatgcagctgagatgaagcatcctgggctcgcagagatgccggggcccgaatgtgatctgctgctgatccaaagccctgagtaacaattacatgtgtctttgattaacgaagatgatgaaacagattattactaactggatagcatttagttagtagacagaactttccaagatgtggcagggagagaggaggcagctaataaaatgggtcatccatggtgaagaggctgggaacccctggctctatggaaagggtaggggcccgccttccctttggctgggtctcctcccagcccacccccctcccctgctcatccctgagctggggaaggtgggccgctgctgcgtgggacatgggatgggatgaggactatcatgtttgtgcttggccaagcaagccgcctctgagctcctcttcactgcacccacagaacgccgtgcgccacaacctcagcctgcacaagtgcttcgtccgcgtggagaacgtcaagggtgccgtgtggactgtggacgagcgggagtatcagaagcggagaccgccaaagatgacagggtatgtgggtccagagctggatgggctgtacctgcccagggggcaggagccaactcacccccaccccctacctctccagggtacacatgtgcaccagatccttcctggctgggggaaggggtgtggggagaaaggagcagaggagactagtgcttggggacagggggctggaatccggaagtgatggataatcagaaggcagacatttatgtcctcttctgtcctcactctgactgagggaaggggccaagaaggaggcctggtagcaaagagagacaggggccccaagtagccctggccagagctggcacacaggcagatgccagccaacgggccatgggtgaggggctgccacccccagggcacccgctctctcagctcatcaggatgactagacctctgaggtcccgcgaccccaccaattcatcttacggcagaggagagccagtgagggccaggggctggcaggaggccccagagcagatttgtggcagagctggttccaggaccaggtctctgccctcctggtcttttgtgctcagcttcacttcaccacctggcattttatttatttacttatttatttattatttttttaattttattattttattcatttattttttttgagaaggagttttgttcttgttgcccaggctagagtgcaatggcacgatctcagctcactggaacctccacttcccgggttcaagcaattctcctgccccagcctttcgggtagctagaattacaggtgcccacgaccacgcccggctaattttttttgtatttagtagaaatgtggtttcaccacgttggtcaggctggtctcgaattcccaacttcaggtgatccacctgccttggcctcccaaagtgctaggattataggcgtgcaccagcgcacctggcctattatttttttgagacagagtcttgctctgttgcccaggctggagtgcagtggcacgattttggctcactgcaacctccaccttgtgggttcaagcgattctcctgccttagcctcccgagaagctgaaattacaggcgcccaccaccacacccagctaattattttacttttggtagagacggggtttcaccctgttgaccaggctgatctcgaactcctgacctcaggtgatctgcccgcatcggcctcccaaaatgctgggattacaggcgtgagctaccgcacctagcctccacctggcagtttaaacagaaactgaggagcctgggacagggtcaggacctccctttggcttccacgtagcagcagtggccttctcccgacctcaaacagccccaccccagccacctgcttgctgtgccccttgggccagagcccctgggtaaggagaggagagcaagttagatggatgtctctgaggtgtggggtgtctgctcccctcaaagatgcctgcttaccaggcaggagcctttgcaccccaggcagtgtgcagcctggagaatggagggaagccatcccctggtgaatgcctaggggccagtctccaggcctggctgcgcttgcacctctgcttctcaccagtttggtgacctttggctgtttccttaagctctgtgagagctctgtgatggtgtcatcactggaagagggacagcccccagccactgcttttcctgtcccaactcccgaacaccttcccgtgcagagaagccttctgtatggaggcttccatacagaagcctccatgtgggacaggctgagcatatgtctgacatgtcccaaaatctaggatggcaagacagtgtgggcagaccaggtgtgtaactactgagactatagattagaccttgccaaacattggaaaatctagaccggagagaaaacgggtgggggggcagcatgctgtgaaggcagacactggggggatgccagttcccacttcccagctccgagacctggacaggtccctgaaccaagcccatcgcacccacctgtgaaggggctgctcctgcagggccagttgagcgtgaagaccgaatcagaccaagtacacacacagctccaagacagcggctgatccgccctggcctcccggaatagggaatgggacccattcccagcacaggccgttacttagtgagagtaaagagatgcgaatgaagagctaagtgaatgagtgagccaaagatggccttctctgtcctccaggagccccaccctggtgaagaacatgatctctggcctcagctatggagcacttaatgccagctaccaggtgacctgcccagagcccacccactcacctctacctcccgcccccttgctttctcatacaagagacccccatcctcccctgcagaggactcaccagaggagggaaggagggtgaagacccaaactctccgagaccccacctctctgccccaccccaactcggggccagcctccacctctgctttcaaggctgggttcagacaaggcaggcagctgggaggatggcatacctatagcatcccctttcctggtttgtcagtctgggggttctctgttccctgggagaggggataagccaggcccaggttccaggaaagctaggaggtaggaggtcggggggtcagagttccagccatgggggaggggtgctacattcaaaggctgagttggggcttgggggttgcccagacagatccgcccgtggggccagtaggcagacacacaggcagctctctagtgggcggggaaggcacagcacttgactgagtgtgccccatcctgtggagccactgacgaggcccaaccctgtgcccctgcaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacaggtgagcacacagcacggacccccacccaccccagcacccctcaaccaccagggaggaggcgtcatcccccaccctgggtggggttccccatcccacccccaccacgcctctccccaggacaagtggcttctctcttccttccctcagccctctcagccctcccttgtcccacctgcctgttcttatcccctctccccacctccccaccttcccaccttctcctccccattttccccctttcttatttttcctcctcctctcttctcttttttttttttttttttaagacggagtctcgctctgtcacccaggctggagtgtaatggcaagatcttggctcactgcaacctctgcctcctgggttcaagtgattctcctgcctcagcctcccaagtagctggaattataggtgcctgccaccatgcccagctaattattttgtatttagtagagaatggggtttcaccgtgctggccaggctggtctcgacctcctgatttcaggtgatccactggcctcgccctcccaaaatgctgggattacatgtgtgagccacctcgcctggcctctcttctatctttcttctccttcctccgttcgctcatctcccctctgctcccctcttctctcctccccaacccagagcagtctctgccccaggaccagcttttctttgaagagagccctaggggagatcagccctcaggtctgatgggatcctggggagggggctgtgggcaccccactgtgccccagagttctgggtgagtttggggggcagggggcagagggcatcagaggacagccgcctggtgcccatgccatacttttgcctcagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaaccaaaactttttgttggctttttcctttgtcgcctccccagcacctgccctcccagtctcccaccccggccccaggctggaagccctccctccacttaagttattgttttaaaccaaagtttacagtgtctgttggtggccaagaccttctctctccacccctcctccatccaccctgaggaccctggggctcagtggaggcagggccctgcccccctcccttccgctcctgcccagcctgggggaaggagaaaggaggggagaaagcgggctctcaccccctcaggagtgggcacgggagcccttctccctgaccctgggctgcttcctgggggctctccagacccctctctaggaccaagtcacccgtcgtgctgggagtgtggattctagcaaaagagctggaaaaaagtcagactctccacagaccccctatgggggacccccaactcaaggccaaggactgggcgtatcggatgctcataacacccctggcctggcccctttactgagaagactccttggatatttcccaagaaccccccacatacacccctcacaagccacccctcctgagaggcagggggccctccgccccctccccatgtattccccacctgtgttccgtttgaccagcacagaaatattaaacgtcctctattcaccgggccctgtgtgtgtcaccgaggtgcgggaggggaggagcattaaagctgaaagatcgctctgctcggggagcctgggcagagcagcagcaacgtgagggtcgctgtggtggtggtttctgtgagtggatggaatgagcagccctgcaggggcgctgggcatgtgccctcactgtggacagggcccacccacctccggttcccctgtgcctcctgtcccttccacgcttaaacagggttctctgtcattttcctgttttcttccagagtcccaatcctttgccctagttctttcactagtttgaaatccaagttcttgccagagtgttggagcaaggcagctgatttgctgcagggatggagaggaccaccgccgcagggttcttttacctgtgccaccagctctggagacatccacacccattcccaggtgtccttccaggcccattgtccacgtcttcaagggggctgcctggataggcgtgtgtgtgtgtagtgcccaggtgtggtggtggcatcctgaagcagtaggaccattagtgtgcgtgcacacccacgtggcacactgtgtggtgaccatggtcatcatagtgggctcacggcggaaacgggatcattcaacctatacaaaggggaccctggataggctgcaaggaaagaggccaagggccaagctgctaagccaaagatggcccctgacacctcccccagccccagcacaccagcctgcacctcttatcccgtgttaagtcctggttccccacctgctgcccctcctcaacacagagcccctcccgccgcctcagacccctgtgcacatccccagggcctcagccgtctcattggtctttattttttattttttttaagatggagtttcgctcttattgcccagactggagtgcagtgatgctatctcggctcactgcaacctttgcctcccaggttcaagtgattctcctgcctcagcctcccaagtagctgggattacaggcgtgcaccaccacgccgggctaaatttttttgtatttttagtagagacggggtttctctatgttggtcaggctgatctcgaactcccgacctcaggtgatccgccagcctcagcctcccaaagtgctgggattacaggcgtgagccactgcacccggctctcactggtcttacgccaccttctggacactccctccttgagggcagaaaggagtcccaggcctgtccctagggacaaggcccagggaagagtgtatttggggagcaggggaggggagggtgttgagaaagctgaactggagtcaatcacccttcccacaaatcaccaaactgctggaactctccagccaaatgctgggagaaggacctggagggtgagtctttgctgacctctctctactctcaggcatgtcttttgtccttttcgtccatctatttctgtctgtcgctcactcgccccgctttctctgtctcaccttcatccactctgcaggcctgctccaccacagccctaatcctctggacgcttgtgtagggcctggggtgaattccctgtcccccatggtacctcgagaggggctggggagctcagcttggtctcagagtctccccaccagatactgtttaaaaaagtagcactgatgtgttttgtaatctgcccctcccagccctccgtggaggctgccagggccttgtacggtaaacctagctgcatgtaatctgtggacaatggcattctctacaatgcaataaaaacaattacccatgattttgctgcggccgcttcccctttccccttcttcccctcccagctgggacctaccagaatgccccagagaatccttaggtgttggctgccagtctcccagcccccttactctgcccccttgaagaagtagtcagttctgtggaccagccccgggggcattcttcctatgccagactctggagggacaagactgcacctagctttattctcaggaccgtccttcccgcggtctaacttcagtttctcctgcttcaactagagtcctctttttattcctctcacagggatatagtgaatggtcagtgcatttgcaggtggggtgatgatctattttggacactggtacaggagagggtcttgcaatataagaaacaagagctgttatgaaccaccaccttctgggtgcattgggcttatagactcagtaatttattttcttcctgatctgacatcctacatggggcagccctcccacaattattaccttattcgaagtatgaaccaacatgtccaccccacccccaacccccatcacgctttgcctcaggaagcgctgcatgctgggtatgtagcttctctcctttctactgttaactcacagccagggagtaggctgttaactgcagctggcagcttgtcctggtcttagcattgctgagccctgttggggaagctatctttggaacctggggaaaaaaaaaagagaaatactccaagccggacgttttaggggtgggataagtagcgctctgcgctctgcatccgacagaagtcccccttccccttggcactcagcacttcgctcccccaccatgaactcgccaccttgcccaaggccttcttgccgatggtcagcagagggcgctttaaacaaagcagaccggctcctctggacaaacttgcctgtttccggggcacagaacaacttccctgagaatgccagccgccgtacagcggagggctcagtacctgtttttaatagtaataattattaacagttaatgagccctcattatgtgccaggcactatcctagaagctttatatttcatttcatccccaaaacgactctgagttaggtattattatccccattttatagatgaagagactgaggcagagtcaaagagatgagcagataaagcattaagaataaagaatctttgcagatgagcaatccgggttctgggtttaaaaaaaaaaatgaacctgtggctgacggtggggaaagagaagagggagaccctgtggtttgcccctgctttctagtgacacgatttactttggtgatcgctgcttccctccttctctggaggctccgagtggggaaatgaggctccgagcgcctcgaagctgggaattaggccctggcttctgagttccccagctgccattctactctaagcagaataaggtaaattgatcttgaaacagtcactgaaggacagagtgaggcagagaagtctgaattaccctataaaaataatcagacaggggcccttctgatgggacggtgaggcagagcagtgcagacaaagatccccctgtctgtggtggggactttaaaatgacacccctcatgcacagcacacaccttcacacacacatgcacatgctactacccgatatactgacaccagaggtcccttccatctgcagtcatctctaggtgaccagaaatggacccccagggtgggacatcccaccacacagaacccccgacacctcactggcctgcagtctgcatccgcctcaggatcaaaagtttagaaaaacagcccctcctgagaaggcagtcatggtggcagcccaggctgaaaggccctctgtcctagccaggaggggccagggacagggcgtgggggctggcaaccttcagaagactggctgaattaacagggacagtgcagtggtgggctgggtaaccaagctggcactctgggcttctggccctggccctcccacgagggcctctcctgctctgggacctggaatgcaggcctgtctatacaaggccaccatgcttgggctccaggagtgggccaggtacagggggtaagggtgggtggtcaccagagaaacacagggtgggtctctgttctctgagagctgcttctctggctgggaaacagatggagatcagccgactgtcatgtgctgtgagggagtaaacacaagggttcaaatcctggctctgctgcttgccaggtctgtggcattgggaaagccactggacctctctgggcctcagagttctcatttgtagaatggggtggagtaataatctctacatcactggcttgttgagaagattaatgatatataaaaagatgtctgggccgggtgcggtggctcacgcctgtaatcccagcactttgggaggccaaggtgggtggatcacgaggtcaggagatcaagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcaccactgcagtccgcagtccggcctgggcgacagagcgagactccgtctcaaaaaaaaaaaaaaaaaaaaaaagatgtctggtgcataatatgccctcaatacataatggctgttaataaaatggagtcctgggtgccagtcaccataggggctcagagggacctaagtgcttactggggaccagtgtatcctggaagactccctggaagagttctggagctgaggaggggaaatttgggtagaaagaggggagaagaaagaacattctaggcctgcaggggaactgagatggagcttagggaaggttaatgtggaagaaaacaaaaaattaaatggaggcagcagagacagaggccgaggcaaggaggtcaacagggtcttagaaacctggccccggggccgggcgcggtggctcacgcctgtaatcccagcactttgggaggccaaggtgggcggatcacaaggtcaggagatggagaccatcctggctaacacggtgaaaccccgtctctactaaaaatacaaaaaattagccaggcgtggtcgcgggcgcctgtagtcccagctactcaggaggctgaggcaggagaatggcgtgaacccgggaggtggagcttgcagtgagccgagattgtgccactgcagtccagcctgggcaacagagcgagactccgtctaaaaaaaaaaaaaaagaaacctggccccatccctgtcattaccaactgactggccctgggctttgggcaggtgaattggggtgtggtttcctataaagtggccctaggactccctgactactcagaaggttaaggggagaattacccgacttggtggcatgagcatgcccacacctgctaatgccagtaagtggcgatgctgctgctgctgttgatgccactggggagtttccatccacagagggactgtcttggacttaaataggtacttcacaggtgtggcaggggccagtgagtggtgctgtgaccttcagaggtgtgcagagcagagccatagagattcgacttagcaggaaagtttgcaaggcaggggatagctgaaaacacacaggtggactgggcaggacacctggggacagccaggaaggctggacagggagactgggttactgggaggtgatagtggaaaggcaggcaccagacaggggaggaccccggaggtcaagctggggaccaagctggggcttgggggagctgtgcccacaggggcatttagagcagagaagtaacaggattgacctgagattgggggaataggccaagtggaaccatatagggtgacaggagccaattaggtgactcttgggattgtccaggtgacagatgatgaaggcctaagtagggtggggggttgctttggaaaatagtgtcaggaggctttttgcaaaacaacagagtaaaagaggggctgttggctacctgagagaaaggaggtcaggaacgagctcaacggggtcttcctaaatgtctattcgcaggagagagggaaatcaagtgtggcacatttgacaatggaatattatattgcaaagagaataaataaagagctcccatcagcagggtaaatttgagcaaaaaaaaaaaaagtaagttgaagaaagatacatagagactgttctcatttgtataatgtttgaaaacatgtaataattctatatatcatgtatgggcacacatgtagcaaacatttaaataatttgtaggaatgataaataacaaattcaagatggtggctgtcactctggggagggggatgcaatggggaggagtattcaaggggcttcaagtctgttggtaatggttagtattggagctgggtggtgggaacacagaggttaaatctgttcttctctgtacctttttgtggctggaatatttcacttaaaaataaaaaaagaatgggccaggtgcagtggctcatgcctgtaatcccagcactttgggaggctgaggtgggcagatcacctgaggtcggagttcgggaccacccagactaacatggtgaaacccgtctctactaaaaatgcaaaaatttgccgggcgcacctgtaatcccagctactcgggaggttgaggtgggagaattgcttgaacccgggaggcggaggctccagtgagctgagatcgtgccactgcactccagcctgggcaagagagtgagaccctgcctttaaataaataaatatataaataaataaataaataaataaataaataaataaataaaggggggatttaataaataaatcaataaataaaagaagaatggccccaagatttggggtccgtgccacaggaataattcttatcctctcagcccctgtgggctcaagacaagcaagggaaaagataaaatgttaaaggggtttgcaggggtggcaggacatcaagtggctcccatgcccaggactggacagatggaaattggcaaagcacatctgggcccacatctggtggtggggcaggagatgtggccacaaaggaaggtggggatagtccggggatggcaaggaaggagaaccacaagagagggcagtcctgagggttcactgtgacagaggccaaagggttcccaaaattcgaggcctgggagctgcttccatggacttggcaactggaagcttctgatgccctaggacagaatagtttctaagaagagtgagggcagaatggtgggttagggcagcggtccccaacctttttggcaccagggactggtttcgtggaagacaatttttccatggaccagggtgggggtgaggggatagtttcgggatgaaactgttccacttcagatcatcagccattagattctcataaggagcacacagtctagatcccttgcatgcacaggtcacaatagacttcacactcctgtgagaatctagtgccaccgctgagctgacagaggcggagctcgggtggttatgctcccttgtcagccgctcccctcctgctgtgcggcccagttcctagcaggccacggagcaggtccacggcctgggggttggggactcctgggttagggagtctgtatgtggagggcaagtagaggcacaggtgtacgtctctctttcagtgagtttagtaagcagcaaagggagagagagaggagacccccagaggttgagaggaggtgggacatagccaaggaatgtcaagaaaatgttttattattaattttctcagcagtgatggttatatgtgcctcagtgtatttttaaggagcatggggccgggtatgatggctcatgcctgtaatcccagcactttgggaggctgaggcgggtggatcacttgaggtcaggagttcgagaccagtctggccaacatggcgaaaccctgtctctactaaaaatacaaaaaaaaaaaaaaaagcctggcatggtggtgtgcgcctctagtcccagctactcgggaggctgaggcatgagaataacttgaactcaggcagcataggttgcagacagagcgagactctgtctcaattaaaaaaaaaaaaaaagcaagggaaaaggcagaatgggctcagattatatacctctttatgagtgcatacatgagccagcccttctccagcagactcagcagttcccctggttctgatgtctccttccttgttatctccccgagaactcaggaacaggggaccccttctgggaagggcagcctagaaacagtcatgggactcacagctggcagtgggaagtcaagagcgggtgggaatcccatccccaagcagaggcctgggcttggtgacactgaaggagggtatgaggcggttcaggggctcctcaatagttaagacaaaggcggctctggcagatgggccgcagtgtggagcacctgtgtgaacaggaggcaagggaggtggcagggaacacagggctggcctgcctgttagacctgctaaggccttcaccccaggagccttctcacctccctgcacccctcctctattgcagtcgccacccccacccaaccactacaccattcacacaagtttctctcctacttcttccgtggaattccttcctcatccttctcttgcttcctgctttgcaaagactgctcagctgtcattggctgtccccgggtgccctctcccacaacccgctctggtcctcagctgtcacacctttgccacgacccacccccagcttcctgactttgcttccgcattggagaatcaccccaaactgacgtgtgtatctttccctatcccagagcgcacccagtcaatccacaaacctttattgagcatcgattctacacccagcctggggctgggtgttacaggtaatatggaaagcaatgagtaggcacaggccctaccctgaggggctaacagagcagctggaaaaagaacactgataggttgtccgggcgcagtggctcacacatgtaatcctagcacattgggaggccgaggcaggcggatcacttgaggtcaggagttcaaaaccagcctgaccaacatggccaaaccctatctctactaaaaaaaaaatatttaaaaaaattagatgtggtggcaggcacctgtaatcccagctactggggaggctgaggcaggagaatcagctggccgacagagcaagactccgtctaaaaaaatttaaaaattaaaaaaaaaaagaaagaaagaaaataacaccgatatgtaaagaagtaaaataagtcaagataaggccccatacaaaagaatatgcttgactcccttctgctgtaagcactccccatatagaaaagggtcttcttatgacactcccaaggagtttaattttacaaaagtctttcccataaaaattgttattaatatggtgacagagaaggcagctgcatagaaaagaatagaaagcaacaaattatgaagtataaccgaggttaatcattcatacattcaaaatttattgagaactttctgcatacaaggcaccaagctgagctctgaaagtacaagatgaataagacacagtctgtctcctcaaagaactccaaacagatacatatataagcagaagaatgacatatatatatatgaagcttatagatatagacagatatataagcagaagaatgacaatacaacattcagtttggggatgggaacccagaaaaggatgtgtgcaacttccctggggtaacctgggaaacttcacaccagggaagcacttgagctggatgttgagaggtgcctgagcagagaggacagcacgtgaagggcacagcgtctgaaaggagctgatctgttcagagtgcccgtgtccagcagtcatggtaggagaattaggcccagagacatagattggagtcagattatggaaaatcactggcctgactcagaactttggactttttactctagacgaaatattttgtctagtatttggccgggcacagtggctcacgcctgtaatcccaacgttttgagagaccaaggtgggcggattgcccgaggtcaagagttcaaaaccagcctggccaacgtggtgaagcccccgtctctactaaaaatgcaaaaactagccgggcgtggtggcgggtgcctgtaatcccagttacttgggaggctgaggtaggagaattgcttgaacccaggagacagaggttgcagtgagctgagatcacgccactgcactccagcctgggcgacagagcgagactctgtctcaaaataaataaataaataaataaataaataaataaataaataaaaataaaaactatatttttgagtggaggaatgatatgatcatgattttttttttataagaggcatttgtagattagatgtgagggggacaagcttgaaaatcaacaggccattcattcaggcctgggtgtgagaagctggatgggggtggtggctgtgaacagagaggaagggaaatggaagggatgccccacccacaaaggaagagaagaggtgagactggttccacaggtgggaggcaaaaaaaacaaagatatacagggaaactatggctttcagccttaggtaacggagtggcagaagccactggcggaagtcaggatatacggagcagaaactcgatttgtagtacacgatgagaggattggtctgggtcaagttgaatttgaggtgacatcagaaaacccaatgggagcagcctctaataaacatggcagattgagctcatgcactttccttcatgccgtcctggagccctactgagctacagtagagggatttttcttttaaggaatagcctcagagagacaaatagaaccagactggagacaacagcaacacattctggaacccttggagaggataggcagagacagctgagtcctaaggcagcatgagaagagctgagaggcagcccaccctgcatgtggccctccccaccaaggctcagggactgttggctggcactgggtacttctagaagtggaggtaatggccaggcacagtggctcacacctgtaatcccagcactttgggaggccaaggcaggcagatcacttaaggtcaggagttcaagaccagcctgtccaacatggtgagaccccatctctactaaaactacaaacattagttgggtgtggtggtgcacgcctgtagtcccagctacttgggaggctgaagcaagagaatcgcttgaacctgagaggcggaggttgcagtgagccaaaatcgtgccactgcactccagcctgggtgacagagcaagactctgtctcaaaaaggaaaaaaaggaaaagaagtgggagtaatggcaaatctttaaccaagtaaatgacaagtggttgccagggactggaggggagggaaggatgaatgggcagagcacagaggattataggacagggaaaataccctgggtgatactataatggtgggtacatgccattatacatttgtccacacccacagaatgtacaccaagaatgaactgctgtggactttgggtgacaacgatggtcagtgtaggtccagagattgtaacaaacgtaccactccagcggggacgttaatcatggaagaggctgtgcatgtgtggggtagggggtgtatgggaattctctgtactttccactcaattttgctgtgaagctaaaactgctctaaaaaaaaaaagccttttttttgagacagaatctcactctgtcacccaagatggagtgcagtgatgcaatcttggctcactgcaacctccgcttcctgggttcaagcgattctcctgcctcagcctcccaagtagctgggattacaggcatgcaccaccgcgcccagctgatgtttgtatttttggtagagacggggtttcaccatgttggtcaggctggtctcaaactcctgacctcaggtgatccacctgcctcggcctgccaaagtgctgggattacaggcgtgagccaccatgctctgacaagccta

SEQ ID NO: 188 - DNA, 29312 bp, Homo sapiens
gtgacccaggaagctccaagctaagaaataaacatcaaaaatggccttagaccagtgctgcttaaggggcactgagtaaaagttctcaatgtatttctgaaaagaccacctcaacccaagctctctggagatgagttcacatatacagacagaaaacacaaggaaatcatccaccatgagcaaaagacagcagagacaacaaacagcagaattagatcttgcctggagatccttaggtggataagatataataagcatgttttaacaattaaaaacacaaaagaaggaattgtaagaagcaatagatgaatggatgaatggataggtggataaatggatggatggatggatgagtggatggatggaaggatgtttggatgatgggtggatagatagatgaatgaatgagtggagggatgggaggatagatggatgataggtggatggatggatggataaatggatggatggatggatgggtgaaggttgactgtgtggatggatgagtggatgaatggatgggtggagggatggaaagatggactgatggagagatggatgggtaggcatatggatgggtaaatggtagatgaatggttggttggatgaatggttgggtagatgaatgggtgggtggatggatggatgggtagatggatgggtgagtgggtgggtgggtggatgagtgagtgactggatgggtgggcagatggatgaatggatgggtgggtgggtggatggatggatggatggatggatagataggtggatggatgggtgcatggatgggtggatggctagatgtgtgggtggttgtatggttggttggatgcatggatggatggctagatggatgagtgggtgggtggatggatggatggatggatggatggatggatggacagatggatgagtgggtggatggatgggtgggcagatggatcaatggataggtgggtggatggatggatggatggttgaatagatggatgagtggagggatggatggatgaatggatggatgtgtgggtgggtggatgggtggatggacggatgagtgagtggctggatgggtgggcagagggatgaatggatccctccattgagtgaatggatgggtgagtgagtgtgtggatggatggatggatggatggatggatggatggatgggtggatggatagatgtgtgggtggttgtatggttggttagttggggggtgggttgaagcctccctccaggctgattgaggttgccagtctccagggcctgttctgctgaggcaccaggaaggaggccctcagagccacacttagaaagtgggtggcaggagccgggccctgaagggcatgtgccactcttgctgctgggagttcacccacgctgggtgggatcattgttttggattacatacatgtagaagcgcattttgcacttttaacattaacagcaataacttggcctgtgtctttccctccctagcatgtcctgaggcgacgtgagcataacaaaggacatggaagaagattccagatgccagaaaacctctgtcagacgcccactggccccagatctcatcctgcctcatcctgagtcccaatcttccaagggtgccagcccctccgttcatctctgaaacccagcatccttttcagctgcttgaaaacattgtattttttttttttaacgatgcagtatttgtgcgttccagaaaagggcccagctctgagcccctcacccttccacactcacgaactctcagccgaggaaggcaagaagcgcagggggtggcccgcgtggcgtcggtggcctccgctcctgctcgcagcctctgtggtcagagctggatacaagattcaagacccttctcttgcttgtcacccgctccaggttggagccacagacacccaccgccaccccggctgggtctgcgtcctttcctgtgcctttccctccagaatgcggcctcagacctagaagctcaacccccctatgagggccacgtcctggggtagctcctgacctccgaccttatgtccaaatttcacacccatggtttttcatttgacccgcccccttctcgctcataatgacacccagctcctttgagaggatcagagcccattgcacaagaagagccgctgccaaccatccttgtcctccgattgcaaaatgacaccccagtaatctagaacattctcaagcccctttaactcagatgtcaagccaccgggcaaaccccgtcaatacctcccaccaaggaatgagatatgtggacctcactgctcccccaacccagcgtcaggctgggacacgccaacgctgttccgggttggaacagcagaggctcagaaactggctctgaaataggcagacctagcaagaggaagatacagggtatcgggcgtttgagtgtttcagaagtcattcgggaagataaatccagtgcgctggccgcagccacctgcattcaaagcttggaccagcgggttcttgttcgggaggcaaatttccctaggaaaaagaagacagacttttctaatgtggtccaaatgcggatcactggtcagatggactctagaagcactgagctccctgtctctggaagtatttaagaaaaggctgggccaggcacgatggctcacgcctgtaatcccagactttgggaggccgaggcaggcggatcacctgaggtgaggagtttgagaacagcctggccaacatggtgaaacctcatctctactaaaaatacaaaaattagccaggcgtggtggcaggtgcctgtaatcccagctacttgggaggctgaggcatgagaatcacttaaacctgagaggcagaggttacagtgagccaagatcgtgccactgcattccagcctgggcgacagagcaagactctgtctcaaaaaaaataaaaaataatcagggcacagtggctcatgcctgtaatcccagcactctgggaggctgaggtgggtggatcacctgaggtcaggagttcaagaccagcctggtgaacatggcgaaaccccgtctctaataaaaatacaaaaattagccgggcatggtggtgcatgcctgtaatcccagctactcgggaggctgaggcaggagaactgcttgaacccaggaggcagaggttgcagtgatccaagatcatgccactgcactccagcctgggcaacaagagcaaaactccgtctcaaaataaaaagaaaagaaaagaatggacagtgtttgcagagagttgctcacgagtttccctctaatcctaaatgtcttcatgtctatcagtctgagcagacggtgagtagggcgggcacattctccaggcccttcttcctagctctgtggttgacctctcagcaagtgctatccaggctgggccaaccagacccacaattaactgagcctcagtgaaagcgtccagtgcatcttgacctgagacagcaaggaattgcatttggggttattccaacgatgatggcagggaactggtggtatttagtgctgaggggcagtgatacagaaagatttgccctgtgggacagggtcctgcgcgagtcccatccccaaaagccagcagctcctgccatgaggaagacggggtttctgagcaggcttatgcctgcaggttcctgtggagccaccggctgtgacgggacacctctgggtctcagcattgccctggggaggctgggacatttagggacatggtagggttttaacatttgtttcccaaatgtcaaatcccgggcacaggggcaagaccctgtcccgaattcccaccccagtgaatggtgtcgctgccaaagccaacacaagatgacaaaagtggctgggtacggtggctcacgcctataatcccagcactttgggagaccgagacaggtggatcacctgaggtcaggagttcgagaccaggctggccaacatggtgaaaccccatctctactaaaaatacaaaaattagctgggtgtggtggcgcgcacctgtagtcccagctactcaggaggctgaggtagaagaatagctggaacccaggaggcagagattgcagtcagccgagattgcaccactgcactccagcctgggagacagagcaagactgactcaaaagaaaaaaaatgacagaagcctgattatcagactgcccggaggagacaggctccagcagatagatgccagccaggcccagctgccacgatttgtcccaggtgaccaaaggcacgcagctccagcatgaatcgttctaacccaacagtgacaagaactgctgggccttaaccgtcatggaagactggggccgcttccaagtcacagacaggagacggggacaggaaagaactcattccacccaatcggacacctaataattgagtgtctacagcagcaatcaagtgacaagtgaggccctacctgacccagaaggtgcctgccggctaaacattctgcccccaccagaaactccagggggtccgcccgttatgccgtggcccacccacgcccctttggatcaccagcagtcacagacaacaggcaggcgaaactgaagaccccaactcagccccagcggaccctccagagcaaaagaggcccccggcgaggccacctgtcggcaggcatgccgaggtcaaacagccggggccaccgttcccagctgggccacgacctgcaccgtccacagatgggctttgagatggatttgtatcagggtggggggtgtggtttggccaaaatgcaatggaccccgacccctcctcgtaaaaggatgttgggtttccctctggtgacacatgggatgcgtcataaaccctcccccaaagtcctggtcagcagcccatccttccaacgatgagttttgcggtttttcagaacagaaatgatcactacgattgacgacggtcgtgatgttaagacgtcgtctccatgagctttggggggacttttatgtggaataaagaaactatcactgagaagggaggtttgttccttttgagtactagtaacaggcagggcccagtggctcacccctgccatcccagcactttgggatgcggaggcgggaggatcacctgaggtcaggagttccagaccaacctggccaacatggtgaaaccccgtctctactaaaaatacaaaaattagccgggcgtggtggcacacgcctgtaatcccagctactcaggaggctgaggcaggagaatcacttgaacccgggaggcagaggctgcagtgagccacgatcacgcctgccagttctctccatccacccagtggggacactgtgcggtggccatgtcatacccaccttgatgtctctgtcaccagcaggtcccaaagtcatgctactgtgctccagttgtgtttatgccggcaggtgccctttaggggaaaaggtggggtcttcgtgggtggatggaggggacaaagagggtggagctggtgctgggatcctggggagccgctcccagtttggaggtgacagccccctcctttatcctactgcacggggtctctgattaccctgagaggtttcttgaaaaccccattcacggccaggcacggtggctcacgcctgtaatcccaacactttggaaggccgaggcaggtgaatcacttgaggtcaggagtttgaggccagcctggccaacgtggtgaaaccccgtctctactaaaaatactaaaattagccaggcgtggtggtgcgcgcctgtaatcccagctactcgggaggctgagccaggagaattacttgaacccagggggcgtaggttgcactgagccgagatggcgccacttcactccagcctgggcaaaagagactccgaaccccccaccaaaaaaaaacagaaaagaaggccgggcgcggtggctcacgcctgtaatcccagcactttgggagtccgaggcgggcagatcacgaggtcagaagatcgagaccatcctggttaacacggtgaaaccccgtctctactaaaaatacaaaaattagcccggcgtggtggtgggcacctgtagtcccagctactcaggaggctgaggcaggagaatggcgtgaacccgggaggcggaacttacagtgagccgagatcgtgccactgcactccagcctgggtgacagagcaagactccgtctcaaaaaaaaaaaaaaacaacagtaaagaaaacctcactcgctctttcattcatttcggggcacagggggtccagtccctcacaccactcccagcccaaggggtgggctcaacccagggacctggggccttcctggggaccaggaggaagggacctttctgatcagagaactaatacacaagcagccgtcagccaagccagcaggaggaggggtgtccccggcagagtgacccacggggagcaaggcctggggcagccagagaggggcctgagggccggatcggcgccaccagtgttgcagaaaaacccaggacgaaattaaagtcttcatcatttggtcactttctttttattatcataattacttttttttttttttgagacggagtctcactctgtcacccaggctggagtgcagtggcacaatctcagctcactgcaacctctgcctcccgggttcaagcaattctcctgcttcagcctcccgagtagctgggattacaggcgcgcgctaccacgcccggctaatttttgtattaagtagagatggggtttcgccatgttggccaggctggtctcgaactcctgaccgcaggtggttctcctgctttggcttcccaaagtgctgggagtacaggggtgagccaccgtgcccaggcttttttttttttttttaatcagggttttcctctgttgctcaggctagagtgcagtgatgcaatctcagctcactgcagcctcaacctcctgagctcaagggatccttctgcctcagcctcccaagtagctggtactacagaagcaggccaccacacccagctaattttttttttttttggtagagatggtggggggcaaggaggcgggggtctcacaacgttgcccagactggtcttgaactcctggcctcaagcgatcctcccaccttggcctcctaaaatgctgggattacagtagtgagccactgcaaacatttctttttttgagacggagtctggctctgtcgcccaggctggagtgcagtggcgccatctcggctcactgcaagctccacctcccgggttcatgccattctcctgcctcagcctcctgagtagctgggactacaggcgcctgccatcgtgcccacctaattttttgtatttttagtagagacagggtttcaccgtgttagccaggatggtctcaatctcctgacctcgtgatccgcctgcctcggcctcccaaagtgctggggttacaggcgtgagccaccgcgcccggccaaacagacacttttttaataaatcaagatgagagtcacttaatataaaattaaccatttttttgttttttcattctttttgagatgtagtctcactctgtcgcccaggctggagtgcagtggcgcgatctcagctcactgcaagttccgtctcccgggttcacgccattctcctgcctcagcctcccgagtagctgggactacaggcgcccgccactgcgcccagctaattttttttttgtatttttagtagagacggggtttcaccgtggtctcgatctcctgacatcgtgatccgcccacctcagcctcccaaagtgctgggattacaggcgtgagccaccatagcatacccggcctaaaattaaccatttttaagagtacattcttcacaatgttttgcaaataccacctctattaaattccagaacattccattaccccaaaagtaaatctgtccccagcagccacagtcatccccacccacctcccccagcccctggcacccacgcgtccccttcctgtcctcgtggattgacgtgtcctgggcatttcatgtaaatgggatcactgcaccgtggggcagtgaggtcgctaatcaataccctgggacctgggactgcttggggactggcaggcatttgtagcccctgtggcttctccctctccttcctgccggggtgggctggcacagggaggcctcccagaggtgccctgccagggcctttatctgggcatgtcactgtcacctgaggccctgggccacgtgccccaccaagaggctgccaggaaattcttgccaccgaaactgggccagaggtgaagcccaggagccgggctttcctgggtgcctgcttgagcacctggaggagctctggccacagacatagccaccccgctgcactgccacagatcctgtggctgactgctttttctgagctttcctcatgaataccccaagatttccagtccattttgcaaaagctcttgaagtccagggtcacaattctgttaacaggactcataaagtacatcattggtcgggcgtggtggcttaagcctgtaatcccagtactttgggaggccaaggaggaaggatcacttgaggccaggagttagagacccgcctaggcaatgtaacaagacctcatctcttaaaaattctctctctctttggtgtattgatctcttactgcatacagacatacaaacttggccatcctatcaccccaccttcctagtcacttcccatcctctgatcacccccctgctcctgggctataatttcccacttttccttgtattggtggaaagggagaagattgaattcaatctccctcccatactacaaaaccccatggtagtagtccctcacccgcctcaacaaagtcagccttactgttttaagaagcatcagaaaaattattttctggtggggagaggcgtcacatgcctgtaatcccagcactttgggaggccgagttggaggaatcatcacgtgaggccaggagttcaagaccaacctgggcaacatggcaagaccccatctctacaaaaaattttaaagttaggtgtggtggtgcgaacctgtagtctcagctgctcgggaggctgaagcagaaagatcgccccagtgtgagaagttgaggctgcagtgagctgtgatcacatcaccacactccagcctgggccacagagcgagaccctgtctcaaaaaattcaaaaatgtaggctgggcatggtggctcacacctgtaatcccagcactttgggaggcctgaggcgggcagatcacctgaggtcaggagttcaagaccagcctggccaacatggtgaaaccccgtctctactaaaaatacaaaaattatctgggcgtgttggtgctcgcctgtaatcccagctattggggaggttgacgaaggagaattgcttgaacctggaaggcagaggttacagtaagccaagatggtaccactgcactccagcctgggtgacagagcaaaactctgtttcaaatttatttatttttattttattttattttatttttttgagacggagtctcgctctgtcgcccaggttggagtgcagtggcacaatctcagctcactgcaacctctacctgccaggttcaaacgattctcctgcctcagcctcccaagtagctgggactacaggcgtgtgccaccatgcccagctaattttttttgtatttttagtagagacggggtttcaccatgctggccaggctggtctcgaactcctgacctcgtgatccgcccgcctcggcctcccaaagtgctgggattacaggcgtgagccactgcacccggctccatctgaaattaaaaaaaaaaaattaaaacatttaataagagaatactttttccctttaccagtagaagagagaagcagcagagtgtcattcctccccattaccccctccccgccccgccggcccccagtcaaatgactccacccacaaggcaggcacgggatgaatggtccctggtgtcacgctgagatcctgtggctgggcccccggtcacctgggcaaggctatcttgtgattcactgctaaggatcttaagcccaccttggccctgacctcgttggaaaacgaagctccccgcagggtcccggcctctagggctgctgtgcgggcgggggtgggtgagttcgcttccttgacgccacgagaaccagtcttaatgtcagggtcaggccataggacacagagagcgggatatttttagggagggaaaagtgtggggctgctgatctgagctctctggccaggaggagggaagagggtgggggtggagaggagggaggagggggtaagaaggggaggagaggggaggagggagtggagagagggcagggaggtgggaggagggaagaggcagccccctgcccggccagctcgtgactaatttaggcaaaaggcagcctggagctatttccattcggcggcgggaacaggtgccggcgcctccgccccatccccaggggccgcctcccccggggcggcctccaggctgccgagacctataaaggcgccaggttttctcaatgaagccgggacgcactccggagcgcactgcgtggtcgcaccctacccgggctgccttggaagtcgtccccgccgcccctccgcaccggcatgaagctcatcgtgggcatcggagggtgagcgccgggggacctggtgggcggccctgcggggcaaagccccctgtgcgcgcagagggggaggcccgggaatgaatggagggatgcctggcgcctgaggtcacctacacgccgcccgaggtcagagtgcagggaggattttctgccctgggggtctcggtgtccccagtgggaaggggggctggacactgagcccagtgtttcattttttaaatggaaatgattcccgccaccttccaattatactcagcataaaaaaaaaatagaccagacacggtggctcaggcctggaatcctggcactttgggaggccgaggcgggtggatcacctgaggtcaggaatttgagaccagcctggccaacacggtgaaaccccgtctctactaaaaatacaaaaattagctgggcacggtggtgcatacctgtaatcccagctactggggaggctgaggtgggagaatcgcttgaatccgggagatggaggttgcagtgagtgcgatcatgccacttcactccagcctgggcgacagagtgaggctgtgtctcaaaaaaaaaatcagtagggacagaaaattaactaaagctccagtgaaccctcctcccgcctcgtggctgtcctggctaaatcggggactgacacgtgggcaggtgggatggggtccccaaaatgtcattccacatgactgtgcctttggagcctctctcaggcgacctcaggctagaagagattcaaactctctgtaaccagcacggctggctttgtggggctcacacccccgcctcagaagggacgggagcttggtctaatgctagccggactccctcttgaatttcatattttttgttttttggggtttttttttttggggggggggtgttgttgttgccgtcgtagtttgagacagagtcttgctctgttgccccaggctggagtgcagtggtgtgatctcggctcactgcaagctccgcctcccgggttcaagcaattctcctgcctcagcctcccaagtagctgggattacaggcgtgaaccacatgcctgtctaaactttgtgtttttagtagagatggggggtttcaccatgttggccaggctggtctcgaactcctgacctcaagtgatccaactgtctcagcctcccaaagtgctgggattacaggcgtgagccaccgtgccctgcccctaatatttttcgagtaagaagcctcgaattttcattttgcactcagcgctgcaaatgtcacagcccacccggggcacaaaataacttggattcatgtcaggcactttctttttatttttatttaaaaaattattaatacctgggggcttacattttaaaaattgggttttaaattttataatacagatgggagtctcactatgttgcctaggctggtctgaaactcccaggatcaagtaatcctcctgcctcagcctctccaaatgctgggattacaggtgggagccaccacacctgagcaacattaggcatttttctaacctgcctcttctggatatgatataggtgtcctctttttccgtcagtcttttttttttttttttttttttgagacaaaatctcgttctgtcaccaaggctggagtggagtggcacaatctcagctcactgcaacctctgactcctgagttcaagcgattatcttgcctcagcctccctagtagcttggattataggcacccaccactacgcccagctaatttttgtatttttactagagacagggtttcaccaggttggccagtctgatcgcaaactcctgacctcaggtgatctgcctgcctctgcctcccaaagtgctgagattacaggcatgacccaccacgaccagctaaaattgtttatattatctatttatgtatttatttatttatttaaagacagggtttcactctcacccagactgaactgcagtgaggtgatcacagctcactgcagcctcgaactcccaggctcaggcgatcctcccatctcagcctcccaagtagctaggactacaggcatgcaccaccacacctggctagtttttaattttttgttaagatggggtcttactatgttgcccaggctagtcctgagctcaagcgatccacctgcttcggcctcccaaagtgctgggattacaggcatgagccaccgtgcatggccggtgctgttttatttttttaagccctgctgagactaaatcaatttccttatctgtaaacataggtgggccgggctcacacctgtaatcccagcactttgggaggccaaggcaggcggatcaccagaggttaggagttcgagaccagcctggccgacatggcaaaaccccatcgctattaaaaacacaaaaattagttgggtgtggtggcgcacgcctgtaatcccagctacttgggaggctgaggcaaaagaattgcttgaacctgggaggcagaggttgcagtgagccaagattgcgccattgtactccagcctgggcaacagagtgaaactccgtctcggaaaaaaaaaaaagaaagaaaccctgtctctactaaaaatacaaaaattagccaggcgtggtggcgtgtgcctgtagtcccagctactcaggaggctgaggcaggagaattgcttgaacccgggaggtagagcttgcagtgagctgagatcgcgccactgcactccagcctgggtggcagagcaagacttggtctcaaaaaaaaagaaaaagaatcagaaaaatcctgggagctgatttgcaggaagaccctgagacatggacaggccccggggagcccaggctgcacctcaggcccccttctgagcaccctgaccttcttggggggagcccaggcagtctcatgcacacgctgtctccccagcatgaccaacggcggcaagaccacgctgaccaacagcctgctcagagccctgcccaactgctgcgtgatccatcaggatgacttcttcaaggtgcccgcccttgcccggggaggtggagctgagaggggatgcagggtgggcagccaggcccggccagccccgccctccactgcccagtgcccgtgtgggctgggcactggctccactccctgcctgacccctcctggggtctctgggataaactgggccaggaaagtgagggacgggtgtcgtgttcccatttcctaagcacctatttcatacgcagcccattctcactggacatccctacagtggggaccccagttagatggatgggaaagccaccattcctccacagggccagccggctgtggctttctgggtgaataccctttattcctctccacctcccctttcccatctgcaaaatagactctgagcccagctcgctgtgtgggtgtgggtgggggtgagggctaatgagatgattgatggtctggggaaaatctgagggtcaggcagagcccccacgcctcagggacctcagcagctccagcaagggaccccctaagactccatcacccaggccgggggtgaggcaggaccgggcactgagcccgaggttcaggctcctctgtttcagccccaagaccaaatagcagttggggaagacggcttcaaacagtgggacggtaaggacaagcatcacctccaagccccactatcccccggggtccgccctcctgcaatgcccgctccccctccactattcccccggggtccgccctcctgcaatgcccgctccccctccactattcccccggggtccgccctcctgcaatgcccgctccccctccactattcccccggggtccgccctcctgcaatgcccgctccccctccactattcccccagggtccgccctcctgcaatgcccgctccccctccactattcccccggggtccgccctcctgcaatgcccgctccccctccactattcccccggggtccgccctcctgcaatgcccgctccccctccactatcccccggggtccgccctcctgcaatgcccactccccctccactattcccccggggtccgccctcctgcaatgcccgctccccctccactatcccccggggtccgccctcctgcaatacccgctccccgtccactgtccccccggggtccgccctcctgcaatacccgctccccgtccactgtccccccggggtccgccctcctgcaatgcccgctccccgtccactgttcccccggggtccaccctcctgcaatgcccgctccccgtccactgttcccccggggtccaccctcctgcaatacccgctccccgtccactgtccccccggggtccaccctcctgcaatgcccgctccccctccactgtccccccggggtctgccctcctgcaatacctgctccccgtccactgtccccccggggtccaccctcctgcaatacctgctccccgtccactgttcccctggggtccgccctcctgcaatacctgctccccgtccactgtccccccggggtccaccctcctgcaatgcccgctacccgtccactgttcccccagggtccgccctcctgcaatacctgctccccgtccactgtccccccggggtccaccctcctgcaatacccgctccccctccactataccccggggtccgccctcctgcaatgcccgctccccgtccactgttcccccggggtccaccctcctgcaatacctgctccccgtccactatcccccagggtccgccctcctgcaatgcccgctccccgtccactgttcccccggggtccaccctcctgcaatacctgctccccgtccactgtccccccggggtccaccctcctgcaatgcccgctccccatccaccgtcccctggggtccgccctcctgcaatgcccgctccccgtccactatcccccagggtctgccctcctgcaatgcctgctcccctttccccagtgctggagtctctggacatggaggccatgctggacaccgtgcaggcctggctgagcagcccgcagaagtttgcccgtgcccacggggtcagcgtccagccagaggcctcggacacccacatcctcctcctggaaggcttcctgctctacagctacaagtaaacatctgcaggctctggccccaggcatggccctctctgggcgggtatagccatctcttgtttttttttttttttttttttgttttgtttttttttttttttgagacaagagttttgctcttgttgcccaggctggagtgcagtggtgagatcctgactcactgcaacctctgcctcccagtccaagcaattttcctgcctcagcctcccaagtagctgggattacaggcctgcgccatcacacccggctaatttttgtatttttagtagagactgggtttcaccctattggaccaggatgttctcaaactcctgacctcaagccatccgcccgcctcggactcccaaagtgctgggattacaggcgtgagccaccacgcctggctcacatctccattttaatagtcaggagacccaggagcagagccaccacgggaagtcaggagttgggggcagagctgggatcaacccaagtctggagccaggcgtggtggctcaccagcactttgggaggccaagatggatggatcacctgaggtcaggagttcgagaccagcctggccaacatggcgaaaccctgtctctactaaaaatacaaaaaattagccaggtgtggtggcgtgtgcctgtaatcccagctactcaggaggctgaggcaagagaatcgcttgaacccgggaagtggaggttgcagtaagccgagatcgcaccactgcactccagcctgggcgacagagagagactccatctcaaaaaaaaaattaaaactaaaaactcaagtctgggacaaacagccacccttcttggggagactgagtctttcttctggaacctcagacttctcgggcagaccagtaacctaggctgcgccctctggcttcactgtgtggccctgagcaagacattctgtctgtctgtgcccgtccaagttggagaagaagcgtgattcaattttgtggggggctgctgcagggatgttggccaattcagcttccctccctgacccctaaactcactggcccagaccaccccatgtgctcgccaccctctgaaagccaaggctggggggttggatattttgactgcggttgaaggaaagctcacaggtgctgaccgtgtctcccccactccgcccaggcccctggtggacttgtacagccgccggtacttcctgaccgtcccgtatgaagagtgcaagtggaggagaaggtgcacttggtgtctgggggtgcggtgggctcctgagggccctgtcttgaattactgggtggaaccagcggtaacctagaaaatgccactgggggctgggcacagtgtctctgggctgtaatcccagcacttccggaggctgaggcaggtggatcacctgaggtcaggagttcgagaccagcctggccaacatggtgaaaccccgtctctactaaaaatacaaaaattagtcgggcgtagtggcgtgcacctgtaattccagctacttgggaggctgaggcaggagaatcgcttgaacctgggaggcagagctgagactgggacactgcactttagactgggtgacagagggagactctgtctcaaaaaaaaaaaaaaaaaaaaaaaaaggcggccaggcgcggtggctcacgcctgtaatcccagcactttgggaggcttgggcggatcacctgaagtcagttcgagaccagcctggccaacatggtgaagccccatctctaccaaaaaatacaaaaattagggaggccgagatgggcggatcacctgaggtcaggagtttgagaccagcctggccaacatggtgaaacctatctctactaaaaattgaaaaattagccaggcatggtggcgggctcctgtaatcccagctactcaggaggctgaggcaagagaatggcttgaacccgggaggtggaggttgcagtgagccaagatcaggctactgtactccaacctgggcaacagagcgagattccatctcaaaaaaaaaaaaaaaaaaagagaaaacgccactggacacgggccacatcccaacgccacaggcactggccacttagctggctggagctctgtgccaggtgcccagagcctgaggcctggatagcacggcccaccccaaccctgtccagggcatctcccggacccacagggtgaacatgccggaggttggagcctctagcccagggcttctgaccgagggtccccttgctcagaggttctgtccctgactatgacagctttcaggccccccaccgggggtatattcttagcatcacccttctgtgctctaagccatccttgccttctccctctgcagtacccgcaactacacagtccctgatccccccggcctcttcgatggccacgtgtggcccatgtaccagaagtataggcaggagatggaggccaacggtgtggaagtgggtaagcccctgagcatgaccaggccttgccccgggcgggcgggggggaccctgggcccagcccctctccatctttttttttttttttttcaagacagagtctcactctgtcacccaggctggagtacagtggcacgatcttggctcactgcaacctccgcctcccaggttcaagccattctcctgcctcagcctcccaagtagctgggattacaggcgtgagccaccacactcggcccctaatttgtgtattattaatagagacagggtttcaccatgttggccaggctggtctcgaactcctgaccttaggtgatctgccctccttggtctcccaacgtgctgggattacaggcgtgaaccactgcagctggccaccattctaaacgcccttcagtactccccactcaggacctttggaaacctggacattcctccgtgagcctcgcccccagtccctcttgctatttttgttgttgttgtttagacggagtcttgttctgtcgcccaggctggagtgcagtggcgcgatcttggctcacggcaatctccgcctcccgggttcaagcctttcccctgcctcagcctcctgaatagctgggattacaggcgcgcgtcaccacacccatctaatttttgtatttttagtagagatggggtttcaccctgttggccaggctggtttcgaactcctgacctcgtgatccgcctgcctcggcctcccaaagtgctaggattacaggtgtgagccaccgcgcccggccccctcttgctgttggtccaggaaactgactccagcagcccgactctgcagatctccttgctcctgacccagccgtccactcgtccccccgtgctctggcccccttcctcccggcagccctgacgcagcctttctgatttcagtctacctggacggcatgaagtcccgagaggagctcttccgtgaagtcctggaagacattcagaactcgctgctgaaccgctcccaggaatcagccccctccccggctcgcccagccaggacacagggacccggacgcggatgcggccacagaacggccaggcctgcagcgtcccagcaggacagcatgtgagcgtttccctatgggggtgtctgtacgtaggagagtggaggccccactcccagttgggcgtcccggagctcagggactgagccccaagacgcctctgtaacctcgctgcagcttcagtagtaaactgggtcctgtttttttaactgttggtgtctaccgtgttctgtctaagatccgtcaggccaggtgcagtggctcacgcctgtaatcccagcagtttgggaggccgaggagggcggattgcctgaggtcaggagttcaagaccagccaggccaggatggcaaaaccctgtctctactaaaaatacaaaaattagccaggcatggtggtgcatgcctgtaatcccagctacttgggaggccgaggcaggagaatcgcttgaacccgggaggcagaggttgcagggagccgagatcgcactactgcactccagcctgggtgacagagcaagatccgtctcaaaaaaaaaaaaaattaaaaattagctgggcatggtggtatacctgtgtagcctcagctacacaggaggctgagacaggaggattgcttgagcccaagaggttgaggctgcagtgagctatgatcaggccactgcactccagcctgggtgacaatgcgataacctgtctcaaaaaaattttttttctcaatgcctataaataaagttttattggcacccggcccctgccatttgtacgtgtcagccctgtggctgctttagtactacaatagcatgttgagtcaccctgacagagaaggtctgtctgcaaagccaaaaatatttactatttgcccctctgtgcaaaatgtgtgctgaacggtgtggtgtatgccaggtcgagtccagggccacagggagggtctgaggtctccgtgctggaggggaagcaggagtggatatggaatgggaggatgacgtggaagaggtggcttgccaaggcttctccttccccataagcacagagtgtggtaaggatgatctgccggtcactgtgcccaaaatagtccaggacaggacagagacatgagggaggtggttccaggacagcagaagccctgcctggcagcccagataccttgggcattattgttcttttaaaaaaaaaagaaaggttcatgcctgtaatcccagcactttgggaggttgaggggggaggatcacttaagccccggagttccagtccagcctgggcaagatagtgagacccccatctctacaaaaaatgataaaatattagcaaggcgtggtagcccatgcctgtaatcccagcactttgggaggccaaggaggtgaattgcttgagcccaggagtttgaaaccagcctgggcaacagagtgagaccccgtttctgtttttatttttctgtatttatttttacttagttatttatttttgagatggagtctcggtctgtcgcccaggctggagtgcagtggcgtgatctcggctcacggcaatctccacctcccaggttcaagcaattctcctgcctcagcctcccaagtagctgggatcacaggcatgcaccaccacgcccagctaatttttgtatgtttagtaaagacggggtttcgccatgttggccaggctggtctcgaactcctgacttcaggtgatccacccgcctaggccccccaaaatgctgggattacagacgtgaaacaccatgcccggctgtgagaccccgtttctacaaaaaattagccaggcatgatgacacatgtctgtagtctcagctactcgggaggctgaggtgggaggatcccttgagcccagaaagttgaggctgcaatgagttatgattgcatgactacactccaggctgggcgacagagcaagaccctatctcaaaaaaaaaaaaaaaaaaaaacaaaacaagaaggggaacagtagccacagggtaaccaaccaaaaaacggaagatgataagggttggccaggatgtggagagagcaaaacccttatgctctgaggtgggaaatggaacacagtgagcctgacgagaaacagtctggccgtttctcagaattaaacatggaattaccatagggcctagcaatcctgctcctgggcaaggccccaaggaattcacagcagggactcaaagagatccttgcacagccatgttcatgggggcacagcccacaacagccaaaaggtagaggcaacccaagtgtccacagacagatgaatgaatgaacacaatgtactccatccgtacatgaatattactgagccatgaaaaggaagggaatctggacacagggcacaacaggatgatccttgaagatgtcacgctccgtgaaataagccaaggccgggcatggtggctcacccttgtaatcccaacactttgggaagcggagaggggtggatcacctgtggtcaggagttcaagaccagcctggtcaacatggcaaaaccccgtctctactaaaaatacaaaaattagctgggcatggcggtggcgtgcctgtagtcccagctacttgagaggctgaggcaggagaatcacttgaacccaggaagtaaaggttgcagtgagccaagattgcgccattgcactccagcctgggcaacagaacaagactccatctcaaaaaaaaaaaaaaaaaaagggaaggaagggagggagggagggagggaggaagctgggcgtagtcgctcacacctgtgaatcccagcactttgggaggctgagactggaggagccaaggagtttgagatcagcctggacaatatagcaagaccctgtctctacttttaaaaaaaatactggggggctagagcagtggctcacgcctataatcccagcactttgagaagccaaggcaggaggatcgcttgagcccaggagtctgagaccagactaggcaacatagtgagaccctgtttctttttttaatttaaaatgttattcttggccgggcacagtggctcatgcctgtaatctcagcactttgggagaccaaggcacccagatcacttgaggttaggagttcgagaccaacctggccaacatggtgaaaccccgtctctgctaaaaatacaaaaattagctgggtgtggtggtgcacacctgtaatcccagctatttgggaggctgagacaggagaatcacttgaacccaggaggcggagattgcagtgagccaagattgcaccactgctctccagctggggtgacagagggagattccatctcaaaaaaataaatttaaatttaaaaagtaaaataaaatatttttaattaaaacaacttttttggccaggcgcggtggctcactcctgtaatcccaggactttgggtggctgaggcaggcagatcatgaggtcaggagtttgagaccagcctggccaacatggtgaaaccccatctctactaaaaatacaaaaattagccgggcatggtggcacacgcctgtaatcctagctacttcggaggctgaagcaggagactagcttgagccagggaggcagaggttgcagtgagctgagatcacgccactgcactccatcctgggcgacagagcaagactctgtcttggggaaaaaaataataatgattaagatggcaaattttgctttgtgtgttttgctaaaagttaaaaaaataggaacaggagcactagggtagctagctcatcccagttggcccagaacgttcctggtgttaccactcaaagtcctgtgttcccaggagaaacaggaggatgagtcacccttatgggagccaatcagcttgagaagtcagattactccatgacccattcttatagggctcagagagggaaagaaacttgcccaaggtcacccagcagagctgatatttgaactcagctctgttgaatgccaaccccctgaccttctccagccccatgtggccttccatcttcacactcgcctgctgggaagaccccctctcccctcccagagccatctaaggggcccagagaatcccaccccaacattgcccgagtacagctggattctgggtgcagtgatggtgtcggttaacctctgcctgtctcgcggctcctgccctccacaaacagaaccagtgactcattctccccaaatgcaaagcagatgcacctgtaatttgtccccctaggagtacccgtccatcagcgacagggacagggcaccccgagaccaggcagccccgggtgcaggtgggcagctccaggacccagcctgctcggcccaaacccaggcagcctctgccacttcctggcccactgtccccaggcaggtaaaacgccgtctctgtgcctcagttccctccctcgtgtgctcagcgtagcaccaggcgcttggagttatcacagctgctgggttgatggctggtgtcgctatgcaccacagtgacaaaccgaggcaggccccgacccacaggccagcccgatgggcacagtgagcgggatccacctgccaggtgtctagcagggcttggaattctccccagcaccccgagagagatgcgtgcaactgactcctttttgcagatggggaaactgaggctcgggaagtggatttgcttacccaagaccacacatgaaaggtggaatcagggccaggtgaggtggctcacgcctgtaatcccagcactctgtggggccaaggtgggtggatcacctgaggccaggagatcgagaccagcctggccaacatggtgaaaccccgtctctactaaaaacacaaaaattagccaggtatggtggtgcatgcctgtaatcccagctactcgggaggctgaggcaggagaatcgcttgaacctgggaggcggaggttgcagtgagccgagatctctccattgcactccagcctgggcaccatgaccgaaactccatctcaaaaaaaaaaaaaaaaagaagaaaaaggaaaaaagggggaataaggatacgagtccaggtggccgagcctgggaacctgagccaggtccactgtcccatgcctgggcccagtgtcagggtaccatcacctcgggaatcctcgttcccccagaggagacccctcctgctcctgtgtgggacccccctccatcacctccaacttcctggaatcccctcagggtcccgccagtcccccagggctttctggtcccctcagcggaggccctagtccccagcaaccacccccttggctggatgcttctgaagtccctcattctcctcctgcactcacaatgggggccacagacacccccacacacaagcttgtgttctttctctctcttttcttccctccttccttcctctcttttctctctttctctctctctttctctctttctctctttctttctttctttcttgacagagtcttgctctgttgcccaggctggagtacagttgcgcaatcccggctccctgcctgcaaccgccgcctcctgggttcaagtgattctcctgcctcagcctcccgagtagctgggatcacaggcgtgcaccaccacgcccggctaatttttgtattttttagtagagatgggggtttcaccatgttggccaggctggtctcaaacacttgacctcaggtgatcctcccgcctcggcctcccacagtgctgggattacaggcgtgagccactgcgcccggcctgtgtttactttacaagtcccacttattttattgatttttaactaaattcctctgaagaggaacctttctgacacaacatgaggaaacctggattttctgatacatgttaaaccacagagcggctcgggtggctcatgcatggaatcccagcactttgggaggtcgaagccggaggatcacttgagcccagaagttcaagaccagcctgggcaacatagcaagaccctgtctctacaaaaaatattaaaaattagctgggctttggggtgcatgcctatggtcccagctactggggaagctgaggtgtgaggacttttttttttttttttttttttttgagacggagtctcgctctgtcgcccaggctggagtgcagcggcacaatctcgggtcactgcaagctccgcctcccgggttcacgctattctcctgcctcagcctcccgagtagctgggactacaggcggccgccacaacgcccggctaattttttgtatttttagtatagacggggtttcaccctgttagccaggatggtctcgatctcctgacctcgtgatctgcccgccttggcctcccaaagtgctgggattacaggcgtgcaccaccgtgcccagctggtgtgaggatttcttgagcccaggacgtggaagctgcagtgagctatgatcacaccactgcactcccacctggacaacagagcaagaccctgtctcaaaaacaatgcaaaaagccacagaattcatatcatctaaaatcatccttgccttcaccttcctgaaatgctcccggccaagagcaatctcaggccaatagttctcacctgggggtgattctgctcccgccaaccagggaacactggacaatgtctggagacatttgtggtcctgacgccttgggaaggggtgagcggaggccagggatgctgctcgacccctgcagtgcccaggacagccccaccccagagaacagtccaaccccaaatatacacagtgtcccagggaagaaacttcttctaagggcagagaatgggctccaatcctaccctgggctgggcatggtggctcacacctgtcatcccagcactttgggaggctgaggcgggcagatcacttgcggtcaggagttcgagaccagtctggccaacatggtgaaaccccatctctactaaaaatacaaaaattagccgggcatgatggtgcacacctgtaatcccagccactcaggaggctgaggcaggagaattgcttgaacctgggaggcagaggttgcggtgagccgagatcacaccactgcactccagcctgggcgacagagccagaccctgtctcaaaaacaaacaaacaaaaaatcctgccccgctcccttgaggtacctatcgtgggcccaggaagggactgagagtccagggcaggcaccaaccatcacacagaggcccccatgttgtcgcgtggctgacacttctctgggccaagtcattcccggagcttgaggaacttggctgagggtagcctggctctactgaaagtcccctgcctgggggcctccctccttgacccttgcaggaccccaggtgacaggcagcccatggagtctgtggagggcagaggacctcgttggaagctggccttccgagctcccgtgcgagggcgggattctcgtgcccacagtggggtccttggtttgcagcttctgaagcctttccctgtgaggggttggggaggggtgtctcagggttcccggggcctgggacagacaggcaggaccccgctgtgcccctggctcagtggcttctccagctgggaaggcaatctttggggggtttttttgaggcagggtctcactctgtcacccaggctggagtgcagaggcaccctcatcgctcactgcagcctcaacctcttgagctcaagcaatcctcctgcttcagcctcccaagtagctgggactacagggcgtgccaccgtgcccagctaatttttttattttatgtagagatgggatctgtttcccaggccagtctcgaactcctgggctcaaggaagcctcccaactcagccttccaaagtgctgcgattataggcgtgaaccacctgggtcatcaggaagccagtctgcagccccctccctgcctgggaggcactggagggtgtgtgcgcagacagatggacagtcccttccatggagaacctgaactccctgccctgccctgcccgctcccctgggaccacccagccctgggactctgccctcaggcccttccccagaagtcctgctggccatgggaagagagaggctgagacccacccggatggaagcagagaggccctgggaggtgggggggatgaggttttagtgccggcctccccccaactctatttcaggcacccccaccccacccccaaccatctgccactcacatcaagtagtagtcagccggccccttaatcagcagttactccgctggcgccgccccccgccccccaccccagggccctaccagggccaaagctgtcacctccaaggccaccgagcttgggtgccccagactccctgctgccagggccttaagggggtgtccttggggccagctgtgggcccagctagggcctgggggagaagcaggctgaagaggccagacaggatccaccctgcacattctgggggagctgcgggctcccgagaaatggccttgtctcctctctgcccccgttaagcttctgcagcattcaacgaggtcgagaaaccactgagcttccgggaggacgagggcccagccccctccaaggtaggggagggggtgacaaggtgggggtccagcggctctccaagcagggaacccgtgaggtgcagtcaatccaaacagggctcattgaggacatggcctgtaagttctcccctaaagggaccttcaaactatgaaaccccagagaggggcgggagaccccaggacagccaggggttggggtggggagggggccggagggagggagcccccacctccgtcctcgccattcgcctccccccactgagggagccacagctgtggccacatcatcgcaagacacacatgcattgttggggtcacccggcctgcggcgggatccccggctctgtccccttagataaggagaagcagtgagcaggcccagcccccaaacagctcagccgctgcctcctcctcctcttcctcctcctccccacagccatcttccctgctccttaggcagggctgggcctgggctgtcctggaggccaccgaaccgcctgggacaagtaggtaccaccccggatctgtgcttcggacgtcctttgaggggggatctcatttcaccactgttctgtgtctgacttccggccgccgagcgggggcccgtgttctgcacgaggctgaccagggggacggggggagagatggttttggtacttacttttctttttgtctcacaacaggggggttaaggttctcgggggctgaaggagccgcttggggctggcaggcctggctttatagcggctgtcaccctggacctgggcaaaggcaccgtggttattaatagtgaccgcagtttcatgcccgtgtatggtcaaggccacggcagctgcgggctctgctggactcaggcctcctcccaacacctgctccaggccctgacctggaggcgccaggcagcgctcgccccacccaacgcgacttggcaatgactaagtctgagaccctagaatcaaacaagactcatagttgggggccctccagagggtgccaggccccgctgcagcccttccttccgccctcaccaccatcttgggaggcagatggaatcgctgtcccctggggagggggaaatggcagagaggcagcaccgtttaccaggagcagagccaggatgtgcttcaacccaggacacattttgcagacagtgtgtaactaaatccaagctgcggcgcaaagcctcaaatgcgtgttctgtgtcctgtgctgcctttgctcagcctggggaaaccgggagggccccgatggcctcctctgctcctgcaggtgcgtcccctaggcaaagagccctccatcctcagagggggctgggcagggtcctgcttctccttgagtcacttctgttccctgctagccctggaactcttctgctttcctcttctccccttctcctcttcttttctttttgagagagtctcactctgttgcccaggctggagtgcagcagcacaaccgtggctcactgcaacctccgcctcccgggttcagaatgattctcctacctcagcctcctgagtagctgggacttcaggtgcccaccaccacgcctggctaattttttgtatttttagtagagacgggatttcaccctgttagccaggtcggtctcaatctcctgaccttgtgatccacccgcctcggcctcccaatgttcttggattgcaggcgtgagccaccgcacccggcctctttttttttagacggagtctcgctctgtcgcccaggctagagtgcagtggtgcaacctcggctcactacaacc

SEQ ID NO: 189 - DNA, 32232 bp, Homo sapiens
aacacacaggtggaaaaattagcaatttattgattcggtacattccaaacatagttgaagctttcttaagctgtttctaagaccccaagctgtgtgcattcttgtgatcatattggctccctctcagccatcgggattaacatactgctgggccagggtttgccttctgattcacaaattaacaacccacaaatatccttttgccaggtagtcagttccggagtcagttcttctgcaaggcttgaggctcagactaggaaacaaaacttaccctctgggaaataacattaaacctaaattctaacacaatttgatgctgaaagatcaaagattcctcagtgtagtttactaatagttccccaccgttaagtataaaaaattccttccacatgcctttcgcctctgcattcaactgtgtttgacaaagcctgtctcacaaactcaattagaaccactgagcttaaacacacccctttccttggtcacttacagtagatcttttcctgactgctcctatcgtggcagggactgctcttagaaaaatgtgctcttgtaaaaaagatctcacaatagctctcacatgaagcttatcgtcaatggtcagtgtccgattatgtcatgccgtgttgtttttccaatgggacagactgctgctttcatcaagttggaggatatatttatggtactgttttgaagggcagtgttttaagtttgaattacaagatatttttgaaaatatagtcaactctttcatttggagctcaaaatgaatatactaaatctgcacttctgaatagaagtccatatgcctggacataaaatgtgcagtgatagagcacagtgggacttcatgagtattggtgtatatagtctcaactatagacatttcgaaggcataattttcatttcaatagattaaggcatgtgtgtgagaaaagcgtgaaaattataagagcccagagttcttaactattgacatttggggccagataattctttgctgaggtatagccatcctagcctctatccactaggtgccagtatcaacattcacaccccaaaaggagacaaccaaaaatgtctctagagattcccaaatattccctgagggacaaaaatcacccttggggagaatccctgcaataaattgttttggtttattttcccatgtggccaaagtaaaccaatcttagaaagtgctggtttgtcttagtcatatgtgaatatgctacggagtgtctacttacctgcacggtcacaaggttttctttatctctgcatcactaagagtgtctagcacagtcctcttataatatgtctgtgattggtgctgattcccagatgtttctagcttttctccttccgggaatggtagaataggacttcctattatacttccactttagatggtcacatgacttgttatggccaatgaaatgggactggaagtgatgcgtgtttctccaggtggaaacattaagatccaatgcacaatttaccacgtttcctttttttctggcatggtgaccaagcacatttgccaagatggctgctctctcagtctggcctctcagttactgcaaagagtagagccccctgctgatctgacttggatataagcatgagtgaaaaacaaaattttgttgatataagctgctgaaagtgtggggttgtttgttacaagtaacagtatgtgttagttacaactaacagtatgataggctaagatatgttttcagtgtcacagacatttgaattcagagcgcctatgagtggtttggttccttttcttccatactttagaaaggttaggaatcaccagtgatgatgagcctatgccaccacattgagctgagaagacagctgcatcttgggttcctgctccagcttaactgtgattaatctgtaaactggttaatttaccatgaagaacaacaaattaattgctatataataagctgaaaaattaaatggaattttcattttactattcaagtactaccacaagtagtaataactaatatttactgagtactttctctgtaccagtggctgagctaaacactctgcatatatttgcatagattatctcctttactcctcataatagttctgtaaggttaatgctcttttagcccaattttaaagctgggaaacctgaggcatgaagaaattattagcttcctctgcgtcatagctagaaagtgtttcagtgagatttgaacttgggtagtctgattccagagtgtgtgcctcttcacagttacgggaatctacctcctaaagagtgattttcactctgataccccagaaaaccaggtacgtatgtattgtgcagacatagacacaagttagagctatgtgttctctaacaaagaggtcttgagaaacattggagaaagcagccatatatttgaattggcacaagatcagttaaaggctggttcttctccatggattatggtaaaccgagtcgctcaaatctactgtaattaagtgaatataattctttcttagggattaaactgggtatgcaagagaacaacatgtaaaacatctgttcttaagatgcttctttggccctgtgtcacaactaatctacttagtgttataattttgtttccagatatatatatacagcattcagccacaattatgactaaggcttaaagtctctattatattaacctgccatctttaagtcttacagccagtaaggtggcttatctccaaatatgactcacacgcaaccatacttcctggtattcaggacattttgcaattccctcccatgttgaatctcactcttctcacaagatgacccagggagcccctcctgcaacaaaaatacatactttacagatagatttggggtgattgtttaccttgcaattttctgtttaaagtattatttatttgagttcttttaaatgttaagattctctccatttttattagtattaaacatttgatggagagacctggaggagagagcagagagaagtaaaactgaggccatgaaacttagcgttcaactattggaaagctcagtaaactcttcatgcagtaattcatccattgtaatagtacaatgaatgaatgactcttcatgcagtaatacagtactactatgatggatgaattactgcataagagtttactgtttatccattgtactactttccttttgctgctgtaacaaattaccacaatcttagtggtttaatacagcacaaattatcctacagtattggatgttagaagtccaaaaccatgatggcggcaggactgccttcctcacgcaagatctagggcagaatccattcccttgccttttctagcatttagaggctgcctacattccttgtctcatgacctcttatttcatcttcaaagcatgtcactcagcctctgcttctgtgatcacatctcttcttataaggaccatgtgatcacaatgagcccacttggataacccctacatcttgaaatccttaatttaatcacatcttcaaagtctcatttgccatgtgagataacatagtcacaggttctggggattagagtgtgaccttctttgggcagccattattctgttcactacatccattcccattcaatatattcatttatgcaattaattatgtaagcatttattgatacataacatatcaaacagtgagctagttgatagaaatgtaaagaatataaagaattgactacatgcgttcaaagcagcatgcatagaccttacttaaatacatggtaccaagtgaaaaagttagaaacaaattgagatccatagcatgataccattatataaaccataagagcacataatcaacacatattcaatacattaatacatattttacaagaacagaaacacaggatccacatcaaacccattataatggttgtatttgaagttggaagaggatggaagtaaagaatggggattgaaggcaacagtacatatgtagcaaaagagatggggcatatggaccaaagataatattgtgttgtgaaccaagaagtataactctacgctgtgaaatggatatttaaaaggaaaacaaacaaactacctttaaataataaacaaagtacacttatgtaaactttaatagtgctgttaacaaagtgggagaacatacagcacagaggaccacagagcaggtagaaggaggatgttgtagaacacttgttctcaactgcgatgattttcccccagaagacattagacaatgtctggggccattttaattttcgtaactgagaggtgggtgctactggcacctagtgggtggaggacagagatgctgctaagtatctgacgatgcacagggcagcccctacaacaaagaattgtctagctgaaaatgccaagagtgctgagataaagaaaaaccatgtgtagaacaaccagaaaaaaatccctgaaattattgtgacatgtcaatagatttgatttataaatatttgattatttgggggattaaaatataatcaactactcatcctctatgttctctctgctgggtttaaggaattcctttccaaacacctgatgcctattcttcatgaatttcagttcctgtgtctacacactgatgattactgatccctgattctccttacacttagagtttttagtgattccatggacttaaaaaaaatcaaatcataattggggttagaaagaatcaacaatcattgtttaattccattagttctatttgggttataagccaatcttcaaacagagaagagtgctgatgtctcacattttgacagtggctttggctcatgcaatcattctaagtttgaatattactgaataaattaagggtaaagtagagtaattctattcaggatctccaatctggtacaataattcaatctttcagtagaacagtgaagcagtgtctacttaataaatatggatggctaatcacacacatatatattttagccacttcttttcattatttagtgaacagacaaaacatgctaaatcactatacctctaaaattataaatttggtttgacaaagtcaaattagtttaatggtatgacatatatccctctagtctttccttttttttttttttcaatttcttggggcgtgaaaccatctcaaacctataccaataattctgtccattcatgacagatattgattgaccttgtgttagacaaagaaccagacatgttcaatagggagaaaatcctacacttcaatttcaatactccatttattcccagacctttacatgctgttatcaaaagacagttggctttggagccaaagacccctaaaagactacgggcaggttattgaaattctcaaggctttggtcacttcattgtaactttgttcttagaaaatttaattaaaaggtgaaattaagtgcaataaagtaggtaacacaaccattaattccttttccttgttctattcctaaattaagccctatcaatattaaagtgaatgctttaccttctgggtcaagccaagataaagcaattaggcaagaaagtactccacatcacttttgcaaatagttctatggtgtatcctctttggatgctcagcttaaatcccacaccagctgaacagaatttcttatctctttcgaaatccttaatattaattgttggaaatacttattttatgctaactaggggttgcccttagttctcattttctagttgattttcatgggaataagttttattttcacagataaaccataagatccttgagattaggaatctcatatctctacatccatctaatctttatctatctatctatctatctatctatctatctatctatctatctagttttgtataggaaacattgattcagacagtgccttcttagaatgcaggttgtgggaggaggcaatcaatatttctgaggaactgaatattactgccactagcttcaaagtctttttttcatgtatatgctaaattccaaatacttaaaaattaatgcacattaatatcctccagtatgatcaaattcagtgattcatgaaatgcaatcttctagttattaccatgttgaatcctcatataacctcaaagggaataaaaaactaaaaatacaacaaagcccagtggtgcccaatcagtaaacctaatgttagtatctatttagagttttgtatttaaagaaactaaatcatgggcaatatataaagttttagaaattttaaaaaactttgtgtatctgatgtcatattaaatttatattgaataatcacttttgttgtttcatttatctagccaatgcagaagttttaagcaagaaaaaaaagtcacattgaaaatatcaagaaggttgtagctgtaggctgagaagtataaatatataaggatgtcagttgctaaaaggtatgagtttcaagtattctgtctttactttcattttatatagctctggtcaatttcacagccccaaccagtactgaacagggaaattggaaaactgcagaattgatttgcagaagtgaagttctattttcttttacaccttcttcatcagagttgctatcattcttgtgttgtgtggtattattgagagtagcctgggtatagctgataattgctaaaagtcattctcttgaaatgaaagcagaaaaaaacaaggagccttcaatttctcattttccaaatttgatgctttcataatccttcatttttgctagaatttaaacgtaaaaacttttcttctctcaagcaaccatgattatagcaattctctttgcttgtgattcctaggtaaaaaaaaatattaaaataataaagctctaagtgtctaatttgaactaaatataggaccttcaaatattctggttcagtttttcagtttccatccttaattgattttactttaaactttaaatataggagtaaattgcaatatagtacttaataccttaagatgaaaactggtttacttttgctgctctttccagatgtgcagtagattcaggaggtttttactaaaattcaaattagaggtgtttgaaaacaaagctgtaacctttggctatttagtatcaatcctgaaaaggaatctccccagtattcttacagatcattgagaaagaattgttgtggtacaactgactgaatttcgagatcctcctacatattctgtgttttttaaaaatgcattttagtgatgattaaatctttactatgtaatgccatctgcccagtagaatggagtccatttacagtgtcatataaatggcaactttttacctataattttttttctatttatttttagattggcttttgttctttgtattctgctgcatctccaatttataaatctttgtgggtcaaagaatcagaacactgtcttctcactaatcaaacaatattgtcaagtctgtttgttactaagttgagaattgaatttttaaaaaattggccaagtttcttaaggcttaaatagatagatggctacaaaacaacaacaaagcacaaacaaaactcctctattttaacagatttgaaaaggttgccagataaaatacagaacacccaattaaatttaaatttcagataaacaacaaatgatatttcagtttaaatatttctcaaataatgcatgccctgtatttttatttgcaatatcgtcagatgttgtcaaaccctaaggattaacgccatttttttcctcaatactaaccatattgtcataaagtgctaccattttaataaattagaaagcaacatcataaaaacgaaaaaataaagttatgagtaaccaaaattaagtcaatttcatctatccagaaacgtgcatacaggacattcacaaagaagaaattataagtgcatatgtatatgcagaaaccccagtcatgaggaaacaccacttcctgttaacttgcatgggattatagtattttaagttctaaatttctcagcagacctagaagacagaactgaattgtttttcataattatttctctttctcaatcacaatttaaattccaagatcctttctttatcaagaagttcaacggtttgatcttttcagtgctagaaaagttatgcacacgggctaactatatgtctactagaaattcttcccattcgctgatacttccttacattttaacatctagaaatagcattcccaatgttagctcatttgcaccttacatttatttttaaaatatgaaacatctataatgtgccaggcaccccgttagatgttagaaacacaagatgagtaaataaaaattcgtcaacagtaaaattttgattttctttccaaaaggttgcagcctatgaaatccatggagtacggattactattacttcacgttacagatgaaggatctaagcgctcaggggttgaaaggtcttatgtcagttctcacatatagtgactaaagagccagggcttcagtaatcatccctggctccgggctcagggcattccggtattttttcaaaggaaattccggaatacttagtattgtatcccctccatttcccaagagcaaaaagtaaagcatcttggatccccttgtaatgttcacgtgaggaacaggtgttctctgggtgtgctagaaaagcaaggcaccagtgggagttgaagatcctaagcagccgctgtaaccagaccaagttaatctgtggaaaccagagcacccggccaaggcgatgctatttcaattgggtgtcataggtgactcatcagagacgccttgcttttgggccttgtgatatttttcttcagggtgggacgtcagatttcctttgcatttttggacaacagccctcctgtccatttccacatttttctggttttacagctctcacgcagagcttgatttcataccggaagctagtcactggcaggaagtttacggaagaagaaaaaggtaaaaaaatgtgccgggggccaggagagaggcctaaaatggggaaattcgcacttgaagagctttccctaccccagcccctcagaatgacagttctcctccgccagaagactacctctcccggcaggcactgcgcgctcgacggccacaggctggccagctccctgctctccacctccatccgaatcagccaataggaattcccggcttgggcctccgcccgacccggaccacgcgggagccggggcaatcaaactacatttcccgacacgcatgtgctcgcgtcgtggccaatcagcgccaggaattcggaggctaggggtggagccagatgcacaggacaccccattggccaggggaagcttagaagagccggaacccgggagctagagaagcgaaatgacatttcctttttaaatagctggagtcggggccccatcgagaaatggccgcgtcggcaggtgggtcgtgtggtggccagggcggcgtggagggaggtgagggggaaggtgggccggggccggccacaggcagtgggatgaggacgtagcggtgcggagctagagggaaggatgaagcggtggaggggaatgagaagagggaggatgaatggtgcggagggcggtgggcggtccggcgggaccgggatggggaggctgggtacccgccggcgctgcgccccaggaggcagcgggaggcggcttgagggggcaccggcggccgccgttgttcgagcttccctcgtgaggctctgccctcggctctcggcggagtccgcgcagacgcctctcctgggctgcgagcgcgtttcctccgcgagcacgggtgccgggctcgccgggctccgcaggagcaggctggcctttgaacttgttccgccgatcgcgctccgccctctgtctcccagatccttaactcgcggtcccacgaggtcgtgcgtatatccacagacatttgtatatatcttgtagggggaaaaagcctagcaagcagacacacaaacagaaaaatcccgcgatgccgtaactggctcggcacttcttgtagttgtacgatttttctcctcctagatttaagtaagtcttccccaacaccgaatgggattccatcttcagacccagccagcgatgccatggaccccttccatgcttgcagtattcttaagcaactcaaaacaatgtacgatgaaggacagttgacagacattgtagtggaagtggatcacgggaaaacattttcctgtcatagaaacgttcttgctgcaatcagcccttacttcaggtatgatgatggtaggaacttctgttggtatctgcaccaagctccctttccccctcagtattgtccacttgatgtttatattgagatgcgataatgaaatgaaaccaatgactttgtttcttgagactagaaaacaagtcctctcttaactaagaccttcttttgacttgagggattcttctagatttcgggtgattgctttttaagttagtgggcctgtgtgtgtgtgtttgaggtaaatgaccagaaaatctagacttgtgctggtcagtatggaagccagtagccatgtgtggctgtttaaacttaaattataagttaaataaaataaaacatttagttccccaggtacactaaatactttttgagtgcttgctggtcacctgcagctagtggctgccatattgggcagcacagaaatacagcattttcatcattgacaattttattggacagtgctgatctagaatttctttcaaaaagttatccataatgcatgtttctttagtgtatgggactcttttataaaatagtttaaaacatgtagcatgttccttcaaaaacaaattaccactcaatagattgtttaaatgctatgggggtcaaagcaagaatgaatatagtttctttgtgcctaaggccccaaattaataatatccaagatttctagaagtatgttaaacgaagtttttgtttttacttatattgtctactataaaacttttaaaagtaaaatttaaaaacttgggtctgaaaaataacttcctactttaagatgagtggaaaaggcagttttctgcatgggcttaacttcttttgtgtcaaatgctcactttaagcctttcagtattcacaagtggtgcataaataatagtaaagttatcaaccacactctgaatgtgatttttccttttgaaggtgcttacctttatagggcacataaccatataatgttccaacagtagtttctggttcctctttctcagaatactgggttaaatatagtcacttcagtctgatgcttgtgatgtaaccgtttagacttgcctagggtaggtcattggactactaagtattaatcatcgcaagacagtgagctggaaagaaaaaaaaactcacatatgcagaaggtatgaagtttggcctggtaatggaaacttctagtgagattcacttacccagattatctattagatatggttaggtcatttgtatgtttaaatatatgtcacagttactacttatcaagctctaggctaagcttactttacatgtattgccttatataatctttataatcctatctctgcatagttgttgttccattttacttatgaagaagctgaggctcagtgagattgagttttaataacctgcctaaatcatctatccaacaagtaaatggcagaggctacatttgattacagagccaggcttcttagtagccatatgactcttaaggaacaagagttggtacagtttcctttaaaacatttttattgtatattgcatttgaatagtaaaaacaaaaacaaaacaaaacaaaacaaaaactgcaaagtaaaaatgtctatatcttactgaaatttaataatctggattatatcatttaaatgtcatacttatgtatgcttactaagtatacttattaagtataatacttagtaagcatacataataaatatgatatatgtatacatattaagtatacttattaagtataatacttagtaagtatacttattagtaactttacataagtatgacattttcaccttgcagtttcattttttatttttgaagacctggaaaaaaattttactttaaaagaagtatgctatgatagatttctaattttcttgattccttaaaatcttaaattctttaattttgttaagtcaatttttaaaaggagtaaaaaatacttgagaaattttctggggatacgatatgtgcattgaaataaagatatttggctagaaacctcaaggattagaatttgatctcttgctagaggtttttgtactgaagtttcttggtaccagcgctgcttcctgtgtgggatgtagaaaatcgtacttaatgtttctacgtcttgcatcactagtggaagaattagaacggctggaaatctggaatggctgtttcatgataccagtaactcatcagaattgaaatttgtatgattattagaaattttttgctgctctggattttgtgtgaggaagtgccctggcttcatttatgttgagtttacatgaagaacttactagaacagaggaaaactcatgaagtgtgagaccactcctgtgtgtaagatgagcctattcaagtcagcagtagttcccatgataaagggatatgtggtaatgtcttcctttgggagttaatgtctccctaatgcagggctttatttttctttttaattggtagctgtatcggtgagtctttcagcacctgaattgaaaaccagcacatacgtaggaacatctagtttttagtcatcaaaaaagccagtgtgatactaaattaaaatgtacattgtagaagtaaaaacaggactcgaagatgattaacctgggcagcaagttgagtccttgtacctccagtgtttctcatactgcattttaaaattaattccatgaatttgagagatattttttaagtgactggaaatctttgcaattcatttttcataagatcacaaaaattaaataggatgagtctggatcatctagaatgaaactttaaaggagcgaaaagaaaggcaaatgatgtttgcaagtgactaatacttaaagagccaggctgcttaatgtttcggtcaagaaaatcccataaatgcaacaatattttaataatagaaaaaaccaacttggtctcgaaggtaaaagtttggggttttaaaaaccattatcttcaaagaatcagttaactattaaactctgtttaaaacaggcattatgtattgactctaccataatctttatttatgtctagatttaggtaggtaaaatatggtatctttgagaaaatgaagtatttccttttaagcaaatgttctcaaaatttccaagggtaagtgaagtgattattatattacttataatggttaaggcagcattcaaaagatgacagttttaaaaaggagtaggtggagaatatgtacttttaaagaacttcttgcttttctaagatgaacattttaaagatatattttggatacaagttgccttgtaattttcaccaggacatgaaaagtttttattaggttgtttctttgtatgctaatgtatcatgttgatacctttataggtattcttttttttttttttttttttttgagatggagtctcactctgtcttccaggctggcactcagctcactgcaacctccgccttccgggttcaagcgattctcctgcctcagcctcctgagtagctgggattacagggatgtgccaccacgcccagctaattttttattttagtagagatggggtttcaccgtcttggccaggcagattttgaactcctgaccttatgtgatccacccactttggcctcctaaagtgctggaattacaggcatgagccaccacaccgggccagtattcttaagctttctgactggcatggcccaatttaagatctgatgtccctaaggcaacttgaccagaactctggataggggcttctaggaaaataaagtgacctggaatatgtgtgtcaccttttgatttgcatttacttaggtgtactctccttttttcatagttggcacacagcgagctagccctgagaatatgggttttgaggttagccagactaaatccttctgatacattatcaatttttactcctattcagaatatcagggactattttaggaaatattctgtttcaaaaggttatctttgtggtaactttgtacttttaaaatcttgccacaataattttgatttatagcacacgtgtaatattaaccactctttccttcttagatccatgttcactagcggccttacagaaagtactcaaaaagaagttcgaatagttggtgttgaagctgaatcgatggatttagtgttgaactatgcctacacttccagagttattcttacagaggccaatgttcaagccttgttcactgcagctagcatcttccagattccttccatccaagaccaatgtgctaagtatatgatcagtcatttggacccacagaattctattggggtctttatctttgctgatcattatggtcatcaggaactcggagatcgatcaaaagaatacattcgtaaaaagtttctgtgtgtcaccaaagaacaagagtttctccagttgacaaaagaccaactgataagtatactagacagtgacgatttaaatgtagaccgagaagagcatgtttatgaaagcattataaggtggtttgagcatgaacagaatgaaagagaagtgcaccttccagaaatttttgctaaatgcatacgttttcctctgatggaagatacctttatagagaaaattccacctcagtttgcacaggctatagccaaaagctgtgtagaaaagggaccatccaacaccaatggctgtacacagaggcttggaatgactgcttctgaaatgatcatatgttttgatgctgcccacaaacactcaggaaagaagcaaacagtgccttgtctagatatagtcacaggaagggtgtttaaactatgcaaaccaccaaatgacctgagagaagttgggattcttgtatcaccagataatgacatttacattgcaggagggtacaggccaagcagcagtgaggtctccatcgaccataaggcagaaaatgatttctggatgtatgatcattccaccaatagatggctatccaaaccatccttgcttcgagccagaataggctgcaaacttgtctattgctgtggtaaaatgtatgcaatcggaggtcgtgtttatgaaggtgatgggagaaactcactaaaatctgttgagtgctacgacagtagagagaattgttggacgactgtttgcgcgatgccagttgcaatggaatttcataatgctgtggagtacaaagagaagatctatgttttacagggtaggtgcctaagtgatttagtttttcatggaagggtaacacatcaagtggtggtttacttaattatactgaaacagttgtgttcccgttaattgaggaatacctccagcttccttatcaaactattggaacagtctgttctgtaaagagctataaagaaaataaactcttgaattaaaaaaaggcaggtattgttaaattactaaaataatcctataatttttaatgattttgtgtcttgatatcatgtagaataactatttttgaaaacattctttaataaataatagttcggcattttgggataactatttcagagtagtttgtaggacttgaaataaatagcaaggttgttacatggctgtttttgctcttgagtaaaattgagatgttgtagcaactggtattctgtggaatttactggattagtttaaaagagaaaagaacaaagcattaattaagttatactatttagttaccaaagagttttatataagccttattattgcaaaaattatgaaatttaattacaaagagtttggaagtatggtcttcaagtttcaccttcactgctgtttatgttgcctttcataatacattttcaatttttttcaccggaaaactttgagatgtcccttttttttggtttgccattttaagtgggactatctgatatatgtagtgtttgttttgttttgttttctgtttgtttttttaactgttaaggactactactttggcaaaaatacagtagaggtagagtgactgagtcagagtaaataagacatttgattcaaggctctgatttgtgataactattttccttttatttggtttcttacacattttagttgcttgaatgtttaatgcagtgtagataatagcaacatccttattcctcgtatgtgtctcttaattgatgtttttctcacactactacttaaggaaaaggagcagcttctatgaagatatacagtcatgtgccatgtaatgttttggtcaatgatggatcacatacacaatggtggtcctataagattatgatagcatatttttactgtacttgttccatgtttagatatgtttagatacaaaaatgcttcccattgtgttacagttgcctagagtactcagtacagtcacatgctgtacagttttgtagcctaggtgtgtagtaagctcccatctaggtttgtgtaagtatgctctatgatgttcttcccacaaggacaactatcacttaatgatgcatttctcagaatatgtccctgtcattaattgatgcatgactgcccttatcccattgttttctttctttcttctttcccctcccccttccccttcccttcttttctttcatttctttctttctctttttttttttgaggcagggtctcactctgtcacccaggctggagtgcagtggcatgatcttggctgacttcaacctccgcctcctgggttcacatgattcttccacctcagtctcaggcatctgccaccatgcctggctaatttttttatttttggtagagtcggcgtttcactatgttgaccaggctggtcttgaactcctgacctgcagtgatccacccaccttggcctcccaccattgttttcttttaaaaattgtgttccttgctctaatcctttatttaactaaaaatttcctagtaatatctgagctcatttgtttaagttcagtgtcaagttaattcctcagaaggagttgtactctctggttccttattttagttaaatagaagcacaggccatgatttgggtttgctgtcttgtggaaaaatggaatataagaatggatgtatgatccgtccagtatacttggataggttatgtcatccagtatgatgaagctgtctgtgtatgtgtgtattttggtcttactgcctaactgttagttggtagaggtagaattagattcctatttggaatgtgaagtttgtatattaatgcaaatactaaagcaaactagcaatgaattaatagaatttcagggctggaattattaacatcatttaatttgaggttatattttatataagaggactctgaagccctaagggtttcttaattgcatattattagctttaacttttattaaagagtactttagattttaacattcaacttctttggtgtgtcgtctttactttcttatctataagaaatttatagagaagtagcacacattacaaagtttaaatttcctaccttatttatcgagaatcctgttacaagttaggcaataagggcagatgatgtgcgagcaaatctgggagctttacaagctattttaagttagttgaaggcaaagcatcactgttacgaagtacgtagttgaatttgtagataagagtaaccctagttcaaaacagttttcaaggggaagctcaatttagaatctggtatttctaatctaaacaaagcctctttacataaataaacctgacatgcatagtcagaagcttatgttgtactatctgtggctattgaagtatcatttaatctgttcataaagtgttcagatttttattacaaagattttaaacaaatgctataattagcaaaactattgtaaatcttcactactttaattctttcagacattttcatattggcagtctgactcagcatacctttttattatcaaatcaaaatagaaactgactcaaagtcaacatcacaaaccatgtatgtgttttctatcttattaaagtcatgttttctcctgctgaatatttctctttgcattatagcaacattcaggtaagcacatcagtgacccataagcataaatctgcacaattccatctgctgtcttctaattaaatagcatacacatttatcatggcatatttatgatgatgttacatgtatgcattttggtcttactggctgaacgttactaataatgcttttttagagctagagtaaaatgaattttctataaacacacaaattggatagagcaaatagaatcaagtttgtgtttttttttttttttttgagatggagtctcacattgttacccaggctggagtgcagtggcgtgatcttggctcactgcatccttcacctcctgggttcaagtgattctcctgccttagcctcctgagtagctggaattacaggtgcctgccaccacacctggctaatttttgtatttttaatggagatggggtttcaccatgttggccaggctggtctcaaactcctgacctcaagtaatccacccgtctcagcctcccaaagtgctgggattacaggcgtgagccactgtgcctggccagaatcaagctcttaacaattctgccatcaagcccaagtaactccttgtaccttcccaatacaaacctcccaattcaggttgattataatattatctgttatattgtgtcatggaatgacaaagttttaaggtattttgtaacccatatgaatgtatctctggagattataaaagaaatgttttagaaagtgaaatatatagcaaattatgccctttaatctttagaggttgtagttacaacatataaccaaaaaccaaacataaaaatttacatattcttgttttcttttttttttttttaggagaattttttctcttctatgagcctcaaaaagactactggggtttcttaacccccatgactgtgcctagaatccagggcttagcagctgtatacaaggactctatctactacatagctggaacctgtggaaatcatcaacgtatgtttactgtagaagcctatgatattgagctaaataaatggactcgtaagaaagactttccatgtgatcagtccataaatccataccttaaactggtacttttccagaacaaactccatttatttgttcgagctactcaagtgactgttgaagaacacgtcttcagaaccagcagaaaaaattccctttaccaatatgatgacattgctgaccagtggatgaaagtgtatgagaccccagatcggctctgggaccttggccggcattttgaatgtgctgttgctaaactgtatcctcagtgtcttcagaaagtactctaaatgagtagcaggccttagtgcatcactggcatctcattcttaggaaacttgtctttgatacaaaagagtgctgacagtatttcagaaagctgagagagttttatacatggaaaatgggtatgcttaaagattgcagggtagggagggattttccttcatccttgtgacatttcatttcagtaaggaaaagataacaaagtgcaattatcagcatttttttttcctggcataaaattaatcatttcattttataattttgtgataaatagtaactgaggtaccagatgaatcaggacaactatgcactcttataagagcatttagggtattattgggtaaagacgtctaaacttgtttgatgtgacttttaattttaaatacgggtaacaatctgaggcaatatcactaggactttagctgtgacctctctaacacagagaagcactaacttagatcctcattcttaatatttatatgtatctatttttgtgtactgttttcaagtgtactgagatttaaatgtgttctattattagagtagatcgaagaaaaaattagtctcagaaagagcttttagtctgattgtttccatttcccatgtaattttaagttaagctaaagttttaaagtggcagttttctgtcgatgactttttcaagtgctaacactgtctcttttgtgaaaatctggaaaagtgctcatattcacaggtggctggtgctagtctaacttaattcatgtgtataactagatggatttaaatggtctgagcctatgcctatctttcaaattggtgtggatttcatggccatagtactttacctgttgaactcttgtgatttcacaagattctctacttatgtgataggagggtatggccagttattcatctaactggactcaatcttagaatagtaggaacattatacccagtttgcactaacatgggccatttgtagcccaaccttctcttccatctacctgtccattcattattggtacaaggaaaggtaacttatttctcttctgcacagagcataatgtgaagttttatacctacttttaaaattctgctttccagaaacaaaattcctgcagtggtctaatttaatgtctttaagtttcatattacaattaaaacctcattttttttttccatttttgcacttaacagtgatgaatacttttacgttggaatcctccttctagctgaaggtgattgaaaaggaaaagagtgagtgaacagaaccatagctttctaggtactaaagcattttttgcatttaactgatgaaatttctaacaatcatcagttaggaatattaacatgaaggataaaccaacttatttgtatacctaaggcaggcatttggatcagtaacatgttttactaagcctagagtaattcgtaaagggtataagcataggacagattttgccctcaatcacaatatttgtattcacttgaaagcaaactggcatggttcgtattttaaaaatcttgcacaaattgtaatgtgatactgtgaaacaaattgaaaacattgcctctttgcatcacatacctcgtttttcagaaactttccaaactgctttacatagacctctacaagtagggaatgttttctgaagcagaagttaaaatggacagcatttctagaattaacattttaaaatctagtcttagctagatatgtggtttcttcttattggtgttgatagtatgtctgtaatctctgtataaactttgtcaacatttttacctccccagttttatcttctgttttgtttttgtttttatcatcatgatgttttggagttattactgtgtattttagaaatcattctttacagttttgcattgctgaggagagagaaaaaacaatttttttgcaagagatgttcatgtaatttatttttgaaagctttgttgaataagatttcctgccgctttttgacaatcttgtgtatttagaaaaatgtattacttgaaaacatgacatagaacattgagttagcaatttacatgggctgtatgttatataagagaatgacatactgtggctaattcaacagtagatttattcttttagcctgcacaacagttgatcttttggctatgacaatttgtatggagggtacgatctaagttaagtgtgtcaaaagcaaggcttaggatttgttatgggagtagaatatatattgaattttgtatgaagaactatttgtttaaattatatagctgggatattttgccactgttaaaatggattcagaagaggtcctagaaaagtaagattagtgacatgtgtgggtttatatttagatatttaaggtgcattttcatagtgtggtaagaccttaagtaaaaggcacaatgggtactacagaattaaaatgtaggtctaacataatgccagttccactttaactttgtttttgcatttgaagaatgtatgtagcactttcctatatatttgtcacacattgaaaactggactgggtataactatgttataggaaagtagaaattgtattctttattttccatctttgttttctgttctacaaagttgatgcttaagcatcaagctgattttattggtcatgagaacaaatggatgtgatcatgaaggaatcagattccctatgtaaagcagtttaaaatggaattcaatgttcagtgctcaggtatgtagtaagtactgtagtcctgtgggggcaaatgtgtagatatttttaaacattttgccataattgcacaattttttgcatttttacctgatgtcattgtttcttataataaaaccttttctgattgaaaacttccagtgttgcaaagtgatatctgactagtgagtgttgcagaattaaaatctggtaaaaaatcatgaaataccttatgtcatgatagaatggaatgagattttaatctattgaatacctgtcctctggtaaaaaatgaactactttatgtatataatactttttaaattctaaagcaagttagttcacttatattggtaaattctttgttctgtttgttctggcctaaaatcttgttatgtttgactcttttgtgttggtccactttgcattaccgtaaaggaatacctgagattgaggcctcaggaggctttagctcatggcagagggtgaagcgggagcaggaaagagagggagccagagaaagttgggggaggttcctgtctctttaacaatgggatctcacatgcgctcattaccatagggagggcaccaagccattgatgaagaatccacccccatgatccaaataccttccactaggccccacttcttccaacactggggatcacatttcgacatgagatttggaggggacaaatgcccacactatataatctcttacgtatttcatgtttaattcatcagaaagtcccgttgcttcttccttcataatacatccagactcagaccacataccatttgcaccactgtcaccctagtctaagccagcttatcttatctgacttaatgcagtttccactgactggtcttccttctatcacccttgacccctcataacctattcttttctccacacagtactcagagtgatcctcttaaaacacaagtcagatcatgtttctcttctgctcagatccttccaatggcttcccatctcccttcatatgacagccaaactccatacttacatgatccacccctctcaaacttgttgccatttacttggcttgctctattttagccacactgaccttgcttgttgctcaaacctgctgagcacctccacagcgactttgcccttgctgtctcttttgctggatagatcttgacaactcactcactttcttttttattaaaacatcaccttactggagaggccttctctgatcacattttgtaaaataagatcatccaaccccacccccatcatacctcctgctttatttttctgctttattttccatatgtgtcttcccccattgaaatgtacactccacaaaggcaacgaatttattttaattcactgttgcactttagattgatgcctagcacatagtaggcactcaatgaatgcttgtgggaagaaatgaattttcagttaagtcttggagcctaaaggattaccaattttattggtcttttcaaaaaaaaaaaaaaccaggtttagttctaatgaattttctctattgttttgtgttttcggtttcattgatttctgttctaatttttatagttttttttcttctggttgctttaagtattaataactcatctttctatttcttttcttttttttgagacagggccttactctgcccaggctggagtgcagtgacgcaatcttggctcactgcagtcacctccacggctcaagagatcctcccacctcagcctcctgagtagctgggactacaggcgcacgccactgtgaccagctaattttcattttttttttttttttttttttttttttttgttaatacggggtttcaccatgttgcccaagctgatctcaaactcctgggctcaagtgttctgcctgcctcagtcttccaaagtgctgggattataggcatgagccactgtgactggccttcttttcctaatatatgcatttaatgctataaattttcctttaagtatttcttttgtagaatcccacaaattttatttagtattttcattttcttagtacaaaatatttttatcatgtcttcttggggaatataccctttcataattatgtaattgcttctctttatccttgataatcttttttctgaagtcttctctgtttgaaattaacatagccactcaagttttcttttaattactgtttgcttcatttatctttctccatcccttctcttttaacctatcctaatctttatacttaaaagggctttcttgtagacaacttacagttgggacttattttaatatccattgtgagaatactggtatgtttagaccagcattgcatttaaagtgagtactgatatagttgggttaatatttaacatattggttattgttttctatttgttgcccttcttctttgtttctttttttcacctattttcctgctttctctggttttgactgagcattttatataggattctattttatctcctcttagcacttcaattatactttaatttttttttcagtggttgcattagacttacaatatacatttcaaaactaatctaagtccacctttaaataacactatactgcttcgtgtgtagtgtaggtatcttagaacaaagttcccaattttcccctctgatccctcatgacattgctgtcattcattttagttatccatatgctataaccatgcaatacattgttatgattaaagtcatacttttagatcaattgatatttaaaaaataagatattttacttcatcttcacttattccttcagtattcatttatttaggcagatctaagtttctgttctgtttcaattttcttctgcccaaataacttcttttattgggcattgcttgcaagacagatctgcaggtcatgaattccttcagatttttgtttgaaaaagtctttatttctcatgtttcaaggataattttgctggatctagaatgctaggttagtgggtgttttgcttcaactttgtaaagtgagtagcttctaattaaatatcagtggtttggtgggcctgtgtcttggggctgtgatcttcacaggtgtttctctagtggtacagcttttggttttcccctctccatcctctttctggctgtgccattcccaattttatttctttgaagccctgacccatgttgattaaatcctttttcctttaggtgagaagagaaggttagagaggtttgggatgggaggaatgctcttccccctgcttttgttgaactctgccaaaatgtttttccgtggagagtatgctttttaaatggaaaaggttctgggtgtatttcatgatcattactcttcctgtcccctagtcagagccactaggaggtttgtctcagatctttgccatgagaacctggtagagtgcctgttggtaaaatccacagaagcgtaggggccccaaaagactgaagttcccaggagttttccactttcatgggagtccatgttcagcctcagcgattcatcaaaaatgaccatttaagtgttcttacagtttacggctctggttacttctggtcaaggttagcagatctggactgtgactctgaattcacctctaatccagggtaacatttgccctgcagcctaatttctctgatggatctaataaaagtcattgattgtcagtttgaatacctttttcttccaaggttaggaatgacaacatccaggatctttacattttcagtgctaaatgtggaatcccctataataagcttctaatacatatttttgattgaatgattcttcagttatgcataaatatcttatgccatcttttatatgtataatgttttttaacaattaaaaaataagctaaaaagtctcacttttaaaaacctatatacttaatcatatttaggtatcttttatttataatttatacggccatgggattatttgacatgtagttcagtgaatgttgactcttgagtacctaataatccatatttcttgcaccaaattaaaattatataagttaaaaaaatcaatcattttaagactttttttcccaggctactaaaactaaatagaaaattacaatgtaataattttaaattatccttatcatggatagacagaacattttctattggctagttttttagaaatgagatttaatagatcctttttctcctttctttcctcttccataaggatatgcacaattatatgatttggtgaatcaaacactataatattaagtaaaacgtggaatatattttctaaatattttatattggtctggtcaacatgaattatagtgttttccgtgaccgcaggtagattacttaccttttctagctttactttttcatgcataaaacaggttaataatctaccacgttatcgagtttttttgaggatcaaataagcatgtgaaacacttatcacagtgccttatcacagcacataatgaacacttcctaaatattaatttgttgaaattattaacgactattctgcagtcttttagatatacttaaccattgtagaacaatattccttaatagctaatataaagtatatattaaagtgtagccatttggactctgattgtgctcataagccatgcatgaaaacaatttttacagttttacagtcacacagttctcactttcatttctggactgtgcatttctaaaggactgaaattaaaccaatggtatttaaaataatttaaacaaggcttgtaacctctgtctgcaaaataaaaataatgctttttggcttgtctatttttacaaactgacaagggcctgtccttagagtttatcttgttctctgttcccattcagagataaggacctgtcctagtcagttcaggctgccataacaaattgccataggctgcatggcttaaataacaaacatctatttctcccagtcccggagtctggaagtttaagatcaaggtgctggcagatcctgtgtctggtgagggccctcttctcatcgcatcctctcatggtgaagagcagagaaagagaaagataaagcaagctctctagtgtctttttataaaggtactaatcccagatccctcatgacctaaccacccgcaacggccctacctcctaataccatcacattgggggttaggattccagcacatgaatttggcggaattggcagaaacattcagttcacagcaggatttaacagagttgcggtcacatagttcagttcttgaaacacatgcttgcaaaatcctttaaggataagaagataaggtcaaaacatcttatcccaacacttagattacgatgtcaagtagccaaagttaagtcttgaggagcaaatgccaacaggaacccacacaacgcaggggagtatttccttgtaatcagtgagaacctgagatagtaagaaatccatggtgctctctgacaactgttcttaaagctcaagagcttggtcaaggttagcgatggaacttaggagtctggcatatccacagagctggttttagttgaatttgagttaatggatgagttagtgcaaagataaattgtaaaatgagaagcgaaagtagctaagaataaaatttaagaaattcagctgaaggaacagaagaaaggcaactgaaaagttatcagagaagaagggagaatcacaaaggagtagtaatgcatgagaaaacttcaggaatgagatccaaagagaagaaatgaaatgcagagagtaagaggctcctggtctagccatgtgaagatctgaaatgagaaagtggttttagccaagtgcaagagatgaaaaccaattgctgtgaattaaggtgcaggtggaggatgtgagtgggtgtcagtgggtgagagtgcaggtgcttccccaggaagcctgcaggtgaggagattctgagacgtggaggtgctggagaaataatatttttttaaaaatcagaacatttaggccttttcaataaaaatgggaaatgagaaatatccttgcaaaaagtcaaaatcttttccatttctagactattcccggttgagagttctgcagtatacccgttaaccccaaaagttaaagagattagggatatgcaaaaacatgcaaagaggcaggactgatgaaagacaaacccctagaaataggagcagagtgaaaaaagagaaaatcctgacccagagagaggtagacacactttctatagcctcttacatttctgaaaaagaatgaaaatagtaagagtttttgcaacttcttgctactttgccccagagccaaatatggttcccacccctgacccaaaacatctggtttgtgataagggctcaattatcctgtgctttctaaagtatgtggtgggtgtggtgatggcaggagtcaacaggcagaagaatggatgagctaatcagagcatgcatacgtgaaagtaaagaggacaagggtcctctcacttggtgtttgtgtagctggagatgacagggagatgacacctatcactcaggggcctgccccagtgagtggggagtttcatggatctcacctcaagttgtacaagtatatgtcctggggcaattttgattcacaatttataaaatcatggtaggattttataattttattttataactttaccctatagctgcaggcagaaaaaagaggagagtaattttgatatgtgtatataggcttttttttcactttatatgaattgtttattcatatcttttcctcatttttcctttttaaaatttcatttaagttccgggatacacgaggtttttatattcatatataaatgtgatacacagcaaaatacttgcatcagtatctgtgtatccttcttgaaggtttctaagaaattggttataattttctttttaatctacattttactattccaaaaattaaaatgctatccacactttactgggcactgacctgtgtgaggttgatttccatggtagcatgaaaaaatatatctatcctgttttgcatgacaaaacatatctatcatacttacatatatgataacaacgacccatgtgaaaaataatatctatgagacactgactaatatcttattcttgcatatcactttctagtttttgaaatgctttggtatctgttatctttttggttcctactaccggtgctgcagccatctgtcattgtcccccttttacttttgaagaaacaaagaaacagaaaaggagttgttaaacttagggatcaaacttagctgtaaatgaaagcagacctgttaatttcctcccactccctagtgagcagggacccaggaagatggcccgaatggttatattcaaaggcagaacgtggaggtgctgggactgcagaccttcttgctggtcaaggagccagtttgggatgtaaagtgagtgagttcacttttggaagagctgagtttcaagtgacagaggatcactatgtatagattactgtgccgagaaacagccaggatgggtgtggagacaggaaactgaatgaaggtgataggtcaggcgaagatgtggagttggcagtcacccaaataccggtcagcgctcaaggcacttacagagggaacgagaagagcccgggtgagagccaagcgtcggagggcccacgtgaggacttaaggaaggggaagagagcatttcaaagagccaaggacagagaggtcctgggagaagcaggagcatagccttgagaaaggaaagaggctgcatgtgaagggaaaacttggtgttcagaatgaagacggctcctgaaaactcagttcaaccttttgttcatcaaatgttcactgttaagtgcaggttttaaatttggactctgaaaaatggtttcttcatatagaatagtgatatgaatgatttcattcactggaacatctcaccgcctaaccagtgactcagaggaactttcctctgttaatgagtgtggccttcctctccgctcacccttctgcaccttgacacgggacactgctcctcttctgtgtctgagtctgcttggatttgaagctccccaagggcaaggaccctttatctcgagtgtgtactgagcgcggatcatggtgcttgacagacaggggtccctcaaccaattcaaggaacaatggcatgaatatcccgcttctgctttccggcggtttagttttcctctctgggactctctgactccatatttcccgttgtttggaaagatacatttgcaggcttagccgtgattggcaaacatttttatatggggcttggcattttaacatctggaaaagttgtgaaatcaattagctgcagataaagatggacagatggaaatatctggtggttttctgcacatcggctatgcaaataatcagaccattgcttattgtgctacacttggactctgttttaccagattttaggaagagtattgttttttgttttggagcatgagcactcagtcaggacatagaaataccatctcctactgaaaaggggactgggtgtaaacgtggagtatttatcagtgtggagttttcatacacttttccgacaggcttatcaaatctctctggaaaatttaggtttttgtttcattcaaacaatgatgcagttgcattgattctattctatcatgtatgtatggtggaggagggcaaagaaagataaaattaacagactggagaaggggatgagaactaggcgcttgaaagggaattgttaaacttgctggatcaaactttgctttagcttaaatgaaaagagacattttatcaatttcctgtgagtggggacccaaaaggatggcctgattggttatattcaaaataatgaaattatttcccctcctacatctgagttacaatattaaagctttgcaacctgctttgtgctgcatatatatcctttagattcctagatgggcttccacatgtgattaaaaatgctcattcccctcccttccctcatctctgctaatatatattgaagccactgtgccattgctttctagcagccagtgctactacggataagttgcaggttattctgtttccctgacctttgtaaatttcctctctctttttctttttttctggaatcttatagaatcttctattttcctttatattctgaaatttcacaatatatgcctaggtttatggatttttcatgtgatatactggcactgggaaattctcctgtcatttatttgataatttattcccctgtgttcttgcttgctttctttctgaaattcctattagatattgaatttcttagatatgtttgttctcgtatttctctgtttctcaatctctttctactttctagaagattttcttgattgaagttttcaactcttctaataactcagctactgttttttttttgatttgcaagaagttgtttttgttttatgattattctttttatggcaatctaataaatattcttttcttatgcataaaatattttcttgtatttctctgagaatcctgttttccaacattttatcatatcaaatttcaaacacaaaaatgttaaagaattgcatagtaaatatcaatatacttatgacctatatcccataattacatgctgcaatttttatatatttatttaatcacatatccatctattcaatgaataatctttaaaagatttctgtttcttgtgctctggattgtctccatttttttcaagattcatttcttttattgtttatttctttcttatcttccaggctgatctcatctgtctgagttcctagttacccactcacatttaagagtaaaatcctaaaactcctgaccatgcccaccaagctttgaggaaaagaagtggatccctgactgctaccattcagtgtgtcaggaaggtggaggagaatggattgtctcttctctgtatagatcttcaatcctgtcctgtgttcagtctcattcctcaccaatgccttctgccttccttggcacttttggtcccagggtctccaggatttggtggagtgaatcagctttcttctcattcatagccccctgtgtactcttcaggtacgggttcttccaatctgctaaagctactcctccattttgttctcctatcttgccaaatttggttgaaatattttcacagttgtcccctatcacaatttttcttgtgcatttatggtatgtgtgtatata

SEQ ID NO: 190 - DNA, 139732 bp, Homo sapiens
accgccactacgacgggccgctgacggccatctggcgcgcgggcgagccctatgcgggcccgcaggtgttccgctgcgctgcggcgcggggcagcgagctctgccagacggcgctgagcctgcacggccgcttccggctgctgggcaacccgcgccgcaacgacctctcgctgcgcgtcgagcgcctcgccctggctgacgaccgccgctacttctgccgcgtcgagttcgccggcgacgtccatgaccgctacgagagccgccacggcgtccggctgcacgtgacaggcgaggcggcgtgggagcgggtccccggcctcccttcccgccctcccgcctgccccgccccaagggctacgtgggtgccaggcgctgtgctgagccaggaagggcaacgagacccagccctctcctctaccccagggatctcacacctgggggtagtttaggaccacctgggagcttgacacaaatgcagaatccaggtcccaggaagggctgaggtgggcccgggaataggcattgccgtgactctcgtagagtgactgtccccagtggctctcagacgaagaggcgagaaagacaagtgaatggcaatcctaaatatgccaagaggtgcaatgtggtgtgtgctaccagcccggaaagacactcgcagcccctctacccaggggtgcacagacagcccaccaagtagtgcctagcactttgccagaccctgatatacaaagatgcctgaaccagggtcccgtccctagagcagtggctctccactctagcccccaccctgctctgcgacaataatggccacttagcatttgctagggagccgggacctagtccaagcacccacaagcatgaatttgccaaatcttttcagcaacctcttaaggcaactgctatcatgatcctcactttacacatggagaagcagaagcagagatgatagaatctttcgcccaaggccacatctgtattgggacgggggcagcctggcacccaagtgcccattcctcccttctgaccagcccccacccctccggctctggcgtccaaagggctaaggggaggggtgcccttgtgacagtcacccgccttctcccctgcagccgcgccgcggatcgtcaacatctcggtgctgcccagtccggctcacgccttccgcgcgctctgcactgccgaaggggagccgccgcccgccctcgcctggtccggcccggccctgggcaacagcttggcagccgtgcggagcccgcgtgagggtcacggccacctagtgaccgccgaactgcccgcactgacccatgacggccgctacacgtgtacggccgccaacagcctgggccgctccgaggccagcgtctacctgttccgcttccatggcgccagcggggcctcgacggtcgccctcctgctcggcgctctcggcttcaaggcgctgctgctgctcggggtcctggccgcccgcgctgcccgccgccgcccaggtgggtgcgccccagacacgggtggccgcgaggggccgggccggggctctctgctcttagataagaccacctggctgaccccctggcactgccagaatgtcggtttttttgccctatgcatcgtggcgctttcctctctttgcatgaagcccagcaggtgtaaccagcacgaaaaaatcccattttgcaataaggaagctgaggctcagagaggttaagtaacctgccttttgatagcagcacagagatatagagacccagacccggttaactctagagccgtccctttgctaccacccggtaaacgattcctctggaggggctctgactacagaccttcctaaatagcaccgttcctgaggacctactatgtgctgtgtgggtgctaggaatacactgatgaatatggcatggtcccctgccctgcagtgcgtgctgagcggtagacagatcattgcaatgtgctatgagaagggctctcctcaaccctacctctgcagaagccagaggaaggtatgcctccctctggtggggcatctggagaaggcttcacacaagccgtgctgggagagctaaataaaaatatgtaagtaggcatgagctaggaaaacaaggagaaacgctcttcctagcagagatcatggtggattgactaacagggtgtcctgagattgccactcctgctgtctctgatctggatcagaaatctgccctgtgccccagagagggagggagcttcttggagcccctcagaacccccaggtccatagcactaggctcacactctagtgagatcagactttgtcacagtggccctggctgctgctgtggccacaatggctttcttgcccgtttcttggaactcatcaagtgttttgtgctcagggtgctcagaagaacggactttttactggattgctcctcagtccacccctctcctcactaactccccagcagggttccatggcacagcttcacaccctgctagtctgctgtttgcttcaaaaacagtggtttcctcgagaccccttccacatggcatgggtgggggtgggcgcacaggctgcagactgcggtggagattcatgcctgctctcttgctgtccctcccacagagcatctggacaccccggacaccccaccacggtaagtgagctccccgcctccaccctaccctaccccacccacctagtcctcatcacccagggggtccaggcaggagaaggaataaatggcaaagggctggggctggggtcctactttgaccaggggctgggccttccttgcagcccaccaaggcacccctcttgcagcctgccaaggtcttccctggacagaccaagcctcgctgacctgctcctcccccacgactccaggctgtgtttcttcctgtagtttcccctccacattcttgaacaggcagattcatacaaaaaccacattggggacactcatccccgttcccccctggcactctgctgaaggctttgcaaacaaaatctctagaggttctgagagcctaggtgaggggcccagagacccctaggaaatcactgactcctgggtcatactctcctcttctgtggcatccacccatgtgaaggctggtgttgaaggagaaagaactcaattcatagaccctgtacaggctgggcctgatcctggcagagggtaggagtgggaggaggagcctaggcactcccataactccacccacctgtgccctgaaggctggaggtgccacactgctggtggccccactcatcagctgcctgccgatctctccacagtcccacaacctgtcctgtgtccctgtttgctgatttactgtcgcaccaacgcccctgaatctgaaagccgaccgttgttcagtcatttaacaaatacttattgagtacctactgcataccaggcactggtactaaagacacagcaagatccctgacctcacagaactcatatcctattgtggagaattttaataaatatggaaacacgccacctgacatcgtaaagtaagagctgtgaaggaaatggacacgtgatgcagcagattccctggggagggggcccgctgctgggctgaggctgctttagatcaagttctcttggaggacatgacattgaggggacctgaggatggaggctggggcctgggcaggtaggagcggtggagttccagagagcaagccccactagagtgtggacgtaagacagggacagtaggggcagcccgggagaggaaaaggcaagtagaaagactcaggtgaggcccagaaaggaggcaggcatttctggagggtggacgggaggaaggcaggaaaggcgtgggggttattgtgggtgcaatgggaagtcactgaatggttttaagcggacgcatggctccatcagaacaagctggcccaggagacttggttgcaggccgttggcaaggctgaggctggcttggctgtttggacaaaggtgcaggggtggcggtggggaagtgggtagacgggaggcagggcttgcccaagagcccagtgggcagcacacagtgtgagagggagccaggctgccggggttgggagcctgagccctgggtcccacttcctgagataaagacaagaggagaagagagtggggcgggtgtgagggtcatgcgtagcacagtggacattgagatttgagattcccactgagatgtcctaggggaagtcaggaaagcagttggggaccaggaggccaggccggagattccgatttgtaggtcagggacatggagccagtcttgaggcctcagacagagatagcaactctatggtctgggctgccctggcctttgggggcccctccctattcctgactctgcccagcctccgatgccattcatctctgagccctgccggttccagccgcactgctccccagaatgtctcctcttcttggcccactgctggcatatagtttgggcagttgtggacctcccacctgtttggatgatcattcaactttctcctgtccacaggtcccaggcccaggagtccaattatgaaaatttgagccagatgaacccccggagcccaccagccaccatgtgctcaccgtgaggagtccctcagccaccaacatccatttcagcactgtaaagaacaaaggccagtgcgaggcttggctggcacagccagtcctggttctcgggcaccttggcagcccccagctgggtggctcctcccctgctcaaggtcaagaccctgctcaaggaggctcatctggcctcctatgtggacaaccatttcggagctccctgatatttttgccagcatttcgtaaatgtgcatacgtctgtgtgtgtgtgtgtgtgtgagagagagagagagagagtacacgcattagcttgagcgtgaaacttccagaaatgttcccttgccctttcttacctagaacacctgctatagtaaagcagacaggaaactgtttacagggcctggaggcccagtcttgtcctcctctgtcaccgacttgctgtgtggacctgggacactctcttcacttctctgggtctcaattcatttactgttgaacacggacaatcatattcttccctcctggctgggaggactacaaagatctgaggaaataatggatatgaaggggctttggaaagtacaaagccatcttctcatgaggggcatgacagaaccctctttgcagagtgacctttggacgtgcagtcagttcttggagaagtgtggcccctgcagcagtgtcacggagaacacagagttccagagagcaagcctggggcaggggctgtgcaaacgtgtggtcagaggaacatcaaatcctggaaacttggtggcagggagaggcctggggcctttaccccatgccccctgggatctccactgtgactgtcccacaccctctgcccaactcttgccccatcagctgccctgcattgccttgagctgggacccctaggaaatggaaaccaggctcccctctctcaaggtatctgggaaccactgtctcaggagctgaagccgggagacctgaggggaggtctggccggagagtccgtgcgtaaagcagctacagctctgacctctctgacctgcagcctctcagggcgtgcgaagtccaaacgcactggcaacttcaccccctttgccctaacgcgggcaggctgacttggaggggtgcttccctatttacacctcagggtgaatttgttgatcaccttagctcctgtggtccttggggcttagggagaggagggaggcatgcctgggtcccaggtaagctggcaagaggaaagggccacaggctaggggaataacgaggccatgaacaagacatctcaccccagttacaatggcttttatccaaaagacaggcaatgacaaatgctgatgagaaagtggagaaagaggaatccccatatactattggtgggaatgtaaattagtatagccactatggagaacagtacagtttcctcaaaaaactaaaaataggctgggcgtggtggctcatgcctgtaatcccagcaccctgggaggccgaggcaggtggatcacttgaggtcaggagttcgagaccagcctagctaacatggtaaaactctgtctctactaaaaatacaaaaattagctgggcgtgctggcacgtgcctatagtcccagcaacttgggaggctgaggcagaagtattgcttgaacccaggaggcagaggttgcagtgagctgagatcaccccactgtcctccagcctgggcaacagagagactgtctccaaagaaaaaaaaagaaatagaactaccatatgatccagtaatcccactgctgggtatctgtcagcaaggaaatcagtatattgaaaagataccagtactcccatgtttactgcagcactatttgcaatagccaagatatggaatcagcctaagtgtccatccacgaatgaatgaagaaaatgaacacacaatgaaatattcagccataaaaaaaaaaaatgaaatcctgtcgcttgcaacaacatggatggaactggcagccattatgttaagggaaataagtcaagcacagaaagataaatatcgcatgttcgcactcacatgtggaagctaaaaaaagttgaaattgaactcatggagtaatagaataatggttaccaggggctgggaaggatagcagggagcgggcgataacgtggggatacttactgagaacaaaatactgttagaacgaataagatctagtatttgctagcacaagagggcgactatagttaacaacttattgtatattttaaaataactaagagtggaattggaatgttcttaacggtaagtacttgaggtgatggatacgccaatccctgatttgatcattgcacattgtatgcctgaatcaaaacatcacatgtaccctataaatatataaatacatatacccatactaattaaaaatgttttttaaaaaagaggcagtgatgctttttccagggagacggtctgaaggtcaagggatcttcacaagatcttcacaagttattatgcaggccagtgggttgcaaagctccactcctcaccagagccttcaccagggcaagaggtggctcctaattaaccttgggattcatccaggagcctgtctgagctgttaagaggtcacaggagcaggcttgtgtacctccttgtatggggatgctttggggcacctctatggaaagtcctgcatgaccagggaagaagttaaggacacaggagtggtgtgtattggaacatctgcctggtctttgaggccagtttcacagccaagaaaaattgcaataggaattatttcttaagtatctgctttgtgctctatcacctcaataccattaccacatttgagatcattaacatgaatgcagtatcattttacagtccgtattcagatttccacgactgtcttcaaaatgtccttttgaagtttgttgtttctaagcaggaagcagttgactccaggtgattcttaagctaacggttgagactgcagctctgggtgcacctggcattggcatgatggtgcagatgtgtaacggtgccaggtaatcagctggtgctagctgatacatacccttctgcggtacttgcattttgaagagggcttcttgggactggaagaagcgccattcctcagagagacatgcctctgttggcatggtttcagatgcagtgagaggctgtgggaagcatgttgaggagggtcggccagctggcaccccctttaacaacggcacacagtgcacaggcagcccccagcttggcctcctgataaagccgctgctcctagggtcagaggggagggtggtgaggggacagcactcggccctccccagaccctctgggctgctcttggagcctggcactgtccctgtaagaggtctgggtggagcagagctgcctgtcttcccccacccaccctctcagagtactcaggctctgtcactggcaacaaagaccagagacacgagcggcaggctgagtcagcatggtgtcctgcggcacggagtcaaggagagaaatgacccagaagactcggtgttttcaagattggacttcctgttgtagtgcagggcacagcgttccatgaacatgctcttcccaggggcttctgacaggcaggctgcggcctgcaggctttgctctgtggtcaatgcccaccagactttgaagacagcagtgagaggaagtggccggcaactacctgggtgatctcctgggtccaccaggagcccaacacactttccctgctgccaactgaaatttaaaactagatgtagctacgtgagaagaaaccacccaggggataatctatggtgaaagtaggccctgccttgagatggaaatgagttggctggagacaccatgggctgagttttcacttgtacctcactggtcagacaggacaagagagccagggtcagggtgggtgcttggtcccccaccagtcacagaagcctcaggctggaaggctctttagacaagagtcaagcgtccgggttttgtcccggctccagtgctggccactaaagtccagtcccaccccctcttcaataacagcccctcatgtttctgggccccctgtgatcctcaaagccctgtaagatcccagtggaggtcaggggcggtggctcatacctgtatcactttgggaggccgaggtgggcggatcacctgaagtcaggagttcaagaccagcctggccaacaaggcgaaaccccgcctctactagaaatacaaaaactagccaggcatggtggcaggtgcctgtaatcccagctactcgggagggtgaggcacaaaaattgcttgaacccaggaggtgaaggttgcagtgggccgagatcgcgccactgcactccagcctaggcaacaagagcaaaactccctctcaaaaaaaaaaaaaaaaaaaaaaaaaagatctcgggggttctaagagcccagcaggtaagactggaattatactcattttaaaatgaggaaaagcccccagggaggaaagagatcttgttaccagaaaggggtcccgatccagacactaagacagggttcttggacctcgagcaagaaagaattcagggtgagtccacagtgcaaagcaaaatcaagtttaagaaagtaaaagagtaagaaaatggctactccataggcagagcagccccgagggctgctggttgcccttttttttggttatttcttgattatatgctaaacaaggggtggcaaagaaagaccaagagagaaaagggctgtcttcagaagagaagcattttcggagaaagatcgtttctttcagagggtccccacaaagatgcccactggtctggagacagctaacttggctgctgcactagaaggaagtgagacaacctgcctctaggccactttccaacccttcaatcttgtggttccatctggtttaaaaagctgccaagcttagacaagggtgagggagacataccccactcccagaaaggcctgtccctaaggaatcccaaattggtttaattctcaaatggaatgtgcagacccttctccacaccttggcccattcaaagtgcatcttacaaatgtgagtgaaaaataacactaaagagaactccctgggcatcccaccactgaaggtggatttccccagcagaccatgaccaagctggggttacactgccagaagcacccccactcccacctcatttgtgcaatttttatggccctgctcttaccaagctcaaggccacatcacagaccctcctgacctctctgagatcagcaggtggcctcctgtccctgccaattctgaaattctcaagttaaaacttctctttgaaattagaggcctcgcccatcgtggtgaaaggtcacaaaataactattctatccattacgaagtttctcatataaaatttttcttattgtggtttaatgtatgaaaagactgtcaaccaacttgcaggaaacaatgagacaggcccgccatgtgtaaattaaattcgaatctagtttatttgcagaattttacttaaccagttgtcatttcttcctgtttctcaccattatataaaaacttaccctttgtacaagtatgaaaaatgtggaacaatgaataagtagtgaatattgcacatttaatgtccaaaataaagttgtggtttttaaaggtcacactagatatgtgggaagaaaacgagttgaacacacttaagtatgtgtctccacataagtgattttaaactattgaaagaaaaataaattctatcagtgctcaatgagagacagtacatctgtacattaaaaaataaaagttataatcaacaacattccttcgcaatttcattatcccaaaagaggatcagtagtataattatttttttttcaagttattttcatcaggaatcaggaacctaccagagtgaaggaaacctcaaatacagctactcctggacactgatgcccgaggcatgctgtggaaaccggaccaaaatgaagtctgcgttagtaagtctagaactttacccagcacaacccagacacaaatggaagatggtagaaggggatactttcttttaatcaacacacttatttcccaacattatattctccattttgcttaataagacaaagttaactgatcagaaaaatgatcagctactatctcaaaatgagctgtacagttggcccaaaatgaagagcaggcagtagtagaggattaagggcaaagtgccttgttgttaggcctgtcatgaagatgtggggtgagatctgtcttgggcaacaactgatattaagctgaggtctgcagtctcaacttgccactagcttaatgtgcctcccatggggcacagctactgaaagctgatgctgcccaagcatttagggagataattatgccacttggaccacactggtgcgactctaaccccagggctggggccagaatgaggtaaaggaggcaccacgggggtaaacccaaggaagcactctcttggcacctgcaagcaagcaccaacttaaatgtatgccccaggtgcctcatttgtctcaccctagccctggccctgctaatccggggcacaccccttttaggataacacggactaatttggacactttccccaaaccgtagcccagttagacatgatggtggaaaaggtctaactaaagacattgcaggggagatgggcgcggtggctcacgcctgtaatcccagcactctgggaggccggggcgggcggaccacaaggtcaggagtttgaaaccagcttgtctcaatggctgggtgaaaccctgtctctactaaaaaatacaaaaattagccgggcgtggtggcatgcacctgtagtcctggctccttgggaggctgaggcagaatagcttgaacccaggaggcggaggttgcagtgagccgagaccatgccattgcactccagcctgggtgacagatgagactcgtctcaaaaaaaaaaaaaaaaaaaagacattgggggatttagcttggatttagcctaagaggtgaggggtggggtggaagtggtgttagacatgtgatgaaaactgaaaatatctaaaggtctgcctcaaggaggggcaagtgaacagccccagcctgaactgctctggacagaaccacgaccaataggcaacgtagaaacatcttggttcaatagaaagcagaactacagagcctgcggatggcagcctaggcctgcccatcacaggctggaccaccaggcactggacaggggcagaggagaggcaggaggatccctgcagagtgagaggggcactagatgaacgtgaatgacccttctgactgtaaaagtctacgattccaggacatttgcttcctgctccagaagaaagaatttcaggaataaaaactcagtgaaaaagtatatatcaccttcatttgaaaggaacgaggacatgaacactcttggcttgtatgacatgtacacactgattttgatgatgaactgagaggaaccaggaggccgtcacttggttgaaaggaagttaggctggtctatgggttttcattttctggactaggctttccccaacctcaaagaagtgagagacgcaggcacacaaccccagtggggcagaggcatgcgatgtctgagccaacaaaggatggtgagactgagaaatgagtcacgccttggagctgaggtcccgagtgtgcaggaaggagctttggaaacatgtacaggtgggtcccgaatccactgctactgtcatgctatgtagacagttgtgtagacacatctggcaggacctccctccctctatgtctggtgtgttccagcattctgcccttcacttgttctattaataggcagtgggacaacatgattccgggatgcagcctgcctctgcaacccacctgtgcactgcagcatggggagtgatggagagggagagagatgtttttcatggcaaccagaatcctgcctcctcctgctcccaggaagctgttagacatctttatttggtcccgatgccactgttggccaccctgtggtgaagtctggagcctgcagccgttcgccctccacgctgctcagtccacagggccttggtcttgcttgattcccgtcttgatgtgcggcacccatcactgattctgaaaccacagccccgtgctctctggaggccaacaattttttcaagccaaggctcattacccctgcaagccaacaggcgggctggtctctctgccgcccttctttcccaggaggctacagcagcatggccatgtctgaactagctcagtgtctttatagcacgttcctagcccagagtttcccatagacacctaggagttgagtcaaccttccaaggttaagcaagaaagagttaaagaggaagcgctttcactgaccatctctgattattaatgaagttcaatgtcaaataaattaaatgacatcaggcataaaaacctacagcaactttaacagctgaaacactttacaagatagtgtgatatccctataatttggtttttaaacagttacaaccaaagataaatgattttattttttataatttttacagaccaaaaaacattatacagattaatcataattttctttaaaatgtgcatactgtcactcaaaaatttcacatcctaggatatcagtaattatatcctcctcaaagaaaacacaaaatatttccaaacaaaaatcgctgttgccagatcagactattaaattgtccacagcttctcaaattttcttatacagagaacaagatgattaattttgaaaacggagagaagcaaaaataagaaaagctgagacagatccctctgagacggacattttgtggcctgtaaaactcaagagactaaacagggatgttctttatcagagctgcaaagcgtgtctttaaggcagaatcgttctgtccaagtaaagaaattcaaagtaaagaaaagctcctaccaacttcccaattttgggggaagcattccaaaaggacatttgaggagagattagcactctgttaactatattcctatacccctataaacattcttggtggctgtttagacatttttaggtaaatattctcaggctacagactacccatacacaaagacatattaagccagctatgcaggcaaaatccatctagagctgatagaatgaggaacgtgggaacagaagtcaaactgctcattcccaggagaaataacatgagcaagaagatggccacagaacaaggcaaagttacacacaggctttggtaatgaatgaactgtcaacaacagaaggcacgtggctatggaaaaaaagccaaatttcagtagatctcccgacctgacccagtttccacagacaagtgtttcagcaggtccattggcttcatctgagtttgaagttaaaaaacaagcagggaacagagaatcaggtcttcagtctccctcagtctctgtctcctgacactgagcctttcagatatcgaacatggtgtctatcaaagggtgcaaacttaggtgtcgacaggggcaagtgatgtgaatgaggctagggtcagggcccgagggaatgcacagactctcccgactagagagaggcagccctgtctgcactcctcaccaagtggaccaaacaaaacatctgtgcaaaacatgctcctcccagactgccagcttgccatcctgattcagacaggcagcttctccatgaggatacacggctggatggaaattgacttgtcatcatctctactgcccactataatcacgatcaagtggtcgtattttacacatgacccactttaactaactcggcatttttatctcccttctgagaaaaacaatactttaaaactattgtatttgtccacatttgagaaatgcagaaatttttcaaaattgacttctttactttggaggaacacaaatggggtttaaaagtaagggtactgagtgacttccaaggttgtcagatctggaacatttacataaaacagagacagaagtggaaacatacaaagaactccatctggaggtcttgtgagatgactgggacattcggcaactgtgagtggctctgcacccaagtggaacttagtaagtttctcttgtggataaatataaaaacttaaagagtccccagaaggtcttaagagctaagaaaacacacacacacacacacacacaccccaaaattatctaatatctaacgcctcccaacttgcatctcagtcaactacacattggccaaactgagctctacagtgcaattgagcaaagttacttgtgcaacagcaaagttaaatgtaaacataaacagcaatgggtttttcaagagcctcagtgttaactatcgtatgtggtccaaataatgcacttctggatacagacagttaacgagaagagccaagaagcttttcccatcttgaaggcaatggccaggatgccttataaattgggtggcttgcaatatttgatcctggtattcaacatactgcttacttgatgccatggattcaagagcattcagagcctaaaagacacggaagatgagagggttaactccatagaggcacataatgtgactgccagaggtacagcacacccattatcactgtgtacttcaactgtgagccttgtgggaaggaggcctacagaactgaggccaggagtccggaaggcaggcattgattaacttaaccacaaccagaaggaggccagcagcccaagcctctgtggcctttgcagcatcccacacccagccttccctgtttctgttctgtgccatttcccaaccttgccttaccaagagccactgctgtggcaggctgctcttgttgctgggcgcctcacctgccacaccgatttctaaagcctgccttgtcctcgttctccccagtcccacctgtggggtcctccccaccagattgtccactccttccgttctagggcgcaaccggaaatcccaggcaccagcctcatcttgctaaggtgaaatctgttcaatctgctgttgggtatgttcctaggttatgagataatgttatatgaaactgtctaacggaaaggaattctagaggaaccagttgctaagtgctgccaagagtaagtgagaaggttgttaaatcagccaacaagcatgaagtacataggttcctcccgaatccatctgacaaatgacacaaaatcatggcagaaactgtttccatgcctctcttcagaggaaggaaagaaaagcattctttgactccagaattttgattattcctttcttcatagtaggagaagagaaggggaagagactgtatatggagaaaacaaaaaatcaacaatggctcttgatttttggggtgaggagttttgttttccaacttaacaagctcatccaccccaggattctgacggtgttcccctcctcactggggcacatcccccaccatggagtgccccactccctccttgtcccttttacagaaaccactgcactagaaaatatgtattaaaagatggaatgtgcttgattcaaaaaccataagagaggggatttttttgaggatgataaataaaccagaattttagaaattaactaccaggagggctgtagatggaagtctttgggctgaaaataaactgaaggtatctgggtaccaaattaagagctatgtaaacagagttcaatttaagaataggaatcaactgggacaggcattcccatgaatcacagtgtccctctgtctctctccctctcttttccttctttaaatttagtcccccaaacagtctactttgacagtttgcctaacgataatcattttctaaaaagacaactttcttcaaatctgaaaatcctgatgacaagtatgtatgggacatacagggagtcatcactttaagtccaaagaaatgaaggcaaagaggccaggcctgggcagcccagggccccagctaaagcaagaaactgatgctgcaggtactggtggccacaggagacgtagtcttctcaaatacaccctgcatctcactgacttcacaacctgccctcaggatattcatctgcccactgggatgtttcatgtaagacaataggggattcaaacagcagctgtctaggcaatgagtgacaactatcagctattttataagcccagatccctgtggagaacctgctaatctgctaattattctgtctgatccttgctcttaataaccaagatctgacattgcatgtggctggcttagacatgacaaagttgccccagcagaggagctaaggtgttcaagctctgagcacttacagagacagccctgcagagcagggaatgggagaggcctggagccagactggccagtgcgacttccagccccaacacttactaggtgtgtaatttgggacaaattacttagcctttctctctctctctctctttcctcatccaaaaaaccaggataataatagttcccagctggatgcagtggctcatgcctgtaataccaacacttgggaggctgaggctaagaggaacgcttgaagccaggagtttgagaccaacctcagcaacaaagcgagacccagtctctacaaaaaaaatttttaattagccaggagtggcaatgcatgcctgtagtcctaactacttgggaggctgaggtgggaggattgcttgagcacaggagttcaaggctgcagtgagatatgatcacaccattgcactcctgcctgggcaacagaataaaaccctgtcttaaaaaataaagtcgtttctgtgctatagcattgctatgaggattaaatgagttaaagctttaactcactaatattggtcgagttaaaacttataatagtacctggcacagagggagtactcacgaatgctgatcatcattttttactgtgcacctttgtacctggccagcatgtccataggttataggaatgtggccttccatgtttttagaagaagctataatttctagctaccattctgtccatgttaggttattctagcatcagccaacaatagtcaaccttcagactcacaaaacaggaactactttctcggttccaagctaaagctcagctaatttccatccatcccaactgtagccacatcttctgtgcgagatcccagtccccagctccagcccctgccccagcccaagcatgtggtagataagtgcatattcacacttatcagaaccaaatttaatgctagacagacttttcgtttggccttacttttctacaatgacagtagcagcgatctagacaactgcctacaaaaatttggaggttggcacatgaaaccattttcccgtaagtagggcacatgaaagggaacactgtgctaccaccacagagcatcatgtcatgacgcgcacaggctacggctgccacctccctgccttctagggaagatgtgcaggcaaacttctaacccttcattgtatatactgacctgctgagctttgggggtcagatgtaattcagagccaggcctcaaacggatctgatcttccataggaacctgaactgaaaggaaggcagccatgcttcgggcaaccactcggaaccttaggcattagggagaggtcagaagaagtaaatggctattaaagtaagcattttgaaataaacaccatattttctatgacataaaaagatgaacacatttccagatctactgtgttgttcaccttctcaggaaaatcttaaatatgatcaagaagaagttttatccattatcaccatccaaacaatatatgtataattcagattcaagaatgaaagtgttggcaaagatgtggagtaactggaacccttgcacattgctggtgggaatgtaaatggtgcaggcactagggaaaagagtttggcagttcctcaacaagtgaagcatagagttaccataggacccagcaattctgctcctaggtatacacaaaaaactaaaaacagatgttctaacaaaaactggtatacaaatgctcatagcagcattatctgcaatagccaaaaggttgaaacaatccaaatgtccatcagctaatgaatggataaacaaaatgtggaatacaaaggaatattattcagccataaaaacaaacgaagtatggatacatgctacaacataaatgaaccttgaaaactttatgttaagtgaaaaaagtccaacataaggggccacacattatatgattccatttatatgaaatgtccaaaataggattcaatacataaagtcataatgtcaattagtggttactagagacacggggattaaagggaatggaggtgactacttaatgagtgtagggcttccttttggagtgatgaaaatgttctgaagctagattgtggtgatggctacaacaacattgtcaatgttctaaatgtcactgaattgtgcatataaaaatggttaccatggaaagttttaagttatgtgtattttatcacaattaaaaagaataaaagacgcaagccaaatttaagtaaaacaaaatctcgcagtcctgctatcttccaccgcaaacaaaaaaacatgacgttaactggtttggaatgagtgagtcccaaagttacaacatcacaatgggctattccacaagaatgctgacatcatcaagtttgcaaactcttttcaacactgacaagggcttgaaaaggaaaccatgatgtaagtaagtattatgagagaaaacaggagctaatggcaaattcttccatgccttgggattttttgcaacaaaaatccagacttgcttctcattacttatccttcttaccaacaggccttttattcattttttctgtttttttgagacagagtcttgctctgttggccaggctggagtgcaatggtgtgatctcggctgactgcaacctctgcctcctgggtttaagcaattctcctgcctcagcctcctgagtagctgggactacaggtgcttgccaccacacccagctaatttttatatttgtgtttatttatttatttatttatttatttttagacagggtctgactctgtcacctaggctggagtgcagtggcataatttcagctcactgaaacctctgtctcccgggttcaagcgattctcccacctcagcctccagagtagctgggactacaggcatgtatcaccatgcccggctaatttctgtattttttggtagaaacggggtttcaccatgttggccaggctggtctcgaactcctgacctcaagtgatctgcctgccttggcctcccaaagtgctgggattacaagtgtgagccaccgcgcctggccaccaacagatcttaacccagcttgacgactttacagttcactagactgagtccctcacaggttctggatttccctgaacgcctcaagtgcccagctgacttggcttttaaactatgctcgcataccgtccatgactagctcaaaaccaaaaagaaatcagtagtgcagttaggttacaaagtccaaacacaacaggagatactattaaaaatactgtttgaattgaaaattttttttaaaggtaagaaaaaataaaaatgctttttagaatgtaaagatgtaatcaggctctgttttttttttctttttttttttccattaatctttctggagaacctagatcctaagtcgaaaaacctactgaagtatatcacaacctgtaagtaggtacagatgtctgaggcctatttagaacaacagtgttagaaaggcgcttccttacctgttagacaaaggcgacttccggccaaacccaattgcccccaggatcccagagctgagtctctcctcagccacgaggttctgcctgctctgaaccaagagcagaattcgaatgacagattctgtcaggacggagtcattctgctctgtctgaatgagggagagctgaaggacttggtgccaccacaaaaacagctttgcctcttcctccacggagctaggggaggcaccggaggaaaataaaattagaagtaaatttttcccactcccatttaactgcaagtccacatcagagtttgaaggataggagacattcagtacttcaaaagcacaggctaacggctgatgttaatagagccatgggattgtaaccaccgccatctgtggaacacctactacacgccactgtgatgaacttcgtgttcttccacttcatcctcatgacagccctatcaggtagggattactatctccacttaactggtaaggaaactgatgcttggtgtttcaaagtgccagttttaggaaacaaaaaatctgctcagaagattagcctattaattaagaatctttccaaaacaactgtcaccataccttaaaaccttattttttatgcacctcttggttctgtgtacttaaagctagacttaagctctaaattccaagttaaccaaatacagcaagtttgatgtaacagcctgagggccaacgtaccttgggtacacctgttccagccacttgcttaagatgagcagcactttcatttcattccttaaagtctgttcgctgtttaaacactgaagcaagtagacgtaaagagtcaagtaactgcccaaggtgaggcactcctgcaggaactcttccatggtgagctcgggaacctgaagggataccagaatgggtccccatcctgaattctgattgagagggcctaagaacatgaagaagagacatcaagatataggcaagaatccaattacttgacaactctagcaaatattttcactttaagcttcatgatttttttttttgacatagcaacctatgagataataagcttcatgtcaagacaacctttcttacagtgaccttggaggctacaaaagtcaaatatacctcagggctcagactggatagccctcaggccagatgcctgtccccagcgtagccaccagaaaggtttaagaaatcagaattcagggctgcatacgtataaatcacctttctatcacattatgatccttaaaaccacatgtagacactgcctgtcctggtcagttaagaattttaactttaataccctttttaagaacatatgaacacttatgctttccgacgggaaactgttatcactcaatctgtgagtagttttacttatcaaagcttagtttaactcatgtattgaaactgtttgatttttagtaacacacatgagtttggaatagcagtgttatcctaatggttctccactctttgggggagcgagggtggggtggcatggtgacatgcacaccacctccatgggtgggcatgtgctgttcatgggtggtcaggacagggcagatggcaggttgtgggcacttcctggatccttgctccgataccctccttctcactactgcttctctcccactgactgcagtgtgatgtgttatctggatatcagagttgagaagtgctgttctcagcaattcttaatcagactaagccgcttccagagtctgacagtttagaggtagaaagtaaaacagatttttaaaaaggaggggtgacaatgaatgagcccttcataatgctttaaaaggtctgataagcagcaattttaaaaacttctatgaaaactccttttaccaaaagtgacaaaaacagggaaaattaacctcatggactatgattatatagatcctggtatatagcatttgttctgaggactatgacttggcctgtgacacaacacaatttgcatatcataacaggttggtctgaccctccaaaactaacgtgaagtggattagagcttttctcccttgaaatgtgattgtaccaacagacatggccacaggttctcatgctaactgcagatctttatgaaaaatacgtatattcagaaacatccacaacatttgtagagcagaaaattagaatggcaaatccctcactgggaagagtctggaaacatatctgctgatgacaatgctttcatctttctggaaaagaccaatacaatggagcgtaagatgacctcctcttactttctttgaagtaggcagtgatgcaggcttctgtagtctcagccatgtggcggacggacgccaggctctggcaggctgctgttaaaaggggcagcaccaccagcccatgcattttttggccaatccaggtccggatactgccccgaaggaactctgctgttggaatagtcgcgttgttcatcatcatcaggacttccataaagaggctgctgagggccatgtggcgggtctggctgtccatgtctgaaaggaatatagacacactcaagaatggctgccagaaaggtactatccatgtgatcaggagaataacagtgcttcaatcttagctgttctccaggcagattttacagtgctagtagctgactgcaagggactggaaggaaggctctggatggtgttaagtttgtacaggtagtatgcggcacacggttactaagagtaaaagcaggaactactgtgagttccctgggtacagcagcatagcagagcaatacttaataaatagacaaatctgaagctggtgtgaaagagtaacttatcagaacatgcctagtcagtctttattttccaacctttgctcatggaaaaccaaatacgtagatctcaccagtcattcagtaaaccaagtagcaaaagtacccactgtcactgccaccgctgtcaatattctagggtgatttacacacattaaaggttattacttaaaactaaatataaatgtaaggaaaaacctttgtaaagtgtcctaacagcagctcttttatttctttgttttttaaataaggaaagtaaaccaactggtaatttttcaaaaaaaattggaggtaaagagagaggaattcaagaaaaagaacgaattcattttacaagagaactgcaaatcttcacattcaaaaacagaaaatatattttactgagagttaaatggaataatttttgccaactcttctagctctcctcaagctgtagctttcacaccacaaggattcagtatttatgtcaataggaagggtaaaaagttgagagatcttactcatcgcatctatcaaaacaaattcatctacttatgcagggttaaataaaccctcacttaatctttctgtacgacctacttactatcaagcaaggacttaaaaaacaagtttgagagagatagtaacagtatatctgtctatttcttcatgtatttctatgggtacaaatattcttggaaataaaggctcatctctgaatttcaacggaatagcaatttaaattttatctcttaattatgactaataggaatagattactacaacagaccctagtctctcccattcctgttcatatcaacagggctctcaaatcttttcctaaataccatatctgatcctatcactcttccgatgaagatctttccagaacacccttctctcctttccctggccagctattattcaaccttcctggttcaatcatatctgaccaactctagaacagtttctccagcattgcttgctgatagtttttttccataagatttattgaatgtggctgacttgccaggctgatgctaaaattttagatattatctcactcaatacttacaatatctacatgaaacaggtatgaccattaacaacatttagcaccgtttcatgtttattggtgatcagtatattttcttttgcagaatgtcgtttcaagggtcttgtccatttttttctactaagttgtctttttcttccttgttttatctggtatgacaatcttagtcattcacagttattataattaattactgatgtagctgggtctaaatctactgtcttcctatatgtatcctatttgtccctcctattctacatttctttttctctcttttgcttcttttagatcattattctactttttccctgttttagcttgaaaactaaatcctctcttaaaattctgacagtggttatcctataaatgaaaacatgcattcctgattttttgaagtctaatgttaattggttcccagatgatgtaatggctttggaacattctaacttcatttctccactgttgccatagcccaacaaaccatttctattattattgtcttatacagtcagatttcatttagatttacccacacatttaccagtttcattgttcttcattcttagtttcttcctatttattttctctttattatttcctcccctctactgtctttgactgtaattttgccgtctttttaaataactgtttaatgcttatctttttaattttcaccttttaaaaaagtctatgatgagcacttaaggccctgaaagtaagtgatacggtttggatctgtgtccccaccaaatctcatgttgaaccgtagtccccaatgttggagcagagtttagtgtgaggtggctgaatatgggggtaggtccttcatgaatggtttagcaccatcctcttggtgctgttctcatactagagttctcagagatgtcgtagtttaaaagtgtgcaacatctccccccttgctcattctctctcttgctccttctctggccatgtggagtgttactctcactctgcgttctgccgtgattgtaagcttccttaggcctctccagaggccgagcagatggcagcaccatgcttcctgtacagcctccagaaccataagccaattaaacctgttttccttataaatcacccagtgttgggtttttctttatagcagtgtgagaacaggctaaaataataagtcccatgttagctgcatcccacaaattttgatgcactgtattttattattcagttgtaagtattttaaatttctattatgattattcctttggccatcagttatttaaaagtttgcttcttaatttccacagtgtttttccctctagttctatttagttactgatttttttttctttgtcatgcaacttcggggcagaaatacacagagatgaacatctggcttttacaaagttttctgccttacagatctatttatctgatattaatatagctatgccagctttctattttaatatttgcctgacataatcatcttgtggaaagctttctatatccttaggcttttgatgtatttcttatcaacagcttaaagctagatgtttttggttattaacctaccttaacaatctttgtcttttaacttaagcattagtccctttaccaatacatttgaattttatcatcttattttggttatttttctcactttctccatgcttcctttcttgccttctttggactgaacatactttggacattcctttttatctccctctactgacttggaaattgtacattttaatttctattcttttggttaatttcttaaaattgttaatattcatactttaatcaaggtataaagttaatctcttgaccactaaacagcagtagaaccttagaacacttttaactcaacctccttcctagcatgctttagtattttctttagtgacacctactgggacaaacactctcagggctcaatgaaagtatggttctttacctcgtcttcatcattaaagggtggcttttcttagtttacaattctaggttatgagtcattttctcatagcacattgaagttgttatcccactgtcttacagattcttttattgatactgagaagtcagctgtcagtctaaatgttgctccttggtaggtaatctgcctttccttcctggatgtaaagggttttgttttgttttgttttttaattttgccactggtacttctgcaggttcactatagtgtatacaggtttgaatttctttccatatatcctacttgggatttgctgggtttactgaatttgaggattgctgtcttcatcagccctgaaaattttcagccttgctatctcttcagatattgcttctccccagttaagtatctcctctccttctggaattctacttggataataggatgtatattaaaccttctcagcctatcctctatgccttttaacctcactttcgtattctttttattttagagatggggtctcactattttgcccagactggagtgcagtggctattcagacacaatcattgcacactgtggcctcgaactcctggccatcagcaatcctcctgcctccgcctccatgcccagctcacttttacgttccttctctgttcctctgtgctgcaatctgagtattttcttcagttttgttttccagtttaccaattttctcttcggatgggtttaatctgttgaacttatccattaactttattataatctttatatttttcatttctaaattatataaatctctcaaatctgcatatttctacaatcccttgcttcttactgatatcttcaatcctctcttatttcagcatataataaaaataacttttttgcttactgtactaattattccactatcttcaatcttttcatttctgacgctgctgttgttttctattactttgctcatggtaccttgtttcctgtgttttgtgactttttttactgtgagtttcttggaactttgaggcatgagttaaagatgcgtttctccaaacaggagctatggttgctttttgccagatgctggtggcaccgccaacccagaactactctaaattcttagattgaggttgttgttattactgctgtttctaccaatctaggtagtctgaattcttgcttcaaaaccacatgagggtcagcttgttatcaattctcaaaacagatatctcttttcctgcataaacatttaacctaacaacgaggccaaaacaggtaactgtctttgccttcctctcacaagaggaggtttacttctagcttatctttacagtaaaaatgtcaccctgtggattatgcatcggatttccttttaggctcccatcttaggcaggccctgggctttaccacctccccctaatatccaaacatattcagcaaaactcttcagggtgacagcagcctcagaactccacctacctttatgggtttctcctttcacttaggttctggcctctgaggttcccttacctttttgccactccactaataaatttaatttccagtttcttaaaaatatttcatccagcacccagttatcttcagcaggagaggcaggcagtatgtctagtccaccaaactgctgggagcagaaggttctccagacacagtttcttgacaagtctacaggtgattctgaagtgccctcccagttaaaagccaaaatccctagaaatgccgctcactgaaaggtctctgatatctcctaatcattagatcccattgtccagcttaaaggtcagtctcgcccaccacccaacagcatctgccagtgtcaatccttccccactgctgagtccctggtgtccaaacacctctctgaccattgcttctctggaaagaggagtgccagtgtcctgaacatcctcctgatctcacagtgccttacgcacagcaggaatgcattgactgaatgaatacaggacttccgactggtcacttaccgggcgggttaaagacaatgatatcgtctaagagcttagacatttcctgttctaggactgctaaggtgatttttccattttgttccagggtgctgaggaattgaaccatctgatgagtaaaagcttggcattttggaactgcatcctgaccaaaaaaaaaaaaaaaaatcattcaaatgaatccaagcaaggagtgttaactgcatatttcctgggagcatggcactgcaatgaatgcttgggtagggagtagaggggacagaacaggaagccacatgaagacttagtcccacgtggcccaaggggcctagtgaaaggcaaatctatggtaacactttgaccagggcccatgttttcccaaattgtggcagaatactcttccttttttactacaagaataacaacattaaccaaacactaactacttgccagaaacttttccaaaaacttttatgttcattatcgaattcaatcctcaaaacaccactttgagacaaggtactatttctttttttttttttttgagatggagtctcactctgttgcccaggctggagtgcagtggtgcgatctcggctcactgcaacctcctcctcctgggttcaagcgattctcctacctcagtctcccgagtagctgggaatacaggcacctgccaccattccccggctaatttttgtatttttagtagagatgggctttcaccatgttggccaggctggtctcgaactcctgacctcaggtgatccgcccaccttggcctcctaaagtgctgggattacaggcgtgagccaccgcacccagcctttgcaaggtactatttctaatcagatgagaaaactgagggacttgccctgtcaagcctaagttcatattaccaacctcccttcctccctgctattctgctgccaatgacattcagatcatgaaaccagcagcttgctggcagccctcaatccttttgacctttcatcgacatgtgacattgctagtaagtaaaagttcacccaaagggagaactcaacccaaaagatctacaaggccaaaagatgagtatatgataatacacatcctccgacttcctctgctgagcacttcctagcttcgactgtcctttgtagcacttatgctgctaccaatctccaggaacagtctctgccttttaaactacctctcaacttacaagatgcttctggctgtcagtaggaatagaaaggcccgcagacacttttaggagcttcatgattaattcagcataagattcttttgccaggatgatggacggcgggtaatggctgctgaaataacttagcacactctggtacgacacaatatccacaagatgccatgaaagtgagcttgtctgtccaaggagactaagtaaaggtgaatcctaaaaataaaacacatattcctttagttccagagccccaatttttccagaaatatgtgttgctaactagtctgtggaataactactaagatggcctatggtaagcacagaacagttatgatatcaagtaagtatctactcgagttaggagtactagtgaaagcaataaccaaacttttggcaaaaacacattcatattaagatgtattgagtatctggaacccaggttcttttctttcaaaagaactccctgttctggtgggacatgccaaaattgacttcaagaagcatacaagagattgaagtagatattaatgagatacaaaataaagttgattaatacattctaactcagtgtggttctttgcataatttagaatcagataatgagctatccaagaaaatcaggcatctggttaaaggtacatctcatatgccaagcatctgttcacactgataggggcactggaaaaacaaatgaaaaactacgacctagtagaaagcaaagatctaagcagccttgccgaatttttgccataagcttcccaaacttactgtttggtctaccagttgaacttcctttgccaataaaatcatcatgaaaaggaggcagacaatcatgctgcgggtttctgggtggggactggaattccaggcatcagagagcacactaacccagttgacttcacagagtacagaccccaaaaataagaaacagctcttggggcttcctcgttccacctaaaagaaaatgaattaaaatcattctgttgccttgtgctatctatgtatctggaaaatgtatgtaaattgtttcataattatgtttttaaaaaacactttttccccagattatatcacttagaatcccacctcctagagatttagacttaatatttgtaatatctttccttccacagtgtatgtgtgtatattttagtttgtctgttcagatttcagcatttattccaatcattcttaataagcgaggaatgaccttccctaaccccaacctgggtggagaatcgctgccacagtaagtcactggagctgcagggagtgtatcagaatcctcaggtgtgccaggacagggcaaagttgaaatttactagtcagtagttcccaaacttaagtgtgcatcagaactaaatggaaggtatattaaaacagactgctgggcctacccctagagcttttaattttgcaggtatgggttgggagccagaatgtgtaagttcccaggtaatgctgatgctgctgtcccagggaccacactactttgagatccactacactagtgtatattatttatattgcctttttcctttttcctttttttttttttttgagatggagtttcactcttgttacccagattggaacgcaatggcacgatcttggctcaacgcaacctccgcctcctggcttcaagcaattctcctgtctcagcctcctgagtagctgggattacaggtgcctgccaccatgcccagctaattttttattttattattttattgcttattttttattttatttttagtagagtccgggtttctccatgttggtcaggctggtcttgaacccccagcctcaggtgatctgtccacctcagcctcccaaagtgctgggattacaggcgtgagccaccgcgcccggcctatattccctttttaatgtaatgctgtattataacaatgtctccgtattattagtctttacaatttttgatgactgcatgtttaaattctatttaaaatatgagaggccgggtgcagtggctcacacctgtaatcccagcactttgggaggccaaggcaggtggatcacaagatcaggagattgagaccatcctggctaacatggtgaaacctcatctctactaaaaatataaaaaattagctgggcatggtggtgggcacctgtagtcccagctacttgggaggctgaggcaggagaatggcgagaacctggaaggaggagcttgcagtgagccaagatcgtgccactgcactccagcctgggtgacagagcaagactccgtctcaaaaaaaaaaaaaaaattagagaatgaggaacagatgtactataaagtatataagaaacctcaaagatctcttacaagctatttaaatacttctaatttgtttaaaataaaacatggctactcatgaatttttcctttcaaaatgaagattaaaagctctagtctatttataaaatcatgatcaatggaatttggtgatgattcatttcttgtcattactgttattatattatgctaactactaattctcttccttttagaaaatgattcttcattgtccattataatctgttctctatcctcatcctcaaccccaccaaaaaaatatagtttattatgccaacaagacacaaagaattaaaagatccccagcttctggggtggtcagggtcatctgccattagaataaaactcctagagacagagtctacagcatcccttaacaggctgtgctactatctaatctgtcttatagttaaggtcatcctttttaaaactccatcttatagttctttaaaccacctttctctagtatgttcataatggtgataaatatttacttaatgcccgtctcatatactaaatctagctataaaatcattcttaagcctgggatttctctagaacaactgccctcagcttttcttgcatttcagctactgagtggctgacaagagcagcacagatggggttccattaagggcactaaaaaagttaagtatattttgctaaccttcataaataactgtagatctgtatcaaagcacttaaggtgtctcaacaataaatgtgacagtaagagtaaacactaactgatgagactatgaacaaatgaactgaaactaccataaaaacctaagacaagagtgtaattaaaaaaaaaaaaaagaagaaaaacaacaacagctccaaatgcctgactagtatgtaagttacactacactctctgttttctggttttgtaaccattgcttctactgcaaagactcgcatgcactctctttttttaagtcatttcaggtctgcacacgattatgatgcatcatcggttgtcacaatgcattttatctcctataatcaaattattcacttgcataactgctaaaagaaactaatagcttcagtaccaatttacatttgctttaataggacatttaacgataagcagttgttgacacaaactgtaatgacacaaacacatcaataacaaccaagattaagcataacggaggcattaaactacgtactcacacgtgacaaagtctaggggatgactgacatattatagataaaatctttctctgggttttaaaaatggtcctgtagatgttttaacacgataaaatgacttccacaagacactgttttccacaggcaccaccgaggcaacacagaatgtattcatggtccacgctagcacacactgccactatgcctaacaaccacagtgaccaggctgctccctagaagccagatctctctaggctgcgatgccgggaatgaagggcttactttgaagaaggcctccatgagcatctggtcagggtgcaggtccttccatggcagtttccggtacgtgctatggaaagcgtacagaatgaactctggcattttgggtgctgtacatgcttcacaataatgcatcaggtgcaaccaaagggctcctgcatcacctggcaacagcttatctagaatgtgaaaagaaaatagagctgaagacctttggtttaccttaaaaaaaaaaaaaaaaagcaaatttgaactaaaagtctaaaatctaaggttctcatgattgacccaatttcaaagattttcatgtagggagagtggttaaggggactactggcagattagtaataaagaatggtactttaattacccactcgggtaactggaatgagcagatgctgtgtgggaaataatcagcttttctttaaaatttctaaacgtatggctttttaactgaaatacactcctacagcttgttgccctcagtatgtattcagttttacacatttagtgcttcattcatttggcactcaggagaaatccaaaatccctcaaaaggaaatgttccattttttaaaagaaggcatacaaatagccaataggtgcatgaagaaatgctcagcatcactgatcattagagaaatgcaaactaaaaccacaacaatgtatcagtgcacagctgttaggatagctgttatcgaaaagatgaacgataacaagtgttagagaggatctggagagaaagaaactcttaaacactgttggggggagtgtaaattagtacaaccattatggaaaaaggcatggaggttcgtcaaaaaactaaaaatagactaccatatgatccagtaatctcacttctgggtatatatccaaaagaaaggaaatcgatagggagaagggataaccacactcccatgttcactgcagcattattcacaatagccaagatatggaaacaacctaagtgtccttcaaaagatgaatggatttttctaaatgtggtgtatatacacaatggaataccagtctgccttagaagaggaggaaatcctgtcatttgcaacaacatgaatgaatctggagaactcatgctaagtgaagaaaacgaggcacagaaagacaaatgccacatgctcttactcatatgtggaatctagtaagttgaactcattgaagtagagaatagaatgacagttaccagaggctgtggggtgtcaggggaaaagggagggaatgaggagttgctgatcaaaagggcacaaagtttcagagggcaggaggaataggtttcaggatctattgtacagcagggtgactaccgtccacaacaatgcattacgtatttcgaaatcagaagagaaccaactttaaatgtctcatcataaacaatgaaaggtaagcaaggtgatggatatcttaattatcttgatttaatcatgccacactgtaaatcacactgtacccatcaatgtatataattatgatttgttaatcaaaaataacattaattttttaattttagaaacggtggaaatgttccaaatgactaaaacttaattaacccttggtgcaatgaaactagtccattaactgtcattcatgtaagtcattctaaaataaatctcacgcttttctgagacctggattattactcaatattatcctcacaagtatcaattccattaatgccttcaagggctaatgactatataagggacatttagtctaaaacaagtggtttcagactttctggttccatgctaatggaatgcagtcaaagaagagagagccacacacagtaagaacagaaacctgatggtttctcaacacaaatcttttaaaaaatggccaacgaggctgtgtgcagtggctcacgcttgcaatcccggcactttgggaggccgaggcaggcagatcactttaggtcaggagttcgagactaacctggccaacatggtgaaactctgtctctaccaaaaatacaaaaattagccaggtgtggtggcaggcacctgtaatcccagctactcgggaggctgaggtgggagaactgcttgaaccagggaggcagaggttgcagtgagccaagatcgcaccaccgcactccaacctgggcaacagagtgagactccttgtccaaaaaaaaagccaatgagcatcaacacattgtaccagacaactctcatttctaacatgcttgtaccctcaattccacaacccggcatggaacaggaatgcacatttttaacaacctttaagacagaggttaatgatagcattcgtttaaatatggataaaagacagttttgtttagataaagttgggtaagtatgtagaagatatccagaaggatgtcttaggatagactgagctgatagttccagccaagacacaaattctgtgacgtcagataaattcttttcattttcaggtccccacttttctcatccatagaaggagctagtggatcagataacctcactaaaaagctgcaatacttcttcatcctaccttgcaaagctctcctgtttcctttctttgaacccagctaccaagtcttgatgtctgtgaacccttctgtcctatgccactttcttattttattcatatacaggggcaagagagccttggggtgctttcccctatactaagaaattaaatatggctgggcatggtggctcatgcctgtaatcccagcactttgggaggccaaggcaggcggatcacaaggtcaggagttcaaaaccagcctggccaatatggtgaaaccacgtctctactaaaaatacaaaaatcagccgggtgtggtggcgggcgcctgtagtcccagctactcgggagactgaggcaggagaatcgcctgaacccaggaggcagaggttgcagtgagccaagatcctgccactgcactccagcctgggcaacagagtgagactcagtctcaaaggaaaaaaaaaaaaagaaattaaatatatagcctttatgattataatttggtgctcaaatctttttctcagtaatcaatatattctggatggtaaaaagcagctagaagtctgcctttcaaaaaaataattgagtactactaggatttcatgtgttactcattgaaccactatttatcaaacacacactgagaatatggcattaccctagttttgtagggagcaaaaagaagcaaagaataacatttctgttattctatgaagagtttacacctcttcaaggtaagataagatatataaaagataaatcagaaatacaaataaggtacagccagacaaaatgaaatgagctatccagccatgaaaaggcataaagagacttcaatgtctattactaagtgaaagaagttaatctgaaaatgctatgattccaaccataggacattctagagaaggtaacactatggagatagtaaaaggatcaggggttgaggggagggagagatgaacaggcagagcgcagaggatttttaaggcagtgaaactgctctgtatgataccacaatggtgggcacatgttatttgtcatttgtcaaaacccaccgaatgtgtttaccaagagagaacactaatgtaaatcatggactttcattgataatgatgccttaatgtaggttcatcaattataacaaatgtatcaccctggtgtggaatgtccagagtggggaaggcttgtgcatgtgtgggggcagaaggtataaaggaattcttgtactttccacttaattttgctgtaaacctaaaactgctctaaaaaataaagtccgttaaacaaaaaataaaatctattacaaaaaaaaaacaaaactggatgacatatgcttaactgtatgtattagctcattttcacactgctgataaagacatatccaagactgggtaatttacaaagaaaaagaggtttaacagactcacagttccatgtggctggggaggcctcacaatcatggtggaagatgaaaggcatgtcttacatggcagcaggcaagagagagaatgagagccaagcaatacgggaaaccccttatcaaaccaccagatctcatgagactcattcaccaccaggagaacagtatgagggaaaccgcccccatgattcaattatcttccactggctccctcccacaacacatgggaatcatggtagctacaattcaagatgacatttgggtggggacactgccaaaccatatcactctataactaaatgccacacaaacacatggcagccacaggggcactaggtgtattcagtggaagaaaacaccatgggccagaagcaaagaggaagccagagtgttaaacagatgctgaaaccagccaaccgaggactatttgcctgctgagttttaacagcacaagaggacagaacatgaggttttctaaggactatattcttactgaaagggtagaatggggcaaaagaggaaacttctctgccttaccctagattgtgagtcaggagagatcaaaaagtttactgtgagaattgaggccagcccgcaagtgagtttggggtttcatttcatgtaactggtagcacgggaaaccccaaaccaagaagttaagtagttccaattgacaacaaatgtagatcctctctggaggacttacacaccctcagcctaggccttatgagattcccatcagtctctctaaatatgggctcacaatacaaaatttaaaaacacacaaggaaacatgcctccaagaacaagaatccaaaggaaaattaaacagcagcataagacaacccccaacaggaatttcagataatagaattaatgtacatacatcataaagtaagcatgtttaaacaaattctaaggaaataaaaaatagaattttaaatgaaagaaaagatactaccaaaaaggatcagggtacatttgaaaaacaaacaaatagatctagaaatggaaaaaataatcacttcaatgaaaaattcaattgatatattttaagcagatgagacagagctggagagagactaaagaaatggaaggaagacctctagaaattacccataataaagcaaaaaaagacagaaaatatgaaaaagaggttaagagttagggaggacaggaagaaactcaacatgcaggacaggcaatattggaagagagaaagactgcaaatttaccataactgagaaactcagagcaacctaacaaaaaaaggtaagaagttacacacctaaaggccgggcgtggtggctcacacctgtaatcctagcactttgggaggccgaggcgggcagatagcctgagctcaggagtttgagaccagcctgggcaacatggtgaaaccccgtctctactaaaactacaaaaaaattagccaggtgtggcggcatgcgcttgtagtcccagctactcgggaggctgaggcaggagaattgcttgaatctgggaggcagaggctgcagtgagcccagatcacaccactgcactccagcctgggcgacagagcaagactccatctccaaaagaaaaaaaaaaaaaaagttacacacttaacactaaataattgtatcagcgacttttcttcagtcacaaataactgcctattaaataaaaattaaatagaggaaagtagaagaaaaagactgactgacttagggaaaaatgaaaactaagcagagacagcctgacatcttcctacctttaaaactctcatgcagtgagtcaatacagtcagtgaacagctgcacaatgcttgaggccaccacagtatcactctctagccaggggtaatgccgctgttggctgctttaaagaaaagaagcacacacttaggaatgcaaccgtgattaaaatactgttaagtcccagtgtctagggctggcctaagtcctggaagcctgtccattatgtaggcctgacacacatttagaatacttaaaaggctgtaaataactgcaggcgaattgtagcttgtaacaccagccatataattttctttcatctccttcataccctttattccaatgcaattagatttcaaaaatgtgctatctaaataacccttaaattaacatctttttacatcaaatttagacccttggacatcttggttacatttcaaatgccgtagaaaaacaccctaagtcagcttcaacagttttctctactcaaagcattaaaaaaaaaaaatcaaattcacataacaaagagatggccaaatattaacaaatagaaaatgagcaaataaaatttttttttttttgagagagagagtctttctctgccacccaggctacagtgtagtggcacgatcttggctcactgcaaccttcacctccagggttcaagcaactcttctgcatcagcctcccgagcaactggggttgcaggcaccgaccaccacatccagctaatttttgtatttttagcagagacagggtttcaccatattggccaggtttgtcttgaagtcctgacctcaagtgatccacctgccttggcctcccaaagtactgggtttacaggcatgagccaccacgcctggcccagagaaattctttatatgaaaaatttaattggctgggcacgggagctcatgcctgtaatcccagcactttgggaggcagaagtgggcagactgcttgaggtcaggagttcaagaccagcctggccaacatagcaaaacactgtctctactaaaaatacaaaaaaaataaaaattaaaattgaaaaatagctggacgtggtagcatgcatttgtaattccagctactcagggggctgaggcaggagaatcgcttgaacctgggaggcagaggttgcagtgagccaagatcacgtcactgcactccagcctgagcaacagagtgagactctgtcttaaaaaaaatttttttttattttctgaatctggtctagaaaactcaatatccaaataggttccgttaattcttactggaaataaacaagcagccagcactatggtaagcagtctatatgtacacagtcactataaaatcctgaagcttgcagattattcagatagccctctagcaaaagcaaacattcagaaccttttatactttccttaagtggctcgtaaagcatcatgggttaatgcaaagagtctagaaacagaagtctaagacctgagttctagtcgcagcttcagcactaaccaaccagctatgagacttgagtttgacattcatgttctctgagtctcagaatcaaattcaagtttttgaaaacaactcctataatgtgatgtttaccactgtcgtaatttttataaaaccctgacaagttcaactagcttctgcttgtatactttcagggaaaaaaaagactcagaaggcaactcactgaatttggacagctctatacctctaagtatttcaaatgcttgtgaaataatgctttaattgaagagtcctagatttaaaggtaattcccacccaataattttatagccaacttagttccaaaacacaactgatgtagtagagaaaaatcagtctcataaaaccctcaagcgaacagcatcattttttctgaaattaaacactaaagtttattcaacctcttattgtggaaaactggaaatgagtgtccagttttgttccaaaattattatcaagataatatctctgatgatccagactagcaattccataaatagaaaatgtcttaagttttgaaaagaagccttttctaaatttaaatatggccttacactaaaaaattaaatctgtgaactcatcacttctaccaaataccatttagaattttaagtctacaaacgtcaaaggaatttgaatatctaaaaaactgtttacctttcgttgtcctctaaaaccaggatccatggcttaaagagctgaatgattactgaatgtagggatttcagcactaaaaagttttagagacaaaacaaaggtcatcatttgtcatttgtcaatatcactgctcacattatatagaaaaatctacctcttattatctgtagcttcataaacctatgttaatgtataaacaacatgcttagtgtaactatgtatgtttacgttttcattggctacactggaatttctctgaattgaagaatttgtattacaatacaatatcatggataattttataacacacttttaaaaaagataaatgtataagatttagaaccccatcttagtaagacaaatgacagaaagggttggaaactgaaacctctctgtaccccaacctgcaaaggaggggcagagacaagctatagcaagcaccctacattcactatgtaatgaatatatccattcatatattgtgacatatatgacacatatatgggctcatgcctgttctatatatttctactttctctccttgacactcaatataaatctcttaatgtgcctatttaaatctctcttaatggaaagtccaaacacctagctccacatcgcatgagaagtatattacctgttttcctgctggcagttgggtcttgggccaaacaggtcatttctaagtcaatcagccttttcacaaggtagcccaagaatgtcttcacatcagccatataaggactccattttgagaataaaccaaagcttttaaagtccatcttggataaccgaagcttataaaaaaagtctgaaagccactgtatagtctccattacctggaagagacaactagtcaaaaaatgcttactaaatatgtattttagtaaagtgttatgatacactgtgatgggggtgtatatagtaggtctttgactttataagagagtggcaaaaatataaagcatatgagaaataaatcaatggttttttgtttttgtttttgttttgaggtagagtcttgctctgtcgcctaggctggagtgcagtggcacgatcttggctcatcgcaacctccgcttcctgggttcaagcgattctcctacctcagcctcctgagtagctgggactacaggcgtgcaccaccatgcccagctcatttttgtattctttagtagagacagggtttcaccatgttgcccaggctggtctcgaatccctgacctcaagtgatccgcccaccttggcctcccaaagtgctggggttacaggcatgagccaccgcgccaggccatcagtgggtttcaaaccttttctaaatcagtggaaccattatttcaaataaattctcatgcaaatgcatatcaaacagaaaggataaaacccagagctccatgggacactgcatcatagaaacccgaccagaggtctcagggtggagtccgatgggctagggtgggcaggaaagatctacaggggagtgcctgcccttgtcttggatacatgggcaagaattagactcaggggaatggggtgagccatctggaaaaaggggacacgagggaaccaaagcacttaacacaaagaaaaacacatggctcttaaagataatgcacaagttttccaactgcttaaaaaatgaatagcaagggaaataaaaagaaatgcacaaacacgtcagagaccaaaggctacacacctgcttgtctgacaagagagcatcagaagagctgggaagcacggcgccctcggtggacgctgccccctgctggcagctgggggcgcagcagcccagggctctcagagtggccttccaacactcggggctcagaagctgctccgcggagcctgccagcagggacaggaagagcaagtcagtggctttcccgaaaggaatattttaacttgtaacaaagaatatgagcaccttataaaggaataaaaataaagccaaaatccaaaacaaactcacagggatatctggggtgaggaggcccaagtaaagagaacctaagagaagaactggccacctgcacatttggttttcctggttcctggtaaccctgctgggagtgagcgctgctgaagctggtggagctacactcagaggggtgggagacctgaccctccgaccctgactggggaatggtggcagtgcctctcctggctgggggaccacagctatctatgagtgtgacagaaacaacagtcacaggacaacggaaaccacatgatgaaggcaactcagggcctgggctctccagaaggagtctcctaccggccccccaattccccgaaaccaagacccagaggcagcatggaaacgctggacaagtccagcagcccatattctgaactagtcccaactctgctacttaataacttcccatcccacaggacaggaataatatctcctaaagtactttccacccagagcgaacatgagaatcaactaaaataacaggttcatggagcaggtctgaggagaacgatggtgaggccagttacaatatgtccagtgtgaggtacctggggacagtgccagtctgtgtccaatggccactggggtctggatcttaggacagcgccccaaaattaagctatcactggaaatcacacatgcctagaaggtggcagtgacatcagggaaaacaacgggctcacccagagggaatgaatgcagtagaagagcaaaggatgctcccaagggaacatcaacatggtagccaaggaggagaaagaaaccaggaggctgaagctcatgacatctgagaggtatcatattgttattcttaagtctgaattacttttcttggtaagaacaaatttctagctaaattccagtcaatagtggtctaatataaatggtttacaatctctttaaaagatttcagggaaaaatccacaacacacactatttgaaactttaaaagcttagagaaaaaattagctatgcacatattcattggcatttgtacaaatgtatttcccttccaccattctccacccaccctgcaacctgcctctgtgggaaacaattaaagcttgaagtgctttcaaaatgagaggctgcacatttcaaggtcctttgggcaacccgatacactggatcattaacttatccattaaactatttctatgatgtaacacaaaaatttggtataaagcaaaatttcatttgctattatatctataaaccgtatgaagtttgcattaaaaagtaaatactatctcatttatcaaattttaataaaattactgcctagcgaaactccaaaaataaaaaagcctaccctatttatttctcctctaaactctaaaattgctatagaaaattgtaagaagggggaacagaagtggcaggaatgtggagattgtaatgctgctctttcccttggtaaatataaataaagtctatcattacatatggataaaattaatttgcaaaaaacaagagtaaaagacttagaaaggaaaaactcccaaaatgtttggaactacagagaaacaaactgtcatattaaacatatcataaggcacaacctccttgctttgccagatctgtcgtctgcagagtaagccagtcctttcccaccccacttcaagacagctgaaaagtcaagacaaagaagtacctgcatgactgtggactccaccaaactggaggtgctgccttgcccaattagagcccattctcaaatttagaacaataactggccatatttacagtaacaactttttgggccttgttcatcaagccctttagatgacaattagtgattctaaactcctatactggtattactttcatatctttgaataacatctgtaagatgaaaaatgtgatattaaatattcactaagatctagttagttacaattaaatgaagacacttactttgcataagcagcctgagaatgtcactgtactggtcaggaaactggtagagaagaagataagtccagtgcttacagaaaagattaaatggcatcaaaatatcctcatctggttcaaggccccaggcagtaagtgccaagtgaatggactccagaagcctggtacgatcagacagaggaggtttagtggcgcttaaccattgtttaagatcgaactaaaaagaaaaagaaacaaaaagccgttttatttgcactagaaaaatagtttaagaggagagaggtctgtgtaaatttagtttaaaagccaaaaattacccagcattttataaaaattgaaattaaaatgtataaacaagtacataaaagattcaacctgaggaagctaattgtaaaataaataaataaataataaaaagagaagtacataaaagaatataagaagttcactaattgggtcgggtgcggtggctcacacctgtaatcccggcactttgggaggccaaggcaggctgatcacctgaggtcgggagttcaagaccagcctgaccaacatggagaaatccggtctctactaaaaatacaaaattagccaggcatggtggcatatgcctgtaatcccggctactcaggaggctgagacaggagaatagcttgaacccaggaggcggaggttgcagtgagccgagatcacgccattgcactccagcctgggcaacaagagcgaaactgcgtctcacaacaaaaaaaaaaaaaaaaaaagtagttcactaattggtgccattatgcatctatttctgtgttactatctagaatctcagaggcagagttttctaagctctgtgtgcttttcttgcaatttaaaaattttactgatgattcattattggcttataattttatactgttcctcagagtctcatacatttctgtcttataataagtttcctctccaagaactggatcagaacttcgtagctctccttcactggcgacagtgccacaaataagcagccactttatggaactgtctcaatttaacagccatgtttctggtctgcatcagttacctgtctcagttaataaaattcagactgttgatattcccttccaaaatcccaaactataaaacatgttctcctccattataggctgagatcaatctgtaggccctaaaattgtcaaggttgtctttttttttttttttttcacaacaggtctcactccatcacccaggttggagtgcagtggtgcaatcacagctcactgcagcctcaacctccagggcttaagcaattctcccacctcagcctctgaagtagctgggagtaccactagcctggtgtttttttttttttttttttttttttttgtacagacagggtttctgtgttggccagactggtctcaaattcctacgctcaagcaatcttcatgccttggcctccaaaagtgctgggattacacataggagccactgcacccgaccaaaactgccaaggttttgattcatagatgtaacagaaatacaagtgaaggcaaagtagctaagactctgaaattctcaactgcttaagtaaactcattaccttggtctaacagagttaatattctaatgttatatactaagatattaatataaaatataatattaatataaaataaaatattaaagttaatattcagaatgagatcaaaggcaatttgcttagatccagcttattctaaatatgagagagactaacaaaacctttgtcaaacacaatttaggcataaattcaggataaattttaaaaaaggatgtactaaactactattatgaatattttcaaaactgtattaagtttttaaaaaggggtgggaattaggtcctttttacactaagtggaataagactaccctatacaacagggatccccaagccccacctcctgtcagatcacccatggcattagagtctcatagaagtgcgaaccctattgtgacctgtgcatgtgaaggatataggttgcatgctccatctaatgcctgatgatctgaggtggaacagtttcatcccaaaaccatcccctctactccagtccatggaaaaactgtattccataaaaccggtccctggtgccaaaaaggttggagaccactgctatacaagacaaccaatgccccaccccctaagaagcagctgtggggtcagactgcttgaagctcatgcaaactgtgaaaaaggcctctcagcctctgctgtacctggaaacaaaactgcagaggtccttttatttctgtagaggaggaagcaacaatcattcctacgtttcaacaatatggtgaggatggaattacatcttaccttggttagcagcatgaaaatcatatcactgttgtcctcacttagaaacttcaccacttgctcatacagctgtatgaactctgcaggtgcagcattgggagtgaagaaaggagacagcagggagcagagcctgctgttcttcagaatggtttcaagtacttttctgcactctgatttaatgccactgataaataccttggaaaaataaaaaggaaaaatgtcaccagattcttccctcacaacctttatttaagcaagcaaatttttaaggggcaccaaataaggtgaatagaatttttttctaaacaaaagtctgaaacaatcaaaagacagctaaaatcaacatagataagcctattgcttccaatggaagtaatattagaaattctgaagaatccataaatctgatttggacaagtcacacagaaaatgctgagttagtccgggtgcagttgctcacgcttgtaatcccaacactttgggaggccgaggcaggcggatcacctgaggtcaggagctcaagaccagcctggccaacgtggtgaaaccccgtctctactaaaaatacaaaaattagctgggcgtggtggtgggcacctgtaatcccagctacttaggaggctgagacaggagaattgcttgaacccgggaggcagtggttgcagtaagctgacatcacaccattgcactccagcctgggcgacagagcaagatgccgtctcaataaagaaaaaaaaaatgataagttaactatactacaagacttttaagacattaaaatattggggtactttgaatccacaaacatgcaatgtccccaccatgattactacagtacccaacatggtgctgcattacgtcagaaaacaaaacttccaggttatagattttactgagagttatatttaatacctgtcaaaaactaacttccataataatatataatcaagatgacgtcatcttgttttaacttggttctaatatttaaaagtacagaatataagcaaaaattgaaacaatttcaccggcaggaaggctttcatatggttgaccacaggcggaaataataaaagaacaagactgataggcttgaatatattaaaattttaacttctataaggcaaaaatatcataaaattaaaggaaaaaaatgacaaactggaaaaatgtttttttaacacattccagatgccaggttaatagtgtgaggagctctttcaaagcaatcggaaaacaagaatctccaacagaaagtgtacaaaggaccacaatcaccaattcacaaaagtatatataaatggccaataaacatatgaaaaggcatataacttaacaagtacttaaagaagtacaaattaaaataataatgaaataccactcccttatcagattagcaaaacttaaaagaatgagagttcctaatgttggttatggtatgaagaataacaaactcaaacactgcaatgatagcataagtaggtgcaaaattcccagggaaggcagagtgactatgtcaagcatgatgtaaaacatcaaatatacaatgtgtatcaaattcctttgacacagcaatcatacctctaagaaattatcctaaagaaaatagtccaacaagttcacaaagacatacaagaatatttacctcagcctgattgcagcaaaacaatctacctaaatatccatccatcaaacactagctcaacacactgtaataaatctgtatcatggagcactatacagacatgcaatgtcatgatataggtctgtatttattaacatgaaataatgtctaaaagatgtgtttaaatgaaaaaggaggttacaaaatagcatgagcccattttaagtgcctatccatatctatatatctctatatatgtagaaatatgtttacatatacatatacacaaatagacacacatatacaagacaaactataatgaaatgttagctatgtagtcagtatttctaggtagttaggattataagaaagttttcttcttcatactttctatgctgtctgcattgcttataataagcatacattaattttttttttgagacagagttttgctcttgttgcccaggctggagtgcaatagcatgatttccgctcaccgcaacctctgcctcccagtttcaagtaattctcctgcctcagtctcccaagtagctgggattataggcacgcaccaccacacccagctaattttgtatttatagtagaggcagggtttcttcatgttggtcaggctggtcttgaactcccaacctcagatgatctgcccacctcagcctcccaaagtgctgggattacaagtgtgagccaccccaccggaccagcacacattaattttatgatcaggataaaaaacttcctacaaaaaaatcaatgatgatacctgttcagcattacttccttgtaagcatccaataagtaagtactcattcagttgaatttgggtgagagtacatggttaactagtgtttacatatttcaaacaagaggttttcctttcttttatgaaacatttcataaatctgtatgattacccttacccttattaaatatctatctatgtcactgtaagccaaataaataaataaacaaacaaataaatgttgaccaagactagcaaccgggacacagcagtggggaggtggagcaagcactgagtgttgtcagaagccctgggatccagtctcagctccacactcaccagctgaattctttaggccagtcacttaatcttctagaacctagttttctcatctttaagaagggaatctcaatcacacagattccccatgaggattaaacaaactgggaagtatttttataaacaatgaagagatttagtactgttattgttaagaacaccaaggatatatgacaagttctgatgtctccctagactttcaaatatgaataatctcccttgtatgagaagcaaaattctataccaacaattctaatcatattttgagaagcctacaactccaagaggcttctgacttgggtaagactctgaacctgtaatataagtctgaagtcaatgctgactatatccaaagaagacagacaccgcagagactcattatctgatcaaggcaaaaggtacagatagccttacctgtcccaagatctcaatacatgaagtaaagaactgccttgttgggggatgacgctgcgtctcatcgctgacgtaatccacaatagtaaagaaaaggctaatgccaactttctgaatcccaggtgtaggctgcaacttgtaggcattcactaaggccctgtgggaaaatgtgggtaagactgcagtctacagtaaaagattccatactcacaaggccttctttgataccctacaatttctcaggcaatattcttaagaatcctcagagcacccatgaaaatgtcactttagaaatatttcatggagtaaatatatgtatcttccaattttactgacaactgattttctttttttttttctttttggggtgggggagacagagtctcactctgtcacccagactggagtgcaatggtgtgatctcggctcaccacaaccttcgcctcccgagttcaagtgattctcctgcctcagcctcctgagtagctgggattacaggcacacgctaccacacctggctaatttttgtatttttcttttatttattttattttatttatttatttattttttgacggagtctcactctgtcacccaggctggagtgcaatggcgcaatctcagctcactgcaacctccacttccagggttcaagcgattctaacacctcagcctcccaaggaactgggattacaggcagctgccataatgcccagctaatttttttgtatttttgtagagacggggtttcaccatgttggccaggctggtcttgaactcctgacctcaggtgatctgcccgcctcggcctcccaaagtgctgggattgcaggcatgagccaccgcacctggccaatttttgtatttttaatagagatggggtttcaccacgttggtcaggcttatgtcaaactcctgacctcaagtgatccgcccaccttggcctcccaaagtgctgggattacaggcgtgagccactgcatctggccgattttcaatacttagtaataatttcatagtctcctaggggaaaaaaatcagctataagaactaattaacattctcatccttattaaaaatgttcatattttgcatgtaattcataatttgttatttaactttttgtattctttatataatttttttaaacacaaaaccctgatttctctacattttaaaatccaaaacactgactaaagttgagataaagatttctgtgtagaataagatcctagaataaagatagcccttccaattctcacacctttttgtgtccctttcccagtaaaagaaacatcaacctcttgtttgcctggtctcctccttcccaggagccccagcccaacacacaaaaggactcgatgctcccctccatacaccatcctactctactgaggggatcagctgttggaactggaatgtggagtcagtcaccttaaagtaaaggcagagtcaacccccacctcccaagtcatgtcatggtggctttggaaagaaagaggacagtgagagaaagccacaatgaaagccaaaagaaaacgatggtcaaatgcaagttcacaaccacacttgagagtcctaattcccctaaataattgtgctatgaactttgttcagtcatctgagttgacaaggataagttcctgggtaaatgtgactttgatataacacataagcactaaatctctccacaactgaatttcaatgcactatatcatctcacaattcaggggtcagcaaactttttctatatagggccagatagttaatattttctgctttatatctctgttacaaccactcaatccttctgctgcagcataaaagccatagaaattataaataaatggggatggctgtgttgcaataaaactttatttataaaaataagtagcaggccagatttgactcaaaggccgtagtttgctgatgtctgtactaaattaacctgtgggtgctgcaggggtggtggtggtatagtagcatgtatgattactattcatgataacaaaacagtatttcaaattataatgcctgcaaaacttacgtgatcaagttttctgcatgtacagcagcttccacaatattaagtgatggtggtttagcagcttctgcttgcaactgcttcacttccttccgtaaaacatgaagctgttggcttatggcttcattcttatgcatgccttcaaactaacaaaaattaaagttatcaaaagacatttccccccatgtgtcaggtttcccatgaagactcaaactgaaataaaattattgtcttataaaaataccaaaatttgtatctctttatatgactgccttataaactggtaagatcttgaattaatttatcaatagttcaaagccttttgtaggatactatttcacttatgtttcaactcctgaaatcctcatcaaaaacacatcccatgtcttccaccactgaggcttttcttgaagcacaggaagcccctccactgctgatcatggctccccagccgtagcccttctgtgtgctctcaatccaacatacaaaacactcaactccaaacactcaggctgcgtacacatgtgtgcccagcattaaaaaaagatgacacagatgctgctcacaaatgtcgttttgaaaggaagaaaatatatataatcataaaacaaacaacaaaataagataaaatatggggaaatgcccaaaccaactccatgccaaggaaagagcaattggctaattcctaaattcaccaatttaggttcctagaagctggtctttgataaaatttttattggttttcagtaaaggtggaaaaacaaggagaatttattgagcttctttaaaaaaaaactaaatttttttcaactcaaaagattatccttttttaagattagcctttcttatttgagaagccatcaacaaaccctttctctgactgatagtgacatacataactggtttgtttatgcaattttaatgtcattttttggatgtggatagaggcagaagaaaagagaagacatcctgggcccagattgcaacacaaacacagaactgacatgacagctgtgggggatatgggacagagatacaggaaggaggagcctggccagggttgcagagtgcagtaaaatcagactggggagctgagagagccctcttggagaggctttgaaatgcaggccggggagtctggacttacaggtacagctgaagagaccataacatttagaaggcaagagttctaaactctacattctcctcctgtcttccccaaacacatgggtgagcagtaaggtctacattttttccttacatgcacctgcccaaacccagtcttcagccatcactgcaatgattaaagatatcctttataaataatgtaaataattcacaaacttattacctgaggctcttatgtcacttatgaggcccagggttattatcataaattctgtataaaagttcctgaagggcggccaggcatggtggctcacacctgtaatcccagcactttgggaggccgaggtgcgcggatcacttgaggtcaggagttcgagacatgcctggccaacgtggtgaaaccccgtctctactaaaaatacaaaaattaactgggtgtggtggcaggcacctgtaatcctggctactcaggaggctgaggcaggagaattgcttgaacctaggaggcagaggttccagtgagctgagatcatgccactgcactccaacctgggcgacagcgtgagactccgtctcaaaaaaaaaaaaaaaaaaaaagttcctgaagggcaatggtccttcctatttgttttacttacccagaaccccagcacagcataactctgacaatacactgagcaactattttttatgactgtgataataataactttcttgtataaaactcattaatgtattaaaaatctttacaaaacttctttaaaaaagaaaaaagctctgtgacatcaaaatgcacaaaagtgaatattctagaacatataatgttaacaataattaacttttactattggagaaatgaaagattaaaaaagaaattacttgcatttaattagataataaatcaatacaagtatctgaattaaatttgaaatctttcaaataacagaccaatgtttaatatcctaaaatgtgattaggagtatctgcagtcagcctttttgttcaatacatcaccaaatacagttagaccgggactatgcgtgtcacagaatcccctggctggcctggagagacaggagccaaacaggaaaagagagaatctgagataaggaaggaagacacagaatgaagggaggtggaaaggcaaaggatccagagaccacttgactggaaaaatgcagacaggactaaaactactctgtaatccaaactttacaactgccattccatgttgtagaaactactaaaataaaaccaggtggtttaggcaagtttagaccctctcacaaaaaacatccccaaattattattattttctagtctacttatttttgtttattgttcccactactgttgaaagttttctttttttactgcaatgaaggtgagagcaatggaatgtctatcagttcataattacaagaagtagtagacaatagaacaaagtagcatggtggaagcccctccacttgagtcattttaagtggacacagaaatttaaaagtttccttgtctaaatttaaaagttggacaaagcatgtccttcagccagtttttacaataatgtgaggccctcagtgggtcttttccatcgttcatttcttggaattaacaaatttttcacatgataataaatcaatcctggggtcagcaagcatacccacaataccaaagtacatcaaaaggaacccaattataaatcaccccatttccccagggaacatcactgaattgttagagccttctactgggaagagagaacacagaaagaagcatgtctcacttcccataaaatatatttgcctttgtataccccaaacaagctatccatagctcagacgcttgcagatagctggaaatttccaggacattctttcccagaaaaaatctattaaggaataaaatattttcatgatataatttgaactctttataaaggagtcattcaaaattatatttaaaatctgaagtcatttcccataaagctaatttttaaaaactgatctaatctagaatgttaagatcacaaattctctaatcactgaaaaaagaaggcaatactattatacagactcagagagaaaatgaaatggtacctatattcatttacatgagatttaactgtcatgatcagcttgctcagaatcacactgcaagtattcagaagctgcagctgaaacagctgaagcaaaacgacctggcaatattgaatgggaaaagtaggggtcttgaatttagacatatgcaggcttgaatcctgatggagctactcactagctatgtgactttggcaagtctcacagtgtctctgaacctgtttctctgaactcatcctcattctgtgaagattaagttggataaactaggcacagtgcctcacatctgtaatcccagcactttgggaggccaaggtgggtggttcacttgaggtcaggaggtcaagaccagcctggccaacatgattaaactccatctctactaaaaatacaaaaattagctgggcatggtgttgtgaccctgtagtcccagctcctcagagagaatcatttgaacctgggaggtggaggttgcagtgagccaagatcgcaccactgcactccagcctgggcgacagagtgagactctgtctaaaaaaaaaaaaaaagttaagttggataatgaaagcaaagcacctagcataataccagggacatgagagtgccccaagcaagtgacaaaaagtactgtgaacatggctgggaaagacagtgcaaccatccttactgcttcccaagactgaatatttgggagacatttacactagagtaaaaatatacagtaagcagtgtatagtatttaagttgagtatttaagtatggaaagtattaagttgtttaaaagcaaaggtaagcacaatcaaggaatgaactgttaatttttaataagaaaaagttccaatttccatgatgtctgtcatggccaaacaatatccacaaaattccccaaagtagttaaaatcagggaacttacttatgaagggcataaatctagagctgttcattccttcaaacacatccattttgcagcactgactgtatgaggcactgatgatacaaacatgaataagacaaagtccctgaccttgtgtaactcaaaatctagtaacagcatagaactaatcataacacaaaataagttgtaacacagcctaatgagtggtgtgttacaaataaggatgcttcctttcagcagaggtgtactaaaaaaattaaaacaggccaggcatggtggcttacacctgtaatcctagcactttgggaggccgagatgggtggatcacctgaggtcagcagttcaagaccagcctggccaacatggtgaaacctcatcgctactaaaaatacaaaaattagctgggcacggtggcacctgcctgtaatcccggctactcaggaggctgaggcaggagaattgtttgaacccaggaggcggaggatgcagtgagtgccactgcactctagcatgggtgacaagagcaaaactctgcctcaaaataataataataataataataatattaaaaacaaataaagatggaaaccttattcccaaagagttcagtctggcaggacaaaacagcaagtgactgcaacagcatttaggcacaagctgcaatgagggaaagaacatctcaattcgactgcaagagtccgcaaagacttcaaaagaggtttggcctgaactaaatactgaaggctgagcaagaaagaggtcagaaatgggtgggaggagaacaaaagcagcatatgcgaagaacaaaggtattaatgtgtatgttgtgtttagaaaaatgcagaaagtctaaatggctgaaaagtaaaatgtctgtgaagtgggagagaggataaatgatgctgctagaaaaagatcaataacagattatgaagggcgctaagggtcatattccttttgatactgccaagtaaatatgggtttttagcctgaaaatgtgatcagatctatgtttcaaaagatgagtaatgagagaatggaaaacagactaggcagggagagagatatggacaggaaatctaattaatgcaacaggtcaagggagaagcgaggtgtgcataccatggagaaatggcaacagaaacacagagaagggaatgtcacgggcttcagaaagccatttcagaggcagaaccaatatggaagcaactttggaaaatacaggaatgaagtagggtagggtaactggaagtgatgatattgatgcctaagtttccagcttgggagaccagctatgtgaaattataggaagaagagatttggaaggtaaaggtgagattaatttgggaatatggagtttgaggtatttgtggaacattcaggtagaatgaggcaggtggaaatctagatttggaactcaagagagaattctggactagagaaacagaacaggattatcaacatatgagtaaatagctcttttgttcgttttgaactattctgagatctattggagttatacactctccagaaaaaaaaatttatgcacactttcaggaacttcaccaattctctaaagaccattcacagaccccagattaagaactccagcacagacagtaggcaaaagaagatgatgtcatatgaagaagagaatcaggataactagcaatttaagggtttgagttgaggaggaagaaaccctggaaactgagaagtgcttagagattcagagggaaaagatgtgactacataaagttcaatatcacaacagaaagatgttaaaaggaatcaaaactactgaacatagccatgaggtggtcactggacacatctatatagagggctacagttttatgtataaaaataacacaacctaccttttgcaggacatactctctcccaatgacagtttcatgatgagtcataaacactgagaactcaccctctctatcctccattaacacctctttttccaaaactaaagtcatccataaccaatattatccatttgggtattggatggcttcatatttaagtacaatctttggccaaaaatctgagcaaaacgaacaacttgcatagataattccccaacttcatagcaggtagagtttcagctttcctctatcttgccctttgccattaatgtgtaacaaaacatatttttatcttcaagtcctagaagtatcaaccagcaaataccgcctgggatagcctcaactagcaacaacagtactatataactttcaagattatttaagtctccgcctataaaagttgttcactgtccatgtttttaattgccctggcaaatctgcgttatcaggcaaaacactggctgcagtcgatactattattgatactgaacttctaggagccatcagtgagggatctcaagcttgtggaacttcccaagtgggactaaaagtcagggcactaagcaaacgagtgaggccagcagaaaagtaaaacctgctttaagaaaacttaaatatttctaatgaggttagggccacaaaatacagctattttttcaaattctttacgcttctgcaacatctccttttttccctctctccttcattacttttcccccttctttcttcaagctatattagcaattaccaatttttctttttttttcttgagacagggtctcactctgttgcccaggctggagtgcggtggcacagtcacagctcactgcagcctggacctcctgcggttaagtgatcctcctgcttcagccacccaagtagcttggaccacaggcgtgcgccaccatgcccggcttatttttgtataatattttttgtaaagacagagtttctccatgttgcccaggctgctgaactcctgagctcaagcaatctgcccacctcaacctcccaaagtgctaggattacaggagtgacccaccacgctcagcccaacttttctttaaagaaaagaaagcacaagaactttggtatgtttgtaaaaacatctaagccatgttcacatcagtccttatcataaatcatcttttctctgacctccctccaatcaaaattacctagaagacattttagaaaaggtgtttctttttatttcagaattaacaaagcaaaagattatgtttaaaatctcaattcaagggttcagacaaataatataatactatgatccctttttctgtaaaggaaaagagacaagtcacaggtaggcttagagcttcagctccctggcctgcctggtggtattttccactgcaaggcccagagagttaacaggaggtcagggcaagagacctgttctttagctgaggcagtaaatatttacagttcttcacagagcaagccatcagccagaactggaaaaacatttctttatagttatctcacttgtcacttataaaaatgcattttagaattctcttctctatataaaattaacagtctggcaaagatatgtagttttaaaatatggaaaaacacaaattggtgaagacacccctttttttattaaaaccggatacattttcagttttttcctcactaactcgaactccacccaaaattggcaaacttttctcccagttttattacttcagcaagcgatcttttcttaaatatttctaccttggtcttactataacagcattagtaactgggaaaaaaatacaccaaaagaaaaccaactgtataaagcacctggccaaagataactcaatgtttaagagtcgcacatatttacaataacatacgggaaaataagttggactcatcctaacttttaggtcaaatttctgaactttagacaaatacaactatgttgaaaaatcagagacacattttgaaagtaatgaaaaatacaatacatataaaagattatttcagagaagacattttgtagaaaagagtctcccaaggaaattgatggagacattggaatagttacaatgaaaattagcaaaaaaagaagggaaatttctgaaagacaaacaagagggagtaaaataaattttctccaatttccaaaagctaacaaaaaagaatcatttgtgtgtagacagatttagacaataggcagtgctaatctccaagcatttctctttcagcttaaggaatactgacttcactcgaaggaggaatacagtgcggtgattaatgaacacaggctggccgggtgcggtggctcaggcctgcaataccagcactttgggagtccgagacaggcagattgcttgagcccactagtttgagagcagcctgggcaacatggcaaaatcccatctctactacaaaaccccatctctactttaaaaagagcactggctctggagccggactgcctgggcctttctggctgtgccacttacgggctgtggcacttcaggtgagcaacttaattaacttctctgtgactctacttccttacctgagaaatgaagataatatgataaaggccaccttgcagagttgttgtgaggataaaataacttatttaaagtgtttagacagggcctggcataaagtaaatgctatggcacactagcttcagcgaagcttccattgtgaagtgcataccatattgcagatccaaattctgcctatattccagtgcaagaaggtaactctgagaggcagttcaagtttcagtcacattgttgcatgtctctcctctgcctgtcagcaagttccacccaactaatctgcttcccatatatccttcccacgttcatcttcaggggctccctgccatgtgcagcagacagccagagttcccaatgatggtgcacaccaagctttccaatgtgaattcccaccaacacccccaaaacacttggaacgggctgacctagccaccgacccctaaatgacatcatggccactccatttccaaattccttctaactgtatcatcaccaaagtcttttaatcaattgagaccggacgcggtggctcacgcctgtaatgccagcactttgggaggccgaggcgggtggatcaccaggtcaggagttcaagaccagcctaaccaacatggtgaaatcccatctctactaaaaacacagaaattagccgggcgtggtggcaggtgcctgtaatcccagctactcgggaggctggggcaggagaatcacttgaacccgggaggtggaggttgcagtgagccaagatcgcgccactgcactccagcctggggactccgtttcaaaaaacaaacaaacaaaaaaaggaatcagttgaagccctctctctaggaatcttctcaatgattctgatttttttttaattcctatttgaatatctgtcttataggactcatctggtacctacaaaaatgtgtgattagctctatgagtgttttcatgccctgcaaaactagtaaatgtttgggacacagacagtgtgctatatatgtctttcaatctttctcattgataagccaacattacggactcaattaaaattctctcagttctgaagaaatttaaacacttacctgaaccgtgacaactgcggctccttggcatttcttaccgctgctgcctctgcactccaaatgtagtgtggtctgttcttcacgattcacatactgctttggcattgtgtctaacagctcaccatccagagcaacctgctgagattcccgaagagctgcggttctgaaaaacatcatcaggaggtaaaagaaagtcttaggaaaggttatatgataggtgataaaggcttccagttacccacagccagcattatagtgcagcaaaagacacataaaccatagtaacagaggaccaaaggttgtgagccaagacttacccaaatcatcccccagcagagaggctaaagagaaagctaagaaatgaaagaaaagcctatagagaagtgagacaacttgatagccacaaacaaagctccatttagaatccatgttataccaacagaccctacaagaacaactgagaattctatcctaacttcatcaccctcaaggggtgccttaattataagtaccaatgacttcttaggtattagcaactcaaaacgaaatgtcaaagaccaagaaagctaatcgcatacatggggtgtcaaaactggtctaacggtatgtatcattacattaatgggcaggtgcttatatgtgcactcaacacacacgcaacaaatgcctggaccaaaaacagacaaggaaaaaaatactgataagaaattgattcatggcctggcgtggtggctcacgcctgtaatcccagcactttgggaggccgaggcgggtggatcacgaggtcaggagatcgaaaccatcctggctaacacagtgaaaccccatctctactaaaaatacaaaaaattagccaggcgtggtagtgggcgcctatagtcccagctactcgggaggctgaggcaggagaatggcgtgaactcgggaggctgagtttgcagtgagccgagatcatgccactgcaccactccagcctgggcgacacagcaagactctgtctcaaaaaaaaaaaaaaaaaaggaaattgattcacataggatttgtaaaagtaaggctcgcttactgttaatgaaacagacttactccacgtacgctccttctcacaagatctcaagttagatcaaaaccttaaatggttgatcatattgtatccaccttgtgaactcaaaacaatgacttttccacacttcaatcaatatttatgtcaatttcttaaagaatatggagaagtagagagtacagcaatgagaaaagaaaggaactcttacttcacacctttccaacatcatctttccaatatcagaagatctcttcatgagaagcatacgaaaatcttagctggcactgctgatgctcagaaatgccaccacaggaaatgtgaaattgatagttggtgagagtaccacataatttcgatgtgaaattataagacttgtcacaacttggttaaccaagtgaaccgtctgggccaggttggtcaaactatcctcattgtaaaaatgctgacaaggaagccactccaggtagcaaattatccaggctgtcaaagccaccaacatgggaacatgatccgtgaggctgcatggtcttacctggcctgctgttgcaacagattcaggtctgtgcacaccagctgggtggcgtccttctgactcaatagcacagcagaggaaataactggcacaggaggcttcgtcgggtgcagagcaaggggaggctggggagcctcatgcttccgcaagttacttaaaaccctttctttagctgaaagaaaattaagtcatatatactgagcaatcaggtgaattagcaggagaacagaagcatgtggtacaattcagtagaattcctatcctcaaaaaatttatagtcttacgatagttgaagagttaaagctcatgatcttaaattattaccctagacaggccttgcatgacatgctaacaagtttggacttgatattagtgtaaagctactatctagtgccttacgctaatatcacgtggatctagtgaacacctctatgcaagcttgaatcagatggtagctatcatctgaataatggtttaggtaaatggagtaggtctggaggcaggtcacccagttaaggttttaatgccatcatccagaattcagaggaatagaagaaaaaggaataagcgttatggaatatagccgagtcaaaaatctgaaatcaggtcaaggtttgaacaggaggactggatgcagtaagagataaaatgaatgaagacatatgcataagctccttcagcacttctatttatgcagtcatatagtccatcagtcatttattcattcactcaacaaatgatttatggagtccaaataagcaatcctgtgccacacacacacacacacacacacacacacacaaaggtgaatctctaccatgcaactttgccctagattacacatgatctcatactgtttaatcaaattcaaatgtttgatacttctagacttagtacagagctgaatacacagtagatatccaatagattcctatcttccctccctctcccttcaccacactatacacataccacacagcaggtggggactgaataacatgaagaaaaatgctgctacctacccaattcttttcaatagcaagaaacagaggaaggcagtggtcaagggaatttcaagtcagtaagtcaagtcaacaagtacttaagggactacagtgaatttccgattacattccagatgtaacattccattttctattcttgttgagaaaaattaaagaaaaattaatagccatgactttacttggcataaggagacttgtattgtttgtaccccaaacagatggaattcaacatttcaaataggtcaagtacagcactatcccttatagttagtgtttttccactagaactaactactctttgcacagatgtaaccaagttaggtattcaccactggataagacttgttactatttatgttaaagttcctttcaagcaacataagaggccatgatgctaaaggaaaactgggggctctttcaaacccaatataagttaccataaaagaaaaaccaaggtattttaaaaacaaacaaacaaaaaatctaaattcatatttaacagtaatcaccactctggaccacaactgacaaaaatattgaagccaataaaacaaatttagtttaagaaaaagaaattgctatcacaagggtgctagtgaaatttttcctacaaccaatcataaccacaaattaaatcatttgatataatcatcaactaatctcttatatctgagaaaaacctgaaactcactatttagaagtataggccctaattttgtttagaagtacaaggtatcaccagacacaagaggtagaataatgagtggtgaacagcaggtctctggagtcagacggctctgcccaataaccagctatgtggcccatgcaggcaggtcacctaacagcttacaaattgggtttcttatctgctcaatagggataacctaacaacatagggtttttgtgaggactgagttaatgcatataaagcactgagacagtgctcggaacaaacgaagggcttcataaattactagcttaactccagcgaaaacaattcgtattttagggcagtgttcaggcaacatagaaacactatgaatggaagggcatgaacggaaatcatttaatagttcccagatctgttcatatatttcttcttcttaacaaactttcaggaatagaaaaatgagaatctacgttgttggcttgagggcaattttcatccctttctctatatacctttctatatcatttaatatttaaaattaatatatatcttttataatcagaaaaaaaattattgtttcaagaaaaagtgcagggagaggaaatgttggagggaaaaattttagagccttagaagaaaccagccagcaccattttacagatgaatggcgtgaagtccagagaagttcttatttgtctctcttcatacaactaacgcgttttggttagtggcaagctggaataagaaggtattctgcatttctctgaatcacctcagtgtcttcttacactatatattgtaataaatattttggtcaacaattgaatttacaatgatatgtcctatatttttgaaatatagtcagtaattaaaattaataggttaccccaaatatcagcaactttataggttaaatgggcttttgtggcctgatagaaaactaactggtaatttataccactgtttctctagaaaaatgtactgggagaaacaagtaacttagaaacttcaggaatctgattcatttgtatggtaagggttctaggtacaaaggaaaagagtttataaaagaaaaagacagacttctgattttcaaaactgcaaagtaattacatttacagttgcaatttacaccattgtgtaagtcaactgaaatctctttttaaagcaccagaggaaaaatgaacactgggggaataaagtatgtcagcctcaaccctcaatggctctgattcaatcattcattcactcattcgaaggggcaggtgctcccaggacccacccagcaaaggatcagtgaagtccagctgcacggacaaactgcagggtgtggaatgggactcaagcttggcctgtgtccacagaccaacagtctcctgaaactcatgatagatgcgctccatgttcaaatactccatccacagatcctgaaacagaacgacagtactttaactctgacagacaagtcatagattcacatataaaactatgtatttaactataaagtgaaccagtaagtttcaacacgaagtggtctactccaagtcctccaccattaggataaattgccattaaaatgaccactctaacaatccctgcagtagctgtaaaacttttttgattgtgtatcatgattagaaaaaattttaacagccctatatgtatatttgtaaattatatacatacactataaagctaatacattatgtatactataagacataggtaaaaaatagcaaatgttaaagaggtaaaaaataaaatgttaaaaaataatcaaatctgaattagatcaagacactaaatccaactatcaatttacagtaaatacaggggacagaaaaacatgttaaactacaccgtgaagatacaattagcaaaatccatactgtggggagcctctatggacaaactactcagtttcttcaacaaataaattgcaaggaaaagtaaagggataaggggaggacttgtagattaaacagacttataagacatatcaaccaatcacaacatgtggatcctgatttaaactatgaaaataaataaaaaaaaaacttttatgacatttatgagaaaggtggaaacttgaacattgactaaatatttgatataaaaaattatttctaatatgtttaggtatgctattgggttatgtcatttttttatccctatcttttaaaatcttcatgcatcaagtgctctctgggattacctccaagataaaatggaagaggaagtggatgggctatagatgaaactagacacatggcatatgtggggagggggagaagagcatgcccattatactgctctccctattttcctataaaatggaattttttcataataacaggtgtcaaataagtaaataaataaaatgagaaaacaataaatatagtagctctagtaacctctccctacactcccatgggctgtcttgcatattctgaattatatatatttcactttggtgatcactacactttagaatgggggactgcctttaacaacaacaacaaaaagtcaaattatcaatgaactttaaatagtaatagcaagtgagcaaacagggactatgggtttgtggaccgtgattttttttggattttaagtgttctaaaggcccaaggatccctctaaaccaaaaaatgtccttggcttctcaataagcatactgctgtgaagtcccaactcattatttccaaaccaacctcacagtccaaggcattccagactcagaggaggagctccaatgtaatcctgatcacaatcctgaattctacatgcagctgagtgttcaatgtgctgggctagatcctcctattgcatacatgctcctttaaatagggtcactctgtcactttctctgcctttatgccaagtaactgttaacagaggctaatgaatagagcaactactaggaattaatgataggtaagcagagacatcttataaaccataaaaatacaaaacaaccctgagcttgaattacagatcaagaaattatacatcaagcaccaagcaagggctgacttaaaaagaaaaagagagagaaagcaagcaattaattctgttgatgctgaggaaccaggataaatctcagagaaccaagaaagctatggctaatttttaaaaacactgaccaagtacctaccatgtacaaagccttggatatggatgaggggtgtcaagcataaaaagatgaggatggaactgaactcaaaggatgtcaggacaccatggtctcatgtgtatttttcttgtttctctggccctatactctcagtcttatttctctgtgcgttaaatgctgttatctctcaatgttccatcttcagtcctcttcttaatctacatattctcttaccactaaatccacatatccgactttgcctcattcctgaattctagatatatacctccccttctgaccaactccttgatagagagctctcgttgaagcccctcaggcaccccctcttccagggtttatctctgggggacaaagtcagaaatttggaagtctttgggtatctgattcttcctcgatatatttttaattcatccatttgtttaataactgctgctatttcaatagttctccaaacaaagacttcaaaatacaagccaaattatttagaaaagtatacatggcccttagggatttcattcctactcatctctctggtttcatctgccccgcctcaggtgctatgccctaccctgcacctttctgaacatgcccatccctttctcacctgctatatgtcgctgcacatactggtctttctgcccattaacatcctctctgccactccctaacaccatgcctttcctttccatctgcccaactcccatttgtccttcatggctcagctcaaaggtcaccactccaggcccaatccaaatcaggggctattcccctatgtttccatagtaccctgtgcattccactctcgtaatttttttttttttttaagacagggtctctctctctgttgcccaggctggagtgcagtggtgcaatctcagctcactgcaacctctacctcccaggttcaagcgattctcctgcctcagcctcctgagtcgatgggattacaggcgcccaccaccatgcccggctaatttttgtattttttagtagagatggggttttgccatgttggccaggctggtcttgaactcctggcctcaggtgatctacccacctcggcctcccaaagtgttgggattacaggcgtgggccatgcacctggcccataatcttgatcacaaaatgtaataactgtttgtttagtctcctgttggccaataagctcttaggaggcagggaatgtatcagatttctttttgtatcttcggtacctggcacttagaagacactcagtaaatacacacagaaggcaaggaaagcaagaagaaagaaggcaaggaatgaaggaaagaaaacaagaaaaagacacctactggagataaaatatacacatgatgtgaaagtaggagggtttaaggatccaaatgaaagtgtttcaactcttagagtttcctaaatcccatcctggtgctggggtcaatactcaaaagactgcagccctagaaaaaaaagaactagaatagaagagaattatcttccccactttttccctgtccccaagatggctagaaaagcttagagaaaactgacatcacaagttttggcctgaaaaagggtcacagacatctttgagtgcctgggggagaacagcttaggacatacgaagactgaaatcaagtggttccagaagagcaatcagaactgtgacaatgacaagtaagcacctccaagccaaacaaaggtgagctcctgatctcctccatgcaaccaacctcccacatcacatatggatccctacaaattcttacaaattcttacactgcatgtaagaatgggagtagagataattgcttaaaggtattcagctactaacaacttccaattaaaaaaaatatacagtcagaggaaggttatgtttatgaggtcgtaaaaagccctagaacaagcttcaagccttcaggtagaaggcacggtggggctggagattcaaaagggagtattccctccatataatcacttagatactgacaaaaccatagaaacaatgaccatctgagtgactacccattttcttatcaataaattgttttattatgaatatgaccagttcaaattacattcagatatgctaaaaaaaaaaaaaaaaaaaggagggctataatttcacctgctgattctgcatcacttttgctagcctgtgaatatcataatgctttggtagagaagggatataggtatctcctttttgaaaattctcatcttctagccataatatatatacattgaagagcctaaaagataaaaacataattatacgaaacataaaaagatgagcatacaaacaaagcttcttacatctctaggaacactggcacccctacataagagtaaagaaagcccataatacagaaaatgtggccaacaaccaccacggctcccagagaactcctggtccagcaggggaggcacgtcacagattattcaaatatgatgcgataattgctaaaacaaaaggtatgaagaaggggctctgacaacaattcttaaagtagatttaaatacagtacacagaaaaaaataactggaaaagatgatttttaccacagacctgggatctgaatctggagcttttctttcctaggcaattcagtcagttatttttgcttagaaaagcaaaaataatacattcaaataaaaacattttcagagaaaatattaagagctattttaaacttatgcattgtaggaattttccagctttaggctcaagaaccatctcccacctcagagaatcgcaaataaatatcacagcatgtgtgtacgcccctctcatcaagaaggaataaaatcaaatcagacttaaaaaaataaaagttctggctgggcgcagtggctcatgcctataattccagtactttggaaggccaaggcgggcggatcacaaggtcaggagttcgagataagcctgaccaacatggtgaaagcttgtctctactaaaaatacaaaaatgagccgggtgtggtggtgcacacctgtaatcccagctactcaggaggctgaggcaggagaatcacttgaacccggaaggcagaggttgcagtgagccaagattgtgccactgcacttcagcctgggtgacagagcaagactctgcctcaaaaaaaaaaaaaaattccaattttccagtaaaaaccttttaaaaatacaatacttccttcatttttattttgcttttgtttttaccagcagtgctagaaaaatagtcggcaaatacacaaattactgggtaggggactgggagatggtctggcctgactttactcaataaagtggaaaattacctcctttacctctgcaacagccagtccaggaagacagacaaggacagggctttggggttcttacagggaagaggttgctaagtagttctctcctccagcttctggctcagtgaaatagatggccactttatgaacacataccaggagggggatataacagaggcagaaaggaatatcaaagactctcttggcttatctaaaatattcacagagaaagccgtccactggttaaggctggttaaaaataagttctccttcaacaagcaacataagggaagaaatcattctggaggctgacagagagtcgtaaaaggttgagggcaaataaacctaaggcctcagtgctagatgaaatggggacctcacctagctattgtgtattgaggattaattcttaagagccatttttattaagtcttatttgtaagactagtatttgatttatatcaaacttataaatgaaaggggaaggaatagtgtgaaaggaatccaaacctacttcagagttcttaaccttttagaggaggcaaatattgtaccctgattttatagggcacatatttttgggagattactagacccctcatctcaggtggatccctgaatcccgtgaaggatctatgaaccacacttaaagagccctgccctggtcatttgtttcttttgaagagctattctaagctacgtgtggtggcacacacctgtagtctcaactgctcaggaggatcacgtgagcccaggagtttggggctgaggtgcactatgatcgtctcactataatcgtgcctatgaatagccactgcattccagcctgggcaacatagtgagacactccttcttaaaaaaagaactattctagcaaggtttttttgtaacagagtctcactctgttgcccaggctggagtacagtggcatgattatggctcattgcagccttgacctcctgggcttaagggatcctcccacctcagcctcccaagtagctgggaccacaggtgcacgccaccaggcttggctaattttttttttattttttgtagagatagggtctcactatgttgcccaggctgtctagcaggctttaatagttgtttacctgctatgataaaatttggcttatttctatttttacgtaaagaagtagaagaggatttatcgctcagactacaggcactcgacacaagtacatccaaactgttgattcagttctcttgaggaacataaaagagaaacatttcaagatgcaaatctatatcaaagccaccttccatattcaatctaaccgtgttaagagaataacatctagcagtttgtaacacagttaactgctccagcatagtacctgtgctgcaaacaacaatgtaggtggctaaataaccatactcacctcaccagctccttgtgcagttctggtgaagtcaggtaaccaggggtgccagagtggctctctggcagcccttcactgccctctgctggaacacggagggccttgcttgcagcatggtggaagtcagccacctcggtcaaacgtctcttcatttctttcaacaaattgatatgagcaggactttgaaaaaaccttcttccaatacaaccatctatgggtaaccttaaaaaacacaagcacagatctataacctttcaacacaagatgtactttctgtatggcataaaatagcagttaattagcaaggcaatttactgtgattgtggatatacaccattaaattaacacctattatttctacctcaaagattattttgatggtccaacaagatggtgtatatgaaagtagttttaaaaagtgtgaaatgctacacaaatttaagacatcactacttagaggtacagcataaagatggtttctattcttgaagaacttgcaatctggcaaaaactaaaacagaagcgactaagaatctatctatctatctatctatctatacacacacacacacacacacacacacacacacatatatatatatatatacattttttttttgagacagagtctcgctctgtcacccaggctggagtgcagtggcataatcactgctcactgcaacctccacctcctggcgactctcctgactctcctgcctcagcctcccaagtagctgggattacaagcatgcgccactgcgctgggttgtttttttttttttttagacagactcttgctctgtcacccaggctggagtgcactggcgtgatcacagctcactgcaagctccgcctcctgggttcacaccattctcctgcctcagcctcctaagtagctgggactgcaggcacccgccaccacgcctggctaatttttttgtatttttttttttagtagagacggggtttcaccatgttagccaggatggtcttgatctcctgatctcatgatccacccgcctcggcctcccaaagtgctgggattacaggcgtgagccaccgcgcctggccgtgctgggccaagttttctatttttagtagagacagagtttcaccatgttggccaggcttgtctcgaactcttgacctcaagtgatcctccctccttggcctcccaaagtgctgggattacaggtgtgagccaccatgcccagccagtatctatatatttcaaatgagtaagttaagggaatgaggaattgaggcaggagctagagagcaatggttcgtaatagtggatggctctggctgggtggagtatcttcatatgaatcccatgaaaatgctgaatattcccaagtacaacctacaggtgacagacaaagcctggcctttgttcacacgcgcaccactcatcacaaggtcccctcctacaagccccatgacggtcacacaggcagcctcagtttaaggcagttgctctccctttgcatctccagaagttctgtgtgaaaccttgcccaatcccagggtgttgtctttactacactggtcatggaagatggtaaagagaagctgccacaagacaccagcaactcaataaagatccagtctaataaatgtcaaacatagagacagagaaagagtcctcaccagagatcaccaaagaatgattccaactcacactccacagtctaagaacacatagaatgagagcagtgcaaaggcagaaatggactcacagaaacctacaatactgggcagcatacccatactgtggtcccggacggtgaagatacagaaggaagaacttctgccaaatgagtggcaggagggggtgatcagaaggtgtgaccagagcctggtgggcccagcgataaatcagcagcctctggagggatggcacgatggggagcttcagctgggtctgggctttctacaaaaaagaaagggctttgagtagccacaaaatgaacataaatgcaaacggttaactctttctaagtgatccaactgaaacaccaaacattctgttttcaattcaataatatattttttaaaagtcacataaaactcacttctccaatccactagttaacattttaacctccttggtagcaagacatgtagggcagctttttattctgtcaaaacacttcacagaccccaaaatgggtatgggtcttaagagtcatctagtctaacctcattttcatttctgaaattccttggcgaatacaacgttatagtgcaagggaatagaaagatatgaaaaccaaaagtaaagccggggacagtggctcacacctgtaatcccagcactttgggaggccaaagcaggtggatcacttcaggtcaagagttcaagaccagcctggccaacacggcaaaaccttgtctctactaaaaatagaaaaattagctgggtgtggtggtgcactcctgtaatcccagctactcgggaggctgaggcatgagaattgcttgaacccggaaggtggaggttgcagtgagctgagattgtgccattgtaaaattccagcccgggcgacagggcaagactctgtctcaaaaaaaaaaaaaagaaaaagaaaaaaagaaaatgtcactatgtgactgtcaaactttatcaatcttttgaaaattcagatttcaaaaggacattcgagaatgctgaattctttgagaggctctgaaacccaaaagcaaattctttaacaggctctgaaacccaaaagcaaaatctatactaaaatagaaggtctttaaagccttattccagtctttcccacatattagtaagcctaagaatcagctaggagtttcaaaaaataacctccttgtcccactcgagactcagagactccaaatcccagaagatgaggtctaggaatctgctttttaacaagttctccagggaattctgatgtacgtgggatgcaatgacaacacccgtcacatgtgcaatgatccagccttcaaatactaggctgagactcttgttaaacaaaccttgagaagcaagtactcttcaattacacagttttaagtattggtttggttgttgagctttccaaacattcacaacaaaataaaacacaaaagctcaaaagctacgggtgaatccatcagcatcaaagtgtaagccaccttctaccactcaaatgcagaactgctatttgtaccttcagagcttggtcaggggtgaaagcagagtttatcaccaattccccttcaataactctccggagctgggagtcctcttcaaagatggattccatgttgagcactgtccaggcaaaccagacctataatgacaccagataaaggggaggggaaggaggagctcgccccactgacgaaatacatcctgatattccacaatttaaatctcttcctatctcaagctcaatcagcaaatatttgcagtttctaaaattaacacctttttatacctacctatatccttgtcgcagatataaatttaaataaaatagatcattggaaaatgttacattcctttggaaaggctactttagtacaagatgttcattaactccatatttaccaggcaagatctgtgtgcaagagagacaggaaagaggaccagacaggggctctgtctttaagaagtcttccatctactggagtagacaagactaatatataagtaagcaaaatgtgaagttgagcagtgacgaggactgagtcaaggtaaagtgctatatcagagaaggttctatgtagatgtcagagggaaaggcatgctggtaagagaatccgctaggcagagacaaaaagaggaaaagcccgggatgtgtctaggtaacagcaaggagtttgttccagctcaatccatgagaggtgggaagaagagcaagaagtaagacaaataagaggttgaagaacattactactgatttaagagatgaaacagacataattttatacacaaagtctaagaggtggtaatgataaaaataatgctgctgctgatgataataataacaatggccaacactcagtgagcactggttatgtgcgaagcactgttctaaatgctttacatataggtgccatcattattcccatttgacaattgagaaaactgaggacagataggtaggcaagctgcccaaggcacagagctaacaaacggcagaaaccagattgaaacccagactgtctggttccagtgaccactctaaacctctctgcagtgctgctgggcagtctctgcagtccggctggctgcggtatgatcaagagctgtctactcctgagacagtccttaattccactgaacctcagttacagctagacacagtagtgtgcctgtagtccccaaatactagggaggctgggagcaggagaatcacttaacaacaggagattgagaccagcctgggcaacaaagtgaggccctgtatccaaaaatgttttttaatttaaaaaaaaaaaaaaagaaacaactcaggcagggcgcggtggctcacacctgtaatcccagcactttgggaggccgaggtgggcggatcacctgaggtgaggagttcgagaccagcctgaccaacatggagaaaccctgactctactaaaaatacaaggttagctgggcgtggtggcgcatgcctgtaatcccagctactcgggaggctgtggcaggggaatagcttgaacccgggaggcagaggttgcagtgagctgagatcgcgccattgcactccagcctgggcaacaagagcaaaactccatctcaaaaaaaataaaaataaaaataaaaaactcagttaactcctctgtaaaacaggaatggcaacagcacaacctcaccaaagggctactgtaaagattaaatgaaaaagtatacttacactagaataagtgctaaataaaagttagtttagacaattagtaatttctttgtaaggatgatcatgagattaaagttcacaaagataacaaatgatcctctcagtgagtttcctacctgagtgggcgtggccaagccctccacaaaggaaggagtgatgttgcctgccacaatccagcttaccaaagatgagagcagactccggtcacagtggtaacccaaggcattctacaccgggagatgtggagcagagagaggaggttttaaggaaaatcttatcaatgacctttacaagagtatcagcaactgtcttactacaatacaagattctgataagacagagatttcaaggatgagtccaccagcagcaatagtccaaggcagagcattacagccaaatgtaacaagcgggactcttcctgggctgtcctttccaacttccctagggtctacgctagtggactacgattatcgggataaggtaccattaaggcaaagcttaaagaaggtaatggccacagagtagaactgaaaactgtacttgggggaatctttttagaaagctactttatctagccaatcactgaaagataaattctctaacaggttaattaccttatgttgttggtagagtaatttctgtatgcagtcttcctgcatcagctgaaaagctgctttacacaagtggtccatgaggaagaggataggttgttctcggtaccagagatgctggcttatgagagcctgaacccagaactccaacacagcaacggggcccacttcattgggctgagtgcttacagatatgtgtgcctgtggagaaaaggctcatgtgatgggaaagataacaaccagcctctcattttttaaatagcaacaaaatgctatctacctccactacaaatcccaaatctattgcctttcttggccaaaagcacactaagccaagtgatctgaaatgactaaaacctaagtgtgctaacgctagaggtcttggttgggaagacaggcgggagtgtgcttaggggcttgcaaggccctcacctggatcatgctgttgagaagcttcacgttgtccccatggctggctcctgtcaggtgctgtgccaccttgtgggtgacctgttgtgtgacaccctgagggacaccgctgtccaagtgtaggaacaagaggagatgcgataaaaacctgccaagcacacaggaggacgcactttaccttccgatcagaactcaacagaattttccctaattacttatgaggaaacagaaaattcctaaattggtcccatttttcgaccaaagcactatttaagaagggattctagaagaataaagttttcacatttaacatgggttaaaaggaattctatctacccacagaggtattaagaacagatccacgacacacaaacacatgcaagttaaacagcattagaggaaaaacacccaaaggcaccactctcccctcctcactccccaactccatgaataaaggcagagatgtttccaaaccattcagtttccaaacttgcctcatacccagggtgctgattcttaaaaaggggttgaagggttaggtgagtagttcccaggacctaacccatttctactaaagtaacatctccgggggagaaacctgggaatccatatttaataagctcttttgggcaaattggagacatactgcttgaaaagacacataacaggaaaactgtaatgctccccttgtgcctttggatgtacttcatgtccccactgtacagggttcctccatatggggtgaggcctcacctcccctttcatcactgttcatgaggccccagccagatgctttactcttgcctccctagacaggttgttctcttcccaccttcctagcatcttatctgtttgcaacactgcactatgtgcactgtaaacaatttaaaacaatcttttctattgttacaatggcaaaccatttgctgcttaatatcagaagcacgattcccagaatctcagggaaacaactgctccttcatatactattaagctttaataagcaattcaaagttataataaatgaaaaggaaaaatatctttcatggtaataaaactggagtcattattagaatcactgttcatcaacctgcattctaaactggggtgcagaatatttttgccccataatacgctgttgaaatagcattccctttattttacttaagaaaccagaagacacaatcatttgtacttgctggactgtttaagagtgtctcctgccatagatggaacacacttactgctcattcttcagaaggtaatactggcaagggtaaaataaaggcagaatcttatccaggacatgaaccactgttctcaaatgtcttgactggaccagaattcccaatagtgggatgccttctgcacagaacttctcaatgctatggaaaaagagaaaggcactgaatacacaagggagctggttcataaaattctgttcttccaatgagttatgagccttcaataccttgggttatctcaggtctccaacacatgttttatacccaatcttcacacagaaatactaaacccagaattctagaattgcaaagaaacttaaaagttaatctttattttcattgtatggatgaggaagggtgaagtatcatgcccaaattcacataatttcctagagtaaggtcaaaatgagaacgccagtttgcaaatttctaatccagagtgctctctactaccatattttatttctcaaaaagagcttctcctaagagccgtagggactctccttgtctggatattcccacaaggtatcacagcaaagaggagactcaaaagtgacctcaatctgtcagtacaggttgactatcccttaactgaaatgcttgagaccaagtattttagattttggaacactcgtatcatacttaaaagctgagcatccctaatccaaaagtcccaaatccaaaatgccccaatgaacatttcctttgagtgcaatgtcagaactcaaagtttcagattttggagcatttcaaagtttagattttcagattagggatactcaacctgcataaactgcaaaattctgctaaaaccaatttggcataaaagttttattctctgcctcacttcaaagaatctatccttaaaaaataatctcaaatacggaaaaaaatataaaatatgatccatataaagaggcgcttttcaggtttatttttaactctaaaactgagaggttgaaaatgacttaaggcaattttagaaaaatcctttcaattggaaatattattgtatcattttaaaataatacacatgatgaccaaaggcaatgtggaaaaacacttctgctataaagatactagggaataagacataaaattttatactcatgatcataactactagtaaagaaaagttatttgtggaggcgaatacagggacaatgtcacaacaaaagagtcattgtacaagagtggcagaagtgagtggctttttctccactttcctaattctgcagtttggttatactgctttaattctgggggagaaaatcatttcaaaaaataaagtaattgtgcaaaggttatgccacaaggaagctacttacaattgtaaagtgaaaaactaaggatataaaattatacatacatctttaaaaagatcaaaggaaaaatgatggatgaaaataaacagaaaaaaaatcaatgattttatgatgggaaatattctgggtgattttctgacttctctacaatgtctgtaatattatattcacaaacaacttatgtccctgcctactccacccatacctaagattgttttaagttacttctatattccagtacacctaatcccaaatgcccaccatggagttttacactagagatcagccctgagaggaaatgctcattctcactctcactcccattcaggattcagtgatcagcacaaatcaaaagttatctctagagagagcccacagcagtatcagtgaataaagggctatggtcccagaatggatacaagaaattcgagaaatcataaaacacttaagttcagataactgcactcaagagaatcacgtcagacactgttctaggcatgttacatgtgtggttttttttttttttttgagacagagtctcgctctgtcgcccaggctggagtgcagtggcgcaatctcggctcactgcaagctccgcctcccaggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccactgcacccggcctacatgtgctctgactcacttaagcctcataaagtaagtttggtgttattagtactcccattttagagatgggaaacctgaagtacaggaagccgttaataacactagagctactggaaacaatataaagagtatgttcctaaggacccttatcaggtctcctcttttctaaatcaattctaccttcttttacttagctttcaaatctctccataatttggcccaaccaaacacctgatcacctccattctccaacatgaatcacaggcgtcagtgagaagtgtttcctcatcatttcccttcctctccccttacccactcagacacctgaggctcctttccacattcattcaacccaccagcatttgttgaatacctactaagtataagatctagagatacacaattgaacaggacaatgtccctaccttcatagagcaaacagtcaatgaggagcaggggagattacaatgacaataaaacacagtgagtgtgctgttcagaatgtacaggggctgcaggtggcaggagatggcccttgaagtaactgtgggcactaagtaactgtaagaggaacacaacatcactctgctcatcagcctaggatgttgtcttagtccatgttgcactgctataaaggaatacctgagactgggcaattaataaagaaaaaaaggcttatttgagtcataattctgccggctggaagactgggcatctggtgagagcctcaggctgcgtccacacatggcagaaggccaacgggagctggcaggttcagagatcacatggtgagacaggaagtgaggaggaggcggggtgccaggctcttcttaacaaccaattctcatgggaactaagagacaagaactcattcattactgagaggatggcactaagacattcatgagggatcagcccacatgacccaaacacctcccattaggttccatctccaacactggggatcaaatgtcaacatgaggtttagggggacaaacatccaaactgcgacagatgtcttgtctaatttaagactcctttccaaaagtcagctcttccatgaaggtatcccaccatactgatctctccttcctttacattctttctgctcagcttctaagtagttctcaatccagggtgtacattagagatacttagagaactggcccccagcccacttaggccaggattctcacccttttccctgcactgggatttttaaaaggctccaaaagtgaatctaaagaacagcagaagttgagaaccactgctttccacacatcatccagcctgcaattatattctatagtactgccgatttatttatgcctatcatctcaacaaaactgtcaacaacccaaggaaagctatcaaacaattctttatctctcctacttcatagcacaacgctgaagactacagctgattgcaactggtatcccactgaaattacacttactgtggaacaagatgttgaaatgaggatgctaaaaagtgttacagtgagtctaaaacataagaatcagaaagcagaggtcaaagagtgtgaagacaaataaatagactagaaaaaaattaatgcataagaaaagaatctttaaagagaaggatgtttaatcaactgagaagtcattcatgcattcaattatttactgcaccagatatagtcttcatcactagtgataaaatggtaacacaagacaaatgccattcctgggcacttctctcatagaagttatatataactgaatctctgagaaaattgaacagattaactatgatatagtgtgataaatgctccagtagaagacatacagacagctatgggctcatatcagagaggcatctgacctagtcaggcatttcattcttctagacagttaaggggacctctagttaagaaaaccaaacaccacatgttctcactcataggtggaaattgaacaatgagaacacctggacatagagcagggaacatcacacaccagggcctgtcatggggtggggggctgggtgagggatagcattaggagaaatacctaatgtaaatgatgagttaatgactgcagcaaaccaacatggcacatgtatatgtatgtagcaaacctgcacgttgtgcacatgtaccctagaacttaaagtaaaatttaaaaaaaaaaaaaaaaaagcctgagttgggctacgatcaatttttcaaaaattttactacaggtgatcaattatttttatttgatcacaattctgaggaagacagtacgaatctactgctgacacgaacattccactccaggagacaagcagaactctcttcataaagtaacatttaggtgacttgcttgtacaaatctgaagtatgtgaatttgggcagcatctccccttgataagctgttaatcaaggattattatttggcccaattgctccgcaataggtttgacagaggcctcagaacttgggatatgaaacataaaattctagaactatctgcaaggttcagtaaccctagtggttcagcccaacactgtacctgtggcccacagctgtcatagataaggctagataacagccaatgggcatgcccgctttcacagccttcaagagaggatgaaacgtgggtgactctgtcatgtcaggcacagtgacggagaagggaacagctggacaattcggctgtattccataatcgtttttgtgcagttttagcctcaagattaaattccaggcccattggttaaatgaggtctcgggtgtctctccatatcgaacaatactggccaaatatgaaacctaaaacaattatttattttgagccacattagtcacacacaaattaaatcagtaagctcatacactcatctccttttgtgaccaacaatgccctcaacgcagaggaatattctacttgctggtctccaattaatgttcactgcactacatcaaagcaatttttcactcgcaacttgcgcttacttgctagtcactttgtgaacctgatcttagctcatgtaaaagaaaagtgacataaaagttgatactcaatgaatagtgtgccgataaataagtttaaccatcaggacggaggtctcatatatagcgcttgtcaattttggtggtgtaaaaattcccaccatggtcaattttaagctaccaatggtttaataacctggcttgcaaagtttctaaaaatttaagtcagttctccagagccagtacaaccaagctctaacacaccactgcagttcaattcaaattctgtaatattagaatagttatatacaggctatttcttaaagaagaatctttatcaaaccatagaagtcaattataacatcttaaattgctagaaatgttcttaggatacctaatggtcaatagtataagtctatcatctttatttctaaatgtcttgggaagataaagattcatgtttccaaatcagaagagaaggaaatacctgcttcatactttcagagagaatcccagcatatggcttctgtgcaaggtacttctgataagcttcaagaaccattaaagccacttcagcatggactgcttgatccagatgaagggtagccttttaaagagaaaaataatcacaaacatacaaccttggttttgttttgtttttgtacctttgaatcaaaacattaggcagaatagtaacaaaggatcttcgatgtagaagctaaatgttccaaaaatcacatcccacacagtcaaactataaaatgacaatgggcaaaaaactgtcaagggcaataacactgtacctagataggtttgaacctgacttaacccctactccagccaaaaaaggttatctttgaatgtcatcccccattccacccaagaatctctacaaacacttcgggtcaagggcaacgccacaaaccaggaagatgcttaattaaacagaaaaatatttaatgaactgtctaggcgtggtggttcatgcctgtaatcccagcactttgggaagccaagacagacagataacttgaggtcaggagtttgaaaccagcctggccaacatggtgaaaccttgtctctactaaaaatacaaaattagccaagtacggtggtgcacgcctgtagttccagctacttggaagcctgaagcagcagaattgattgaacccaggaggcagaggttgcagtgagccaaatcgtgccactgcactccagcctgggtgacagagtgagattctgactcaaaaaaaaaaaaaaaagagaaagatatttaataaattatgtctacattcccttttcctgttctatcattagttacaataaataagacactcagcaacacaggtaaaatattccttctgatgcctgaagttgcctatcaaatttcctacactatcttcctttgcagcctggaaaaatacattccttaaacctttcagaaagatgactttcctaactcttaacaaaggcataaggagactctcacgcagctcttcaagaggagagcctaggtgattctgttcacaagccagagaatgtgaaggtggaaaacagccccctgtagctcttgcctacgagcatgtcaatgagagagggcccagatgaatctatgggcagtcccaagtggtcaaggacacctcagcagaaaagctcccgggcttcagtttcctcatctgcacaacaggtatcatgctgtccaggactaaatgacttgctcagaacaaaacctgtcagacaggtgtaaagggctgagtttgccaccattttcccttttaaatgttaatcttcttatggaagagctaacaaataaggcctatggtaaagaggcagagaaggtcttttaacagtgaaaatcacttgaaatgtatctctgaagatatatgctacatagcaaacccttaataataaccacaccactgagtacgtaatgtgtggcaagaatcatcctaaacatcttgtgtttcctcatttgtttaacctttacaacaactctatgcgcagtggcacgcgcctgtaatcccagctactcggcagaaggctctcttaagcccaggagttcaaggccagcctgggcagcatattgagactccatctcaaaacaaaacaaaaaacaaccctgtgagacattgaggtatactcgttaatatgaatgtttacaaataagcaactaaggcccaaagagtttaggaaacttgctcagagtcacacagccagaaggtggcagaactgggatcagaacccagggaggctggcttagagctcagactcttaaccaatgcatagtgtttcagaaaacaaccctgacaatgacatgcaagacaaattacaggagaaaaaggaatgagaggcagaagaggcaattaggagaaactaaagtaactagccagagacaaaacaacagatacagccaggcacggtggctcatgcctgtaattccagcactttgggaagccgaggcaaggtggatcacttgaggtcaggagttcgagaccagcctggccaacatggcaaaaccctgtctctactaaaaaatacaaaaattagtcaggtgtggtggcatgcacctgtaatcctagctacttaggaggctgatgcaggagaattgcttgaacctgggaggaggaggttgcagtgagccaagatagtgccaccgcactccagcctgggtgacagggcaagactctgtctcaaacaaaaaaaataaaaaataaaaacagatacatgggaataaggaaaaagggaagaattttcaatgtggaacaatttatcctcatttaatagttgctcattctgcaaaagagaattaaacagaaaatcctaaactctgacacagctacaaagaatttgtagaccttgcaaatggtactcagaaatgttagtgttttgacaaaatccttctttgaaacagatgcatgtacaacctccagtctccagggaatggtttgaacacatacctgtttagcaaatccccaattcagtccttcaagaataacacaggccagtttattcttcaccactgtcaggttgtaattcaataaccaatcccgaatcaccgctatctcagatgcagaaggttgccaaagatacaaaggcagttctttaaacaagtatagagaaaccttattaaaaagaaaacaataatcattaaataaagacttagaaacaatgctatattactacaatattatattattaaactgcttgtaaaaaaatttctccaaaaggaactggagtttttgtttaatttttagacaagtgaaatggaaatcacggacaaccaaatcaagtgggtattaaaattgatgatacatcaaaagcacatttcataatcctttgtaaagatcaatctttttaaatattcaaattggtatgcttcagtttaggtaaaccaccacactaatgcacatttttaaagtcatgataaatcgggggacggctattcactttgcaaaagaatttagcactttaagtaattattcattctatggcatttagaaagatactctattggcttccaagccatccaggccgggggtggggtgagtgggagggtggtaagatgaaacaagatcaacaaagagaccaagagttgatagctattgttaaaacttgatgataggccattataccatactattctcattacttttatatgtatttgaaataatccacaataaaaaatttttaaatcctatttacagaaagtctacagcactacttttaaaataacacatccaagtgtgcaaattaagataaatctgggccaggcatgatggctcatgcctgtaatcccagcactttggggggcccaggtggacagatcacctgaggtcaggagtttgagaccagcctggccaacatggtgaaacctcgtctctactaaaaattagccaggcatggtggcacgcgcctgtaatcccaactactcaggaggcaggagaatcgcttgaacccattggcggaggttgcagtgagctgagattgaaccactgcactccagcctgggtgacagggcaagactctgtcttgggagaaaaaaaaaaaagaagccaaaaacaagaaaaacacttgagaaaaatgtcatgagctcaaactgaaagaatcatatgatccactgtacatttctctggaattcatccactaatcactcaagaaggagcaacagaaaacttcctactgtattgaactgtatatgaaaagctttttatctcaatataatcatcttgcagtagcatacaatgtttttcttttctttttttttttttttgagacagagtctctatctgtagcccaggctggagtgcagtggcgtgatctcagctcactgcaagctccgcctcccaggttcatgccattctcctgcctcagcctcctgagtagctgggactacaggtgcccgccaccacacccggctaatttgtttttttttccatttttagtagagacgggatttcaccgtgttagccaggatggtctcgatctcctgacctcgtgatccacccgcctcggcctcccgaagtgctgggattacaggcgtaagccactgtgcccagccaacactgtttttcttaaaaggaaaatgaccatgtactgccactatggaaaacagtatgatggctcctcaaaagactaaaaatagaattatgacatgatccagcaattctacttctcacatgcccaaaagaagtgaaagcaaggcccgaaagagatattggtacatccgcattcacagaaacattattcacaatagtcaaaaggcagaagcaacccaagtccccatcaatgactgaatggataaacaaaaagttatacacacacacacacacacacacacacacacacacacacacgcaccaaggaattattatacaggcttaaaaatgaagtaaatgctgacacatgctacaacatggatgaaccttgaggatatcatgctagctgaaataaaccagtcacaaagaccatatattacatagttccattaatatgaaatgtctgaaataggcaaaaatctagagacagacattagattagggcttagggccctaatctatgaaaggtgcttaggaccccaacctaagaaagcttcttagagctgaaggagatagaagagtaagagtgatagctgggccaggcacggtggctcatgcctgtaatcccagcactttgggagaccgaggtgggtggatcacctgaggttaggagttcaagaccagcctgaccaacacagtgaaacctcgtctctattaaaaatacaaaaaaattagctgggcatggtggcgggcgcctgtaatcccagctacttgggaggctgagataggagaatcacttgaacctgggaggcagaggttgtagggaggcagaggttgcagtgagccgagattgagccactgcactccagcctgggtaacaagagcaaaactccatctcaaaaaaaaaaaaagtgatagctgaagtctaagggtttttgaggtgatgaaaatgctctaaaattgactgtgttgagagttgcacatatctgtgaatagactaaaaaccactgacgtatatactttaaataggtaaattgtatggtatgtgaattacatctcaagaaaacttttgaaaaactacatgaagattgcaaaagggattgtgacaaatgacagaaacaaattaaatgtgtcctcctcaacttaagttactacatactatttattttgcttttggctgactttaaataggaccttctttgtcagttgtttattccaagtataaaatataaaaactatgaaagccaaacaaattatgaaataaaaattgttaattaactataggtcataagtaaagtaaaaatatgttattgaacgaggtggacaagtcaaccttgagatttgagagaaacaatcacatctttttataagcagcagctaatcccaagttggtgtggtgagtgacacagaggctggcacagtaaatgttagttccttttatcctgtttatacccctagtgacaagatcattcccaagaaccttcctatttttgccaatgttccattactccaagatttgaaaaaacaaaaacaaacaaaatcagtgctcttaccattccaacctggtcaatggtctcttgaactctatccagaaggacggaaattatctcagggtgaacagctgtgatagtccctaaaagctctcgaccaacctttgaaaaagtctctctggtagacaaggtgacataagatacctaaatggggggaagggggaagaagatggcacttttaatatcaattagcagtcaaaacacacttatatcattttttcaagcaaagcagaaagaatcttacattgagccttaattgacactatgttccaaaaaatgttaaaacttcatacaggcaactgtctactctgaggccgaaaggtgcagggagaggaatataagagaatggcaacttcttataacaatgacttcaagtgtggattcaaaaagtatatcccaaagtctgtcggtaacaataaaatggttcctgcagtttcaaaacttttctaaatctgaggaaatcactacaatgatgaaaatcagaatgcatttcatggaaatgcctagcttcccctacagaataagaaccctaactacaagaccttctaaaacattgtttaccaactccttttgaattatgtcttccaaagtgtatgttacaatccattaatgccaatggtattttttaacacaatggaatatacagaaaaataacagaataaaataaaatagaaaaatgtaatagtgtatcacaggtagattaagtattgcttcaattgtacatacacacacaggatcagaatgtaatatagaatgtaatttttattgtgactcctggtcaaaacactggaaactttactcaagagcataaatattactttagcaacagatcttgagaatgtcacttaatgtctgtgaaaatatgtcttctctccccaagtttttcagatcatgaagacagtctgaattccagatccatcgagatcttaactttatgcatggttatgaagtaccagtataggaacagctgaatcaagtatttgatcctggaaagaacatccaggtttgtcattctcaaactggattattaggggaagataataaaacccaaataatcatcttcaaacataattttacttgagcacactagaatactttggaggagatattttgtatgcagataaacagataaatgacagcttaaagtgtaaaatgtgcaaggctttttaaatatacaaaaaactccaatgaacattttggtaaccactttgggctagtccctagatgctcaggggtccaaatttcactcccctccaccttcacggatggctcagtgaaaagatgaagaatgcaaggatctcctcccagcctgtaatttcatattatagatgaggaaaatgaagcctggggtaataagttatcttttttgatgtgagatggccaattaatagcagagttaaaactcaggtatcctaactccaggttcaatattcttcccaccatctcatttaaactggctgggaagctaggtttctgctactagccagagtggaagagtttagttgaaggggtgggggcgagggaaacatacatcataaaaactgtgtcaggctgtgtcacattgtctctcccttactgaaactggtgcaacaaatttcaaaagataataagtactggggaatggatataattcacattttcaataatccctgtagcaaaataatgttccactgattctctatcccttctctgaagtgtagacagtagctaaataagtcacaatttgtaaaagcaatcccccaaaaaatcaacagatggacaatccaaaagaaaacatttttagctgatttataaaacttcatattctaacctcatatatctccagaacaataatttttatgaagtcttcgtccacattggttcttctggcctgagccatctgagcaaaggtagtcagaaggcaaatctcttctgagctattcatagaagaaagacacttctcaaagttggtaaaatgttctgggtctgcaagttcatatcaagaaaattagagtggggaaagaataaatttatatcttttaatcactcttccagagaaaaagatttaggaatatttaaagatacaaaaggtctttctttgttccaaaatagatttctacaggcatcaggaataaggctggaccagatggcctctgaaattccaacaaactctaaatataatgtagcctcacagaaaacatttaacatctcttagcttcagtacccacatctgtctcaaaaggttacttaataagaaggttaaatagcatgtcactggtgacgtgcttagttaactgcaaagcactgctgctgtcaccaggcagtcaccttcaaaggcagtactgccaacttcaaaggcacacttgaagctacttggtaactgtcagacaaacaaagacctgactaatgaaaactgctaatactagcaactacttggcacaaatagggcattccaaaaaaaagagatttgcttatgaagaaaaactgggggcaagaaattagttataaccgtaaatgaaatactaatgaatgtcataaacgatataataaatgtgatatgttttgcctatatcacaaaggatgttgtaaaagcaatactaaattctgccattaggaagcaatattcacaaatatacatgacagtaaactacatgcaaagttctacagcagaaaggaaaaaaagcccattttaaaaatatatgtgcttggccgggcgctgtggctcacacctgtaatcccagcactttcagaggccaaagatgggcagatcacttgaagtcaggagtttgaggccagcctggccaacatggtgaagcctcgtctctactaaaaatacaaaaattagctgggcgtggtggcacacgcctgtagtcccagctactcgggagactgacgcaggagaatcacttgaacctgggaggcggaggttgcagtgagccaagatcacaccactgtactcccacctgggcaacagagcaagactccatttcaaaaaaataataataataaaattaaattaaatatatacatatatatatatatccttgatggaacttttcacagtaagaaggcaacaagccaataattcttttcatatttacacatttgagaaaccaaggtagatagctcaccaaatttcctgcattttcaaaataactctgggacatttaccaaaccaattttcattttccatctccaaattggatttatagtggaaattattacacaaagtattcccagaataatgaaaattggcatgatcattctaacgtatattgtgaaaggatatttaaaaagaaaaaaaagaattatcattcaaacttacaatgtttaaggtacaaatcaaggaaaaggccttatattttaaataactctatagaaaaaacaatgggaaagtgaaataactttctaattagcttttaaaatattaactataaggacaaacacatttctacagttatttatcatcagatttgcttatggctacactttactagtagtcagaatgttgattagactagaaataaacaaaaagaagccaaattaaaacagactggtttttaacaatcattgctaagaaatctgctagttagaaaatgttaaaactagttaaaatttgttccctggaaactgatttcaagctcaccctactcctattaccacagataaataagaactggttataaagaataagcacttctggcatttactaaatataaaaagtgaggaagggaaaagatgttagaaagccttattcttccacaaacaataaaaatcaagcctcctaacaaaattgatatataaaagattaagcaaaggagaagatgaaaaaacagcaaattagagcaggaggatcaaattttgcaaagactccactctcaaagctagaacatagtaggcagatgaaacttctctactgtgccactaactcctgtgtcaggtgatacaggccctaagggagataaagataaaagtgccgtggaagcctggagtccagacagaaaactccagcagcaggatccaaagctctagggcaaggcaaggctggtactgccacttcagggtctggaatcacatccactacagagctgagctgtttgacatcggctccatctgccacatgctaacacagagcctggcagatagtaagtccgcaatgaagggagatgacactacaaaggagacctacccaggactcaggtatacaaagtagtgctgctgaccatcccaggcacttccaaaggaaatgtctgcttctgtattagctatttcaaccacagaaatagccgccagaggacagacaatggctgtgagacctctcacctagctcactcgtaagcccaggtccaaccacggcaatggtctaatagaagcactgcccccaggacagtggagaagcactttacaaagaataataatataaggaatccagagctaccactaagaagatagaaagaaaaacagaaagggacaaaagaggacgcatgcagagccccataaaagaaaaaaacagaaacagaagaataaagacatcaagagagacagaaatggaggctgagtacggtggctcacgcctattatcccagcgttttgggaggccaaggcaggtggatcacttgaggtcaggagttcaagaccagcctggccaacaatgtgaaaccctgtctctactagaatataaaaattagctgggcatggtggtgcacacctgtaatcccagctactcaggaggctgagctaggagaatcacttgagcccgggagatggaagttgcagggagctgaagttgcaccactgcactccagccggggcaatgctcattctcaaaaaaaaaaaagaaatggaaataaaaaaataaatcatgaatgtctgcagaaactactttgcaaacagtagaggcccaataatttttaaagtatatgattttcttttaagtgatacagacatttaaaaatttggaaaacagcctttacttcctgctgtgaaggaaaaaacacttggaaaacagaattatctttggtgtttttttttagtcttgtatttcagtaaattgtctatcttttttaacgtatagggtagttttttaaaatcactacaacatacatctaattaaatggtgtttttcatttcgaacattataattttgttataagtaaatatcctggccaggcacggtggctcacgcctgtaatcacagcacttgggaggccgaagcaggcagatcacctgaggtcaggagttcaagaccagcctgggcaacatgatgaaaccatgtctctactaaaaatacaaaaaatagccaggcgtgatagcgtggacctgtaagcccagctactcaggaggctgaggcactagaatcacttgaacccaggaggtggaggttgcagtcagccaagagcacaccactccactccaacctgggtgatagagtgagaccctgtctcaaaaaaaataaaaaataaaaataaataaatatcctgtagtttagaggtggtatgacgcaaaaacttaagttttcaccaaaattaatttttaaagtacacctgtctacatctttagttcataaaaacaatacaactttaaaaaaacagcaataaaagaaagatattaaaatggctgggcacaaagccttaacaaatttctagacaattaatacatatctgttaatacaactgtcaactagaataatttcacacacacatgcaaaaaagtgcttcctaaaagttagaatattgtgtgtattggtatactgtttgggactaatcaaattttgatttcagatatgctagttgctatttaatacatcaaaactgtgaagcagtctcctgaatttcaaaatcattacacatgagtatgtagagtaaaacattttctcttagtccttctaaaagtaaaaattaagccctgaagagaagcacaaaaagatagggagagctggacgccgactgctcggcggggctgtaccttggagctgctgcttgcactgggcgggctgcagggaggaggagagctgctgcaggttctcgctctccacctggtgcatgaggtagaagagcttccacagcatttgcacagacagagtcccaaagggcatctcggacataaacagccaaatgccaagtctgcatgtaagcaggaatcattttatttattaatcagcttcattacactaagaaagtagacaaaccattggctctcaaggaaaaaaagattcttaaatcacactatgatttttctaatatgctttagtcataaacacctcaaggatggctaagaataacagcaaatacaaaccacccagtctgtgccagggactgttctaaccacaacaatgtgtgcatgtgtgtgtgtatacatgtatgtacaatatcaactcaaaccatcctcacaaaaaccaagacaataattatggatatggccgggcgtggtggctcacgcctgtaatcccaacactttaggaggccgaggcaggtggatcacttgaggtcaggagttcgagaccagcctgaccaacatggtgaaaccccatctttactaaaaatacaaaattagccaagcgtggtggcgcatgcctgtaattccagctacttgggaggctgaggcaggagaatcacttgaacccaggaggtagagattgcagtaagccaagatcgcaccattgtactccagcctgggcaacacgagtgaaactccaactcaaaaataataagtattattattacggatattagcaccaatgcacacaggctactaaggcgcacacaggtactaaggcacacacagtagtgggtggcagagaggccagctgtggatgtgtgtgtctgagcacacacacaggtacacgtgtgcccacagacacatgtgcagtgggtgggaggaaaatcgaaatccatccagtactcctctctgaacactgaacaaagttcaaattcctcagcccacattcaaaggcttccacagtatggctctgaatcatatttccaaccacagccctctctgtcctccttcagttaccactgcattccagcaagcctggagagaccccacacctccaggctggctccttccatgggtcaagccctccttggacttcctcctctgcactattacagaactccatccatacctgactttgccatcatcatacattctgccagtgatccccacactgtagtggcagaaaaaccacctggagactttctggaaaatgcagattcccaagcctcacctatagagaccatgattttgtaggtcacagctggggcacaagaatttacacctttatagtcacccttggtgactcagactcaagtgattcttaaaacacaacatgagaaacccctcatggtactgtaatttacatatgacatactaacctaacagcaatttgagagcagaaaccatgtcttgttcatttttatataaaccagtttataactagaaccttgtattttaattatctgctacttaaaccagtatctcaaaaacaatcagcactcaatagatgcttattaaaattgtatgtaaatgttatcacaactaaaaaaaaacacttgtatcaggatggtggccatgccccaagtcagaatctgctaaggaatggctggatgcggtggctcacgcctgtaatcccaacactttgggaggctgaggcgggcaaatcacttgaggtcaggagttcgagaccagcttggccaatatagtgaaaccccatctctactaaaaatataaaaattagccgggcacggtggtgtgcgcctatagtctcagctactcgggaggctgaggcaggagaatcacttgaacctgggaggcggaggttacagtgatggtgtcactgaactccatcttggacaacagagtgagactccatttcaaaaaaaaaaaaaaaaaaaggaaatctgcaaaggaatgtacagcaacttacctgttattaaattaaaaaaaaaaaaacttaaaaaaatacgaggcactcaaagctgttgccgtatttgagaaacaactactacaaatcatccaattacaaattatctaattacaaataaaccaaatttaagaaaaaaatgaatagtgcatgcctaatccacatctatgaacctaaacaggcaactggtagttcaaacccacacttacctggactctggaaaagccagctagacttctgaacaagagattaagaaacttctctaaggtcagttgggccaggtttctatcttattagttaattatcctaacacttcacatgggacctgatgctgttttataccccaaaacaaagaagggaaattgtagaggacttaaaagtaatatcacaaacagggtgtatttcaggctataaaattccctatatggcagacattcaggaagtctggcatatatatacatatatatacacacacacacacacacacacacacacacacacacacacacatatgtatacacacacatacacgtatatatttatataggtatttatatatatatacacatatatatagatatacacatatatatacacacacacatatatatacacacacacatatatatacacacacacacatatatatatattttgagacagagtcttgctctgctgctgaggctggagtacagtggcgcgatctcagctcaccgcaacctccacttccggggttcaagcgattcttctgcctcagcctcccgagtagctgggattacaggtgcctgccaccacgcccagctaatttttgtatttttagtagagacaggttttcaccatgttggccaggctggtcttgaactcctgacctcaggtgatccgcccacctcagcctaccaaagtgctgggattacaggcatgagccaccacgcccagccctggtttatatttttgttgtctgtcttttagtatagttcagttttgttttaggttgaagggatagctattgccagaaatttccatttgagtgccgaataaatttaaatttcatggctttaaatatctggttctcatataatttgtttcctaaaataaacttaagaacaatagctgtcaacattttaaaacaattatctttgtgaaattatatacacaatgttacagcaagggttcacagctcaatatataagctctagtaagtaactaggatgagagctttgcctctccactaagcaagcacaagaacaagtaacagatcagagaaggaagactcctcccatgcaccaggccagcgtcagtggacaggtgctactgcactgatgccctgacacagtcctgaacaggatttggtgcatctcatgagaccaccaaatttatggtataagtataacaggagtaatctaaagataaggccgggtgaagtggctcatgtctgtaatcacagcactttaggaggctgagccgggcagatcacttgaggtcaggagttcaagaccaacctggccaacatggtgaaaccccgtctctactacaaacccaaaaaattagccgggcatgatggcaagcgcctgtaatcccagctacttggaaggctgaggtggaagagttgcttgaacccaggacacagaggttgcagtgagccaagatcatgctactacactccagcctgggcaacaaagtgagactccatctcaaaaaaaaaaaaaaaaagataaatttctatacccaagttctatttaagttagactcaatgccttcacagtgtctaaaagtggttaacacttagctaagacctcctgatctttctctaagtctctagattattctattccccagatgaaaccacacaagaaaaacccccacttacatttgaaaagtcctttatggtttaaaatgtatttcctcatattaccacaattcaccctcatcacacatccatgaggttaatggaacagtagtatcattatcaccatctccgttttagaaatgaaaaaagtgagaccacaaatattaagcgactttcccagggtaacagtaaatggcagaccaagactcaaacttactatacaacacagaataaatcaggggctaaggctaagagttacatggcaagagggagtgtaggcagctagctcaggagagggccaaagcaggggagagccagtagttcataagcacagctgggtgggggtggaggcagccccgcatctcctagcggagggcataatcctgcagcagagcccactcctcaacttggccagtggctcagggaagggagcacgggatgtgcagctatgcccttgcctatgcctcaaacaggtcctaggctgtaagcagtggcacagtcagcatgatccaaagacagcatttacaaagctaagacagggaaccaagatccatgacattcccagaccttaaaacccttaccggaaggcaaattgaacaataaaatcagcaaatcatttgcaccacatgctgcacacctactgcgtctcactgcaggcactgcagtgggtatgtgatagatagaatctatccttgttttcccctgctcaaggctgccccaaaagttcagggtggcaaaaaactgagacaccagaatagtgttatcttaaaacagaaagaaattgagagagagagagagaccatttcagtcaacaggtgggtactacagataaggaaaccaaggcccaagaatttgccctcaataagaaatagatgaaatacactaagaaactattataaaagacctacttaagtggctttcaccgaatggttcttactagtgaggaagttacttctcactaaatatcatcatatgtcttacttaccttttggccttcagcacatgtaggacagccctcaaaaacagttcatcaaattcaacctgtagtttctccatagagtagggctgttgggccaatcctgagccttggttatggctcacatactgtgcccaatggtcacttacataaccaagagtcatcctgagcatgaggaaagataatacagtacttttcattagctcaatatctgcacctttatattacatttccaacattcatttattcaacacatatttattgagcacctactatccacctactattgtccaggttctgaaactaatgaaatggggaaaataaaatcctaccttcatggagcttacatttagtgaagggcaaagagacaacaaataaaataaagtcatatacagtctgtcacatggttgtaagtgacactgagaaagataaagccagagaaaggaataaagtatgtctggaggtggaggggtgggcaggataaggaggtgggttgggagcacgaaagggcttactaaagagggacatttgataatgtctggaaaacagtgaggaatcacataagtctctatgagaagagtgtccacgtagaagaaacagccaatgcaaaagcgccgaggggtgtcaggtatgtttaggaacagcaaggaggccaatgtgctgagaggtagactggctggagatgaaatcagaaaagtggcaggaaaccagatcgtgaggggccctgcaggccactgtgaggacgtcggctttttccctgagtgcagtggggagcacagtagggtcctgggcagacagtgaatgggctgactcacaattcataaggaacactggctgtttaagaatacactgaggtggggaaagggcagaagcgggtggtgggcaaagtcagaagcaggaagataagtcaggaggtttaggaatgaaatggggtgctagcagtgaaggcggtaagaagcagctagattctggaaggagcatgtttcattgattcaaaaggatgcatgtctttcacactagtatccctgcaattagaacgtcagaatccatgttaatattaatgatgtgatgccataatttggcagcattttccctatgttagtggcatataaaatgtatcttaaaaaataattggtggcattttagatttgataaaagatggtattttgatggtggagatgataaaatttgcagttagattgaatgtggggtataaaagaaagaaaagccacaggtggcaccaggtgttttggcctgagaaactagaatagagttgctacttaatgaaactgggagtagtagtttgggaaggggggagagtgagttcattttgagaacactacgttacaatgttaatgagtcatccaagtggaggtgctcggttggtagttgaatatacaatgtgtttatgagagaggtatggactggaaatataactctgagaattgtaacagtgtttagatatttaaagatgaatgaatgacatctcaaaaagcaagtgtagataaagagaagagaggtccagggactgagccctgagacactctaacattaagaagcctggaagtgagaatgaaacaaccaaggaggcagaaaagggactgtcagtgaaatggtggagaaatcaggagaatgtggtatcctggaagccaaggaaagaaaatgttttaaggataaaatgatcaactaactacgagaaaggctgctatgtaagctgcgtgagagatgccaagtaggatgaagagacccagaactggccactggatctggagcacaaggttcattagagatcttcatctgtaggagctgtttgggtagcggtgggaggaaaagcaagttcaagtgaggatggaggaataaaatgggaactaatagacgatctgaaggcaagcccttatgggaaattgttctgcaattagaaggtatgagaagaatctgcactagatacaaaaagtaagcagatggaaagaaaaacaaagaaagaataatcataatacactacagctgttatttacacaataatgtaaacagtgatcttaaaacagtaatgataccaacgtccttcctatagagttactgagagaataaaataagaaatcacagtcctggcatacagtaagcacgcaatcctacatcatgtaagtgagcttatggacaaattttatttatggtcttatttattaagaaaaatcagaaaaagaacgtctggatggacttctgttaataacaggtagatgggcttttagcttttaacaaatttatctccaagtcaccagccatcctccctcccactgtctcattctcctaactctatactcaaggctttctctagacctcaggagggacccccaggccgggcacagtagctcatggctgtaatcccagaactttgggaggccaaggcaggcagatcacttgaggtcaggagttggagaccagcctagccaacatggtgaaaccccatctctactaaaaatacaaaaagttagctgggcgtggtggcacacaccaatagtcccagctattcgggaggctgaggtgggagaatggctttaacctgggaggcagaggttgcagtgagccgagatcgcaccactgcactccagcccgggtgacagagtgagaccctgtctcaaaaaaaaagaagggacccccacccttttagggcatcctataatcacttgactgatttataaagctaatggatacatatctaaaataaatgaattaggccaggcacggtggctcacacctgtaatcccagcactttgggaagccgaggcagatggatcacttgagtccaggagtttgaaaccagcctgggcaatgtggtgaaaccccgtctccactaaaaatacaaaaattagccaggtgtggtggtgcgcacctgtaatcccagctactcaggaggctgaggcacaagaattgcttgaacccaggaggcgtgggctgcagtgagacgagatcgtgcccactgtactccagcctgggcaaaagagcgagactcatctcaaaaaaataaaaaaataaaataaatgaattaaaagtaattttgttttggaagcgaaaggagggagagaagttttgtagttttatggagtttcttttgggtggggaaggaagttgaataacagcatacgtatatgctataagaaatgatccagtaaagacaattaaaattaataaagcagaaaaaagagtataaaattaattcaaagaaaagcagtacatattctctaaatttattaagacagctgaagcagtaagagcctgtattttcctagatgccttctctctcacccagacttcaacccagcaacagctttggggatctcaactccaagaacaatcatctagcaagccagttaaatttgagataattaacgaaatactctaactggaagcaattatgaaattcccatcttatagatggtgaagaaaaaaatcttaactattacgagaaataagacctgaggtttacaactaaaacgtccatcatcccaattatgcagtatctgtgtctgaccagggtgaaaggaacagagaagggtagagcaacagcagtattacctgatcatataaccaattcgcttcacaaactgcctatagcgtgctctattaaaggtttctaaccccacagccagaagttccactagtgagttggcaaaggcaaaaattttcatcatctcttgaggtcttgttgtttcaggtaaataatcacctagaagttaatcagataaaagaaaaaaatcatagttactatgaaaaaacatgaacggatacatctgtataaatattttaatgaggactcaaagccaaggtggagaagaactgacagtctcattactctggctcccatatcaacatgaaatgggaaaaaacttgagacaatgtgccaaattaaaaacaatttatttaagttgggaatgtgcaagctagctagctttctcacatttaagcaccaagtgggaaattacaagcacaagaggagcctagaacagctaggcacaagaaacccgagttggagcctacacaagaagtaagactcgggccaggcacggtggctcacgcctgtaatcccagcactttgggaggcggagacgggcggatcacgaagtcaggagatggagaccatcctggctaacacggtgaaaccccgtctctactaaaaatacaaaaaattagccgggcgtggtggcgggcgcctgtagtcccagctactcgggaggctgaggcaggagaatggcgtgaacctgggaggcagagcttgcagtgagccgagatcgcgccactgcactcaggcctgggcgacacagcaagactccatctcaaaaaaaaaaagaagactcaatgcagagttcctgtgtttacacttgccactaccacattttacacttaagagaaatgagtctaccttttgctttaaacccaagaagatgctgaaagagttcatgaaaggggaactgtgctaaaatggtaaccaaatcatcttcattaaggagaatccaactggtctcagggtcttcatcctaagggaaaagacaaaaaatcatgtcagcagatttgatcagatcacactatgatctagcgttacaggagctaaattatcacaggtctcaatggtatacatgtgatatcctcatgagtcttcatggaccttttctccaggacagcaatttatagtatcagttccacagacagttacacagtaaatcccctgaaattccaagcacaattttatatgtatctgggtcacagcaagtgattgaaactgctctcattaaatgtccatcccaaagaaaatagaaaaaaagaaatcctctagagtgaggaccttatagggatcagtgctttgataacatcaattaaagaaccacagatgggccgggcgcggtggctcatgcctataatcccagcactttggaaggccgaggcgggcagatcacctgaggtcaggagtccaagagcagcctgggcaacatggtgaaaccccatctctactaaaaatacaaaaattagccagatgtggtggcatgcacctgtaatcccaacaacttaggaggccaaggcatgagaattatttgaacctgggagtcggaggttgcagtgagccgagatcacaccattgcactccaggctgggtgacagaacgagactccatctcaaaaaaaacaagaaccatagatgagagttcaaagttatgttagctgcaattctcttctcccaaaatcaagatctatgtagtatgcaacagacttaagacgaagcaattgacatttgctataggtgactaaagttctgttgtcaattactgctgccaaaagcagtataaaaataacagtggtcatacacaaagattacataggggaaatctttgcggtcttttcgtttgacacagagcactaaagtcaccttagaaaccaagttgattcatgtcccttaggacatgaccattaaaaaggacgctaccattaaaaagggaaggaagtaaaaagatcctgagaacctgaagaatatatcacctcaatttcaacaagggactaaggcaaaatcattcataatttccttaagccactcaatttttacactcttattatgtatctaaaatggctaacaagcatttcagaaactctacttaaggcagtagttctcaacttagctattctcaactcaaaggtacatttaacccccagggaggcttttaactatttggatgtctgggtgtgggcctgggcaaggtttgcaagttgcccaggtgattctagtatatagctagtaacaagaaaccaatgatgtggataattcagagtgccttcctccctacagccttttctgaggtaatggcactcccaactttctcatctactcctcaagttcttgaattcactgaatatttagggagtgctaaacaggagccaggcaccaatgcagggtgagataattaatcaaatattttgactggaagtatttataacgcctaatcattacatgtaattataacgctccttaatcattatctgtctgggattaaatgcaggaaacctaccagaaaaaaagacttctcccccaagaaagaccactctaaaaaaaacatattgctccactacaatctttaaaagaccaatctgtactggctcctaagaagcttgcttcagaatgactcctcagtttctagcaaaaatgcctgcacatccacgtcatttaccaccacctgaccacctcctcctgcaagtctcaggaagagaaaaacgactgtgaagggggctccctacttctgaatgagcactctgggaaatacacagacacgatccaacagctgccacggctgtcattctgagaactgttggctggacactttcatctccttttaagagagggattataataaatcggtcactggacattctagacaagaacaccaaatcaagattcagaccaaaataaaggactagaactgataattagctggagaacagaactgcttacaaatctaatcacaatgactatagtagaaaggaaaattaacaagggtgatctcgagaagctggattttgatcattaaattctcaccaaaaatggaaaaccatcttctacctttcaaatgagaatttctggataagaagtttatgagttaagggaaaactttgctaagctccagctctttatttctcagattcatatcatctgtaggtgaggctccaaccccagcaacttgttactatataaaaaaactcctaatatacatcttatgtaatatgactttaatttccaggtgccaaattctcccagctgaacagaatgatattctagagaaggggtgcagcacagcacactggctcaaagcataggctctggaggctccacatttaatgaccctatggtttaagagaagatacttcacacccctgcacctcagtttcctcatctataaaataggaatcataagtctttacctcatggagttgctgagagaattaaatgagatactatgtgaaaagtgcttagaacaatacttggtgcataagaagagttcacaatgattcatcaaaataatgcagatatgacaagttacctcttctcctccttcgtctactagcgtccaagtcccagacccaggccctgaggaggatggcttccgctcgctgggcttcatgtggcacataaactcagctcgatttctaaaggacaagaataatcactcccatcacttagatgtaggctacgtgagtgcattgtggattctctactcaccctgaagaagagccacacatcatcccaatcttccaatggtttaaattagtgaataagaactggccaaaaaccaaggctaataaaactgcactaattttggtggagaatgcaaccattctgaattagtaatgatgaataattgcagaaaagcagctacactagcacagctccctgcatgatgcaggacctcaatacatatgctgcggaccttaactcaaaccaggctcacaaagtcttgccagggaaactattttagcaactatgagttactgaataaaaaagggtaatggaggctgggcgtggtggctcacgcctgtaatcacagcactttgggaggctgatgggggtggatcatgaggtcaagagatcgagaccatcctggccgacatggtgaaaccccgtctctactaaaaatacaaaaattagttgggtgtggtggcacatgcctgcagtcccagctactcaggaggccgaggcaggagaatctcttgaacccaggaggcagaggttgcagtgagctgagatcgttccactgcactccagcctagcgaaagagagagactccctctcaaaaaaaaagaaaaaaggtaatggagaggcttgtttagggccaaaacatagatataaatgcaaaaacacttgtgagtcaaatcattatctaccacgtgcaggagcaggcccttgtatccaaggcagtaagggagaggaaccatcaaatctaaactcctcatttaatttcaaggacttctataatccaacccacccgagttcttcacctctattaccagctcccgcacacacctttgcttcagccacactgatctacctgtgctccgtacagctatcctaacctgtgttggggcctttgctcacactgttctcccacctacatgttctccattgtcccgttctcctactgaaatctaatccattctttttttttttctttcagttggaatttcgctctatcacgcaggctggagtgcagtgacacgatctcagctcactgcaacctccgcctcccaggttcaaatgattctcctgcctcagcctcccaagtagctgggattataggtgattacaccaccatgcccggctaatttttgtatttttagtagagacggagtttcaccgtgttggccaggctggtctcaaactcctgccctcaggtgatccacctgcctcggcctcccaaagtactgggattacaggtgtgagccaccatgcccagtccaatccattcttcaaacacagctcagttaccatgaaacactctgactactccactcaactctttattctcttcatttctattgcatagcttcgcaatttagcacttaaatctctctgtgctatttctcttctggcattaaatctcttcttccaagaaacagatcaccttttttgtctgtagcacctttcacaatagtatatatgacccactaaaagggggaacccataaaaatggttgcttatatataagcagttgaagggtcactttgaaacaagtatcaaacccaaagaaaatctgcaatgttaaattctagaatgccaacacttcccttagctgttcttctttggatctaggcagtttcaggagccaatcctttagaagaaagaagcatttcaatctctacttcacaaagctcttgcacacttacttgacaggagacatcagcagggcaagggattgcataaaatgaaagacccctgatgggttatgcaacactttgatctgaaatcagaaaagcaaaaagcatactgtagaaaacaaataacccaagtgtccataatcttggttcacaagcattctgaccaaagttgctgttaagagaacaaagctgaaactggtacctaatacacaagagtaaagcacagcccatgggttacctggtggcactgagtcagctgtactcaaagagcagaggtaactgagcagtttccaccaattatctgtaacaacatgggatgaaggacactactgctactttaatccaaagagagacaaaacaaaaacaaaaaaaatcctccttctacctaataagattcagacttcttgccaccagaagtgctaaagaaaaggaggtgtggagaagctgaatttggcaaacattttggctcctgcaaattctaagtggttgctatgagtaacaaaatgacccaaaggcaacagcagagaggagaatctaaaaaccacatagtcaactcctaagtatacaagagttgatcacatagacctgagatctctgctaatattaaagaactttgagatgtggtggcttctgtttgacctgtaccaactgtggtgtaagacagattgacttaggaagctgtattgagtaccacgggaaaaaagtcctggtgagcctttctacacaggaattgtgtagaattaaatgcgactgaaactacccagccagactacaagcagacttagtacagtctgtactatcaattatgggtagcccaacaagtttcagtctaagaacttttataaatgtatactggatatattttaagaattttattttaaatattactcttttttaaatagtcctttttttttcagcaatttcttcaggaataatgtctaataaaacctctcccccaacccctcagaatgagttgatgattcatcatacctggataaaaggaacagcccatttactaacaccagcggggcatcgaagaatatggtttagaaggaagaggtgatctccaggacagccaactctttgtagcacggatacctgaacaataaaggtcatatgatctcactatttttaataaaagaaataatttatctaggggtctagtaaagtcatttatccagtgcttcaatacatgcaatctttcaaaagagtaaccagacacaagatatactattcactgatgagtttctacgaggcctacaaatctatgagtactatgataacatcataagcagattctctacaaatctagctttttcttctttggcaaataacaaatcactaatttcctggccacaagtgaatagatataagtcaagtagtttaatctattcttagtttgtaatggtttcttaaatccaaataagtatgcttgaaacattatccttcatttaagaactctagtacaaacctaaaaagagcaaccaaggcagccccactgaaaacataaccaataaataaatagccctcttcccataacacactcaacatctttcctaagttttccaaatccttttacctttcttctttctcttaaaagaaacatttttaagcatgacattaaatatcacgacaaaaagaatgacatatagaaaatttttgatcgatactttatctaaaatgcacaagaccagaagtatttcagacttcagattttttcggattttggaatatttgcataaacataataagatatcttggtgatatggtttggatgtgttcccacccaaatctcaacttgaattctatcatccagaataagatagaattcttcttctccattgtgggagagacccagtgggaggtaactgaatcatgggggccggtctttcccatgctattctcatgatagtgaataagtctcacgagatctgatgggtttatcaggggtttctgctcttgcttcttcctcattctctcttgccaccaccatgtacgaagtgccttttgccctccaccatgattctgagacctcctcagccatatggaactgtaagtcaaactaaacctccttttcttcccagtctcaggtatgtctttatcagcagcatgaaaaaggactaatacatttggggctgaaacataagtctgaacacaatattcatttgtaattctgtacctgagacaaagtttctattaagtacttaggtgtggaattttccacttgtggcatcgtatcagcactcaaaaagtttggaattttggatcatttcagatttctgaattaggaatcctcaacctgtacctatattctgaatatacatctagtcttcaatttcgcatacttcctgcatttccatttctttcaaagctgaagtccagagttcatttagcataatctttactagagagaaacatactttgtgctcaataatgcactagataaataacttactaccatgtatcatgatcaaagaaaagtcattaataaactcatcaaataaattagctgaaaaagttgaagaccaaatgtaatgatataacagataattcctaaattatgaaagaaataaaacaaagactactgtgtctatctctgtccccttaccaatttctgcagccagagaagaatatcatcatgaaactgagtatcttcattaactctcctggtgaacatgaataagacactaatgcattcctttagttgacacagatcagagggaatgctttctgtctgcttagacgctgtaaatgaaagatattaaatgagtctctcataaatggtgtttttgggggaatttttagtgtcttcacttaaaccaataacaacaaaaacctttaaaatatttagtgcagataaaaggagaaaagttacatcaaaatacttaaatttttataaacagacaagtcaaaaatgtgtttaactttgaagtatttcaaaataatggaaaaatcaacctcatcataattttttttttttttttgacacagcctccactctgtcacccaggctggaatgcagtggcgcaatcttgactcactgcaacctccgcttcctgcgttcatgccattctcctgcctcagcctcttgagtagctgggattactggtgcctgccactacacccagctagtttttgtatttttagtagagaaggagtttcaccatattggccaggctgatcttgaactcctgacctcaagtgatccacccacctcagcttcccaaattgctgggattacaggtgtgagccaccacacccggccataatccactattttttatttgaaaatcagtacatctctgacctacccccagttaattgattagttaagaaaatgggggagggggaattttactttaaagtaccctaatacatcccccagaaataaaaattgcataattcaacaagcatacttaatattcatgtcataaagactaatttcttaaaatccaaaataagatgaaaaattcagaacattattaatcctctgttggaaaattaaacaaaacagccctacaaacaaagcagcccaaacaaaccacaagagataaagggtgaagaagtattccgatgattacttttataatcaaaaactatatttggactcaacttggtaacaagcacattaactaggacagcaaaggacattaatgatagatagtgagctttttggcatcctagagaagcagagaaagacagccacggagaaaggagacctggcaatgctcccaagaaatgtcattaaggcagatctcaatcctacagtgggggaggcctggtaaaactgcaagcacaaatggtaccttgtaagaccaattactatacagtcaattcaaccaggctatacccctcaatttttttttacttcaaaacacaagaaagagagcttcattacttacatacctcggccttgctggtgaattgctgaagatctcagaacagctgaactactgagcaatgcatagatgtaagactccacttgcaatcttgagagcacagaagtataagaatgaagggccagggtctggtggaggtgctcagatttggcatcgaatagcttctttagctccaccagtgcattttcattcatttctactctttggtagcgatgatagctgaaaactttcacttgatctgcacagataccctaccagaggacaaaaaggtacaatatgaaaccagttactctttccatttgaagtaagcaggcagcaagtataaggtacacaggcttcagtaccatcttcaaagagcttataatcatggtgaggagacatattactgtgtagagaacattaccagcaaatatatgatcaggtgcaaaggaacagaaggccaatcacaaatacatcgcaaattcagagaagggaagagtaactctagtagtcagcagtgggccaggcgcggtggctgatgcttgtaatcccaccactttgggaggccgaggcaggtggatcacgaagtcaggagtttgagaccagcctggccaacacagtgaaatgctgtctctaactaaaaatataaaaattagctgggcatggtggtgggcgcctataatcccagctactcgggaggctgaagcaggagaattgcctgaacccgggaggtagaggttgcagtgggccaagattacgccactgcactccagcctgggcgacagagctagactccatctaaaaaaaaagtagtagtcagcagtgaaagctgcaagaaaataatagaacttgtccctaagactttcatgattgatgatcttaccttctattttatgaatatgaagccaatgtgatatctccaaaacttcaaggtatctcaaaacatctctggatctaccctcatcattcttcatagttctactcaagagaatacacactccaccagctgtgttcttgattctatcctctcttcttcaatacagtatttccaaatatttccctccttactatgtacagagatatacaggtctgccaatgaatgaggattagggataggggaatgacatgtttctccccaatatcccctccagcttcccttcactgccaaacttgtcaagagtaacctcttcttccttgccatctctcctaagccactatgaaatggcttatgatcactttggcctccatagggttgcatctaatggtcttctccatcccctctcaaacttgagaggacgtctcccccttcctttgggggctctgtgttacacatcagggactctccattgcttatagttaagaaggtgagtttcactctcattttgtccactggcatcatcctggagctaggaatcagttactaccttcagattcctcatccccactcaatggggaagaccattggatgcaaccccatggaggccaaagtgatcataacaccttcagtttcctcatcccttctcaaccttgacactctcttcccattggatgttggtagcattatgcccaaggtcacaaactaatgacccatgggctgaatttcagctggagacatgatttgcttggcctacactgtctgtatgtgtctgattagttgctaacatttgcaaattaggattcctcacactaaaatctagatttctagtttttcttgtaaaatcataagatgtggcaatgctgaaccatcacaacctcacagcaaccatcatctagaacttgagaacggctgtcccatctaaaccaggcatgggctggcccagtgaccattgtcccactcagcctgcttcactcctccagcttatacacctggctcctgcaggcatttgactttgtgatccctgcactctattactctaggctgaggcagggtcagagtgggtgtaaggcacagactccagacctggacaacatcccaggaatagcagctccgctgcaaattccccaggcttctgatcaaaatacctgtacagacatttgttcctccttaaactgccacagccgacttttagcattttggcaatcagatgtcagagtaagcagctcagcttcagccagcagcagttgcttcctacatcgtgagtagttcaaaagcaactcataaaattcatgcctgtcttgatgagccatgctgtcaaattcttctaaatatgactcaacattttccagccatgaaccaggctccaagatttttagctgttctttagtaaatggtactagttccagttgagacgggagttctgggtagagtcgctcactgcgaagcaagggtttcactgccaccaaagctggtgcttctccagcaatttcagctggcaactggggatacagtttcttcactctaggtgtctgaaaaccatgtttggctgggcaagaactctgcaagccaacattctgtggcacctctgaagaacaaaccaggccttgtttgtcttctttactattctgagtttctctgacttgtatattttccattgctggctgagtataagaaaaattagattggggtgcactttctgaaagtccaccttgtaccgacatattttcctctacctctgtgaagttcttgggggtttctactttagttccaacattgtctccagggtggacctttggagtgactgcactgtcccccacacagggtctggcctctcccccttcctttgggggctctgtgttacacgtcagggactcttcattgcttatagttaaggaggtgagtggtacatcaaacatttcactctcattttgtccactggcatcatcctggagctgggaatcagttaccaccttcagatggtctcctttgaattcacaggctagagaagggatttcctgctctctggaggtttttggaagggagacttcactggactcttccctctgaggagtttcatacttcttcttttcctaaaaacaacatacataatgtgaaataatttatcacaataattaatgctttcagcaggaggaattttaaagttgcacataaaatctaaatttcatcatgtaacaaatgaaacctaaattcactttatcagtgtttttgaacagatatgaacaaatatgaaacagaaatgtgtttcatatttcgtattatccaatattgagcgtgttaaatttggagattcactagtctgatcctaatagaaaaagacatcacagtaagcagcaaattctgattcaaaaaatagaaggggaaagttaattagattgtacaccattttgccaggggttaagttaaatagatcagtctctacggatcttcagccacaataggtttgtcttcaccttgacaaattcactcaaaactcagggagaaaaggacggaacaacttgagcaacataacaattgtagtactggaataaaataaatatccaggagcccatactgacataattacctgaatgaataaatacataaataaaatgagtgagaagcgacaattcttccatacaggaaaattccaatgaatagaattaacagaaggaatgagaaaaacagaacacttaccacaagaacaccatggtaactgccacaggtaagatctacccatggatgctaaagtgagtaagtgaagagtttaagggaaacagagtatctgcatagtctcaaagtatctcctcccaaatatttaataacaacgaacaggaaaatagtaagtttcagtggagaatcctggaagataatgccttaaccaaatgatcaaagttacatcaccagtaatactgacatcagataacccaataggatattcccagtaatgagtaacctcaatctaatcatgagaaaacatcagacaaaaacccaaactaagggacagtctacaaaataactgaaggaatgtggtcatgaaagacaagactgagaaactggaagagactggagagaactacagtgatctgacaactaagtgtattgcgggacctggattagaaaaaggacattaatggaaaaactggtgaagttcaaataagttctacatcctactattgtaccaacattaattctttagggtgttttatttatttatttttttttttttgagacggaatcttgctctgttgcgcaggctggagtgcagtcacgcaatctcggctcactgcaacctccgcctcctgggttcaagcaattctcctgcctcagcctcccaagtagctgggactacaggcacctgactaattttttgtatttttagtagagacggggtttcaccgtgttagccaaactcctgacctcgtgatccgtccgcctcagcctcccaaagtgctgggattaacaggcgtgagccaccgcgcctggccaattccttagttttaatcattgttccatgccatagaatgtacggttatataagatgacgacacaagaggatgaagggtgaagagtacatgggaagtctctgtattatatttgcaacttttcactaagtacaaaattatctctatcatcataaaaaagctgttcactaaaaaataagttatggtttcaaaaaaaccttcaggcattaatacgcaaactagataacaggaagttaggctgaataaagaagaaaaaattatttaaataacatttaaataaagttgtttcattcaaacagactaaaaacctcattgaaatcactcaaatacttactttcttgaagaaattttaaggcaggcaaacatgagttatacaagctcttggttattttggattattctgctctgaatgtccagcagactaatagccaaaaaagtagggcctttatatattaaaaagaaaaaaaagatgaatatttttgacatggaatttgaggtcagcttgttgaaatgaacctgactgccaaacatttacaaatggtaatgattcaagaagtaatatgaccctccaaattacttcactccccactgtgaactgtggacatcagatccagaagtcagtcacccaatgcatacctcatacaaactactttgttaaactgcctaaaatcacaaataatagaaaaacattatatgagtgttaataaaacaaaaaagcaagcccaaactatgctgcaatgatgtttagcaaacttgctgtaataaacagggttcttagactgagaaatcagaaagaaaaattaagagggaaaatggttactacggcaagagaaatgttagtggacacatcagggactcttcatcgcttacggttaaggaggtgagtggtacatcaaacatttcactctcattttgttcactggcatcatcttcaaacatcatccttaaaaatacatatgattcgcttggcctatactgtgtgtgcatgtgtgtgtatgtgtctgatttgttgctaacatttgcaaattaggatttctcacacaaaaatccagatttctagtttttcttggaaaatcataagatgtggcaatgctaaaccatcacaacctcacagcaaccatcaactagaactcgagagtggctgtcccctctaaaccaggcacgggctgacccagtgaccactgtcccactcagcctgcttcactcctccaggttatacacctggctcctgcaggcatttgactttgtgacccctgtactctactagtctaggctgaggcagggtcagtatggcagaggccaaattttagtgagttgacaatcagaaaatgaaattagtaaaacaatttcatttataatagcataaaaagaacaaactagggataaattgagagaaagaagcataatacttgtactctgaaacttacaaaacattactgaaagaaattaaatgcaacttaatttatttaaatggaaagacaatctatgtctttcgcaatattgttaagatgacaatattcctcaaatggacctacaaactctacacaatgccttgcaaaatcctagctacctttttttgcagaagttgataaactgatacttaaattgcatacagaaatgcaagtgacccacaacagacagaaaatcttgaaaaagaacaaagttggagaactcgcacttggcaattccaaaatctactacaaagtacagtaataaagacagtatagtgttggcacatggacaaatagatcaaaggaacaaaactgagaatccagaaataaaaccttacatatatggcaaattgattttgacaagaatgccaaaacaattcaatggggaaatttgaacaaatggtgctacaacaactggatatcctcatatgaaagaataaattggacccttaccttatatcatatacaaaaattaatgcaaaaaggatcatacacctaatgtgagagctaaaacttttaaactgttagaagaaaacaaaaaaatctttataaacttgggtaggcaaagccttcttacatatggcaccaaaagcacaagcaacaaaataaaaagatcaattggacttcatcaaaattaaaaactttggtgctgcaagtaccatcaagctcacacctggtctggcaccagttgatcaataaactggttcatctgatcttgtggccccaacccaggaactgactcagtgcaagaaaacagctccaactccctgtgatttcatctctgaccaatcagcattcctggctcactggcttcccccaacccaccaagttatccttaaaaactctgctctctgaatgctggggagactgatttgagtaataataaaattccagtctctcacacagcttgttctgtgtcaattactctttctctattgcagttcccctgtctcgatgaatcggctctgtctaggcagcgggcaaggtgaaccccttgggcagttacaaaattagccaggcatggtggctggcacatgtaatcccagctactcgcgaggctgaggcaggagaattgcttgaacccgggaggcggaggttgcagtgagccgagatctggccactgcattccagcctgggtgacagagtcagactccatctcacaaaatacataaataggggccgggccaggcatgggcggctcacacctgtaatcccagcactttggaaggctgaggcaggtggattacgaggtcaggagattgagaccatcctggccaacatggtgaaaccccgtctctactaaaaatacagaaaactagccaggcgtggtggcaggcacctgcagtcccagctactcaggaaggtgagacaggagaatcacttgaacctgggaggcggaggttgcagtgagccaagatcgcaccactgcactccagtctggggtgggggcggggtggcaacagagcgagactgtctctaaataaataaataaataaataaataaataaataaataggcctgggtgcagtggctcatgcctgtaataccagcactttgcgaggctgaggtgggtggatcacctgaggtgaggagttcaagaccagcctgaccaacatggtgaagccccatctttactaaatacaaaaaattagccgggcatggtggcaggtgcctgtaatcccagctacttgggaagctgaagcaagagaatcacttgaatctgggaggcagagtttgcagtgagctgagattgtgccactgcactctagcctgggcaacaagagcaactgcctttacctacttcagttaaaaataaataaaggtcaggtgcagtggctcacacgtgtaatcccagcactttgggaggcaggaggatcccttgagcccaagagtttgagaccagcctgggcaacacagggagatcccatctttatctttataaaaataaataaataaagacacagaaggaagacataatgtatatataataatcattacagatcacaaagtaaaattcagacaactctatgtgtatcaattccatgtgtatcaagtaacataatttaagccaaaggtatttccttttttaaaaaaaaatcagagacaaggtctcactgtgttgcccaacctagagtgcactggctatttgcaggcacaatcacagcatactgcagacctgaactcctgtgctcaaatggtcctcctgcctagcctccctagtagttgaaagtacagactggtgtcatcatgccaacaaaagatatttcttacaactaaaaatgccaggcatattaagaaaaatctatttctttatttttgatctccacataagttacatacagattaaaaaacgattttaaagtcattcaaatggagaaacaataatgagtaaattttacaaaaagagttgataaatagagaaaaacatgcttaactatacattacagtaaatatgctctggagtgtgggtatatggggaaaaaaacctaaagaaaaatacaacaaaccattaccaacagttatttccaggagatggaattctgggcatttcatttctgggttgtacactgtgagagtgtgtgtatgtgtacactcatacacactttaagcaatgaggaatcagaaagtaatcatttaaaactaaagttttttttaagttttgggaaataaatgggaagtttctattcatcacttgaaaaaaacatgtaaagatgtagaataggcttggattcacatgtccaaggctactccacattgctacatgtttatttcaaaattaacatatgtaaaaccaaactcctgattttcccccctaaaacctgttccacccacagctttctccttctcagggtcttccttgactgttttctctcacatcccacatccaaacctcagcaaaccctcttggctctcagacttcaaacactcctcaccaccttctctctgacaatcctggcccaagccaccatcacctcttgcctgggtgactgcaatagtctcagatggtctctgcttctacccttgcccccttacagtctattctccaaaaagcagtcacagtgattctttaaagcacaagtggaatcatgtcactcctctgctcaaaaccctgtgttgattccatatgtcactcagagtaaaagctcacgcaaggcccaacatgaccaggctatgctacttttctgacttcatctcctactgttctcccctcactcactctgcactaaccacactgcctccttgcagttccaaggacaggtctggcatgccaccgccagacagccttttcctggctagtccctctgcctgaaacacttctcccccaatatccacatagtgaactctctcttccctttcatgtctttacttaaatgtcaccctcaataagaactagccaggctgggcatggtggctcaagcctgtaatcccagcactttgggaggccaaggtaggcggatcacctgaggtcaggagttcgagaccagcctggccaacatggcaaaacctctactaaaagtaaaaaaacattagccaggtgtggtggtgggtgcctgtaatcccagctactcaggaggctaaggcaggagaattgcttgaacctgggaggcaaaggttgcagtcagccaagatcgcgccactgcactccagcctgggcgacaacagtgagactctgtcccaaaaaaaaaaaaaaaaaactatccagaccacccatcctaacctctcaccagtactcctcaactcttcaacctgttctttttcttttttccatagcgcttataaagcatgatatattttcttcttcatgggtttttgtttgtttagcttgcttgttttttgtcttctccctcttgaatgttaagctccactaaggccaggttctttggggttttttctcttttacatcccaagtgcctagaatagttttcggaacataatgggtgatcaatgagtgtttgtttaataaatgaatggcttttaggaggcacgaaagaagctaaataatactatgcagcatcccccaacttcaaaccaataaccactcctgatagaaaggaactagaggtggaaatcaatcatttaggcatggcacaagggggatggagattcaaaggtttttcctgtgaccttctgggacacatctttctgtccttagcaattaccagatgttctcactattaataagttgttggcattcagaatttaatattaactgtcaaagaaaacactataaaatgcactgctcctgcagagtaagtccaaatctaagaatctactgtacttataaattatcaagatcaatgaagtcagggtgctcagagttgggggattttatagcagagaatgacactaaagaaatgaaaacattattaggtctctctcttaggcatcaggtgataagcaccacatacctaaccacaacctagcagccgaggttagctatcagatgattaacattgaggaatgtaggtcagctgctgggtgaaatccagaagccactcaaactgtctaaaggcaacagcacatgacactatccacttcctgaactgagactttgaaccagtttgtggttccctaaatagctgccaaattatactatagatggtaaaggtttcattaatataggactttataactataatcgaactataaccagcactaagaagtgcatcaattgactctaaaaaaaattactttctagattgttttattctaaaagaattaactttctagattgacaaagataggggccttgctggtatcatggacttttttcatccgttttctcatactagtcagaggaaattcactagagtaaattcctctgagtgacaaagcttggaaatattcttcattactggcatttatttcatcattcgacgaacattatcaagtgacaaagaggctacgaagggtactgagaacaagacaggtccctccctcagtgagttcaaaatctaagggagaagagaaatgttgacaaagtaaccacaaatgagatgagtggcacagaggggagcagagtgctattggagaggcagtgacaccaggaagatgagaaaaagcttctctgacgaagtactgtttagctgacacctcacaaatgagtagctggctaggtaaaaagggataggaaggggtgtcagaggaaacaacatgggcaaaggccctgaagcaggaaagaatataaaggttaagaatcaaaagagaactttgggaggccgagatgggtggatcatccgaggccaggagtttgagaagagcctggccaacgtggtgaaactccgtctctactaaaaatacaaaaattagcccagcatggtggcaggcaccataatctgagctactcaggaggctgaagctggagaatcgcttgaaccaagagacagaggttgcagtgagccaagatcacaccacttcactccagcctgggtgacagagtgagactcggtctcaaaaagaaaaagaaaagaaaagagagaaagttgggattggtggtagaactgaggctgaggaggaagacagaggcaagatcatacagagcccttagtccatgctttggactctagcctctgagtgatgggaaacctttgaaaggttttgaggagagtaacatgatcagttttgttttgaaaaatatatatccagctcagtttagagaatgggcagcaagaatgaacgtaaagaggccagtttagaagaaatcctccttggaggagggttgtactagttaggatggagaggaaatgcacagaatcaaaagaatatttagaaaatgcaattggcaagacttagtgaatgatcagatttggagggtgagcaaaagtagatgtcaaggatttttggtttgcccaaatgcctctgaaataaaggcctcttcataaactttaacaaaaaaaaattaatgtatgtttgtataggaaagttgcctaagatggataaaaaatataatcaattggtttttcatgatggatctaaaagcttaagatttttaactttttaatttagaaattgttttaaacaaaataaattaagagggaatccccttaacagactttttaaagcatctgtaacattctatctatggaaagacaaaagacatacagatacatgaaataactattaagttcctggattgagagtcaggatttctggctttaacctgagttctctcacgaactgcatgacactgagcaatatttaatccccggaggctttagtttcatcaatatcttgggggaaaaaaactagagattaagacttaagattctgctctcatagacaactaacatttatgtgttatgcactactgcattataggttcaggaatttttttttttcttcactggataggtatgttttcttttttttcctgtagtctcatcgttaagtaggtttagggatcttatgcatagctggccaatggcttttttcttcctcctgggcctggatagttctttaccaacccaatacaatgcaaaagcatttcttttaaaaatatttctgagccgggtgtggtggctcatgcctgtaatcccagcactgtgggaggccgaggtgggcagatcacctggggtctggagttcgagaccagcctgaccaacatggtgaaacctcatctccactaacaatacaaaaattacccagcctgtaatcccagctactcgggaggctgaggcaggagaattgcttgaagccaggtggcagacgttgtggtgagcagagatcgcgccactgcactccagcctgggcaacaaaagcgaaactctgtctcaaaataaataaataaaattcctgaaatttggtaccaaaatgactttctcaccagaataactcctcacagacctggatacaccaatgtgtctaactccactacagccgtttaaaaagtcatatcaagaaaacgtggtaaatactcagcatggaatactatgcagccataaaaaagaacaaaatcgtgtcccctgcagcaacatggatgcagttagaggtaattatcctaagcaaattaatgcagaaacagaaaatcaaataccacgttctcacttataagtgggagctaaacattaagtacacatggacacaaagaagggaataatagacaccagggcctacttgagggcagaaggtgggaagaagggaaggataaaaaaaccacctgtcaagcactatactcattacctgggtgacaaaataatctgcacactaaaccaccaaggtgtgcatttgcccatgtagtaaacctccacttgtaccctctaaacctaaaataaaagttggaaagaaaaaaaaagagcatcataatgaaagaaatccacataagtcatctacagtctactaagtatggtacctatgaacactaccctcctgttaaaaccttgttcccatgagaaaatcggattacagtatcatgcttaaattacacctgctttggaacatcacccacttctggggaaaaaaatgtcctgtacttgtaataccatcctccttatttcccaaatgtaaactctgtttcaggtaagccaaaattatgaggtctggccatgcgggagcagcatttaatctgttcatcttagaaaatatatataaatagggtgggcgcggtggctcacgcctgtaatccgggcactttgggaggccaagatgggcggatcacctgaggtcaggagtttgaggccagcctgaccaacaaggagaaaccccgtctctactaaaaatacaaaattagccgtgtgtggtggcgcatgcctgtaatcccagttactcgggaggctgaggcaggagagtcgcttgaacccgggaggcggaggttgcggtgagccgagattgcactccgccgagattgcactccagcctggacgacagagcgagactccatatcaaaacaaaaacaaaaacaaaacaaaacataggctgggcgcggtggctcacgcctgtaatctcagcactttgggaggccgaggcgggcggatcacgaggtcaggagatcgagaccatcctggctaacacggtgaaaccccgtctctactaaaaatacaaaaaattagccgggcgtggtggcaggcgcctgtagtcccagctactcgggagggaggctgaggcaggagaatggcgtgaacctgggaggcggagcttgcagtgagccgagatcgcgccactgcactccggcctgggcgacagagcaagactctgtctcaaaaaaaaaaaaaaaaatacatatacatatatatacacacacacatatgtatatatgtacgtatatatgtatatatgtgtacatatgtatatatgtgtatatatgtactataataaaatgaaaatccagactgcacttataaacaaatcaacttaaaatcactctaataccacatgtagtctaatacaggaaactcagaaaattcaaacacttccctactgtgtgagtcccgccctgggttaatttctagccattcatgccccttataaacaatcaagacaataagaaataaacagaggcagcactactatcatcttgaactttcaaagtgatcagaaatggcacagcactagtctacttataaagttctgccaaaggtaccttctccgcgtggaggaggggaacattccctctttatgcatggcagggactaaaaatgttctaggatataaaagagtaaagagagagtcaacgatggggctggaaagagaaaaattatttcacggcaggaaaccagacccaggtgaggaaagccaagagagcagaaaaggaagaggccagtgaagtcacaggagggagaaggaaaaatggggtcctgacagagtgtggcagggggatatggagaaggaatggaggagaagggccggtgtcaacgggtggtgggatcaaatattggaaggtggaggcggaagatgcagagggctcagggaacgggagtagaattggctggggaggccgaagagaggagcaaggagacacagcacactgccagagcctcgggagggtgggggagatcctcacctttgttttagtccggctggccttggccttggcccggcgctggggcttcaccgcctcggccatagacccttccgcggcgccgtcaccgtttgtttttgtcaaacccctgcgcttcaagcaacctgcccggttctggcctccggactgtcacatgatcgaatctccgccactcccggagaagaggcggtgagtcggcgcctctacgggccgcaacgtaggacaaaccactccaggacgcatttgcactggaggaaggcaggcccgcccccttcccggagcccaggccccacccctagccctggctccacccggcgcgcaggtgtcttgggttgcgctggacaagggcagcgacccaggctgacccacctcctccgtctcccggctctgcggaacctcactcagtgcggatcccgggcgcgctcgcacacctcacccgcgtcggcttgaagaaatccggaaagtgggtttgccattcttttttttcatcttcagataaaccagatccagtcggttagcctaaatccgcactgcgcgcaaggaagaaaccctgacgcccatcggggtgtgcacttcggcgtcctcttttgtaaaggggaatgatcacacctgccttttcggatgtcatgagaatttaatgggctctcccagaaaggtgcctggtagcggcaggcatgtcggtacatggtagttattaattatcattactgtacaaattcccagactggaaaaaagacatgtgctcctaaaaggacaggcaaacaggtaacaagataaataagatccgtaaaagtattcttagtatacattttacagtgtgcttcatttgaaatttccagatgtgaaaaacttgtccacatcttcccttcccagctctaggatttctgtgatttgcttgtatccttattgttagtgtctgtcaatcctcccagaatgtaagatcctcaaaggcagggttcttaattttgttgcctgatgtatccaagggtctttagaacactgcacgtagtagcacatagtagatactaaataaatatttcgtgaatcacacaaatgagtatgagttttgtctggcggtggggtaagatcgttgaaatggagtgggccaggcgcagtggctcacgcctgtaatcccagcactctgggaggccgaggcgggtggatcacctgaggtcaggagttcaagaccagcctgggcaacatggtgaaaccccaactctactaaaaatacaaaaaagtcgccgggcatggtggtggacgcctgtaattccagctactcgggaggctgaggcaggagaattgaacctgggaggcggaggttgcagtgagccgagatcgcaccattgccctccagcctgggcaacaagagcgaaactcccatctcaaaaaaaagaaaagaaaagaaaaagaagaaaaggaaatggagtgtatgggagggaggaaaaagaccatccacccacctgtagcataccctagaataaaaaatccagcaatatggcatgaaaaatggaaaagacttcagagatgcagtttgcttgtttgtgatgatattttaattgagtatataatacaatttcgtgtattttgttcccaaatcctcaacaacaaaaattattaagctactcagaatatacatgtactttgtatgtcctggtgtgtgtgtgtgtgtgtgtgtgtgtgtgtgtgtgtgcatgtatataaagttatcacctgcaaagagttggccaatataaacaaaatctttataccaccattactatccataacttttgctgatatttctcccagtctggaatacccttgctctctgacctctcccagtttaagtcatttatgacatttaaagttctctatgtgctacccactacttggtcagcaaaacacaactgaccctactctcaatttgcatgttttacagtttagttgggaagcagacacaatgcatagatacattgtgatacgtgtatcatcgcctaactggtaaaagaggcatacattggaaagactgaatgaagggatgacaccagggcaggggtgagttccacacaaaaaagaggttaatcagggaggatgggagaaagaggagaaggaggaaagaaatgaaggttctttaaaaagcacctcagcctggcacagtggttcacacctataatcctagcattttgggagaccgaggcaggcggattgcctgagttcaggagttcgagaccagcctgggcaacacagtaaaaccccatctctactaaaatacaaaaaattagccaggcctggcagcgtgcgcctgtagtcccagctacttgtcccagctacttgggaggccaaggcaggagaattgcttgaacccaggaggtggaggctgcagtgagccaagatcgtgccactgcactccagcctgggtgacagagcaaggctccgtctccaaaaaaaaaaaaaaagcaactcaaaaccacagcctcctaggactgcataaggtacttctgctgcatttatgtggcttactgcacttctcaagatggtgaatgtgagtatgatgtatgatgactggagaggccagagagagccagattgctctgtataagcagagatttagagaatttagagaggaaggaagaacaatatataaggggaggtggaaacgaagtcacctggcagagggctaactactaaggagacctacattttccatcacgaagttatctgtcgttggattaatttcagaaagtgaggccaacagccagacaattcaagttcagtagaatccaaacaaaaggtaaagcaacaatcagttaggtaatgatataatttgaaccgagaaggtggttttgaaactactccttttgaaggatatagacttgaagtctctgttgccacagcaacaattttaaaagggacaatgggagcaggggctcagaaaagttcccgaacatatgcagtcaaggatttcatgtcccagccagacaactgactgataagcaacctgagttcccagggctgctaaacccaacctgtgagacagtagcttgaaaaagtaaacaggccggcagtggtggttcacacctgttatcccagcactttgggaggcagagcagcgcagatcacttgaggtcaggagaccagcctggccaacatggtgaaaccccatctctacttaaaaaaataccaaaattagcgtagcgtcatggcatacacctggaattccagctacttgggaggctgaggcaggagaatcgcttgaacccaggaggcggaggttgcagtgaaccaagatggcgccactgcactccagcctgggcaacagagcgagactccatctcaaaaaaaaaaaaaaagtaaaccaattcctggaagtaaagtatcatctcaggaaagtcaaatacaaagcagataaagtaatttaagctgacagcataatccttttgtgttaaattaggaataaactgtatctttttgtatttaaagtgcttgtactggttacgataatttggcaaattaaaggatatagaccttatgattccaaattaaaatatgtattttactacctgattttagattacatatattttagttaaaaataagataattttatacggcttacataatcatggaatatctctgagaaattaagatctatcatatttataaactgaatttgtggctgggtgcagtggctcatgcctgtaatcccaacactttgggaagccaaggcgggcagatcacgaggtcaagagatcgagaccatcctggccaacatggtgaaaccccgtctctactaaaaatacaaaaattggctgggtgcacacctgtagtcacagctacccgggaggctgaggcgggagaatcgcttgaatctaggaggcggaggctgcagtgagccgagatcatgccactgcactccagcctggcaacagagtgagactccgtctcaaaaaaaaaaaaaaaaaaaaaaatttgttagaccttagtaggatggtttaagtagttagaatggttggttggtcagttcaggcaacattaaaaaaattaatattttgaatttaatactgtagtataaaacatttgaaggaatttaagtgatgatgggaccaattgtttaagggactttggtctgttgaatgtgagtggatgaattgttaaggttcccccttgaacatgactatgaaactctattagatttataaaaataatgttgaggtatgtataaagataacttgaagacttaacaaaaactgggccgggcatggtggctcacgcctataatcccagcactttgggaggccgacgtgggtggctcacctgaggacaggagttcgagaccagtctgcccaacatggtaaaaccctgtccctactaaaaatacagaaattagccgggcatgtaatcccgtactacttgtaattacaagtacctgcctgtaatcccagctactcaggaggctgggacacaagaaccacttgaacctgggaagcggaggttgcagtgagctgagattgcaccactgcactccagcctgggcaacagagcaagaccctgtctcaaaaaaaaaaaaaaaaaaaaaaggtcgagcatgggggcttacgcccataatctcaacactttgggaggtcgaggtaggtgtatcacgaggtcaggagatggagaccatcctggccaacatggtaaaatcccgtctctactaaaaatacaaaaattagcccagtgtggtggcgtgcacctgtaatcccagctactcaggacgctgaggcaggagaatcgcttgaatccgggaggcggaggttgcagtgagccgagattgcgccactgcactccagcctgtgagactctgtctcaaaaaaaaaaaaagacttaacaaaaactaaattttagaatgtgtatgggtttaataaattaagattaatttttaaataatttaaaatactaatttcagctagcaaaataacaacaaatgtcttctctatgcataagtactatttgcagagattctaagaaattcatcttgacagcaagcagtgttcatcactggcataataatcagagaagggtttgctactctgggctgtaataattatcaccaacatttcctgagctcttactctctgctgggccctgttctgagtacttttcatgtgttaactcatttgattcttccaacaaccccgcgatgttgaggatttcattgctttcattttataaaaagagaattaagactcagagagattgaattatttgcctaaggtcacacagcttatgtaagtggtggagctgggatttgaacgaaggcagttatacaatataaacagactttgaagaggaagccaggtttactgtctccatgtttgcaatatttaatacttatacactggggccaagatgactatcagaaatatttcatttaaaagatactgtattaatcataatagtcacagtgttgactgctggatgtcaaggttatatttttttcttcaaaaatttctataatagttttaaattataatatttcttttggttgttgttgttgttgtttttattttattttatttttgagacagagtctcactgcaatgcccaggctggagtgcaatggcatgatcttgatcttggctcactgcaactcccccttcccaggttcaagcgattctcctgcctcagcctcctgagtagctgggactacaagcatgcaccaccacacccagctaatttttgtattaaattatatttctaaatgcaactgcaaacaatatagaagtacctatgatagtaagttaatactcctttccccagagttaacattaacagttcagtatacatccttaaagactttgctctactcacatacaaaatcacactcttaaatactccatgcctatgtgtagattgcgaccttttaattaatgaatcctagcgctatttccttgtaaaaacagatacctctacctcatttttccttcaattaataaaatatttcataaacttatttaaacttatttaaaacttatttaaacagacttttgatggccattgtgttgttttcaatgtttcactattaaaaccagtgctggtgggcgcagtggctcatgcctgtaatcctagcactttgggaggccaaggacggtggatcatgaggtcaggagatggagaccatcctgactaacacggtgaaaccccgtctctactaaaaatacaaaaatatagccgggcgtggtggtacgcacctgtagtcccagctactcgggaggctgtgacggaagaattgcttgaacccaggaggtggaggttgcagtgagccaagatcacgccactgcattccagcctgtgcgacagagactccatctcaaaaaaaaaaaacacacccacacaaaaaaaatcagtgcttatacatgaccactcatatatttttatgcatgtttatttctgtaaaatcaattcctagatgtacaattttgatcatagaggcattctcatttttaattttgataaatatttaccagatttcctcctaataggctgtattaattttcactgcggctttaagaatttaaaatactttttaatctcatgattaaaatcctggtcaattaaaaacaagaacaaggcggccaggggtggtgggtcacccctgtaatcccagcactttgggaggttgaggctggtggatcacctgaggtcaggagttcgagaccagcgtgaccaacatggagaaaccctatccctactaaaaatacaaaattaggcagacatgatggcacatgcctgtaatcccagctactcgggaggctgaggcaggagaatcacttgaacccgggaggcagaggttgtggtgacccgagatcgagccattgcactccagcctgggtgacaagagtgaaactgttcatctcaaaaaaaaaaaaaaaaaaccagcattcataaaaagactgtaactcatatattatgttatggcattccataacataatatgactatgatgcataagtcagccagcatctggaaaagagtaaaagcaaggttcagtgaaagctgctgaactctagaaggtacgctgggttgacctttcttaaatctccttccaaaattccattccagagtctctgttgccatctggtggcaatgcctgcttggtgaaacctcttacatatgatttccgagaagtcattcatgatacagatagttactttctgtacatcataacagcacaaggcgttatttcatcattcttcattactaaatgcattttttaaaattgcgaaagaatcaggttgcttctacattatttcagtttcttgagacaattagctcccagagcaagtacgtaccaaaaatgtacaacctatgtttttctaacaaactgtcttccataggtgggctcttttccattaacagacttttgcttccataggcagcaaagcatataaactttgtcctttttttcctcttataatctccaaacattaaatgagtcatacaagtacagttgacccttcaacactgcaggagttagggtcactaatcctccacacagttgaaatctgcatataaattttgactcctccaaaattttattttattttattttattttactttattttatttttgagatggattttcactcttgttggccaggcaatctcgtgcaatggcacgatctcggctcactgcaacctccccgcttcccgggttcaagcgattctcctgtctcagcctcctaagtagctgggattacaggcatgtgccaccacgcccggctaatttttttttttttttttttttttttttttttttttttgagggggagtctcgctctgtcacccaggctggagtgcagtggtgccatctcggctcactgcaagctccgcctcccgggttcacgccattctcctgcctcagccttctgagtagctgggactacaggcacctgctaccacacccggctaattttttttttttttttttaatggagacggggtttcactgcgttagccaggatggtctttatctcctgacctcatgatccacccgcctcggcctcccaaagtgctgggattacaggcgtgagctaccgcgcccagccctaattttgtatttttaatagagacagggtttcatcacgttggtcggctggtcttgaactcctgacctcaggtgatccacccgccttagcctcccaaagtgttgggattacagatgagaaccagatatttaaggccatgaaatttaaatgtatttggcacttaaatggaaatttctggcaatagctgtcccttcaacctaaaacaaaactatactaaaagacagacaacaaaaatataagccagggctgggcgcggtggctcacgcctgtaatctcagcactttgggaggctgaggcaggtggatcacctgaggtcaggagttcgagaccagcctggccaatatggtgaaaccccatctctactaaaaatacaaaaattagccgggcatggtggcaggtgcctgtaatcccagctactcgggaggctaaggcaggagaatcgcttgaaccccagaggtggaggttgcagtgagctcagatcacgccaaaaagaattctagcccctctcatcttgacttggtggctagtgcccttttatttgttttatgagaacaatttagccttttgggaagggctgttatataaactatcactaaattccttcccaaagctagtttggcctatgcccaggaatgaacaaggacagtttagaggttagaagcaagatagggtcagttaggtctgatatctttcactgtcataatcttctcagttaatatttttgcaaaggcggtctcagtcagggtgaaatgaaatggtgataacatctgtgctgcaccataaaaaagaacgagatcatgtcccttctgggaacatggatggagctggaggccattatctttagcaaactaatgcaggaacagaaatccaaataccacatgttctcccttataagtgggagcttagtgatgagaatacatggacacaaagaggagaacagacactgggatctgtttgagggtggagggtggaagaagggagaggatcagaaaagataactattggggccatgcgcggtggctcacacctgtaatcccagcactttgggaggttgagggctggaggattgtttaagcccagaagtccaagaccagcctgggcaacatgacgaaaccccgtctctaaaaaaacacaaaaattagccaggagtagtggcacatgcctatagtcccagctactcaggatgctgaggtgggaggatcacttgagcctgtgaggtggaggttcggtgaaccgagatcatgccactgcaccccagcctaggcaacagaacaagactctgtctcaaaaaataactattggatactaagcttagtacctgggtgatgaaataatctgtacaacaaacccctgtgataccagttaccaatattgaaatgcttcattctctttcacccattcatgagaaataattatttctcccttgaacctcacaggtctttgtaaatgcctctattaccacattgcatttcaattatgttcatatgtaatgcaagccattagaatgccaaacccttgtggttcagtcttgatgtgatgtcatgattaaagaggcacaggcagaccaaaaaaaaaaaaaaaaaaaaaactatgctgcagaatcacagttactgaggcctcactcgtggtgaatttgggtgaaacaggtggaagagctcatgcaacattactaacacttgaaagatatggggcaaaggtaattctaaggactatcaagtaggttggtttttatcaactgctgttgacacactgcagaaaatcacaagcttgggtcacttagggaatagtgggaaagccagaaagcccttatggcatcatttaaagagatgcattttgcaaaattataaagataacgtgaatataaaaagaaatgatgttacttccaaattactttatctttcttcagatcccctgagtcacgggtcaggagggcacatcagtaatccttcctgcagtggaaatggtacattctggtttctttgttgttgttgtttatagagacggcatctcactatgttgcccaggctggtctcaaactcctgggctcaagggatcctcccacctcagcctcacaagtagctgggactgcaggtgcatat

SEQ ID NO: 191 - DNA, 467894 bp, Homo sapiens
gaccaagaggaggcaggaatgataacaagcccttcctgaaggctgcctttgtgccaggctccacactgagcccctctgtgagcttcatgcatgttaccctgtgcacgtctcacaacacctggggaagcagtgtttttaccccatgtgttaagatacatcttctccagcaaggcatttacaggaatcactctgctagccaactgaataaccaatatctaaaaccacttccacctggtcttagagtgaatgatctttccaccgcactaacactttaaatatcagacttcaaccttctgtcaacaaagacgaaggctgtagctctaccaacatatttcagcaacagtttctctcttaaactctccatcctaaaaatgctcacagttacaacattctgcctagttcatttggtacacctggagaagaatccattttcaattttggtggaaagtcttattttttttttctccctcatggagtcaaaaatgccatcatcacgttatttatcattaactgactgaggccactctcaatcttctatacatttgcctcaaacatgcatatctgtgaactgatgccaataggccagtgacattttctaaaatctaaggcagagaaagcttacatccattgcattctagagaaggggaactataagaaatctaatgggggagcccttctttagttgataaggtagtgaagagatgccaaacactagggcctgcgtggagctttatggagcagttaaccttgagacttacctgtatgtaaagataaaactgcaacttctagttaacagatttattgagctttacaaatactttggtttcactctttgtgcttttatctacttctggactttattactgttttctgtccagctatagtctttatatacacagactgccagagattaaacagtgaaaagaagtcaaaagatttcctttgtcatcttgcacgtccttaaggttttaatagacaggcataccttccactgattagaaattcacagaagataccaccccctcccccacatggatgacaagcattttatgaatcacaatcctcagataagggacaagaaaacatcaccagagtggctccccaaggttttggtgaaaaataacttgcccacatttagcagttcattacgcatacacaacatctaagtaaatacttcatgtgacacagccagtatatttgtggataaatacgtcacagttaaacatcatataaaagagactattgttttggatgtatgtgaataatgacacagccacatccgtgtagaagatgaagcaaaaataaaaataaaaaaggaaatgccaacattttttcaggccccatctgtgctgagtgattctaatattacggaatccttcacaaaagacaggaaatgacaatcttaaagtaaaaatacatgaatattggaagcagaaagaaaacaccaatgaatggtgtgaggagggtggcctgttcacacttgccctagctatgaggaagtattgcataaagtcattccttcttgctcctctagtgctgactgtcacaggggcaagttaccaatccatgtgaatgctatgacttcagaaaaaacatttctgactagaaaattaagtttctcatttacagttctacctactcagcaagagcgataggcaacttttgttttttttactggaagaaaacaatttatttcctgattgcggtgaattctgtataccagaagccattgcgagtttcaaaattctttatcatgtttcaaaaatccaatccataatcaaataatcaaatgaaagccatttaaaatagagacttatatgggaggtatggtatcaattcagcactttcctaatgtaaatttgtcctaaggattttcttctgaaagatgtaaaagtgttaaagtcaaataaatgaaatgtgttttgtttctttaattagggtaagactttgtggattgaaataatgagatagtaatctggtgttaatcagtgtggtcactggcagagagttagatcagaaactttcggatacaatacaggactttcatacgtagtcataaagtgtatagacagggaaattccagtgaaaggttacaatttgataagcctcccactgataattttgacatgtgaatatattttaaattatcaattattttattatgcttatttaaggaaacaatatgtttgtgtgggtgcctctaaaatataacttagttttcaaaaaatttactagaacatccgtttttagaaataaaaataccactaactctgtattgcctaaataataaagtccaaattccataatttaggtttatgttattttattttgagacagggtcttgctttgtggtccaggctggaaggtagtggtgtgatcataactcactgcagccttgaactcctgggctcaaatgatctttccaccttagcctctcaaacagctgggattatgggcctgcacctccatgtccacctaattttctttttagtttttgtagagatgggggtcccaacatgttgcccagactggtcttgaactcctgggctcaagcaatcctcctgccttggcctcccaaagtgctgggattataggcatgagccagcacacgtggccagaatttagcctttagatctctgtaatctaattagaaagtacacttccaactttattgtttctattctccttattaaatcttatctattatttgaatcatttatgtagctatcaaatattttttgagtgcttaatacatgccaggatctgtggattcgaagatgaacaaggcacaatttctactttcaaacagctcacaatctagcaaagaagataactacttagcgtcttacaagggcaatatttgtggtgtgtttaaggtccaagaggaaatgctgatcacttcttggctagatggatgatggattcaggcaggatttcacagggaaggtaaagattaatttagaattcaccaggtagacacatagaaaagggtgttcaaggcaggggaacagtatgggctgaggcataagagtttgagacaggaatgtgggtttgttcaaatacggatgtttgactattgctggaaaacagagaacagggatttgccatcttccaaatgctgttcatccattcattcctttttcatggcttattctgctgtttctccagatcaaagtggacaatgttggttgcttatgggaacctaatgtctttgacaggacctgggacctgatttctcaaccttggcactactgacaccctgggcagaggaattctttgttgtgggagaccgtcttgagcattgcacggtgtttagaagcagtatgggattctgctcacttcattatattagtatctcaattaagaactctgatattatacaacttcaaccacctgagaaagtaatccctatatgaaatttcataattgtttcctttaatcacaagactacttccaattaagtacagaaatatttgtgaataaaaatcatagggttaacatctgtgtgtaaggaacttatgcagatactttatacacctgaaataactaagagaacttagcctgttagaagccaatcttgtgaatttaatttaaaatacgtaattaagcaatgatttacgtttttaaaattttaggttgaaatcttacaaaatgtacatggaaaattggaacactcaggagaatttaagaatcaccatatttaaaatttaatagatttatacaatgatttaattactggggctgcttgttgttaatttgttaaagttcttaaaagagaaagcaaatagataatatttacaaattcagtttttaatgttgatgggaatctaattgttatgagcccttataaacaaatattagatttgctagatttataaatataataatatttgtaagttgaagtaaaaggttaaggaagaactagactttggatgttttacttcaataattatatatttatctttttttcttgagacagtcttgctctgtcgcccaggctggagtgctgagattacaggcatgagtttcccaaagtgctgggattacaggcatgagccaccacgcctggccttttttttttttttccactttttaaacagagtcttgctttatcaaccacactggagtgcagtggcatcatcatagctcatcgaagcttcaaacccttgggctcaagcgatcctcccacctcagtcttctgagtagctgggactacagtcacgtgccaccacgcccagctaattttaaaatttgtacagacagggtcttgctatattccccaggctggtcttgaactcttggccttaagcagttctcttgcctcagcctcccaaagtgctggggttacaggcgtgagccaccaagcctggccttatatttatcttaaaaagaagacaaaaaaacaaacaaaaaacaaaaaacacaacttccacaaagtcttcttggatgaaggatgtaataaaaccttaaggacaaaacaaaacccacatagaaggacaaggtacttttaataggaatcaaacttgacattaccagtaataggacaaacttgtatcatgtctctcctgatgcaatccactaaggaaagcccatcttctatgtcatgttcctgttaaaaaataaatgcttaatctgtatctaagcatgaggatacaaacaaatctaaattgaaaaataccttcaaagcaactggcctggattatttaaaattgtcattattacgaaaggccaccattgcacaaaaactaaaaaattaaaagataaacagagagaataggaagaaagcgagggaggctaatgactgtgattcttgtttggatctagatccaaaaacaaaacgtctataaaggacattattgagacattttcacaacgttgatgagaaaaatgtcattgtttttagatgacagatatcgaactattcaggggagaagtctaaagatgtccacaatttgcacatgaacaaaaatgtgtatatacagtgcactgtgaatctagctggtggctatagggacgttcactgtcctatgtttgaacttttctgtaggtgtttcatttttcaaaagaaaaaatagaaaacaaaaaccccaactcacattggaccccacttttctcccttatgaagctcatgagtctcagaagttgaccccgattttcagcacaagggaactggcctggtctaagggttttctagccaaggactggctaaggaatgtgcttatttctgaatttggatcaacaaaattagaagagaggttagctacgggttttcttcctgtctccactcctgggagagtttttgggagcaagtctctctcttcctttttcatgcttgtacccaagtgtgagacctgataattcaggaagctgccagaggaaaatggttgacaaaattcagggatgcagagtgggaaccactgaacccatcagtcctgaagagactgtgctactgttggccttccagttatggcaatcaatcaattcccttattgtttaagccagttgaagtacttgcagccaaacacataatctaatctgagccccaaactgaagctgccttcacactcaagtgttatatccctcatgaagccgaccttaatatctccattccaaactgtagtttttatgaggagctgcttttgtctggcaaaatattttggtgggacatgtagagaagaagacaagactatgaggtcaggaagatggacagtagcctcagtaaccatggacagatggagatattagccagggttctccagagaaattaaaccaacagagtatatgtttacacttacataccgagagattattggctccatgtggctgtggaagcttgtcaagtccaaaatcggatggggtaggctgacaggctggagactcagggaagagttgcaagttcaagtccaagggcagtctgctgacagaattccttgttgcccaagggaggtcagtctttgttctgataaggccttcacctgattggatgaggcccacccacattatggggggtcatctgctttattcaaagttcacctatttaaatgttaatctcattcaaaaaacacctttacagaaacatccagaataatgtccaaccaaatatcttggcactgtggcccagtcaatatgacacatacaattaaccatttcaatagaggttctgctcaatgtgagatggagcacacctggacttgccttgggagcaggtgggcaggaggagaggagagagaccaccccaccggaggctttcaaagtttattttttacattgcgccctgtcacatgcatgctaacggacaatgaactgaaacaaaagctcttcttcatcttcgcttccttcctgcttcattccattctatttcatcccatcttataccatctcattcctttctttaatttttgaaaatgctcactttcatccactacatggatttcattgccatgaatgggtcacaaaactgcagtttgcaaactgaatatacaacttacatgtgtgttggcacatgtgcaaatcaaagaagaggctgacaggatggacaacagagatagcacacgtcacaacttgaaatgatccataaaccaagagaatgaggtgattgtgatcaggcagacacctctgcctctctttctccagtgttgcacacacactcaaaattcacagaaatcttccagagggcatgttattagggatctgaatatctacatacaatgtgtatttcaggggacacaggggctgactgattacctgtgttactgagctattctctctacccttaaaattccatcacgttttagccagttctggtggtgcttatccatttacagttcatactagagaaattgtgtatgtatctatctacgctaatcggatacaataacttactttaggtgagggactatgtcttaagtacaaagctttatgccacacatcaattagcataatctttttacagagtaataagtcaaacatgtgcttttccttattttatgcacataaaaattgctatcagtaaccataagaacatagatttacgagtggttgaatagaatatagactttatgtaatttcttaaccatttcctccatgttttagatatatcaaatataatttgaatgctcacttggataatgcataatattgatacatataatacaaaagggtcaatatcagtgctcaaatgactgtattcatttatgctgaacaaattacaaagaaatggctccaaatcagccaggaaaggtgaagtagtgtacacaggccctaattcagcaacagaatgcattggccacactgacataagctttcaggaccctggggatgatcaataacgtttaaccctccagggccacgtctacctcatgacctggccatggccaagtttaagagggcatagcagccagaggcagcggcaaggccacccttgagatgttggaaccaacttgggtctttggtatagactgaaagctctgagggaccagggtataacagtagctcatgacacagaccttctgtgctttgcaatcctcttcaagataatggattacaatctgtgcaatacaatacttactgcagctacaataagagaaaagggggctattctgatgactatatgcctatttaaacaattctggggctctcctgagtaaatgttttttagcacatattgctgatgtcatcatggcctcataaaactgggtttctctctcatacacatacacacacacaagcacactcttaacatggtgaaactataaaagaaaaaagatcatgtaaaagttgttcctgtacaaggaaaatgtaatttatttcagaaatagacaatcactcaagtgtatgagctgtgtaggcgttcattggtgaatttagactaaacaggaagtgatgtaaattatagttattacactgctgggagagaaatatattaaatccagacagcacacgaacaaagcacaaggagctcattgtgttgaaggaaaccacgcactttggtgggaagacaatgcactatatagtatgaaaaccctccatggccattgggactaaaataattttttagggagcatgattttgttctagcactgaaatatttttttcttttctgataaagccccaaggcattctaagctgaagtacattgctgctcctgtacttttaactatttcgtgtggtttttttgtagacttcaaattggggagaataagaaacaatgaaaccattaggttagaaatcatggctatggcaaaacggctagagtaaaggtaaaacatgagataatgaattatctatcacctgtgtaattccagctatcattgaagtatccaagaatcaccctggtagaggaaatatcaacgaataaattaccctgagggaaaaataacatcatgtgatctagtccatgaaatctgcctcattggtctatttgtacgacaaagcctcccggggtgagctgaaaaataaataaaaaacaaagctggagagctggtttggctgcttgtatggcctacaaagaacagtcagaaaatcaggccaaagacataatacctaatgtccaattcatttgcttacaaagtcatatccaaaatgaagtaaatgaatggattcattttagccttgcaagtattattacatttcaaaagagagtagaacaagatagactttttattggcccttgccttaactgaatatttctaaaatggcacaactaaaatctttacaagaaaatgagtaaacatgtacttaatgatttatggcctcgattttcaaagaatcttataatcttctagacagtgatttcttccgtaaggctggtgttgagctcacccaggaggtgaagctctcaccgagaggaaatgactcccacaagatcctttcctagtgctcaaagcagggccgggttggggagcgtcaacacagcggtacgcttagcctcccaactgatggcaaaagaggaggcttcagtgggaatggagtgggcctgacggccccatggctccctctagttcccctgaatacagcagaacaatttcacagaactcagagttcatttggaaatgggttcgagtcagtgataaagcgaaccaaaatcgattttcatctctgatttgtatgagttattaaactacagagttattaaactacactctggtttgctgagtattaaatgaaggatagtattctgttgggtttatttatattggtacatatataatcaaaggtatttgttgaatgttttatgatagtcattgctattctctcttccaccttaatctctgcgcccccacctcccatcctttctccatctctataatacactcatatccctttagtgactaaggacactgatcctggaaccagactgactgggaaagtcaccaacactcagtgcctcaccttttcattggtaatagaactcaggatttttgcaatgaataaaagggaacaaacagaatgcttcgaacattgccttgcatctgggaagtacttaaatattattttaaaattactatctatcatctatcaccattctatataattattagtactatttgataccattccctttgtagaatggagtttttctagttctctgattaaaagacactaggaaagatacttaaaacagattttcaagtgattatttgagcaattacttaaagataatctactcattaatggtcttattttcaaaagcctttataactcagttttcttaaaaatctacagaaatcagctaactgtagcaggtgttagatgaatcattccatacttaaaggatacgtaaagtgggaagaaattataatccccaaggattcaattctggactctgaaagatgcatttttcatattacttgacatctctggactactttttaattttatattcattaaaatattaagctagcaatccctccttaggtgctggctgttatgaaataaaaacgttgcttttttagaatagactctattttgttccgtgttttaaattactatacacaaatggtaaaacttttcataacaaaggtttaattagaatggttaataactatgatttccaaagtgtctgagtcagttagggagttttgttccatacaaaatgctttatttaaccttcatgccttcattcagataattatacaaatgcatacagttaaaggtttaaactctatttcagttcacagctcaattcataggaaagttgaatacagaaaagcaatgcaccaacagaatatgtctgagacaccattaaaaacaataacacttgttcatttaaatctctgagaatagactggaataatcatcctctgagagaatctcattaggagggtctccctttacattatcatagggcaaaaaaatcaccattttacagtaaaaggaaaaaagctctgagtatatttacaatacatacactatacataaatacaagaacaacacttacataatattaataaacttataacagggttgcctaaacactacagagtatataaatgcagaggaaactattgggaaattaggtctttagataaactggagaaataaattcatttgcaattaaaatcctgaacagaaaaccaaatgaagatttaagaactcaacacatttgcttgccagcatcactggggggctttatcctttaatgtgtaggacctcctctgggcactcttaactccctggggtcagagacccaagagtgttttgtaaaattacatccataaagcaaatcagatgcagcccatctattcaatttgctgttcagaggcttcaagcctagaataactgttttgtaaactaaaggatgtttctgtattttcacacggacagatctcgtgatccaatcaccacgtataatgagctaaacgtcaaggaaaagaaaaaagatgcctgcttgatttggccaaagatgatatttttctttattcccatgtatttttttttcaaatatgactgagagatttattcaaaagaacatgacgttagaattgacccccacacaccaagaacaacgtctagactactactaattataactaagtcattttaagtggcaggtgggtatcttaaaggtggtctgttctcatcgtttcacaacacaaagttctgagtacattcttctatggacaaacatgaatttgctggtttctctttttttaaatgagcatgttatgatacacataattgcattatgatgcaggatgacataatacataagacgatgttttcaagctggttttataagtacttatctcacatccacagagagttggtttgccatgtgatgcaatgtgtcccacatagacatgaacaaaacaatacagtcactaccccacagggggacagtgatttttcaaaatgaagctttaaacacaacaaatcgtggacagacacgttgataggaaagagccttgaatataggcaccagtgccccagttcaacaatatccatccaatgtaataaagtttgaggaacaaaatatacactatattctggatgtaattacaaaattctgccatgggaaaactagaacacaagtagggcaaaagcactttttatgatttttttttttgccatatctttggagcatgaaattagcagaaagggaagatgttggtatgtccctaaaatatcttactttttgattgcttggacacttttatcactagatttggatccaaattctatcctcctattaacccttacttctcaacaaaaatgaatctctgtgaaagtcttgatgaacctgctttggaagaagatgcaataattcacacaaggagtccattcattggttctcgccttgcacaaagggtggactctgtctcaaacacttcaaatttctagagatgaaatccagaaagaaaaagtactgaggcgactgtttccactattgatctcttttcaactcacttcaagttgtggtttttgttgtggagaaattattgcttgtgaaacccaattaactgagaagggccccagtctgcagcaggttgtgcacatggaacacttgctttgagcatggaagagaatttgtttatacagcttctatctctttccccagccaagtaacagggagaaagataataattcaggagattcattttcagaaacagaaacactatgagaaatgacattctcttaatgttttctaagtccattagtacttccatgaatcaatactgtcagagaccttgttctacacagaaagtgggaggaatttcatttctctgatgttggacagcttcttacataaaattcaattaaactaacaacaatactataaacaaattatttataagactatttaaaacattccacaacagagctgttaagtgagaactctgaaaaagaattatccattatctctcctttatcatcatctgaacgtttgattgccaccccattaccaactgcaagagtgggctctgatattaatcactagttccatgggggtgaaaatttcaaatgcatctgaagcagattctagaatgtctatattggtggaaaggtatacaaagagttgaggaactgagaaagtgtactcaggctaaaatgctactaagtatttggatgattttggagctccaggccagacatttatgagaaaagtgacaagttcggggagacaactggttgctattgtttgtttataatgatccttcatgcatgattttccgggaaaggcctgatttcaaatattcagtaccattgttaagtcatgtgttatatcatgtcccgatatttcacttgaaaaatatgatgactactcatgcatgttgtccataataaaattactgagagtcaggaatctgggaaggtggtttcgggacacccacgtgcagtgtggtggagtgggaaagatacaggcagacctccaggtcagagataggcggtttcactttcctactctgccgtttactatttctacatccatgaacaactcagccacacttcccatgtctccgtttcccatccataaagtgtagaaatgttgtacaggttgcaggtaacgtatctaaaaattgcctagtctattgcttggcacacagtgtttaataaagaatagctattatcttcatggtttgctgaatgtgtaacctttcaaggtactttagttttttcagacaacacatggtaagaagcccagtcagaagacttgacttcagtgagattaaggaacccagcagctttcctttgacacttaattggttattttacccccttatcctggtacatttccgtctcccttttcttctttctaacattgggaggagaaaacagtggatgtttttttgaggcctgtggtctgagtccatcatggaagtctaaagcctgaatgtttaatcacagtcctacttttaaaattgcccttacccgatgtgtgactctccatgagtataattttactgatagcctcagtagcttgtttgggtgaatttgtgctctgagatggcagggttggagaatttccagggttcatgtctattcatatagtctcattgtatatttctatccatgactccacttttagcagtacagtaattacaggaaaaaacctgtgagcttctgaatgtgcatctggtaatttttaggactaactgcaaagatggttaaaggctaggcttactaagtgtcagtggtacttcaacagactttttggggagaaatgattctgtcaatattcattccaaaatgattcttaagatgataataggaaatattaggggaaaggggaatgaagaaatgtaaagatgaatttgtgcgtttgatatgagtggataaaatgaacaagcaaacaaatatccttcagtcttttgcgccaaataaattggtgtttttaactgagcaaaactttttgaatcatacatactgtttcataagtttggggcaaatgacagtcaactttttatctggaaattataattaccatatgcaatagtgttcactgaagataaacttaatgttcagatttgtgttcttaacgttctgcaagttagaaagatcaaattaagaaatgttaatgtaaacaagattaggtatatttgaaagctataaaagcgttttttgtgggcatgtgaacagatttgatttactatgtgtatgtatttactctctctgtgtgtatgtgtgtgtgtgttcacatgtgcaggaaaaaacccagtcttattaagaattattgctgtgtaaaagtataggaatatctcattggtcataaggtttactgacaggcactttcagcatttaatttatttctgaaaatgggcattagcttattcctattgcgagtatagattcctttaacacgtggccatatccacagcacttaatcttgtcaacatgtagttatacctaaaagcagtctccctggaataaaacaagaataaacacctgtatggttgttcacactctgttgaggagggagataactgagaaaagagaacaattgtaagatgctcctctttagtacaagcaaaatcctgtgcagctgttttgcccttttcaggaaaagacattactagtttggaatcagttgtctgcaacttaaaatgacttcattatattttaaaccatcctggctaaaccatgacaagtggccactctattttgaacagaacacgaagagcatgctctgacaaagttggacagagttcccatggcaatttcactcattgtgtgtaagatatacaaggcatatctgaacaagttttttctttttattgtgatgaaaactagaagctctctttcccaacatacttcatcaaactatttacaacctctgtaaaatttgtgagtttgaaaatactttttccactatcacatatgttacgaatacagtaaaatatcttcactctattttttaaagatgcagtatccttctatttcattttcttatgaaaatctggatttctattgcaattgctcagtaattagcatatttaaagtatcagtggacatgggttactaaacagacattataatgaaactgtgaaaatatagcaatttttatgtacatttcttaactataaaatgcaggcagagtcatatatagtattataagccggtttcctaataaggtaagtaactcacatttctagacagcacggattattacaaattctttttaaaaaagttctttgctgatatttgttagcccactggctgctgcatatacagttgtgtacacacatgtgcatgtgttggggctgtctgtacaggttaagtggaaggcagtgtggggatgagtagaaatgtcatatggaagacatgacttaccaaacccctttctaaactaaagccaaatctaattgaagagacttttttaatgggatgcactacctcagaaaaactaaaggaagagatttggtcaatgatgttttatactagaatacatttacctgctaagtttacaggcaacattgaagagcaaaatctgagactggattatgaactatgaatattaaggctttctgggcctattatgattcataagagttacctcacattcagtcccttatacgcagactgtaacatggatgctggtattcttaacactgcttaatttctgtcaatcctcactataaatgttaagacatctttagaacaacatcatggctacatttctaagcagtcataacaacataacaaaggcgtattaatacattttgaaggcctcacctcaccagatttattcagttgcagctttggtaagtataataaatcaagtacagaataaggaatactgcatctttatccatataaatgttatcattctaatgaactgattccaaagtgcagaattatgtttaaaacacagatggcaatttaaagttaaaaagaattgtataaaaatgaacacaatctttgcataagctattccaaatctgaaccataatgaaaacggcctttctaatcacctggaactggcatttgtaaacactgtagcattttgtaagtttttcccctgacaatcatcttcctttttcccacttaagctttcaagtgaatgaaaagtgctcatttttttaaaaaatgtggtttatgttgctgttactcaactgcttttgaaaacaaatgtcctatagtgttttatagaaacgacgccaggcagaagtataatctttatggtgaagtcattagaaatctcagtctaactgccttaatagaacttaagacaagttatcaagcaggcttctcagagtccacacacaattgacagaatgagggcagaggtggatgcagaagcgtgaatcttttttcaaacaacttaagatcagaccatgaaaagggattcttaaaacctcaaaggctgaaagtcataacttttcaaataatgtaactcccttgaaatcaatctctatactgcaaacagaaaatcaggtctactgcagctgcttaagtagttaatggctctatgtgtataagttcccaaccatgcacatatccccagctgcaaactgaacagcttcaaatttaaaatcaaagaatgcttctagttacggaacaactgttatgtcctttaggattctactgcttttctgttgctcatgatgcactgtgctttttgaaagaggctagaaatggacatgagatgaaatggaggctcttccatgactgaagacattccatttctttctgtcccaaaccactttctcctttccatggggaaatacttttagaaaactcaccaaggagaatttgccacgtctcaagacaagccccaaagaagtttcagttcctgaggctagaccagggactcaattcacttaattgtgcttagatcccttcttagaagtactgatacgtcaaaaggggaaaatgatggaatgctgacaggttttatcagttaacttaccatctcagtctggtttccactttcagaggatgagggaaaatgttcccttccccaaatccatcctatgttattagaaaagtgcaactcatctagttctgtgctaaatttaaaccaagctgtcactcaggaagattcccctgcctgtcagttttatgaattctaaaaaccaagtctacctgtaatactctcaagacatctttcagcagagaaaagaactggctctttttatgagagcaagcaggactaaatacaaatctacacttcacttgagagatgcacccactacttgccaactaggtgctggtactagtgccagggggttcatggctgtgtttgtccctctctgtgttctctgtcactgactagtaaccagcactggcatgcatcaacagacctttttctattctgaatggtcacaggcaatgtgaagtaggagttgcatatagtacaaaaaaactttccaggtgctaaaaaaaacccactggttgatgagtagtagactgtgcagctaaagatgctatttatcactagaactgcagcccttgttggagggaaattgcttgatgaatttttgagacctggcagacaatatagagcacatatttgtgaagccataatttgacctgaaaatcattacactgttgcttaatgttttaaaaaattccttttgaataccatccaacacaaattgtccttgtttcaacgttcatagttctcgcttcatcagaataagattatctgaattagaagatgatcctaaaaagggtaattctgtaaccggaaattatttcagaatgtccagacatttaaaaatgagctagtaatattgtgaggttaatatgtgcaattcccaaaatcaagtgtttgtaattaaaatatattgcaaaggtctttgttggagaccttttatatctaagctataaaaaattctagcaacaacaacaataacaacaaaaaatctcaccagcccctcagccacagaaagctggaaaaaaacccagcttgtggtggggacaaaaatatggtaatttttctgaaagaatgctcgttggtgatgtattgcttgtttactgtatatgttcctagttgcaaaaaggttcataattttatggggctgatggaactaacaccttcctctcatcctctgcacaggatgagtgggttcaatatccctgcagatgccaatgcaggacacctgggtcctgatacagtttagaaaatgaaatcggtatagaagaacctattggagagtcacttatccttggctctccaagagaggaaactagcaccatgtcgggctttctatgggaagcattctctttccactgattcagttccaaggagaactgacccattaaccgaagagttaattcccggctatgcctcccttgcctttctagtcaccaaataactgttttcaaacaagaaaaggggagcataatctttaattgtggtactcaaccaagcaggacaacaaacagcagaaagattacctcagtgctgtaaatggaaccaagacacctaaaatgctggggtgttttttacaatccctttagtaagtatgaaaattggtaacgtgagtcctcagtgaagttattgtaggaaagtccttttattcattattgcttttctcctcaagaggcgcattatttccatctctgctttgtctgagttttcatgttcactgactttgcctgggcagccccacctcttaccttggtgccagtgtgtctaagaaagtttttttcccctggttccttgtaatcaaatactaggggcaggaagagatgatgcctaggtgacagaacactgcaatttgaagtggggcagtagttttttagacaggctcttcctattcaactacagaacacctctgtgccagtccatgccagggcagagaccaggacgagacttcaactgcccctctgctcgaacagatgaacaaaacagaatcgaaacaaaacaaaaacaatcaacgacaaacaaatgaaagattcaatgttggttttcttcagggcatggcagaatgacaagttgagagtgatatctagtggctgccatcgcgattgcaaagggctgcctgagtgccctttctttgcaggtaatgggacctctccatctgcttcttcgtttctactttcatgctgcttgctggtaacagattggatgtgtgttctagcttactcagattgtaactaaaatttctgtaaaaaggggttaagggatgggatgatgggagattcatccaaatttaaaaggtcttgctctagccatcaatttgtggtaggtgacctttaaggtatcaataacaaaatgtctgacagctcagaaaatgtacaagctacaaacatctttaaatggcagaggacacagcacggaaaacaatgcctgtctcttcagcatttatgtcactgagctcccaggcccgggtaaagacggttctcgtctagtcatgatgggggttaccttcagaccaaaagaagtgtgccttctttttcctgctctggtttcagacatcgtgggatggtgatgcccttttgtgttaacactgtgaaggggattcagccctgctgaattgggtgccgctaagagatccagctcttacgctcagctggacaggtagcattcctcacaccaacatatgcctccggcggtgcagggccaaatgatctgaccgggaaaagctgcgatcacagtccgcgcacttgaatggcttcactcccgtatgtttgcggtaatgcctcgtcagttcatctgaacgagcgaacttccaggtgcagccttcccaggtacacttgtaaggtttctctcctggaagaaacaaaggaacacaagctttggtgctccatccatcactttgccataaccaggccagtactctattttgggaaactggtgttctcaatgaattttcccgttggtaaatctttgtcgggaaaccttaccatcccaccagcggtctgggtcagacaggtgatggtttcaatctcgtcttgcctgctgtgacatctggcaagctagttaacactggtgtcctccattatgactttgccatcaacatataaaggcatggattgactgccactggatatatcaccactagtagactaaaaagaaattactaaagctttacccagtttgatttgattttaaggctgaaagtcacaaagaattcttacggtcaagcagttatgccttgtttcaacacccccccacgcttccccctaccaactgtgcatcacttagatggcttaaggctattttaaaacacaatgtccaagaatatacacaaaattttactgaacgataatgtactctactacctccagatatcaggtattaagtacatattgttcatagatatctattttttgcttgttctttgggggaaaatcctagatgccttaatagtgtaaagtttaagtacatttttcaggacttaagaatcagggtaagccctgagaaatcatcacgttggtcctagagctaaaattcacagagaaaagctgtctgaagaagcatgtaatttgaccgggtctctcagtcaacttgtaaggacagtaaaatatgcaaaggctgtgctgggaaaagatacactagccattgtccaaatgagctcccagggggagtgggacaatagttgacccaggtgtgccattttcctggatctcattcagaatgggaggcttgtccccatgcaaccccacaaaaactgatctctcttctgccccttacacccaacaatctacaatgtgctccttggccacatatggcctctggtgaaaagagcctaagatagggaagggagctatctgctgttcctcatgcacaaagctacaaagggggtattgttgacaccacttcacagatgagaaaactgaggcttcaggtagtaacattactcaaagccagtaaaaagatgtgcatggctctcaatccagtgcttttcactattttacagtggaatggattaattcttaccccatctaaattttgtcacaacttcagacagagttagtgtcactttcttaggtatgaccaaattattcacttcctatttctatgacatcacctatcacaatataccatgaagatttcgtttagacgcccttctgtaccagtttccgaatacttggagatctgggactattctgcctctactatttcagtgtcactggagcctagaatagctgccaagcaagtacttgaatgtattaatacaactgcaacacacacacacacacacacacacaaatacacacacataggaacatatatggtaaactacaggaccctataaatgagatgtgcaggtaatgcctacatgggaaaactagtccaaactggacccaacatttttcattcaactgttaaatcaatgctgtctgtgtggattcttacaggatcaagcagccctttcagaagagagtgaatagttcaggcctgttaaatctagaaatactgatggactaattgtggccccaggttgctctaggtttttctgaaagggctccttttaagaaaaagcctactgcctggattgacaccaaacctcaacttctgattcactgtggttgtcccatggagacaaaactgcatttgcatgtgtctactgaccaaagtttgacagaaatgaaacaaaaatcagcaaaacccctaacttagaaagattggaggtctactatatagtattatctacatgcttttacgtgttacatgtcatctctacatgtttttgaaatttatactatgagcatagttgagcttgataaaattcatcttttcaaaaatacatccatctttggtacattgagctgagctagttggatgttggtcaccgagagccatttcttagctatttcctgtgttgctatggaaccagctagagagagtgtaaggcctaaaaagaaaacaataaaatttcatcttcactggagatgagcgttgctcagttgtgtagtatagaaggacgtgtcttggtgagggagtaaacatgagattagataaactggctgggtgtggttgcttacggcagtaatcccagcactttgggaggccgaggtgggagaatcacttcaggccaggagttcaagatcagcctgggcaacaaagtgacattctgtctctccagaaaattttttttttagttagccaggtgcagtggcatgcacctgtagttccagctactggggaggctgaggcagaagaattgcttgagtccaggagtttaaggccgcagtgagctatgattgtgttactgcactccagcctgggtggcagagtatgaccccgaaagaaagaaagaaaagagagaaaagagagaggaaagggggaggggaaagggaaggaggaggggagggggaaagaaaagaaaagataagctgctggatcctgccctttacattccagatagtgaaggaaggggttccataacaggagtgcacctggggaggagaggtagacaagaacttccaggctcatcttaacaaggatgtgagaggctggtagcaaggtagagatgatttatacctcaggtgctgtctagctttttttgtacttccaattgagtcacttaaaattctctaatttcttccttaaaatgataccagtcatactttcatttttatgttggctatttaataatggtagttatgtcctttccacttgaaaatctggagcagggggtagtaaactgcagtccccacttttacaattttaaaggttgaaaaaacaagaggaatattttatgcataaacattatatacgatttaaattttagtgtccataaataagtttttattggagcacagccacatttatttatttacacatcattccggctgttttccagagatggaagagttgaatagctgcaacatataatgtatggccttcaatgcctaagacctttactatctagtcttctatggaaggggtttgccaacccctgatttttataagagatggccatctctgctttttgtaagcttcgtgaatatgttagcttattgaattgggattatatattacacattgggtgttggaaatgggtgggtgagggaatgttttagttacagttcaatcacttaatctcaaattaggatcctcgattcaaattctaacagtcctctcagtgataaacacacatgatatttcaaatacttcaaattgatttctgggcaacaggaaatgagtcactctcttagaagactcacccactgaggacagtggctcaggcttataatcccagctacttgggaagctgaggcaggaagatcccacttgaggccaggagttcgagatcatcctgggcaatacagtgagcccccccacccccccactgcaatctctaaaaaaaaataaaaataaaaaaacgtagccaggtgcagtggctcacatctgcagccccagcgattcgggaagctgaggtgaaaggattgcttgagaccaagacttctggtctacagatgtgctatgatcatgcagctgcattccagcctgtgtgaccaggcaagaccccgcctccaaaatataaaaataaataatttttaaaaatgaaaattaaaaaaaattgaaaaaggctcacccaactcaatcagacctaaaaatatcctcagaatcttctgctcattaaaaaagtacaataacctcacctatgagggtgaaggtcacatggtatgaagatcaggagtgcctctccatacttcacctggtaaccaaaagtaaggattctacattacgatggtgccccacctcacctccagctcctttaaatactgttgtattaaaatagccactgtgaacactgatgagttaccttcctattgagtctgggaagtggggttacaacatgagaaggatcagaaagtagaagctgagatgtttggaactgtttctaagatggctattttaaaggcagaagcagcagggaaaacagcacctggtagagcaagggtttgtctgagcccataaatgtagagtggggaaacagtgcaagtgaagtgtgatcaagtgtaataaacaatcgtgaaaaacaagggaagaggcctcagaaatacaagaggcagatacttccctactccacgaataaaatcaataaaaatgatatataaattataagctaggccagatgcggtggttcatggcagtaatcccagcacttagggaggctgaggtgagaggatcaatcacttgaggccaggagttcaagaccagcttgggcaatatagcaaaaccttatgtctatcaaataaataaatcagctggtgtggtgacgtgcatctgtagtcccagctacttgggaggctgaggcatgagaatcacttgaacccaggaggtggaggttgcagtgagctgagatggtgctaccgcactctagcctgggtgacagagcaagactctgtctcaaaaaataaataaataaattaattaattaattaaaaagaaaaaataataataaaaaaatttataagctatttggggctaagtaactaatgaaggcatgtaataaggaatgaaaacctttcctatgtgggggagggggaagaaagtatatcagaaaacagtaatttaattatctaagtgataaaatgaattttccttgaaattttccttataaaaacatacacttttacgatccccccaaaaatcctatgcataatattcttcgctcccattgccccattaataaaattagaatttaagcattctctcaccatgcttaaaaaaaaaagaaaacaatatcttcaattctctcctcaaaattagaggctgagttatgggggtaggggaagagaagatggctactgtgtccagccagagagctcaagagagacctgttttcattatatacgcccagtgcctagtatttcattaaaaaaaacaaaacaaaacaggaaagaaagtctataagtgctctctttagactagtgaaattttagaaatggataccaaaaatttgagtagctactgcattgtgttttaacaggacactgtatcttatgtttgtgctttgaagcaatttaaagcacacaatcttataaacacattaagacagcagaaactaacttcatgatgagagtaaaaaaactaattagaaagataattaagtttgtaagatatccagtagtatgtgtaaatgagccctgaaaggctatcataaagaacagaattgtcttttttgtcttctttcctttaaaaacttgctagaaaatagaaagctaaatataatttttaagaagtcagcagcagggacagaatggtgaattttccatgaaaatgttcctatgaaaagagttggctgggacaataaatggagtcagacccctcccagggcctgggctgctgctgcacctgggcgactctgcatcaggttgagcagtggtgatcagaaacttgatttctattaatttctttagaaataatgcatttcccctaaactcatttgaattagaattcttcaaattacttgaattctgtaacacacataagaggaatgtgcaaatgtgttattcaaaactattttctctggaaataagctaaaaataaagacagcctacctaccttctttgcttcttttgtctaactcacaagtacacagtcaacctcttttgacaatagtctttaaaaatgtgttttatgtttttctgaataatctaaagttttgactttactttgatttgataatctttgattttggtttcttatattaaatctatgaaagagcaaacttacagaaaaaggtattgtgcatttctttgccaataaatcttaataagttttttttgtttttaagttgagacattacatttttgatgtaaagagaaaaatcaaaggacactagttgggtaacgggtggctagctgggtgataccatgccagtgcttggtgtatagcttattaacttctaggtcttcaattctgaagggatggtctctatgtcccatgataaatccttaggccacttccaggttttgtatttaaaaaaaaagaatatgaccattttcaccacaacctgtgcttctccagttctgtgaaaaacctggactaaactaggaaaacttctgaaaaagaaacgtgttaaccaacactaataagaagagcatctgttttttaaagtgaaatagtcctctaaatgttaaaaaagacgacataccacacacacacacaaaaaaagggtgggggaggtgtggttgttattgttcatcctgaaaactctgtaactccatttcggagttcatgttaaatacaactttctatgtatatgcagcatataaaaatgtaggtattatttaaatagactaagtgttctgggaaaacaaaaactcacatcagggttttgttttgttttttcttgaaataaccaactgatggattatgaaaacggctgtctctttcaattttggttaaagaaaaggattaagagtcactaagtgcatttccatgacatttacccagcagaaggcagaataaagtctaaagaaaacaccaggtattgaatggattcccaaaacccaccaaacaaaaataactttttcaggtacctcccatttcgccatctgaaatgctgaaaggtacatgtgtactgagacaaaagacaggtgccctttcatattaaaatgacgtgtgagcaacgcacataagaggaatgtgcagtttgaaaaagcctgtgttaaacaaaacatccatgttctcatcagcttctctattattttctcaagcaactgaaaaggaacaccttttgcaacaggaagcacaggcattttcttaggttcagaagtgcatttctgaaacgtgtccctgtttaacttttataaagttacggggccccagacactgacaaatgagcttcattacattcaaggctcaacgtatttgctgtgacaatctgtttcacttgaggaatggtatttgcatatgaggaaaaaaacaagaatcaagattcctatcttgtcttctggtttctgttacattagttcatgaaagttcacagaatctagatctggaaggaaattaggtaccttcaagatgaggaaactgaaacctagaggcggggaaagagctgagattacaaggcccctgacttgtctgcagacagaccaggcggctatacctcttcatagtttacggcagcatacaataccacaggttttgaaatctgaaagagcacacagccatatacaggcttagtcacctatatgagattgatccaaggccaaaaagttaagctttctgaaagcttcccagtttgaaagtttcccagtttcctcatctgtaaaacaggaatgccatttactcctgcagcactgttgggaaactcaaaaatacacacactacatacctggcaaataatacccactcaataaaggatattttatatttacaaaattcagggtatttctgtttttataaagaaataaaaataatataaagttaaaaatggatcctgtttgctattttttcagcaattaattatagttttggggtaagcagatgccaatcctgatgcgattttcttaacattttaaagtataaaggtactttataggccaagcagaccaatctattccataatgtccatttggtcctgtcaattcaatcaaataagtaatcaatatgccagtctccatcctactgaattgcctggactgaattaattggctatctttttcattaggtattatgaagaccaagtgggttccttctttcctcctctaaataatactgcatattctctaataagtattgttgataaaaattatatttgctaaagcatatagtactttccatgtaccatactttgctctaagagctttatggatattacctcatttaattttgataacttcctaaagaagtcgttgcaataactaaccccacttcacccagtgtcgtcacccagttagcatgtgtctcaattgccactcaccctgcctctcaacattttaaattagtgctgtcataaaccaggatatctggtcagaactgggcacggagactgcaaatgtgagctactactcacaggacagacaatagtgttaacaaacacaggctagcccttctcacccagaaatccgatataagtgaactaaaatatcccataataaaagtgaactttagtgtaagtaaaaagttcaaggtcaaaagacaatattttatttggctgttctgagttttcatttctacgtagtgacctttcttttcctatgtgactggttactttttccttggtttcttttgcagagacctcttcctttacctgttgcataaacgtttccaaagattttgacttaacttctcgcgtggcaggtgttcctcttggctcatatgtcttccactacaacctataagggaaaagactcctaagcagctatacctcagtctctctcctaagcgccagagagggagacaggacatttccaactggtggtctgaaagcatcttcaatatgagcaaaacttgctcagcatttgccacctaaacatgttcctcttccggtttttctggaaaaacagtaattccatctactcaggtaccaaatcgtcaatgtctccagttggagagatttcttggactcttccctctgtgtgactccctgcctgccccactctgataattacatctgccagttctgccttctaaaatctatccagcaatcctcccagtttatccccacagtggtggtctaccttgctttaggtcctttccaccttttaccaggaccagtttctaatgattctgtttctccgtcttgcctcctatgcacaccaatttattgtccatgctgtagagaaagaaaactttttgaaagataatctgatcatgccacttgttggccccatagtaccctgagacactctcttcacaccacgctgtgattgaaggttttcctctctgtccgactcagcagtgccgactcagcagtgccgtactgtggatgactttgagccttcttaccactgtatccccagggcctaacacattagtgctgtgtgctaataaagacttgttgatcaaaggagtgaaactactttaatttaaatactttgttcttttaaaaatagaacataggagggtcaacataagagtaatctattttgtgagacaaagagagtacactgtttacattctatctattctataatgttttcttgtctaatgaattagaatacatacttttgaaaataaaaatatatttgtgaggtatcatttaatactagtgccacttacagttctagtctgcaaacaaatattttgttttaaacctctgaaattagtaacgtgtgactgagccttgtattctgttgctcaaatgagcattattttaacatttaaaatatatctcttacaattgtattattcttagttatggagatttttaattgaattatcataagcattatgaatcaacattttatttatttatttattttgagatggagtcttgctctgtcgcccaggctggagtgcagtggcatggtctcagctcactgcaacctctgcctcccaggttcaagcgatgctcttgcctcagactcctgagtagctggtactacaggtgtacaccaccatgcccagctaatttttgtaattttagtagagatgggttttgccatgttggccaggctgttctagaagtcctgacctcagatgatcctcccacgtcagcctcccaaagagctaggattacaggtgtaagccaatgtgtccaatcctatttttatatattctttaatgatgaatctatgttctatcaaaatacaattccttattgtctttaataattccattaaaaccacaaattttatattagtagttaattttaccatttaggatatgaccaacactcaaatctagttattcttaggcagaatgagagaaagtagaaagactgaagatattattattccataccttttatataacccagctttgatggatgtatggataaaatgaagccagaagcaaaggaaggagaatgatgtcacaaagacacgataaagatcccatggcggccgggtgcagtggctcacgcctgtaatcccagcactttgggaagcagaggtgggtggatcacaaggtcatgagatcgagaccatcctgtccaacatggtgaaaccccgtctctattaaaaatacaaaaattagctgggcgtggtggcacacacttgtagtcccagccacttgggaggctgaggcaggagaatcacttgaacctgggaggcagaggttgcagtgagccgagatcgtgccactgtactcctctagcctggcgacagagtgagactccatctcaaaacaaacaaacaaacaaacaaacaaaaccaatggcatctttaactttgcactgtcattgataatttatatgctaacacaaacagaattatgaaacacaactcatttagttatttatttaaatgaggtaataatggataggtttagaagtcttttctaaatataggaaaaaagatcaacttatttttaattgataggtttagaagtcttttctaaatataggaaaaaagatcaactgttttttaaataaaaataaggtaaaacttttaaaacaaaatttgttcaactatgtacagaatggttgcctacattccaatcattgtaaatcttaagcatgtgtgtctaaacagtaactctccatgataggttaaaatgactctcttccccattgatgaaaataagtgctacacctgcaaaacattttgttaccaatccaaattttttgttttccttgttggaggtggcactgaaacatgcttgtctgcataggcaggtgatgcttgctgcatccccccagtcaggaccaatgaccccttcagtgctgctgtagcaacctgcatagagctcgctcagggctttcctattacgtattattttatatgctggatatgtgtgaatgaggctgtctctcccaccagatttaggactccttgctgtcttcatttgtacacagcacccattacattcaaagagctgtgtgccaaacaagcactcaagagcagcctatttaattttatttaatgattaatgcttttggtccacatcttctcactggcttctaacaaaattttagtagactatggagaaagaccactctatgttaattaaagccttaaaaacagattaaagtctcttgctctctcattactttaccgtccctgaagggctgatgctgaacaggtaggtactgctgggtagacatgcataggagcacggttccagtgaagagagaagactcgtaggttatcagcaaactagtctgagaccagatataaggaaaagcataggctcgagagaaaccagagtttcaatcctggctctactgctttcctaatacctgcccatgtccacgtgccctaaccttgctcctttccagggatttacatgtgtgatgagtatatgtaaagcactcgaagaggtatgtttgtgttcaaaggtaaaaaagaaaacctgagattcacacaagtagtttgtctaagttcactaacaagttaggggccaaagagattgaaacttttgtctctggacttcaagtttggtgatatttctattatattttctaatgtctcagcagttaccaatatagctcatattcatgagctatttgatcaggacttacaaacaacttacggggagaggatttttccttgaaaaatgtcagtgtgctcttaaatgatttattatcttggcatcactaagcactatgctttatctaacaaggaacctagatgggggggtctgaaatggagctttatgtggaatgagctatttaattaatgaatacagatgtgaagtcatgaacagcagcactcactcgtctgaagttaagatctagcaaccacaagcacctgcgaacaaaaggccaccaggatgcacagctgtcacaaagcccctgattttctttgtaggaatatcctcaaaccacttcagaatctcatccagtaaatgaagatgaagattcaaattagaagcaagaaatactggaatagcagcaagaaatgatgaggcaagtaagaaagtgagaaaagacagaatctgcaatcatttaggatcgctatgtgtggaggggcgtgtgtacatatgtgtgtgtgcattccaaatatgtaatcaaatataattaatggaataaacatgtaatagtatttgatattaattacagagacttcattcatcaagagaaaaattattaaataatgtgtggtttcataaaggtagggaagatcatactctggaaaccattaaatcagaattgcttaatatttttaagtgtctatatgaataaacttccttaatgtacaaaattcagatatgaataattcctaagaaatgtgactaccttaagtttactaatttttaaggttagaggtgtatggctttcatatgaattaaaatgaatattatacaggattacctactgggcctcacaaatttatcagagaacagtatgtcaattggggatagaaaatatttccagattcatttgaacagactatttttacatattgtaattcctttgcaaaaaaaatttgattttatctttattttgccttttaaaaaattcatcattaaattgtaatattctgcagaacactgataatgtcagtgtcattgttccattttaatgtcatgtcatacatactgttagagttctagtttctcttcagaccctcttctagactagacccaacatctggttctggtgcaccatctagtggctgtaggaatcactgatgcctgaatgttacttgcttttactgcattgtagaaattactagagcatttattttttagaaaatagtgagaattctaaaaggcaaaaccaaattcacaaaattattttcttctaaaattcaaatgcaaatcagttaataagcaatagaactcttaacgtgagggaatccatagtgcataattgttttgtatagcacatatttaaatgaccatattaatttaaatggcaatgcatactcatttaagtactaatatttatttgtgaatatgcatatttatttaaatactctgtaaactgcttcatgtacagagacccacaatttagacagtggatataaataattaacctgctgacaataatgtgtatgtgatggctgagatatattttttcctttttttgacatgccttaaatgattaagcacaagcaggcattaataaactcattcaaaaatacttggtcacatcttcgtgttattatctaaactgtacactcatgaaaatatacttatttttaatttagaaaggcactcctcagcatttctttttctattctaaattctttgctaatatctagaaaatgtacctctttcaaatacctacaaatatgtttaagttactaagttgtaaataaaaagatgactgatcaggtacttatatggtacaaaaagatgaagcattaaaggcaaaattaactttctcaaagcaagtttctcactgatacttactcccctcccatagcgtgcatggctctcgtaagtcaactggtataatcccaaattccaaattaattgttggtcacacacaagtaacttactcaatatgcctgaagcaaaggtaaggctaagaagatgtttactaagagcatgcaaaccaacctgattccctatagaaatagttttgatttcattttgaacactgttacaaaatcttatacataattataaatcagaagtcaggatgggctcattttgaactagttacagaaaaatcaaccaaatttcactttttttctttctaaaaataatgttatttgactgataatagttcaaggaagccatgactgcacatagtaactatctctctgctaagtggatgaatggatttgacatatcttggttttgggcaggtatttcacaaggacatttagatttaactgtgaggcagagaaatgtgagctggaaacaggagagctaggtggattctggctactgtttaaagaattaagacctatctgaatggaggcctctcggatcatgtcttagggttttttccttgaacgcatcccattcaatacattcatcaattacctggcacagatgaagaagctgaaacagacagcaaaaataatgaaagcaaagtgggtagggagaactttcaagtcatttcaatttattagaataatgggcccaaatcaagaaaatgaatatagaataattatttcttagacttgaaaaagtatgtgcaacctcagaataatgattctgtcctgtatttccagcctgtgcctcaacactttcagtgatagggaacacactacttccaagcaaagccatcattaagggacagctccaaccacacatacaacatggcatgtttaggtttaaaagaaatctattataggtacaagggatagacaagatacagttgttagcagtttttgatttagataacccaatagagtaaactgctaaaaaaaacttaacaccatttttgcatatacaggcatatcttattttcctgcacttcactttattgcatttcgaagatattgtctgtgtgtgtgtgtgtgtgtgtgtgtgtgtgtgtgtgtgtgtttacaaattcaagttttgtggcaatcctatgtcaggcaagtttactggcgccattttcccaagagcatgtgctcactttgcatctttgtgtgatacttgggtaattgtcacaatatttcaaacttttaaattattattatattttgtatggtgatctgtgatcagtgacctttgatgtttctactgtaattgttttgggttcgatgaactgtacccaagacggcaaacttaatggataaatgttgtgtgtgttgtgactgcatcactgaccagctgctaccccatcttactccctcttcttgagcccccctattccttgagacacaacaatattgaaattaggccagttagtaaccctaagtgttcaagtgaaaggaaaagtcatacatctttcactttaaatcaaaagctataaatgattatgcttagcgagtcaggcacttcgaaagctgagatgggctggaagctaggcctcttgagccagttagccaagctatgaaagcaaaggaaaagttccagaaggaaattaaaatgttattccagttaacacacaaatgataagaaagcaaaacagccttatcgctgatttggagaaagtttgagtggtctggatagaagatcaaaccagttacaatatcccccaaagctaaagcctaatccagagcaagggccactcttcagttcttcacggctgagagaggtaagaaagctgcagaaggaaagttggaagctagcggaggttggttcatgaggtttaaggacagaagctgtctccataacatataagtgcaagttgtagcagcaagtgctgatgtagaagctgcagcaaggtatccagaagatctagctaagatcactgatgaaggcagccatactaaactacagattttcaatgtagatgatataccctcctattgaaagatgtcatgtaggactttctgagctagagaggagaagtcaatgcctagctttaaagcttcaaaggacagatggactcttgttagggactaatggagacagtaaccttcagctgaagccaaggctcatatactattctgaaaatcctagggcccttaaagaattatgctaaatctaatgctaaatctgcttgtgctgtataaatgtaacaacaaagcttggattttacagcatggtttactgaatgttttaagcccactgttgaggcctactgctcagaaaaaaagattccttgagaaatattactgctcactgacaatgcacctggtcaccctagagctctgatgagatgtacaaggagatggatgtttttctgcctgctaacacaacatgcattcttcagcccacggatcaaggagtcattttgacttttaagtcttatcatttaagaaatacatttcgtaagactatagctccatagctagtgattcctcttgtgaatccaggcaaattaaatttaaaaacccctggagaggattcaccattctagatgccattaggaacatttgtgattcatgataagtcaaaaatcaacatgaacaggaatgtggaagtagttcattcaatcctcatcgatgactttgagggattcagggcttccatggagaaaggaattgcagatgtggtggaaacagcaggagaattacaactagaagtggagccgggcgcggtggctcacgcctgtaatcccagcactttgggaggctgaggtgggcagatcacctgaggtcgggagttcgagaccagcctgaccaacatgaagaaaccctgtctctactaaaaatacaaaactagccaggcatggtggcacatgcctgtaatcccagctacttgggaggctgaggcaggagactcacttgaaactgggaggcggaggctgaggtaagccgagattgcgccattgcactccagcctgggtaacaagagcgaaactccatgtcaaaaaaaaaaaaaaaaaaaaaaggattagaagtggactcaagatgtgactgaattcctgcaatctcatgataaaacttgaatgaatgaggaactgcttcttacggatgcgcaaaaaaagtgattcttgaaatggaatgtattcccagtgaagatgctgtcaacactgtccaaattacaatgaaggatttagaagattttataaacttagttgataaagcagcatcagaagattgactgcaatttagaaagaagttctatggtgggtaaaatgttatgaaacagcaccacaggctacagggaaatcttctatgaaataagagtccactgatgtggcaaactttattgctgtcttaagaaatttccacatccactccaacctttagcaactatcaccctgatcagtcagcagccatcaacacagaggcaagaccctccactagtcaaaagattacgactctaaaggctcagatgactgttagtacttgtgagcaatgaagtgctttttaattatgtactttttttagacaatgctattgcacacttgagtatagtgtaaacacaacttttaaatgtaatagggaaacaaaaaaattgtgtgacttcctttcttgtgatatttactttattgggatgtcgggaactgaacccacaggatctttgaggtacgcctgtattaagagaagtccattcacaggatatgttccctcaatttgtggtatgaaaacttaaaaagacacagtgatcagttggagtgtatctacaaagacacggctgagaaaactggaggtgtttgatttggagaattaagatgttagttggttcatgacagtgttgagaggaacaccggggccagtgagtgaaaattatagcattatcattagagccattctgttcaaccagaaggttccaagacctaaacagcaccgtaagaggctactggacattgtaagagaggagaactctgtcttcagattgtgttgcagaagaatatgcggccactcagagcatttaaggagagttggttaaactactaatgtgggaacaatagtcagccagaagtgccaaagagataataacagctacaaccatctggttgttaataacaaattttttaaaatacacataagtatgcagaaaactgcacagcagtgacttgctctctgcgaaatatgacacgcaaggggttccccgaattaggaaacactagactgtaacatataaagtccattctgacccttagagtctgtgatttcattgtattaatagccaagctaatcaattctgcttcagcatagcattcaaggttcagattgttttgaattacaatgcataaatgatgtctcctctgctctcatggtgtatgttagaatctgtaagatgcaatcctatactgccatggagttaaatcctttaatagtacctgattaaaaattttcctctctttcactgttcatcacttgggtaagaggagtggaggtgtctgtgtgaaaatgaggctaatatgtattccagaaaactcaaagagaataggaataactcaaaatatgtgatgattcattgtagaaagtcatttttttaaaaacagaaatgctcctataaagtcagtaatatggtctaatcatacttcctgccatgatctgtgttcactatctactggtaggatggaatatacttactcaatttccatgtcttcacactcattctttgccttaatgataaaggaactgacttaaaaatagagcctaagaaacagataaaaacctctctttgggaagctcagaatcgtagaaaaggaagaatctagaataagtagaaaagagaggctgggtgcagtggctcacacctgtaatcccagaactctgaaaggccaaggtggaaggaccacttgagcccaggagttcaagaccagcctggccaacatagtgagaccctgtctctaattaagtaggaaagggaaaagaacagggagcagagagagaacatgggctaaatggaaaatgatgctaatttcaattattttgatacctaagctgggaggcagtttacagagtacagttcttttcacatgtctgagatgggaatctgttacatgtgaagcttccagtcagtggcagatgctgtcaaggaaagacgctggactggacttgcttgctgtgagccatgttttaccgggaatgtgtgaatgaatttccctgctctatcggcttctttgggcttcacgcagtccagtcaccactcttcttagaagaagtggtggaactgtggggccctcttcctatcttcagtctcttgccagggccttgcactggaggcatcctggaggaactggaagctcaggaagccagaggatgccagctgagggacacagaaggcagaggatggggtgggcaggggctaagtgcagagtcaccagttcatttcctagatggatgggggaacagtggcaaaggcagtgagtcaattgtggtatcaatttccttttctgtaaactgtcaatactaaaactcctctccctatataaaaaaaataccagtgtgaatcaactggagttatgcctgaatgtttgtaaaaacttcccacaatgctacgtatctgtcattttttatttttcagttgtttacctatttgctatttgggagagagttttgaggagagcaaaaagcataatctaaaggaatggataaaatactaactttaagagagagaataattgtgttcagcttcttctttgatgtgccacgtggacattttttaaaactgatagcctatataatgattaagtggtgatgctgactgtgagaaagactactagatcactatgttcccaacattttaaaagctcaaatacttcactggtttctcaagtttctctctttctcaagagagagagaatacattccgcctagaaggagggaactggacttgagaggtacacaggatgaatgagtacgaaaggctcccgaggtaagtggccggcgctttatggactctcactggctcacaggtgagaagccctgcagagcggtacctgtatgtgtcctccggtgagccttcaggtgagaactttttgtgtacactttgttgcatccctcaaaatcacatctgtggatacgccgttttctggagtctggggattcagaccgtctctggcgtcttgtgctctcaatactaaatggtgaaattgaactggaaaaagaaaaagtggagttacacggtgagatgcacaccgccccattttggttctggtggcatgggaacattgtctcagacactacagcttcacagactcaaggccaccatgaccacagttcttgctaccactatcttgggcagatctcacttttcgaaacctgaaaggcaggcagcatgagttatttccggcaaaacactccaagggagagaaagacatgcttcaaacaacaataacaaaaactgaaagtaaatgaaagcagtggtaggtgagtatttcctcattatcagaagaaacaatctggtaggggtaaattaccatctcacagttttgaatttctgaatatcctgatagagaatattttaagaaggcttgctatagacaaatgacaaaatgatacatttaataagtaacaagagggtctgcactgcatgtgacaacatagaaactcctgtaaaatcacaaggtacatttctaaacaagggagtcaggctgaaagaaatgacatcagtaacatgaatcatgacaagctatttctgtttggtgaaacgcacctgacatttaacttttctagttggagtttctttgtggtgaggaataacgtgcattgtctttaaagattagctgtaccaccattataaaaaaaagttttaactaagaaatttggccctaacttgcatattgtttaatctgaatgccccagtagaaaaacaggattagtttataatgtcaggtaattgactaacatgtacttaaaaaaatcttaatctcttttgattgagacagaaataatatgactcatcttttttagtaccatgacattctttaaaattacagtgagatatgataaaaaagcagtcactcatatttctactctacaaaatgtactacagttaatattttgacatattttcttccagcttgttcacattttgatgcttttaaaaattagtttttattggtaaatcacctcttttaaaagttgaacattactgataaagatcaattccccccttgttttccaccattatcctggtcctttctcctccttccagggaagagcctctatcctgagttttctttacctctttccaattcttttaaattatgtctacctatacaaatctgcatttacagacattcattttttttgtgtgttttttaagtcatatgaataatatcatgctgtttatatcattctgcaaattgttttattcctttttttaattcaacatttaacatttgagattcatccatgtcgatataaatgccataattcatttatttgaagtgctatatacttataacttaccaattttaagatctatttttaaaatattttaaccatctccaaaatcagaatgcttcttaaaattgatggcttattacagttttactggcataactttttttattagtggtacataaagtaacggtgcattttacaattgaagacattttaacttagatcgggggtcagtgaacttttgctgtaaagggctagatagtaaatattttatttcaacaccgagggccacacagtcttatgttgtagctaatcaattctgcaactgtatcatgaaagcagctatagattatatataaacaaatgaatgtcgttatgttccaatgaaactttgtttacagaaacagtgggctggccaggcacagtggctcaagcctgtaatcccagcactttgggaagctgaggcaggagaactgcttgagcccaagaatctgagaccaacctaggcaagaaggagagaccctatctctacaaaacaaataaacaaaccaaaaaacagtgggctgtattctgtccttgagctgtagcttgccaactatggaattagatgaaacatggcaggagtccagtgaatattcattgccatttcccaagtgacggacatatagactacttgtaatttgcactttcatattgctccagtgaattttttctgaaagtctctttctgcacacgtgtcttcagatttcagtgtaccttctcccttttactaataaattaggcaaacaaagctttctgttaggtaaggtcaaatataaacaacatttatctacctgtgtctcaaacagttttatgcaagatctaccacagtagaatgaaagaacatatgttatgtatggccaagccacttttttcagctttcttatcaatgtggatctgtggttttccacataattgactcacagttgcagggatcggagtctatcgtgaaaggagtcaaaacagtgtgactggcctgcctcatgtaagaacagctgtagttactcctgacaaggtatatttttatcactgggtttgagtcccatgaacaagtaagactgtgtggtgataacagagcaacagtaattcatttctggaatatgtagttatgaaaataaatattgatcttggcacttccttttatttcctgaaaaaaaggaagtcattcatagtgttgtacaatgtttaacatcttttaaaagtgagaaaatgatagagtatttgttttctgcaagttataacttaaagtctataagaacactttgttttgtgtaatattttccacacatgaatataaagaagtctaaatgtaactatgcataaacacacacatacaggtttttgctgagttccattgattttagctatttatcttgctatctgtatataaggagaaacgtaaaaaaaagaaaagccaaccaaaaaaaccctgaaatcagaattcagtcaataatgaatgtttctttagggaccaatgaagtaatcgggcaacacagcccatcaaccacttaaatatagggcaggcagagaaacaaaaacaaaggctacagaaggccatgaaattgcttcactgtgagttctgaatttacatcaaaatgaagacaagtggattgtctataggacctcagccctggttttcctcattctacagtgaaacgtgggccaggtgtggtggctcatgcctgtaatcccagcacgtagggaagctgacacaggtggatcgcttagctcagaagctcaagaccagcctgggccaacatggtgaaactccgtctctaccaaaacacacaaaaattagctggacgtggtggctcacaccagtaatcccagcactttgtgaagctgatgtaggtagatcccttgagctcaggagttcaagaccagccagggcaacatggtgaaaccctgtctctacaaaaacatacaaaaattagctgggcgtggtggcatgtgcctgtagtcccagctacttgggaggctgaggtgagaggattgcttaggctggggaggtggaggttgcagtgagccaagatcatgccactgcactccaatctgggtgaaagagcgagacctgtctcaaaaaaagagttaactgaaatgttttagaacattataaagaacaaatacctaaaggtatctgtacaataaaaataattttttaaaaggatatacgcaatgaatagttgtacccagtaaagctggctttcaaatgacattcaatgggtagattttctccttggttcccctttctaaatggcagagatatcttcagatgtcaaagaatccttggctaagcctatgcctttcagaactgctgatttgatctttttgtggaaaggtaggaaggtaagtgaagctgaggtaacagggaaccagaagtgcagaagaacctgaagaacacaggaaggtgataggacagtccaagctccaagagtgctgcgttgtgttgggatccccagcatatatccacagtcggcgggcactgcaagtggacgacaaccgtggactgggggtttgtctgaaccaagtccatggctggaaaggtgacagtcgagttactggtaccaagtaattttgtatttccagaacctaggacattgtgggcattcaaaaaaaaaaaaaagtttgctaaatagaataaatgaatgcattaagcctggtattcctgatttttaattttataagtaatttattaattcttaattggttaattcttaccaggatactttgattccaagtcttcagacaatgggcactcaattccacactcctacgcccatttccccgagttgctttttttttttgagatagggtcttgctctgtcatctagactggtggcctaggtggcacgatcatagctcactgtaatcttgaactcctggactctagtgatcctccccctcagcctcctgagtagctaggattacaggtacatgccaccatgcctggctaacgttttaattttttgtggagacggggttttgttatgttgcccaggcttatcttgaactcctggcttcacgtgatcctgcctcagtctcccaaagtgctgggattacagacataaaccaccatgcccggccaagtttcatattttcaatgctacacaaagtggctagtgaatatctgggaatctgggtaaccattaaaaacacatagatataaatgtctcaattatttcctctaagttcaagagcagtgtgttctaaagtattgcttacaattaaatttctcagtgggaggccaccgataaatgtgtaggatgctggtgaatgaaataacaaaagtctttcttttgaccctaacaggcatttagataagctggaaaaagtgagagaaagacccttactcctggcaatattatcttgccccatctcactcgagggctgtccataagaaggggtgttaggtaacagaacagctgggtgttttcactctgccttacctatgctttctgagcaacatgccctttgttcagaaggcacctgaagaatcctcacaggtatatgcaacctgacttctgtgcttcaaaaactggcctttttataaagaatgggaatgtgcaagtaactactgcatacaccagtagagcattctttgcataatcattagtaataagcttggtatgatgaaaatggtagaggtaaaacacttgtaactgtgttcccaaatcccgtactaaatatatctgtacagccccaaagaataataactaaaggcccacttctttccccagaaggttagaccatttagagtagtgaatgaacacctgagggggcctcacaggtaccacgttgtaataattagatctagagagaacaaatgagtgaatcatgactttggttgcacaatagtcccacttggaatggcaagttaaattagaattaaacccagagaggctcaaaaagtcacatccaagaacagctctatttaaatggaaggcgccacatggctgccatgaaagaaattagggataactgtaatcagccggtaataaaagaccactcgtcatgtgtgaccttagcatgatgagatgtccttcactgaaactggagtttttacaggagttaaaaaaaaattaaaaaggccaggacaatctttcaagcctggaaagaagacatacacatcccagatttaaaaaccagagcagaaaacactggaattgaaggagctttagtaaattcacacacgcaatcacaacagaattccaagggccacagctgaggataacaatgatatttacagaatgcttagtgggtgtcaggcaccgacctaaatgccttaagcttcagagcaaccctctgagattgacactactatccctgtacactgtatccctcttttacagatgaggaaactgaggcacagagaggttaaggccaaggccaagacaaagtctgcggctacactaaaactcagacctgagtggttgattccagaactcaattttaattacaatgttatgcttattcagatgaagatacaggtattacaaaccaacatatgatagaaggggaaaaagcaacaaaatatctatagcatttaaatttcccctttaacccaattatataaaacaacagcacacataagtgttattgaatatagcctgcaacgataagacatatacttttctctggagaattttaaaaaggtaaaccgttctgtaagtactgtcagatgggcattcagtacacttactattaatctaccaaagaaagtattttcttttctctcctttcatcttgtttttaaaaagagacaagaactcattctgttgcccaagctgcagtgcagtggtagaatcatagctcaccggagcctcaaactcctggactcaaacaatccttccgcctcagcctcctgggaactaggactacaggtgcatgccaccatgcctagttaattttttttttttttggtagagaaagggtcttgctgtgttgtcctagcctgtcttgaactcctggcctcaagtgatcctcccacttcggcgtcccagtgttgggattataggtatgagacactatgcctacccagtacatattttcttaaagttgttataaactatgtatttccaagggaaatgttttttaaaggctgagtttggcagtggtatatgctaatgtcttccttgaccattaatgccacaaaattagtcccttccctgacattccactttatttacaattgtaccaaaaagaattgagttggttgcacgatagaattaccttaagggaagtgggagcattcagtttacaaagtatattttgtactgtttctaaggtttcatattatttaaaataagacattgaacatcacctacagaattctgaattaacttctgccacagaatacctgtaggtagaatgacttctttgttagtgaatcaaacaccaccctgggaatgaatcatcaagaccacaagcagagcaagagtggatgagactttcagttaatcaggatttacataaatctcagtaagacagattctattcacatgaacaagccagatatctgcatttctttgtaggctttcccttaaccagcagatggctctcagaggcaggaatcttcatatttatcttccatactacaacagactctagtgcctgtcaaaccatgtcaatgtctctcctatgatattaattagggaaaaagcagtgtttagatacatttactaccaaatccccagcagctacattcggaggtggagcagattcacaggcatcaagttcctctctcactcctgtctgtagcatttcacagaaaactacttttgaacagattgaaattgtaagattagtagttgccacccttttcagaagctgtgactgagacattatatcatgttctaatttggattcaataaaaacgttttcacaaaatgtataaatcaagagaaatacgtttgctaaaatgcgtcaaaaagctcaatcttaacatctattcaaactagcgtttggcaagttttccatatgaacagaatgcgtctaaaatgcatatttaattattgttttactttaataaacaaagtttcctactaaactaattaaaagataatggtttacaaatgagccttttgggcgcccaaggggtgccctggggatggattcacagtatttcatgattttacttaaatataacagcagccactaagtatttttccacatcactttctagaccgttaaaaaacttaaaagtatgacaagctttctgttctttttgtttcaacatatttcagcaagcaagatcataagctgtattaggcaaaatgtttaaagagaatcaaaatagaaaaaaacgaatcattaacagtctgttctggttggctatattatcaaacttttatgatgaaattagactacaagttgaaagaggattgttggctaacaaaaaaatgcctatttcagatatagagtatctattcaaaatagctactctgtggggaatgtcctatgcattgcgaagactttatcccatgagatcaattaataatgtaggatgaaacgagggttctgaaacaggtatggatttctggattatactagacatacccactgaatggaagacacataacatacttaaatatttagagggattttcccacagaatttcttcagaaaataccggggtttaaattatgttttatgccagaagtgatagcttggtggattacataaaccttaaaaaaaaaaactttctaggtcagaataggattaattattttaatcggaatgccttaagggtaagccctgccctcctcattctggcatgggcccaacccatgccctattgctttatgagaacagcactttatcttatccatgtggctcttgaacacatctgatttggggactctctagaatcatgctaaattttaaaaataagttatccttatttgactacagttaaactttaagctactcaagagtgaagagtcttatacatgtctatttatgtgaccgacaaacatgaaaaaaagctcatcatcactggtcattagagaaatgcaaatcaaaaccacaattagataccatctcatgccagttggaatggcgatcattaaaaagtcaggaaacagatgctggagaggatgcggagaaataggaacactacactgttggtgggagtgcaaattagttcaaccatcggggaagacagtgtggtgattactcaaggatctagaaccagaactaccatttgacccagcaataccatttctgggtatatacccaaaggattataaatcattctactataaagacacatgcacacgttatgtttactgcagctctatttacaatagcagagacttggaaccaacccaaatgcccaccaatgatagactggaaaaagaaaatgtggcacatatacaccatggaatactatgcagccataaaaaaatgagttaatgtcctttgcagggacatgggtgaagctataaaccatcattctcagcaaactaacacaggaacagaaaactgaacactgcatgttctcagtcataagtgggagttgaacaatgagaacacatagacacagggaggggaacatcacacctggggcctgatgtagtacttaagttaacatgaattattgaaagtttttattgcttgggtaggattatataaatcagaccaagtagaactcattggtagttttccacttgagtctgtgttaccagaatgactgtctgaggccacatgtagggatttttctcatcataagatgtccaggtatttgaattctggaggaaaagaaaaatcttcccacctgagacagataatattttacccgcttttgattttgttcctgaaaattttccttactctttgaatactctgtgaaattaacactggaaaagtagagaggtataccaatatgactcaaattcatatcttaaagacatttagaagatgagaaaactaaggctcagaaagattagactaattactgctcgaagctcacacagctaaacaggggcagttagagctaaacagtgggtttcttgacccctagagctaagacttttccgctttccaatgatgttgtagaaagatctgtgtggtacttttacttagtaggaaggaaaatctgcttggcaacactgatattctttctttttacatcagatagttagaactacacacttacgctatttccttttttttgctttggctgctagaaaactcggatacaatagcctaggattggttgtggcttatttgccactctaattataagatttgaaacacaaaactacaaggttttaattttatatagtattttattttttatttttttgagacggagtcttgctctgttgccaagctggagtgcagtggtgcaatctcagctcactgcaacctccacctcctgggttcaagctattctcctgactcagtctcctgagtagctggaactacaggcgcccgccaccacacccagctaatttttgtatgtttagtagagacgggggtttcaccatgttcgccagcatggtcttgatctcttgacctcgtgatctgcctgccttggcctcccaaagtgctgggattacaggcgtgagccatcacgccgggccagtaattttttaaatgtaggtattatgaaatattttctgaactaaggaaacttataatgataaacaagaaaacaaaaacaaaaaaatagaatatgcttctctttaaaatggagaaaactatgtgatagtcaaacctgggttttaatttggagacttctaaagttctgtgatcaataagctcataatatctttaaggaaaaaaaaaaagacaaaataaggattttgatttttgtggtggaagctccttgtactaatagcctcattctcttggtcaaatatcactattccatttataggacttaacatgctaattaaaataacataggacttgtagtctgaaaatacaaacatgaattacagctattataacttgttagctatggtatcttgggcatttaaactcttggagttttagattcccatatttcaaaatgtatttatttatttatttatttatttatttatttatttatttatttattttttgagatggagtttcactcttgttacccaggctggagtgcaatggtgctatctcggctcactgcaacctccacctcctaggtccaagcgattctcctgcctcagcctcccaagtagctggggttacaggcatgtgccaccatgcccagctaattttgtattgtttttagtaaagacggggtttctccatgacctcccaacctcaggtgatccgcccgcctcggcctcccaaagtgctgggattataggcgtgagtaaccgtgcccagcttcaagtgggtttttaatagtaattactgaatggagttttcatgaaaattagtttagagtaaggtaaagctgacccaatgtccaatacatccccagcacttcttaatattatgttccttctttcttttgtggctaataactttactcacacatcatgaagtcatccttataaagtgtacaattcaatggcattcagtacactcatattgttatacaatcattacttctatctgactccaaaacattttcatcaccccaaaagaaaaccccatactcattagcatccattctgccttcctcctagtccttggcaaggactaatctactttctaagaatttgtctattctggacatttaatagaaatggcatcatataatgcatggccttttgtgtctgccttctttcactgagcataaagtcatcagggctcatccacattgtagcatgcatcaatacttcactcattttatagtcaaataatattccatttatggatagatcacatttactttatggacatcacatttagtttatttagttgatggacatttgggttgattccactttttggctattatgaataacactgctataaacattgtgaacagtttttgtgtagacatatgttttcagatctcttggttacatacctaagagtagaattattaggtcatacgataattctatgcttagcattttaaggaattgccagactgtttcctaaagtggttgtaccattttataatttaaccagtattgtgagaaagatccaatttttccacatcctcaccaacgcataatgtcagtctttttaatttcagcaatcctagaggttgtaaagttgtacctcactgtagttttgatgagcatttccctaatgactaatgatgttgagaattttttcctgtgctcatgggccatttgtataccttctctggagaaatgtttgaccatttgtaaactgttttgtttttttattgctgagttgtaagatttctttatatattctggatgcaagtcccttatcagatatataattctcaaatattttgaagttcgatttagttcactttattattttttgtgataaatatttggtgctgtaagatggcttggactaacataaagtctcaaagatttactcctatgttttaagacttttatagctttgactcttacatttagatacatgatcaattgttgagttcatttttgcgtatggtataagaaaggaaggagtccaatttcattcttttgcatggggatattcagttatcccagcaacatttgttgaaaagattattctttcctcagtgaattgtcttgacaccactgacaaaaccaatttaccataaatgtaagggttgattcctggattcttacttctattccatggatttgtctatgtataattatctcagtaccacaatgtcttaattttatagctttaggatcagtttttaaattggaaaacattattcctcccaatttattctcccccctcagattgttctcacataaaattaagaatcatctcatcaatttctttctttttttttttttgagatggagtctcactctgtggcccaggctgcagtgcagtggcgtgatcttggctcactgcaacctccgtctcccgggttcaagtgattctcctgcctcggtctcctgagtacctgggattacagacgtgcaacaccatgcctggctaatttttgtattttagtagagacaaggtttcaccatgttggccaggctggtttcgtactcctgacctcaggtgatccacccgcctcggcctcccaaagtgctgggattacaggcgtgtgccgccgtggccagccatcatcgatttctgtaaaagaaaatgcagctgaaatttggatgaaaaccaaattgtagactgctgccatcttaccaacattatgtctttcaaaccatgaatataggacatctttccgtttaattaaaaaaatttttttaaccatgttttgtagttttcaacgttcaagccttacatatcttttgttaaatatgttcataggtattttcttctttttcatgctattgtaaatgaaatcgttttcttaaattaatttttagattgtccactgttagtatacagaaatgcaatgaatgtttgtttattcatcttgtgtcctgtaaccttgttaaactcatttattagctctaatactttttgggaggcgccctttagatttcctatatacaagatcatgtcaactgcaaatagagatagctttacttcttcctttctaatctacatttctttttcttaattgcctcggctagaatgttgagtgaaagtcctgtatggacatcttgtcttgctactgatcttagggttaggtgctcagtcttctaccattaagtatgttagacatgagtttttcatagatgcattttatctgaggatactgccacctattcctagtgtactgagtgttttcattacaaaaggatgttggattttgtcaaatgccttttctgtgtctatcaagataaacgtggttttctctattaatgtggtgtattacattgatttccacatgtcaaatcagcctcgtttctggggtaagtcccccttctcatggtaggtaatcctttttatatgttgctggactcagtttgcttgtaatttgttgaaggcttttgagtctccacccataagggatactggcatgtagttttcttgtgaggtctttgtctggttttggttattaggataatgctggtatcaaagaataagttagcaagagttctgggcttctcattaaccttgggcttcatggcaccatgtttacactaagatccattccttactatgtcaactgttcccatttgctgatatttgtaacctcagttctgcttttagtccactttggcagagctgctctttattatatttttatgctatcagccctgctcttacctagaacttttcatatcactaaagtttcacggccatgatgtccactgaatacacagacctggcccatccctatttacctgtgaagaaagatcaaacaagaactttgcaagttttaaagtatcatgtgttatttactttcccagattcactcttctgcattattggccacacactgtctaaagttctcaggatctgagcatattgctaggtatttctgttcaaatctcaaagtgaactgtactgtttacaatactctcagtgtatactgtaaaatactgcatggtataataatggcttctatagcaccaaacataagcttagaagattgtcagaaaaagtacttgacagcaggcagggtaggtactgttactggcaatcttacagctgagaaataggtgaggaaagcatagcctggagtggttaattgctaaggaatgataaatctgagagctcttgtctctactcctcttcctacatttcatctttccaaaatcttaaaaatgtcaagatgataatgttaaacctcctgtaccatatttattgatgattaaatattatatgcactgttggttttttaacatggctttttcctgctgagaaaatcagtaacatgagagtagtagattagtagcagtcagctgtgtaggtatttttcatcttaacagtagtgactcaataaaatacaataacaattattttctgtaagttcaccatagggaagcaagtgaacacgcaaaggcatccttagcaacttgataatctagtaaagtgtagaacgtggacagctctccacctcaaatgaatgaaaaatgactcaaatttttgctcaaatctacgacatgtggaagtgtaaagcctccttcccagccccctccaggatgtatgtacatttctgggactttagttctcagaacgaccttggcctctagcatcaagttagcaccttcttcaagagcaccttcttcaaaaactacataaacccatctgagggtctagtaagccctctctccaaagacagatgccgagggactcctggagcttcactatctttgcccggtgctccttctgtctgtaaaatgctcttgactgcctctgtgctgctcactggtctcacccagcctcaggctctttgcatcttgctggggagctctcagctctcttctctgatttcttactccacccccatctcaactgtacgcaaaagaagaacaacagcttcattcctttggcaaaagtataacagctttgccctccaaaaaccttggtggcaggttatatccaggtccctggctaggaagtacgggcagggctcagctcatagtttacctccaagcctttcagagggcacgttttccacaccaagaattttgttctggaggaatctggtgccagctactaagatgacaaaaactccccccaacttattatatatgtaaataataattatatcaggcaaaaaatgatatgtgataaagagaggtgtaatgaagtgttatgggagtcaagggagggggtgtctgattctgtttggaaagtcagggcaagcttaatagaggacaccaacaaataagtcttgaagaatactggtatgtggatgtgtcggtggtaaagagaaggcggaagagagaatttataattatggagataaaatagctcacagttaatcttaataccaaattgtctaacaaacagggttcctaatgggtgggtgggcagaagaggatgatatagggcagacaggatgaccagggccacgtatgacagactgaatgtttccttacaagaagttcaatgtgtaggtcctggaagtgccatgattttgttttgttctgtttcgtttttttagttttagaaggaaaattctggcttatgacagtaagcttccacggtgagaaggtgattaaagtcaaggcctttatcaatcactgagctatctattgccatcactcaagtaagtggagtctacctgaaccaaagtagtgtctttaaatatgaatcagaggggaccaattccaaggaatttcagaagtagaacagtcagttcttggtaactgattggataaccggggataagggcgagagaggagcgaatggtgtccccagcagctgagcatggatggccaggataacatcattagccaacttggagtccacaggaaaagtgccaagataaaagctaatgattaaaattaatctatatgtaaacaatacatttatgtttaaatgacaaccgagtagcactttcatttgctagacaagtaataattaaaaaaatagtagaaactaggtaataaggaagtatttccagaaataacttaaatggattttataaaagaaagctcataaaataaacttaatggtaatggaatttcattaaatgttgtccaatgtgtaattctaaaggccgggtccatggtagaggaaattagacaaaaaaaaaaaaaaaaagcatagtttttgtttattcagtcatttaacattcattaaattcttttagggatattactaagtttatagttggcagtttacatacttgatgacctaggtgattgcttttctgattgtttttaattataggagtttgtttttcaggacctcaaagagatgcacttaagtggagggaaggacaaatggatgaaagaaacaagttctaaagcacaaactgtggccttaggcagcctgctgagtgttttacatatgagaatagcttgaaagagtgaagggactgaaagatgtgagttcaggactatcagaggaagaatcttaccaatgcatttttagctatgtcttagagaaatttaacacctttcctaagctttggtttcttttcctataaaacaatagcatctatactttgtggggttataaaaagaattagggttatgaaaataaaatactttgcgtaaggaggtaaatatttgggaaatgactgcagtaactgctgtttcactttgtgttaactgtaattattaaccctatttttttttttttttttgagagggagttttgctcttgttgcccaggttggagtgcagtggcgtgatctcgactcactgcaacctccacctcccgggttcaagtgattctcctgtcttagcttcctgagtagcaaggattacaggcacccaccaccacacctggctaatttttttttttgtatttttagtagagacggggtttcaccacgttggccatgctggtcgcaaactcctgacctcaggtgatccatccacctcggccccccaaagtgctgggattacaggcatgagccacagtgcctggctgtttaaccccattttacagatgagagagaaatctggggttcagtcatgttaagtaactcacccaagaacacagataataagcagtaagagctgccttatgggtacttgttattccaagcacctgaaacagtggctggcagaggagttgctcaatagatagttgcctaatattaaggaaaaacatctcacatcacacatctgcatacccccttccctcttgacctctcaatgttggaggttccctgagctcagtcctccagccgtttctcctttctgtttcaactcttccttgagtgatcttgctcattcccatgtttcgcatggtgtgtttcatatacctttttgtatgtcactcaaatctatttcaaactctcccttccctgagctccagactcgtatatcttttaggccttccacttgtgtgtcaagcagataactctaacttaacatgcccaaagctgaactagtgatgcttttccccaaacccactcctttcccagttttccctgtctcaggaaataaccacttctctcctggcagtccagaacaaaaacaggggtccctcatgattattctcttctatagcttatacaggacctacaggctcaacctctaaaacgtatctcaaatttgaatacttccatcttcactgccatactcatctcttatctggctacctgctataggatctaactggaatccctgctcccacacccttactccttccccccagtcttttatttgtaattgtaatgaaatatacatagcatgaaatttacccctttaactgtttttaagtgtacaattcagtggcaccaagtacagtcacactattgtgtaaccatcaccaatatttacatgtagagcttcttcatcatcctaacagaaactctgtttccactatatattaactccctgacccctcccttcctttagccctggtaacctctactatattttttgtctctatgaatttgcctactttaggtgcctcatataagtagaatcatacaatattcgtctttttatgtctgtctgtcttatttcacttagcataaagttttcaagattcatccacattgtagcatgtatcagaatttcattgctttctaatgctgacacacacacacgcacgatcatatacacacatgcacactcacacacacactttatccttattcatggatgacagatgggcatctaggttgtctctaccttttggctattgtgaataacgctgttatgaccagtatctgtttgggtccctgcttccaatttttttatacccagaaatggaattgctggattacttgcaattgtatgtttaactttttaaggaatcaccaaactgctgtgcatggctgctgcacccttttacattcccacaagcaaagcacaagggttccaatttttctataccctcactaacacctgttagtttcctctttattaatagccatcctaacagctgtgaagtggtcgctcacagtcttctcaataaaacatatgatgtcctttcaaaaccccagtggtctcctatttcacttagaacaaagcttaaagtctttatcatcacctataaggcgctctaggaaccctgagatctcttcattctgttgagcgtcctctgctccgccacagtggcctcctaactgttctggaacatgtcaaatccatttcaactcagtgccttcactcttgctattcttctgcttagaatagtttctcaccattatcacatggctttggcctaattcatgtctctgaccaaatgtcacttcttcagacatgttcacatctttagatgtcacatctgaagatgttcttcagagaggacattcctagcacccaatctagatagcctctcctgacccctgcaccacagcttctcactgtctattgcttgctttgcttcatataccttatcattcttaacattatatggtatatttatttgttcataatccatctctctcagcagaatgtaagttttatgtggctgggggactttttattcatttttgtgtcccaaatacctaaaacagtgccaagcaaatttaagtactaattattaaaggcaggcaaggttatctgttgatagaggcttaatagtttgagatttttatggtaaagaatcttaacctacttatttttataactttcataatagatggcaaaagattctttgatatctgaaaatatttttaaaatgtcttttcttccttttttgggggggtgggggaaacatgattttgctattatctattggtcagttaaggaaagaaacatccactgatattctgaataatagcaataatatcattaagcatttacttgtgccctgcactgtgctatgaagttaatatacattatgtctgattttcacaaaattatatcgagtgttttcattttgcagataagaaaactaaggctcacgaaaggtacactgcccgagatgacatagcaagtaagtggcaggtcaggaattccaatcaggcactgtctgactccaaaggttattgcttattccacacaccattctgcaagaggtaatactcaacagtttggaggccacagagaattatatcccacaatctctcccttaaggaccatgctggctgggcatagtgacttacacctgtaatctcagcattttgggaggccaaggcgggaggatcacttgagcctagtagttcaagaccagcctgggcaacatagcaagttctcacctctactattaaaaaaaaaaaaaaaaaaaaaagccagctattgtgacacatgcctgtggtcccagtaacttgggaggctgaagcaggaaggtcgtttgagcccagggagtttgaggctgcagtgagctatgattgtgccactgcactccagtctgggtgacagggcaagaccctgtctcaaaagaaagggaacatgctgtttagttagtagtatgacaaagcatttatctacatgtaatttaaaagatatcattcaatacaatggacaacaaaagtcggtgcctccattatgttcatggtaattagagggatttcgaggaagatgtcgccccctaggggctctggtggtcaggaagtcatcctggagggagtgggacttgagccaggtcgtgtcaagtgggaatgggctgagcgaggcacacaggaagtgaagagggtcactccagctgtgggaaccacctgagcattggcctaaaaacaaaaaggagtgagcagcatttggtcaaaaaagggtaaagtgatctacttggaattcacagcttacttctggaggagttgaggaaaaggaagaatggtagctcatcttcatcaagcacttagtaaatgatatcaagcactgtctatttgctatgtaagtattatgtatttaatctgcagaacaactctatgagattgatactactgagttacccacgtcacataaaaactgagtctaagggagagtcaagggtgcacagtgagagataaggatgcataggccaactgggtcaagattttgaatgctgcgaccaagtacttgtctttgccctgtatgcactgattttctttctttctttttctttttttttttacctgcttcaagttttaccatgttttaataataaccagttgtactacccaggtatgacattaaaattctaccagctcctctctcacctatgctatcctgagtaacatggatctaagtatgcttgcatcaagatgaatctcctagtctccactcattctagactgtcactcctaaaccctactaactgaaattccttagtttatgcctctaactcacctcttggttcctccattcaaggacttatctcccagccatcaaaatccacataatgtaattcatttgtagagaaaatgactgtggagtttgagaactgtttcatagatgaatgacattaattaaggatatcatctctagaaagcctggagtttctgtaaattataaactattcatctcaattcagacagttaattatcaacataataaatatttgattcttccagctacctatataaactatagtattttaaaactgtctgactccaagagtcagtaaaataatccctatactagaaaagtcaccattttatactttctcccccattacttctcataatttccatacaattacctagtatcaggtgatatgtgtctgcatattaaagatcatattgtcaagcaggaactttaatgtatcaccaagcatttgctgtgcttatgtaacaggtaatgcgcaaatgcactcatgatgcatatttcggcttccaaataacaacccagagtttggttgtcagatgggttgcttccatgcagggttaatggggtatgttgtggtcaagtgttcaaacatgtttaacatcatcagtgcaagttcaggtttattcaaagggcaggtaaggtagaaaaatggagtattgatgctcactctgaaagagaatgaccaaaacaaaacccaggggaaaattacatactaataaatatactccaacatatattatggtttctagtttttattcaaaaaatttagagccataaatgaaatattttcttaatttgcagctctcttcattatataccaacttcaaaaatacactgtggttctgatgaaaaagagtacgtaccagtggatttctgagatttctctccctactttccaatctgtgcaatttatttttttcttctttcttcttactagattacctgagggcaacttctgaagccttgattcaaaaagctaatgtgctcagaagcctaacaagtcactatggagcttaatgtattaaatgtgttattggcaatgcaggggaattctattaattttatattttatatcctgccctttcttcagctacaactgtagcctttctttgagtcacaaattaaaaagaattttatctggaatcagatttatttattcttcaaatttacttcactagttactaagaggccttttctcaacattcttcaagggtccttacaaatgagtgtcaacaatgggaaagtgttattttcgtgtaaccctggataagtcatttagcagccctggattccagtctcttcatctgtaaaataagacagtggaactaaatactctttcctgccctttcaggtcctatgatgctgtgattctagtatactaaaatgttttagacaaacactgaagttagatttatcataaaatacctgtgaatcaggtacgaagttcatactaattagaatttaactttccttgattactgggcaattaaaatatactttaatatagaacagcaaggctctgacattttctaatcccatgcatgaatattatggatatgtggaaatatacgaaactgtctcatttaggtatatctaaaagctgattttcacagcaagaagattagctaaagagtatgtacactatcaataagaactaattaagcattttctttagaaaaaaattctctcagagcctttctgaagaagacaagattggccaattgcactttggcactaatacgtgactgtaaaccaacaacatcaaaatatgtgaagattacattctggcagatgtgagaaacagcttaataattaaaatcaacatagtttaacttccttaaatacacttcattcaacaaacacacacacacacacacacacacatacgtgtgtatatatatatatacacacacatatatgtatgtgtacatatatatatatatatatatatatatatatatacacacacacacatatatatacacacacacatttttttgagacagagtcttgctctgtcacccaggctagagtgcagtggcctgatctcagctcactgcaacctccacctccagggttcaagcgattctcctgcctcagcctcccaagtagctgggattacaggtgcccaccaccacgcctggctaattttttttttttttgtatttttagtagagagggtttcataaagttgatcaggctggtctcgaactcctgacctcaggtgatccacccgcctcagcctcccaaagtgtttggattacaggcataagccaccatacccggcccatcacatatttttaagttcttattctactgtttttccatgtattttgtgaaaaatcgacaagtagtaaaagacactgtctctgatctttcgaatctcaaatctgggtaagtaaatatgtattatgtttggggaaaaacaacaacaaaagtcaggcaaaacccaaatatgagtgactatggagaaattcagatagaatctatgcatgctgagggatgtaacatgaatggtaagattaccctaaaaaggctgtgtaggtgaaatgttataaagaacaaagaccatgataaacatagccacagtgattttcatacaacttccactgatgactgttacttctgaagtgtggactgccggccatctgttgaggtttacagttaaatgcctggtattgcagtcagattaccaggccccacccatctaactgtgccactatggacaagtaacttagggcctcaatgcctcagtttcctttctataaaacggaataaataacgtacttggctgggcgtagtggctcatgcctgtatttccagcactttggaaggccgaggtgggtggatcacttgaagtcagcagtttaagaacagcctggacaacatgatgaaaccctgtctctactaaaaatacaaaaattagccagatgtgttggtgcatgcctgtaatcccactactcgggaggctgaggcaggagaattgcttgaacccacgaggtggaggctacagtgagccgagactgtgccactacactccagactgggtgacagagtgagactctgtctcaaattaataataataataataataataataataataataataaatgtacttgtcttaaagggtgtggaaaggattaaatgagttaacatgcaaagcatctgaagcagtgcctggtaaataccttaacaaatgttttcttaataaatgatttctcactgttccccaattctgggctgggaatatattaaggtattgttgtttacctcaagggaaattgcaaaagggctcaattcagtttttaaaaaatgtatgtcatatagctcatgtaagatgtagaagtgaaggcataaaatcaataaaaaaattaatgagtattatatctccataaaggttgggagtcattgctctggggcagaggctggagaaatgagcatgcccatgtatgtcctttattccactgctgttatctgacattctctagagactctatgcagcactagagtctcctttttttttccttctaattctagggtaagttcacaattgttggccattaatagcttctgaatcgttcttgcatttacatagacatgatgataaataatcagagaaaacattaagctagctttgccaatgataaaaacatttgtaaatttatctgggtttagcacattcttggataattttatcttttaaacaaattgtgtaatttccaattccaaatcacagtttttccttttagcacaaacatattaccttctgaggtgtgttaattaagtgtaacaagaagccttcctagaaagccatgagaaggaactggaccactgtagacagttgtggggtgctatggtctgatgtttatgtcctcccaaaatttcatacattgaaactgtctcatttaggtatgtctgaaagctggttttttaaattttcacagcaagaacacaagttaaaaaataaagtgaaggtattaggaggtgaagcctctgggagatgattaggtcataggggtggagccctcatgagtattagtgcccttataaaagaggctccagagagctgccttgctccttctaccatgtgaagacacagtaggagggtgaggtccatgaaccagaaaagcaggcccttaccagacactgaatctttaggtaccctgatcttggactttgcagcctccagaaccacgacaaataaatttctgttatatgtaagccactcagtctatggcattttgttacagtagttgaaaaagactaagacacagggtaaacctgcttaagcattatcacagaagatgatttaggaataggcatgtcatggatcctttagtttatttttatttttaaatagagatggggtctcactatgttgacaggctggtcttgaacccctagcctcaaatgatccttccatcttggcctctcgaggtgctggggttacagttgtgagccactgcacctggcctagtttttaaaaatgagttcaattcttgatttattttttcaaagcaactatttagactttctttgccaaatgttcttttatctcaagaagcaggaatcagggaaagcattcttccgacaccctctaggagtcctgcggggaaagcattttgtgctctaacatatgtctcagttttggagcctctgtagcatgtcagtgtgtgggcagacttgggaaagtgcagcaagaacagcagagcagtctgctctggcagacagtatcacttacagatgcaaagcccgcccagtgctaacgcagtttacacaccctgaagacagtcctaaaaattccaggagcaaaagcaaaacagaagacacaaaatgagacacagtctcaaagtgctaacggcattttcacataatactttaagtttataataatgactttcatttctataacatcgttctgctgaagagttaaatatcctctaaagacgttttattcatttttaaagttacaattcatcctgacaatgttcccatggaacagaaggaaatttgactgcatcttataggagagaaaacccaaaacccaattagatgaaacacgtcgatgtgatgaggaagcacgactggaaagctcacataagctctgccgtggcaacccacgatgccgcccccatacaagggagcctgccagggttgttccctgaccccgggagagctacaccaacaatgctgtgaagacctacaaaagctttaggttggtaaggtattgctgtggtttcaaaggcttagatgctggtttccttgctaggtaagaaaccttgctttcagatttacaaagaattatggcaaagatttctactgcaatctgccagatcccaactatttttacagttcttaggccaataacacattctctctgaattctataacagtgtttttgaaaccacataccatggaaccttcagagcttcagggtcactcatttgaattatttcaatttcaagtatgttaaggctaatctaagaggattacaaccctcatctctgacttcccatcatgtttatcaatagctcctttggagctattgtttttggaggttgactttacactaacaagttactgctcttatcttttaaaatattctatctacagttaagtttaaaaaaatgttgttttcaaaaaatctccagaaaattgtgagactggttgctcatttatcatttcacaaatatttattgagcacttatgtgcagagtgtagcactaagctcgggggatgcagtcatgagtaaggtggggactatctctactgtcatctgctatgcatacaacaaagatcaccaactgacaagagacttcactttcctgcagtcactcacgttgaccttttacaagaggctgaaaaagcctacggatatggtgagttttaagcccaacctgctgaggagtctcttgttttatggttgttgagcagagtcaacaaagtcaatttaataaaatgcagagtatttagagatataagcaaagggaaaaaaaataaaagcaaagggcagcgcttatttacattttagattcttgtattagatttggagaagattcttgaatatttaaggtgtcctgtagaacatacacttttttttacttaggaaagcagaaaattgtaagaactgaaccaagtctctgaaattacttcctagttttacttcagtcaaacctgagctcaaaatatagagtgtatataaatttcagtctatagctagaggattacaaatagtaattttcctttcattgaactttttggtattcaaatcttaatagttaacaatatttaacagttatagagcaatttaatgttggctagatactacgctaaatactttacatgcgtcattttatttaattcttccaacatctaagatgatggcattatcattcccattttacattccccttccgccctggcccctcccaaatctcatgtccttctcacatttcaaatgtatcattttatttaattcttctaacatctaaggtggtggcattatcatccccattttacagatgagtaaaatagagtttaggcagattaagtagattaagtttgaccttctctttaagatagaggtcacacagtagaaatgttactacatcaaccgcacagtgctgagaagatgaaatggtgggacatatacttttcaaatgagagctcaggtttacaacttgctccttcttttaagaaaatattacagccacaagagaaaataataaactatcccatgaaggacttgatatggctcagcctcccactgctcaaaggaaaggctgttcttcagttctttaatgtcaacctctcattaagtcaggaagagccataggtttgtgttctcttcgggattaaaaaaaaaaaagggagcctttagtctcatccctttcgtagtcttttctcttacataagaaaatcctgtttctgttagttcctccacttaaagcaagagttgccgcaaaggcagctgaaagcagcatgtaacatatcagatggactgaggacatcatgtttatttaacggtagatcctctttcctcagctctgggctgcactctatttccaaacttaggcttggcatatgagaaaactgggagtgaggagttaggcatattcatctatgaataacataatcattacatgtgctaggtggtggtgttattactcacttttacagaatattgacagaggggtttaacattacttctctcaggatcaactcttcttgtatagagagtctaaaattctgctgtctgatcagtgctatcttatataaaataactattgatctgagatcctgaaagcaccgtagaatatggctttgccttaagacttactatacaattacataacaagttgaatgtactagaaattaaggcagggttgggggagtactagaaaaaaacgttctcccattcattaaagttacaaggaaacttctttcaaaatggctcctagaaaacctctgaaaagatatagcatgcatattacattatatgtgtgggtttatgtgtatttatgtagagttggaaaaagctgatccaagaagtagattttaactccgctttggtatcagcatgcttcagaactatttcagaataatcaccttatttttaaaagttctgctcatcagtgagaagaaccaaagttgtggtttctaagaaagttacgcttccaggaaagagagaaaaataaaatgactaagaagtacatggagggctcttatcatttactaattccttgaggcaggattctatttcaagcagtccaggtagaagaaactaatgtatacctttaaaaaagttttgagaagtacttgcaagaactttagtgacctctcctatttatttggaaactcttcttatgtaagaaaagttctacatctacaaatatttttccatacctcaaacagacccaaatgccaagacctatggcatctttgaactaaagttaaataccgctgttaagtctgctttcaaattctccatctacaaataagaattcaagtctgactttgggtagcatggattggattaggagattcactgctaaatttggaatgtgaagatctagatgtgccagggctgttgcaaagtggctttgttccataggacaaataactgaatttctattttggaacttcaatttcatcactgacaaaatggggtcaatactacctattgtgaatgtcgcaagggttggttgtgaatttctcatgagggcatggatgaaagggcgttttgaaagggtgagtgtaggtctcctgcaggaggggtcttttcaagataggcctttataaaccctttaggcacgctggtggtaggagcaaaaagcaggtgactggggcctgtgtgatggacatcctggagcctgggtcagctacccagggggtggtctagtaatggggggttgtggggggtggcagcaacagcaaatgaagccagaaaaagcaacacaggaggaactgctatagagccccagggcttcaggagcaggtaggtagacactgaggagcaacgcagggaaggaaagcctgctgcctaggatgagcatgacaaaacgatgctcagcacttgccaaacctgcatcaggacatgaaaaaataaaactgcaaggtgacgtatgcatgtctacgcataggtgagcatacgcatgtctctacattattagggttcattaatttctgatggtggctagttgagtttacctttgatgaaggctagtgtgtcagaaaagaactcaacattcatgcatcctggtgttaaattctgaggccatggttgcactttctagttctacagagccttctagtgttagccagctgcactctttagaccaaggcctgctaatgtaatcagtcacttttatgagtacctaaaattatagctgctaggtacccattaaaataacttatttattcatttattgtttataagaatttgtggttaatgcatccgtattcattgtttaagccgtggttcattaccacacataactgcaggatggggttctgttttgcacatgtgctctttgaccacctggggacataagagaacacatattacaaatgcacatacatttaaagcatatgttttaggtaggaaagaggggacgctactcttatccaattgcaactaaaatcatgacgttgtgaaagagctcactatgaatggagttgtgtcagtagctcagaagtaggctctggttttcctcctccagtgtattaaatcatttgacatttaggtcacctaggatgaggactgaagggcatgctctaaccagtacaattgtaaccatacatatttataaatattaaaggtaattattatccttaaaatatatctaacaaatgtcaacccagattgtgacaaggactgaatttatattttgtaaaagtatcacatgtgataattactgtttttcacacaccaggtcaaaatactaagtgtaaaaagaaaaagaaaatgctcctttgttaacacttgtcattgttctgcacgtatgtaatttctagaatcagaggcctccaaatctattaataatcacaaatttgcaaaagctatgcattatttcagataacaccaagcaaaaatagcaccaagattctaatttcacttaatgatattttcaagatacccaccagtttgaaagcatgcaagtcaagggtataccactaaataactgaatcagtaactgtggaaaaagttaaatgacgtatcatttttacatttcaaggatcgtaatgtcctgcaaaatacgtagtacacaccatctgcatcgggcaaaacgctgtcagatgctttcaaaataggtctctggacccagagagaaatcagcattctaatgacatttcacaacggtgtggcacctggctggtaaagatctacaaaggaaaccaccaaaaaaaaaaaaaaactgtgcattgccacagttagaagtgtgtatatgtacatgtgggcaaacaatgcagggactatattaattcaattatattttggtttcttcatgtgataaaacacactaagagaagtattaaagaggtaaagcaatagatatcgatgtatttaaaacttacaaatgaaatgaaacaaatatgaattttattatctcaaacaaggctaactcccagggccaacatatgatgtaatatctaaatatgttaaattggtgaggaatagaaagaccaacctgtgacaaagaggcaatgctgtctttataaaagtctgttaacacacagccgcaacataactttactaactcattcaccatagcttgaattctcttccaaagacagagctcctttagatacctttatattctttatatatttatatttacatatgccgttatattctcctttagatacctttatattcttccaaagacagagctccttttagatacctttatattaattctgagcattactatactgcctggcacctagtaggtgctcaaaatatgtcagactttcaattagctcattattttaattgagtgaagtttgataagagtcttaaaacattctattttatttaaattttgtgtatctttctaaaaaaattaagagtgatttaattatggagttgaaactagaagaattagcatatttcagtttaaagccatgcccctccctccctccttttttttttttttttttttgagatggagtctcttgctctgtcgcccaggctggagtgcaatggcacaatcttggctcactgcaacctctgcctccctggttcaggtgattctcctgcctcagtctcccaattagctgagattacaggtgtgtaccaccacacctggctaatttttttgtatttttagtagagatgggatttcaccatgttggtcaggctggtctcgaactcctgacctcaagtgatccacctgcctcagcctcctaaagtattgggattacaggtatgagccactactcctggcattttctttctttcttccttcaaatatttactgagtgtctactatgggccagaccttatggtaggtgctggagacttatagtctaagagaggcacacatacttccttacatgcacacaattgagggccatgacaaaaagacatggcagggatccagaggaggaatgaagaacccaggctgccatcagcaaagaggtgagtgttttagctacggagaaggctgttatcaagggagaatatgcaaaaggaaatgaaactttgaagaacatgaacatttaaagggtaggtaaaggaaaaggactgaatgagaaggacgcagtagatatgtcaaggttagcttagttatatcatattggggaattgagttaacctagctctcaaattgtattatctattaaagggtcaaagtacattttagctagtagattacataattaatgttagctatgtattagtcatggctgtacataaatgagtcttgcatccccttgtaataatagtcaacacttatttattgcgtttggtaaatactgtcctttgagctttatatgtaatatagtgcatttaatcctcatgataaccatgaaacaggtattattagcaagccccattttacagattaggaaccagagactcagagatataaaataacttgctcgaagttacagagttaatatatagtaactgaaatatgaaaataggcagtctgatttattgatccctactctattctttctcttttcattttaaagattaaaataaaactgtttttcaagacatgtcacagaatgggtctgagaaataaataaaatggtatctatgaactgtgtgaaaactgtgaaaagcttaagaatgtaaaatatcattgaaaggtggttctaacaaagtacaatgtccatttctggtgaaaactgacttcattgtttccactggagggaagtgttgaaaacgatgaatttgtggagaatcactttggagactcgcctctatcaccagaggatgaattatttaccaccaatataaccaggcacacctgggagcaaattactgattccagggcccatttgtaatcccatatcagattcctttgtcacacagaagacaaagtcggactgaagtgatgtttaagttttaagggagctgatatcagaagttggtattttaataaaaataatattatatatgatccttgtctgtccagacctttaatctgaattaacagttatggactgaatgtctgtgtcccccaaaattcacacgttgaagccataatcctcaatgcaatggtatctggagatggggcctttggggattatttagatcaggtcatgagggtggtggggcccttaggatgggattagtgtacttttataagaagaggaagaaagatcaaagttctcttctctctccactttttgaggacatagagaaaaggtgcactctgctagccagcaagaaagccttccccgggaactgaatcaccagatggcttgctgttggacttcccagcctccagaactgtgagaaatagtcctgtggttttagccacacaatctatggtatttttttaatggcaggccaagttatgccaaatacatttaaattttaatatgtggagctctgggagatatatttttgttgtatattaccacagaggaaatgatagtgaagagtttgatgatttgcttaacgccaaaagccaacagcaggtagaatttgaatctgcatcctttgattccaaagctgtgctctttccattgagttgtttggactcctgttctttatatttattcaccccatgtcagttttaaaggccttggaaaagttactagagaataaaagcctatacattcagtacttcagaggccacatctccctctgtggccaattaacactcgatttactttgatggtcatttcctatagagtacctatgttcagttttttatcattagaaggcccttttcagtgtgtgttctaagaccacgggccctcagcttgctacaatcctaggggaggcccagcttctcagccctcagaaagataaatggtttacctctttataccaacatggattgacactttgcacaatgccacttaaaattcagtacctgctgattcagctaagagattaaaaagaaaaaaagatatttattctttgttcatatgaaaatgtcgtatgcattaatcccattaaacaacagagcctgcatttaaatctcattctaaatcctatttccagagttttaatgtttgaaggtgtttgtgtcttcaaaggtgtgacaattaaaactaaaagactgatcttcaaattcattaacatacacaagagacaaaaagccaacaaattagcacagccaaaggaaaaagatttttaaaaaaatagccacacaaagcccatccagggggtgatgcttttttattggactaattgcaaggaaatataaaagggtaagcttttactaatcaagctcttttcactcagccatgaagaactgctaggcagagcaagcaaagagacagggtgttaatgtaagcctgataattaaattcaggatcaagtggatcagagggaaggccaaaaacgtaaaaatcaggtggaggtaagaattagaatcccaatcttttataatactatatggattgtcgaaagaagaagagaaaggaaacttatgaaagttggttttttctttctaaagcatgaataaaagtggttatatttaaaagaaaagtgaacagtgacaatactgcagaggtattttgtagcatcctgccttctgtgacataaagctctttcctacatactcatctccatttattttcacataatccctgtggaaagaaacaggcaagatcaggcataagggactcaatcttgccccagatcacataattagagagtgacagaacaggtctaaaatcttagcttctgaaattcaggtcagtagtcaccattattcttcaaacattttgtcaggcataacaacgataaacagagaaagggcagaaatgatgtaaccaatgtttaaagatgtctgtaatgtgaaaatatgtcttgctatcctctgaatttgagtatttctacttttctgaaaatattgactaaggaatgggaaacagccatcaaaatgtggaaagggaaccaccaaagtcaggcggcagaagttctaagttctaatcctagctcctgtgcaaatttggacaaaatcattcaaactccgggcttcagttttcctaccaatagatgaggatagtggaagagatgtcttcatttcactgatcaatatgccttgaacctgctgccacatgtgctgtgcttggagccaggcaaggacagccttcatactggagggcctcaggcttgaggagaaggtggaaagaacattacacacgggccaacaaatacagtaaatcatgataaaagtgatgctatgctccatatggtggcattggatcagagaggaagaagaggctgatgggtggggggactgcagggaagtcttcacagaaaagcatttttcaatttaattttaagttctggggtacatgtgcaggacatgcaggtttgttacataggtaaatgtgtaccatggtgattagctgcacctatcaacccatcacctaggtattacgcccagaatgcattagctatttttttcctgatgcagaagaacatttttaaactgagtttttgagaattagtttccttggtgatcaagctgttttgggaaatgtaacaagttcagtgtggctgaaatttagggtccacgggaagatggaaacaatttgtgagaagtgagatggaaagagttatgtgatgcaaagggcctcatacgtagtgttaagggctttggacttctaaatcatggcacactaccacagagttgtaaagacaggagcaatcccatttgcattttataataatcactgtaggcatggcaatgattggattcagaggaggagtagaaagaagtgaatctagaattccatggtgtatatgtgatacattttctttatccaatcatccgctgatagacacttaggttgattccatgactttactattgtgaatagtgctgtgataaacaaatgagtgcaggtatctttttgatataatgatttcttttcctttgggtagatacccattaatgagacccctggatcaaatggtagttatatttttagctctttgagaaatgttcgtactgttttccatagaggctgtattaatttacattcccaccaacagtgtataggtgttcctttttctctgcatccttgccaacatctgttgactttttaataatagccattctgactggtgtaagatggaatctaaacagacctgttcggagcttagggtaatgtttcaggcaagagatgatgagggcatgtggggtgaggaagagccaacactgccaagcaatatttaggaggaggaatgctggactcatttgatcaaataaatgtgggttatgacagagttggagttaccatgaggtttctagcttgggtgattttgtagacgaggaatgagaagactgaggttagggaatatgaacagatagaataaatggctcttccaatgctaaagtcttcttgtggaagaaagacatcagggtacttggtgttttgggaaaatgggccctcatatattaagacgtatttattcagttgaagtcagatatctcacagagcagtccggggctggacatctactgggggtaagtggcatcattttacaatgggctgctgacagcatgtgcacgtggggtgaagaaattggctgaaacttacagggtcctttgtaccctgaggacacacacaggcagccttagatacattcatacagcttctgtccagtttacctatggatttattttattttttattttttactttttgagacagagtgtcactctgttgcccaggctggagtgctcactgcaaactctgcctcctgggttcaagtgattctcctgcctcggcctcctaagtagctgggagtgcaggcaaatgccactgcactcagctaatttttgtattttttgtagagatggggttttgtcatgctggccaggctggtcttgaactcctgagctcaagagatccatctgcattggcctcccaaagtgttgggattacaggcatgagccatcatgcccagccacctattaatatttgtggctcatccactgtacatttttacagcctttagttaatggtttgcaggcatttttaccttcggattttcttcatctcaagaactgttctgtcccttaacatcaaatagacacacccacaccacacacatgcaccctgtggtaactatcatttatatgccaatggcacctacctttacatctacggacttgccttctgctctaaattcccaaccacaaccaccagttgctcacactaaaactaggtgtcatccttgattcttctcttcatttccttccataagcaactgctgtttacagttttcagaacgcatcctagttgcatccacttctctccttctgtggataccattctagtcgtggctagcatgtctttctcctcagccacagccttggcttcctcactcattcccctgctcccttccacatatatatttttttttttttgacacagagtcttgctctgtcacccaggtgtggcacgatctcagctcactgtaacctctgcctcccgggttcaagcaattctcctgcctcagcctcctaggtagctgggattacaggtgcccgccaccatcattatgtatttttttgtaaaaaatacaaaaattagtactggctaatttttgtattttttagtagagatggggtttcactgtattgaccaggctggtctcttactcctgaccttgtgatcgacccgccttggcctcccaaagtgctgggattacaggtgtgagccaccatgcccagcctccttccacactcttacagccctttctccaacaagctgccagactaagcctgaaacataagactccaccacttcactctcctgctcaaagtcatccgcggtccccgtcccacccagactgcggactacatgtttctgctcccaccgacctctctgagctgaggttgtttcacgcttcccctcattcacttttcgttccttgaatgtccatgtttgttcccatctgaaggcctttgtgtgagctgtttctagcacctggaataatgtgcccagaccctcacccagatggttccttcctgtcattcagctcccagatgccaagtcacctcctttcaagaggcattttctggccaaaccccttggattgctttctagtcatctccaatcatatcctcattacattttcatcaaggcacttatcactaccagatgctagccagttgtcactcttgctccactacatggtaagaagtgggggccgcatttgtcttattaaatactgtgcccctagagcacagaaagtggctggatcattgcaggcacaataattttactgaagagggaacagatgaatgaacacaaatattctggaaaagtgataatgctaccaagtgtaaaaaaaaaaaaaaagtcaatctctggcaatttcaaaagatgatcaggtttgtaagtgacatagaacttaaatacttaaattaaggattaaaattaaatacaggctaggagaaaataaagaagacaagcaagtaaaggcccacatggaagctaggcagagaaggggctcgactaatgcattctaaggaagcagaagggtgtaagatagacaaggaacactctgattgcgatcctccctttctaaaaggtgttgcttggatcttcttgtatttttttggagcccttttctccttgaaagccatcatcaatagcattcaatcaagcctcccactcaggagaggagagagaggcagacatggaaactcacacacatattctcttcatattttctcacctttctatgccaatatgttttcctttaatgctcctggaggtacccttcacatagaatacgatgtgaatagtgccccctggggttgtgcaatatgggtgtcctgaaaagagagagtagcaagccaaatgtggcagcaccaaatttcttgctacccaggcttctttccatttaaaaaaatgctctgacaattttttaaaatgttagggctacatctaatcaattcctaacactcaaaatgaaaacaggctcaattgcatattgttctggagactggtgctgctacgtttgtttttaggtcttggcataacttaggagagtcccagggtcctttcctctgactggtgtgcccgggacccttgcctctcatcacgcaggcctctcctgctgctggccctctcctgggagaaaggaaaagagcatcagccacacaatttgatgagatctgtagtttagtggtgcttctgagagtatatttgaaaaaagatagccaagactgcggaaaacacattctctattagccatggtaatgatgacttccaaataactgagattatattgtacaggatgaagactttcaataacttaagttattatgaccagtaacaaggctactgctggcaaaaaatgcaaaaacccacccaggtcaccaaaatctcatgaggaatatggagacactactaatggggagtgaagggagatggaataaatctcgtctcacctagaggcagaaactaagtcacttggctgcatttcagtttaggattacattacatcaatgtctactcaagaatttttgagtattcacagcacattctcaaaatttaccaacttttacctctaggtggcagcaactttcctctgttcttcacatggttgcctttagcctttgtctcctacctttaatacaattccatacttccttgtctttcacaaataaatgccttatggactgtgcagtttggggaagattactgtaagtcactttcactgtaagaaatcagtccattcttcagttaagctacaaggttcttcaaagagtacaatataattcagatctaaagcgaaaaataataggtatacccttttctttctccatacctataaactgcaaactctcagaaaagcagcgtttctttttcttttcagacctctgaggaaaaaaggcaatgagtacaggaatggaaaaagagatggaattggagagatttctattttacaaaaatatcaatttaatcctatgatatatccatttatgagggtgttccaaatacattacaggatggaagagaagatttaaagaatcacaaaaacatggtaacatacaagtacatatttatgtaatgtattgaactgcagtcctacctaaatataccctctagctcagaattctcaactgttaggtttaggaaaggctcgagagacctgaaggaaattatagccttgtttacccaatgctgggcatgtcaatgaatgtcctaggtggtagtaagagattccttttacataaagttgaaatttgattgtgggctaatacttagggttgacaaagcactttctctctttttttttttatttcaatgggtttttggagaacaggtagtgtttggctacataaataagttatttggtggtgatttctgagattttggtgcacccatcacctgagcagtgtacactgtaccctcaccacccccccaaccctttcccccaagtccccaaagtccattctatgattcttatgcttttgcgtcctcatagcttagctgccacttatgagtgagaacatacgatgtttggttttccattcctgagttacttcacttagaataatggtctccttttacattcagattgctgcaaatgctattgtttcattcctttttatggctgagcagccttccatactgtatatatacaccacattttctttatccgcttgttgactgatgggcatttgggctggttgcatatttttgcaattgcaaactgtgaagcactttctttcaaggtgatgctatgaagagtcttacctcttggggattctttcaagacctaatttgaatagtctgggtcagatatcatttatttattgatttaagataaatataaatattatttatcttaaagagccataaagactaatttagcataagtgagaaatttataccagaacccagcttgtagatcaaagctttatgcatttcataggcagttcctctgttttctgcctatcgtatatgtgatatcgcaataactacgtatgtttggttttaaaggctgcatttttaaatatgtgatgccaagtagggttttagagaaatgaaggttcaaagtgattaagatcaacactcttaggtttcaaggagaatgctgtctattttgactgaacatccttcatacattttggctactcgataactaagagtaagaccaaggagaaaggacctagtaactaatgatagagtgctttcactttctaaaacgtaaggcattacgaccttatggaaagcgttaaagcttgtcatggaaaagctactacccttacgagagctttcaggtaatttaaaggtagggcaaattgatggttctaatttataaagagtagtctttcccatcattttttggtactaacacttttcctttgggaaactactcccacctcatctcatctttgtaggattgtaaccaagggctgggcacctaacccaggaccaatcatactctagcttcctctattgtgattattgaggaggtgacacagaggaactagagctgacccctcccaggcctgtacctgctgattaaatcttgctccctggaccctgggtgctgtcctggctcctgtgtttcctgaggcccagatcctcttctttacttttgtctccatataacctaccttatgtcctgaaaaatcaccttttgcttaaggcagccatattcagttagtttccattacttccaacaaaagaaccccatctatacagcatacattatttgggtgatggatactctaaaagccctgacttcacctacacaatcctatgcatgtaacaaaattacacttgtatctcataaatttacacaaaaaaagaacttcatctgataaaagggactaaactaaatgaatatttagacagagataacagccacaagtagacagtggatttcagcagggtcctcagccccttagctattagttagctgagggcttatgtaaaacagctgtgacaaaacctgtgtgattctgagttggtttaaatcttttttataaatacgttgcacgctatctattgctctcttaaaactaatttaaagaaatgtattattaggatactggtcttaccttaggcaaatcttgtactatgccaagaaatgtaataaatagctagtttcagggaaattactaagaaactttatgaagatctggtggtcaactgagaaaaattatattgaggtaagaatatgtttgattttaaaattgctagttcactgtccatgtgtatacggagaaatctctgtagctagaaagatgacattgcaaatgtgaccagcagatgaaaaccagaacaaaactgctggcacatggagcattcctgcagggaaccccttaagatttattatcctgagcagtatttccagcaaatgcatgaacacattcagatttttgattgggttccaattttagtcattattctttcaaatgcatatttagaagacagccatggattataattgatagccaattttttcagcccaaatatatccactgaaaaatactatgaaagatgaagaaaggatgtggcttctttctatatatatgaaataaaatccttcttcattttaagttgatatgttaattaaacatggttggtactggttctatcacagatacatatattttttcatattgagacacagtctttttttctgtatcagtcatttatgactccccacattcccttcttcatgtttcattatgacatgaccattgctttgagttttaatttttcttttttttagagacaggggttggtcttgctatgttgcctgggctggtcttgaactcctgggctcaagggatcctcctgcctcagtctctcaagtctctgggattacaggaaccggtctactgcacccagctattttaaagttctacatctggacaactttaaaaggaagaggtttgggatggagaataacccacatcatacaatttaaacccctataagaagcagtagtttaagcagctttgctagagtaaatcatgatttcagactgtgtgaattttaaatttcctctgctgtataaaaccactgtaagaacaaaaatagacaacaatagactacaaaccccagaattacaaagttgtttggaattgttaacaatattgcctgttcatgctgtaattagttagtatgacggagatgttttattacatgatagcaccacacctgggtacagtgttgggaagataccaggaatcaacaaagagtacaatgacatgtcttatgggttcacatgttaggtttccagtacaatattaatatggttctgagccgcaggttgataaactattcctgggtttttaatatgaaaatgtctcagaagtggttacctttatggcctcagcatgatcttacagccttaattctcctataattagggaaataattacagaaaattatctactttaatttttttcccttatatcatctttactgttactaaagaaatactagagacaaaatcagctgataccagcaggaatatagaaactacttttatcatgaatctctcttgctgaaattctgggtgatagagaagttaagaaaattaggccaaagttctttcatacggtcactttggaagacagaacataagtctgaagtgtaagtaactgtccccaagctaaatttgaggaggtaaagtcattaaagaaattaataggtgatactgcattatagccaagaaaagatgagaatttggagggatttaaaatgtaacaccaccctgcaggcacttctttttattgtaattcagcacatatacagagaacttgcaagcaggttaacgatgacatcaactatggcccattttccaaatctcctatcaaactttggagacagcatgcttccaaaccaaacctaaaggtaaccttctgtgacttatttgccaacacgcatggcttaaaaagaccatgaaggctttgcattcttggaactggaatttccacatattaaagtccatgcataatataatttttgctctgtaagtcaagaagcaaggcagtgaaatactctagtaattaaaattaaaaaatcaatattatctataaataatgagcatgcaaggatctgtaagatgatgagtaaacattttggcagggagtaagtgccacatactggtgtgaggagcaacgtcttcattaagcttctcctatttctccttgctctcccatcccatcaatctaatgggaatttcccaggcaaaagccttctgcttagcttgtaatgaattaaacattcacatttctcttgctctctgcacaggtggacaactgccacgtcatggaaagactactggatacgcatgcagaggcctggatgaacaggcacagagaggcttggatttatgcctaggtttggcatgtaacgtttttgtctgggggcctccatttgtaaggtaaggaggttgaactgcgcttgatgatgcttgcatttcctttatagccttgaagttggtaatttggaaatgctctgtccctcctcaaaagactgttctacattagatttctgagagatttccaatatctacaacttcagtgccttcctctgttaaggaaaaaggtttaagcaagaaagaatgttctcatttttatgacaaaactctccaagttatatccctcaaaaagattccatgaagtcatgtctaacatttgcaactgcatgaatataaatatttaagttcactgtagcaccatacatccacactaaaacattgaagtgtgaaaaggctcttcctgccctccacaaaaatttgtgacacagaactttttcacacccaaatgtgaaaaatgattcacacccggaatgcatcataatttgcatagagacctcattaacactggagactttttgtgtatatagctacataaaatcttaggcacattagtaataaataaataataatagagactggtagtggcagcatccaattggttagagaaaactacaaaattacttctattttactaatgacaattcctacatatatagttttttcacagagtcttgctctgttgcccaggctggaatgaggtggcacaatcatacctcactgtagccttgaattcctgggctcaaggctcctgcttcagcctcctgagtagctaggactacaggtgcataccatcacgcctggctaattttaaaaggaaataaaaaatagtgagctggcgtctcactatgttgcccagctggtcttaaactcctgggctcaggcaattcttcagcttcagcctcccaaagtgctgggatcacaggtgtgagccaccacatttggccaatgattactattaataacgctgtatttcctatgttatcatacaaatagcccataaagtttgtattatgtgactcccactaccactgttacacaacagcccttgatactggttttaggtacacagcacaatcactaccgccaccattatcaagcaacgacacatgcccaagtcctttaaaaccttaaaaatggagcaggatagagcaagaagtggagaggaaaaaagaaagtgaaaatctaaagatggagcatacataaatgtgcacgtctttagaatatgaacatggattctggaaatttctggagccttaagtcaactgcaataattggttcacagatatttcccactaaacaccaccctgtcctatgccagcctacacagacacaccaaaatgtagcttaaagatttctgttatatctttaggaataaaacagctgaatatgacctggaaacagctgctctcctgtgggtctgatattaggatataatcatttcaattaaaaagatctgccaagaataaaagtctatcttcacattcaactctctaataagaattttccacatttggctcaaatgcagaaaaatagattttttctggcattactgtatgcaagaaagagtggcaaatattctaaaaatggtttataatgtgaagggtagtagaatatgccacttcaaaatttgccacttcagcctaagaattattatgagctacaggcaatgaaaaaggaggagacacaagaaaaagtctctgctctccttctttctaccaggaagggcaaggcaattcttaatcactggagacaactctcctgtatcaacccagagatggcatcagaggaatctgcacaacacatctcattatcccttatttcccattagtttctcccgcttatttaccttcctacaattgcacgcccttgaagctcaaaatccttttcctctgtctttttcacttctctaaaaaactgtctttttgttgttgttgttgctaagatgctctaaaggtccaagctctaaccacccctctgggttactcatgcccatgtgtgtatgtaaatacacatgttaataaacttctgctcatttttctttgttaatctgtcttttgtcagtttaatttacagggccccagccaataaacctaagatgggtagaaggaaaagaggtttttacttccctaccacagtcactggagaaaggaaggcatgctcacttccatttagggacaagggtgaaggtaaagaggagcggtctgatgaaatagagaatgaaattcacacgaccaaaccccaaaggcttcatcaatcttcaaatcagtaaatgttcctagtgcatggtggtactgaggggacaaactttctgatgaacagagtttatgtctggcctggcttgctacctttaattaattcaatactaaatgagttgtacaatgatctggtatttgttattggggtgctaatatacccgcaagaagttcttattgccattctttaatcccttggagttagcaggcagttatagcaagcctgaatccactccaacatatgtcgttgggcctcttaggccctggcactctcgtttcctccctgggtatgtacaatattaccacactttcaattccagtggattttgtttgccttatacagatattctttttcttcagctccagaggaaatgttcccagatgaacaaggccagcagatgctgcctctcgtaacaatatcatgcaaagaaaaatgctagttaaaagtttaaaccatcttaactcaataataaacactggtttgggaactcaacaacagccataggctttcccaacctactgattttcataccttacctatacataccttaatagtgttaagttggaggcttttcttcttttcctgaactttaattacttatttgatgaacacaattttttaattgattggggtatttgctaagctaccttcacaaaaatcactgttcctaattctcaaatacagtgtttgcgggttgaacccaagccagagccaagctagtgttgaacttgacatgtaatcctacaaattacccagttgatagatgggggacagcaactatcactttcccttcctcttcattgccagcgtgagtctttaaactttctgaattttcagggccaatatttcactaagaaataacaagtgtttatcactttactagaagtacaggctgggtgattcatggggcttcttcctagccaggtgatttatttccatatactagactcacagtatttacctaaggaagattcaaggtagtatatatcatagaaatcttagctagcttatgaccaaataacgtacacgtattaaatccatgtatgctcctactagagtcaatttggaaatatctccaggtctttctatgcgtgcatcaatctataaaggaaacactagctcaactctgcttttcttactaattctaggtctttgctcaaaagctttcttctttgggatggattttctgacagccttgttccttcctttatattccaccccctcccaagtatgaactctcaaattagtcttaaataaagctgctaacttctccttctaaacattatattataaatatatctccttagagctttacccacattgtatattatgtgcttgtgtgatatcgtatatgtgcctgtgtatgtgacatcacacacacatacacatacacatctgccctgcaagacaggtaggcccttgaggatagaaaccatgttttatttatctttctaatctagtgcttcttacagtgcctgggactgtaaataaatgttgctgaataaataaaagttgaattttctcaaggccagtagtaaacatcacttttgttttccatggattacttctctggagatacaagaggtttacacttactaaacaaataacatgctatgaattatgcaggaacatcattacttcaatacttcagagaggaaaagtcaagaaaagaaactctgttatttactccatgttttacatttagccattgagaaccaagttatggaaactggatctcatacctgacaactctgtactctacccattagcttgtggcgtgtgataagtcaagaacagacctgatttgtccctttcctttcacataatgatcatcatattattactcccttagcttttcaggccggacaggggataacatgctttagcaatggtaagagacgaggaaggatgccccggctctgaggcaaggtgtaagcaaacgcctctgtgccccatttccccctctgtgaaaaagaaaagcacaatatttaacaacatcgccaagctattgtgagaattaattagatttcgtgggggaagggaggtgagatgattaggcatgattcaaattcaaagtgtcattattttgtgtctaaaaataatcttgatttaggaataaaattaatttggaagctcaatctttggtgatcatcttcccatacttaaaaaaaggcatagttttaatcaaaatctcattctaactataattcaatgaagtaaaaatggaatttccattcatctttgaagtaatacagccacagttcatttttttctttttagtttttcttttttttccttaataacacattatgtgttaaaaggttaactttgtggaatggagtaatataaacaaatacagatattgagcccactttttttgttgtttcgcatgaaatatttgtgaaacactttaaatcgcttctctaaagaatcgataagctatgttttctggttgaaataacttttcaggttgtttctgcaaaattccatctatatttttgttcaagaactcatcagttaaagaagatcttagtactccccaaattaaaaaaaaaaaaaatcctggatatttaaggctatggcaaggaaaaaaaaaatcactgagttcgttgtaatccccaaaactaatgtaacagattcattaactgtggaaatcttcatgaggagttgaagttggtatctgagaaatatctgggtctatgtaccttcgaaaaaaaggaaaacattctttaaaataggtaagagtttataatcttgggaacttagatcatatctgtcaaaaaaaaaagttacactcagggtttttggtgaatgaagagtttgggctggaaaggaactctatcaatatttatttcgaactgtccagaggaaaggaagaccgcatagtccagttagcaggtatgtactctgtatagagaagtaggactaattctcttaattttaacataagccctattaaagtttcccgtaagacctacaaatactcatattagactgtatactcaccaaggaaacttttgattattcattcgattgccccggacccttgatactggggacggatgtaccctgtagacagagaagaataatccagtcattgaaaaagcatattcccaattgcaaatttaaaaaaatggcatgttttataaataatttcttttagaattgcttaatacaaaatccccagaacttgaacccctcttagtaaatgatgcaattaaattcctacgcctgcaaatctgtggtccttttttccttcttaaccactctcaagacaacaggtctgtcataatgttcactctgaagactcccagaggcaggactgatgcattcattcagtccaacaaaagtgactgaatacctaacccttgccaggtacaagggtgggtaaaagttatctaaggtatggtgcctgagttcagtgagccctctttgtacctgttcccatgagggtgggcacaaagaggtgtctaagtgccctctccttcactctaccacatttaaaactctaggaagcaaacaacgttattcaaatgtgctgtgacagaatctgcaggcacagggaaggaaggaagggtgaacaggtactcctaggaggagtacattctggaagtgatgtgctacactggactttgaagaaagtaaagtcaattcaaaattttagccagataaaggagaagtgaagaatatattgctttccaagcttccaggattggacttatccactggaaacagcttaaagcttccgggaactgctgttatcttctaatcaaagcctagctagtaaacctccgcctctttgtgggtcactaaccggcaaaacaatacgccctacttccggctgccagcttcctgttatggtctgtctttagccaggatttgtgagatccaagcagtcttagcttgtattaccttcaccctttatgcttcatacattgctcttatttacaagaaaaaaaatggggatataaaactggtcttaaagtccagttagaaccaaggtttgtaagaaacccagttctctgtagttgtttaataagtgaaaatcattccaaaacagataatgcagttccagccccgcctaagggccaactgcagtctttccctaaacccagagccagactgcactttgcactcggaaggcttatttcttccaacatcccttattaacattcttttcctcacagcgcttctcaatggctgctgcagctgagctgctcagcacagattttctgctcggcatgggggagggggtgttaattatgcagaaagatggagagaggccagacagcccctctggtgaactgtctcattcaagcacggcccacttcctgctgttttgcagctacaaggatcacctgttggtctcggcgtccagccaaactggggcctagtggaaatgacagactcagctagaaatgaaagccagttcataatccagtatcctaaattggacaaagagggggaaaacgcaataatagtacataaaaattatacgaaaggcagcaagcgtaattttttcctcttttattcttttacttttttactttctgtctgcttgaaatacaatccttaaaatggatatttgagccaaaaaagttctccccagttaaagccccctgacctaagaggaagtgcaggaaattctcctgaactttccctataccctcactggggtatcagaatcctaactatttaaataaagtttaatcagccccaaatactcacagttctttaatttgttctctatcttttacacatttactttttatattgtcccctccttaaccctaggagtacaaagaaactatttcatcatgaaaattccactgggtgaagtttaatgacagaagtattctcttattgatgctgtttattgcatatattagtgaagaaaaagagagtctgtttaatccataattacaacattgtctaggtatttgtatcttttaggaaaatttcactgatccatagatcaaatactgcaaatggagaatttctataatggtttagcagtctcaggaaaagaattccttaggaaagtctttggaaaagaagtcctgattgtgtatatgaacaaataattacaaggtttcctaaattaaaaaggtaaatcaacaaagctttatttctgtcctcaaagggaataagtacactgataacttggcacatacttcatctgataaagtagaccataagccttgcacttcaccaaccccctatatattatttcttcaaaaggatatggcatgtttttttgagctcagtctttaacctgtgacactttttgccatcttctgccttctttccacatatagaagccaggcaggtagcaacgtcaaaacctctgtaggagaaaccaccacctaatctgcatgtcatgcattattcatgacctcctgattcttgcacctgcatctaggcaggaagcttgcagggaatgttcattattcttcccttagcctcacacaggctcgattactgctaagccactttgttctgtaactaaggggttcaggccttagtactaactgctggatgtggaaagaaaaaacaccacgctgaacaaaagggcaatcttggttgttgtgtaacatgtattgaatgtgctcttctgagactgacagtttgtcaggtagaaatgctcacatttggtgatttacattacatagaaaacagggaagctataccattagggccatgtgtaccaactgttctatttatatacacttactcatctggagcagagagcatgtttataattttacccagtgcagagcttaatttagctttcttgctaagcatatgagaactttttagatgacttaatacaaaaacggctctttcttctttgggtataagcaccaaagaacctgactctcaaaaccttgcatcttaatgactgccatttatagttaatcaagagaataccatcactctggttttcaatgttttcataaacctacctgagtggcaccccctggtgactggaggtgggatgcaacatcttgattcccaacacaaatcatcagcactcatgaattgctgggggaaggatactggtcccactttactatctgcaccacagaaaagctgtgataacttaatgcaatcttatcatcccaaatggaattaggatgaagtggttaagagtgaaaattgtgtgaccagcctgcctgactgaatcccagcttcaccgtttaccaacggtgtcatctttgggcaagttatttaacctctctgtgcctcagtttcctcatcagggcaaatggaggtaataatggggcctattacctagggctgcgaggtttaaatcagttaacagctataaaatctttagaatggtgctcagtacttaggaagcagtcaatacatgttagctattgtcactagcagtgctgattagacatgaaaggatgggaagtcagaggatagagctggactatccaggtaattccaggggattaagattacaaatatgctctacagagcctgcagtcttacctactgtgcttatacaactttactaaaggcgagaaaacaaaccaagaaataaacatgggcagaataatacaaaccaaaaactatggcttataaggtatggcttactctcaggcagctcatttttttctgctctttattagaagacctatcttctgtgtactaaactgcacagtatttaagttatgacccattcaagaacaagacagtaatcacggcaatgcaaatttgcacccatttacagagcccttactatttgcttggtatcatgctaaataattaagacatattatcttaatttatcctcatgtcattactgtccacattttatctttgagaaaataggcttagaagattaggtaacttgctggggtcacgtaggtagtaaagagaaaagtcaggatttaaacacaggtacgtctgacctgtctgacctgtcttacatcatggatgatataagattatcatctgatacttatatatattccctccacccagcccagaggatgtaataagatgaattagcaccagggtcttaaataggaaattttccatgtatttaagcccaattgaacattttataatataagtagatataaagtggaagtaatggttttcttggactaaatatgaagcatgtgggtacttataagaagcacagtcataataatatactttatctctttaattgtttatgaatgttccttgttatattagcattgctatttaaatacataatgtacaacacatgtaaattttagagggcagaaattaattctagctatagccatgcttcctcacattccattttctctagaatccaatgtagttggtatccacaccgctctgatgaaactgccctcatcacagccatcaatagtctccatgttttcaaatctaatggtgaattcttagtcctcaacttctcagcagcaactgacataaattatcactccattcttgaacagcttctttactcagcagccaagacattcttctggctttcctcctttctttctcctttgcttgaacctcctcctctcattctttcaaactctaaatgttggcatgggctagttgtcactgtcctataacctttcctctccactatttaaactcactctgtagctaaaagaggctccaactgagctaccatcatgaccttcccatccacatcatcacgactcccaaatgtctacctccagccttagatcttctctgaaaaccagacccaggtttcttaatatcaacctttctctgaaagaaacaaacaaaaaaaaagatgttccttctggtatcttctcaatttcaaaaatgttggaattattcactcagttgctcaggccaaaaacccttagaataacatgtgagtccacttgtgctcacaccccataaattagagaggctgtttcatactgagaagaatgagaataaatgattattccacagaccaatgaaatctttcttgtaggacattactcatctagcaagactagatattttataccaagattataagaaattattatgtacaaatacgttctttttctaaaaccatttaggttatataatcattaacctatattttaattaggttaatgattaaatgattatctatacattgtgcaaagcattaaacataatacatactttaacaactcagtttactacatttgctgaagaaaagattaacctaaaataactccacaattactaaatatcagaattttcctatgcagaattatataaaagataatttaaaaataattcttggtattgctttcttcttacactcggttgtactgaatacaagttctcctgatgatttaggttactctagatgttattttaatataaacacactacccatgaccaaataaaaatatgagtgtgaccagtgtttaaattcagtgggcctattttattctcaggttttcctcaggccagtgattaaatgactattagaaatgccatatatttttaaaaggttctccatctgcctttatactaaaatttctctcatgaaaagccatttatgttacttttagaaaagtgggctgaacttaaatattatatacaattaatatgtgaactttttttttttttttgagatggagtcttcctctgtcacccaggctggagtgcagtggtgccatcttggctcactgaaacctctgcctccctggctcaagcaattctcctgcctcagcctcctgagtagctgggattacaggcatgcgccacctgtaatggctaatttttgtatttttagtagagatggcgtttcaccatgttggccaggatggtctccaactcctgaactcaaatgatcctcctgcctcagcctcccaaagtgctgggattacaggcgtgaaccaccatgcccagccaatatgtgaaattttttttaactgcttactataactcttattctaatgtcatagacactgaaagagagaagttaaactgtgctaaaaatattacattttgaaggaaacattaatttctgatatacaccaacagaatgaggaattctaaaaagagcatttggtgtgcaattataatgtattaattaatcctggccctatctcccaccatccccacttgctctctctggggcagtgacactagatgttctcctctctccctgctaaggtgattagctgatgctcaactgtaagatgccctccctaacctccaggtcttggtgaacttgctcttagttctcatggcacggggtacttagcatgggttaactcaagattatatttgttagtatgtttagtttatgtaacctgtctctccaactagacagcatattccaggggacaagggaacttttctctttttgcttactgtcatatctccagtacctggtactaaagtaggcactcaataaatagctgttgtattattggcctgattttcctactaaactacaacttccaggatggatgcaatgaccatgtctgtctaataaactattgcatcctcagagcttatcataacacattgttcacatataataaacatgtagcatagatgcataaacatttgctaaacaatgagtatagaaaaatataaaaatgttttatgtttagaaatctgagcaatctcagtgaatttactgaaaacctccagagcacctaaagcatcagtaattgaacattattaattcaatccaacaaacttcactcaacagttactatatgcgaggtcttgcattgtaagcaaaataggatccctgccctcaggcagcttacagtccagttgagataaacaggtagtaactattacaaaataagataggaaaattataagagatttcaaatttcataaaagttaaaacagggttagaatgaattcaaactgtgaaataccagagaaggtttccaggaggaagagacttttaggctaggacaaaaagaataggtacaattttcataggcaaaattgaacaatggtaggaaagcactccaagaagaggagctaagttactcacctaagtatgaaagtgaatacaaggtatgaagtgaataatatggcatggccagaggggagagattcttgcaagtatttgcgggagacaagcttgatgttaagatgggattaagatgcacatatcaatacataaatgtctaaggagtcgggaactgggtcacagagctgtgcagccacatcagcctttcttctattgctcagagccatatatacaacctgtctatcttttacttaaccaacatttattgtgcacctattacttactcattaattcaaatattagttgaatctctactgtgccaggcactgttctaagttcttaagtgtgttccaggctcctatgtgctatgaagtgtgtgaggggaggggatgctacaaggattcaaacacagttcctgacttgaagaagccagcactgcaaggtgagcttagacaaataattgaccatgatggtgccatgtgataaacagctgcagtggcagataaacggccatggtgcatctgaattaagctttggagtgaacctgggagtttccgtaggacaatgaaggaggtacactttaaaggatacatttctcagatgtggaaaaggaaaggggaattctggagatatgaaaaagcaccaaagggtaggaatgtgtccaatagcaaaaccacaaattggtgtagacaaccagagggaaaggtttagcgagcctggaggggcaggagattacaggtgtcgtgtgttgtggtaaatggttaactcaaacagaattaaaggacagccatcaaaggatttcaagattggaactggcacagtcggatttgtataccagaaaaatcaccttggcagcagtacagagggtggtctgaggggaatgcaaggcacaggaggccatgggaggacacctgcaataatgtcacaaagcgggattcagatggacacagcaggaatgacggtgggtcgagggaggagtgagaagaagatggacacagattaggcgtatctgcaggatctggtctaagtacatgtgaggtgggggtaagtgaggcagaagtaaggtaacaatttttggatgacatccagggttctgatgtgggtaatcaaagaagccagtatagggaataaaggaggaggatcatgtttctggattaaaaaagaatacaagtttttaactgtcagatgcacatacacatctggggttcagcagacaattctgagaagagctagagacctgagtatccttagcatataaatcataggtgagccctgagcttcatggaggcagaatttaagtgagaagaccaccagaccagggccaggaccccagagaacaggacatcttctcgattgactttaaacctctcttcccactcattcagagaataccagggatctcactggatggaaggttggagtttcatgactcatttcaggctcatatgatctcatgaccaacgtcaggacagaaaagagtgtctccaccctttcttcgatgtcagaaaggcaaaaaacaatctgcttttccttcagtgttgctttgagcagtcattaacaccagtatcaattctgttaaacaacccagaaacccaggagttaccctggtctgaactctttccatatccacaaacagggatggctatgacactatgtccattatatctgtgttccatttccacagttactcacctattttaacccattcctcttttttaagacctcccctaatcccttggctgcactatagcatagtgatatttttcagctccactgtccctttaatggctttccattgcttttgaagttgacccaaatctcaacacggcccgaatgcctatcagccagccactcacctctccaagcttcatgatgctacaacatccccttctgttttctgtttcttgctctcagctcagtgtctgtgcatatgctggtccttttattcacagccccccttaccagccccacctagtttactcctaccccttcctcagctccgcagttcaaatgtcacttctctccctccaactcaccaaactggatcatgtctccaccttacagattctcatcattccctgcattgcccttcatagcacttagaaggcttataattatatggagagtgattatttgataaaaagtaagaactatttctccctagctcaccactttatgcctagtaccaggccgtatgtccaatacaaagtaggcacacattacatactgttgtataaataaaaagagatgatgagaactcacaatagtagtcttattttacctaaagatgtgttgctgcaataatttggaaaaataagtaagtcaatatatgtgtgtgtatacatatacatatacaaactatatatatatacacacacacacacacacatctatatatatatatatatagattatacattaaaaagatacagtacaaaatgtaagagaaggtgactgaaaaatgatgtaccttaaagaaaagctttggccctacaggagatgtgggttctttggacctgcatcggcccacacctggaaccatcccaagccagaatgtcagggcagatccatccgtcacttcctcaccaccacagaaattagtggacacagtgggaaaactggtgaaatccaaatgaggtcagtagttttgttaattgttcgagcaacgataatttatcggtttgaataattatactatgaggatgtaagatattaacattagaaaaattgggtgaaaggtatatgtgaattctctataataattttgcaacttttacattctcaagttatttcaaaataaaataattttcaagtgccagggctttgctgggataataatataagcaatacagatctattagaaattattttttctgtattttattttgtgatagggtttttcattcaacagttattatcaataacaatctatacatgtttacaaatataaagtatatgtgtgtgtgtctgtgtgtgcatatatatgtaccttctctcgcattctttttttttttttttttttaagatggagtcttgctctgtagcccaggctggattacaatggcacgatctcagctcactgcaacctctgcctcctgggttcaggtgattctcctgcctgggcctcctgagtagctgggattacaggtatgtgccaccatgcctggctaatttttgtatttttagtagagacaggcttttgccatattggccaggctgggctcgaactcctgacctcaggtgatccacccacctcggcctcccaaagtgttaggattacaggcatgagccactgtgcccggcctatcactcttttttcaaagtaaaaactgattaattccacctttattttcatggttttctgcatgaactgagtacagaattactaataaatggaatgctgaagagtggtagaaagaaaagagtaaaagaaaaagagatgaaggcattttcaaaggttgataaaataatgctatggtaagttttggggaaatttagattatgtgtacagagaaatacaacctatatcatggaactgacatttatctaggttatacagatcccaaattttgctttgacctgagatatcctgataattgcttcaattttccactttccttttcatggatataaatatattatttttcagtgttcagtaaatggtacattaaggttctagttctttattacatgaactgaactactttatttagttgttagagtggattgagttggagacacttcatgaactggcagacattctgattggtagttatgctattagtcccactggtaacaccatttatttggtgagctctgttgagaaaaagtaataagtagttgaggaattacttcaaatgcctttgctatctctggctgcattaattttgagatgcctcatttaggctataaaaagaggcaaagttaaagtatataatacagacattctgtcacctcaaattggacctattacaatttagcattctctcaagaaggtgttatagctcactaagctgtaccacttttcctttgaatagaacaaaattttacgtcgtttggttcacaggcataatgaaagtggcataaactagattctaaagatgataagccatctctaaggaaaaaatgtagcttacatttcacttccaataaaatttcaaatgctagaaaactttcaatctataaattaaatgtgactattattattatttaaaataatgtgttaaaaagaaatggatttatgtaggtgtgtgtgtatttaagtctcagtttgtttttctttaagtggacaccaaataaatcaaaaggaatggtatccaagagatggattcagtactgaatcacagagcggtctgatccgtaaacagctgtagtagcagtttcctcactgccaatactgacagccaagaagcttggagaacttcaaggcaaagaagccaggacctgacctaccagcttatacagagacactttatttcaggccttggcatctgagtgtaagagctgccaaacacataaatcagtacccacaaggctaaaggtacttgtggagattggcaagaagcttatgaagtatcacatgccagcccaccaataggattggacaaatagcaatgcacccaccatacaagcactttcaaaatgcaccgggactctcacatttgaccaacatcatttatagtagtcacattcaaattcactgttctcccctctgccccacttccagccactggtgtttggtttccactgcttcatgcaggacaagccaaagagggtacagagtttaccctgcagaaacacatattggttattactatattaacaaaatagccaaattaaagcacatctggttgttattttggttatttttggtatgaatcactacatcattgttctggttgcttatgaagcactctaccattgtgattttaaaaaaatacatgaacaggaaggaactgattaaaatgcacctgccaatcaatttaggtaatactaaagaaaaactaagacatagcctctgatcttaaaaaaagacaacagtccaattggggaagtatacaatagtctcagaaaggttaaacaacaacaacataagattaagaacacccaattctgcaaacagaagaagagttggaaggcagcagacaactaaacagtaaagaaatcatggaaatatgattacttcgagaggtcagaagagagaaaaattccttccagtgaatggtgtgagatttgggctgggtgtcctaagatacagcttttgtgcaggcgtggagaggcagccaggtatatgagtgaagaaagacgtatgtgcaaaaaggaagaggagatgattggttgagtgcatgactaccttaatgggaagaaggagttcatgctaagggggtacatcccagaaggtacaatgtccttgatgatgcaatcgatgttttgagatttttctctcttgaaagtggaagatttcgcttcagatgaataacatacaagatagtgtcatataagaattcagtggcggctgggcatggtggctcacgcctgtaatcccagaagtttgggaggctgaaggaggcagatcacctgaggttgggagttcaagaccagcctgaccaacatggagaaaccctgtctctactaaaaatacaaaattagccgggcgcggtggcacatgccagtaatcccagctacacaggaggatgaggcaggagaatcgcttgaacccggtaggcagaggttgcggtgagccaagattgcgccattgcactccagcctgggcaacaagaatgaaactccatttcaaaaaaaaaagaaaaaaaaaagaattcaatggcaaacgggtgtgcaaatggactagaaatgaaaaagactaatatctaggtaatctttcccttcctcctctttccctcccttactctgtcttttttttaaagaaaacagaagcctgggcacggtggctcatgcatgtaatcccagcaccttgggaggccgaggcgggcagatcacctgagatcaggagttcgagaccagcctggccaacatggtgaaatgccatctctaccaagaatacaaaacaatcagctgggcatggtggcgcatgcctgtaatcccagctacttgggaggctgaggcaggagaatcgcttgaactcgggaggcagaggtttcagtgagctgagatcatgccactgcactccagcctgggtgacaagagggaaactctgtccaaaaaaaaaataaaaaaagaaaacaaaacaaaagccataattttgtatgttaagtcaaaggagccaatggaaaaggagctcctgaaaatgcttgagggaaaaactgagtgacatagaataggcatgacagtgttccatgacacttggcagttacacaaacacaagtgttttcctaaagcaagagcttccatgaactttgtactgtgctaagagtttcttttttgtttttcttgagtcagggtctccctctgtatgactccccggtcatagaggctggagcgcacgtggtgcaatcacggctctgcagccttgacctcttaggctcaagcgatccctctgcctcagcctcccgagtagctgggactacaagcgcctgccaccacgccccgttagttattttattttttgtagagatgaggtgaggcctccctgtgttgcctaggctagtctcgaacacctgggctcaagtggtctgcctgtctcggcctccgaaagtgctgggattacaagcgtgagccactgcgcctggcctgtgctaagagtttcactagagagcctcaccaaacaacagcctgtcacgcaggtattattctcactttgccaacgagaaacgcaagcttagagaggttatgtacctaacccaaggtcacataccatggttgaaactcaagtccaggcctgagggactaccatgccacactcttaaacaacaccttactttgtttattttaagagcaaagaagcagctcttttaaaaaatgttaagtagacataagctagaatgacagaatgtgtggcaaatattatagtttcatatttaccaaacagtggtgctgtttgcagttaaggattagtttagaagtcataaactagtctgggctatttaaatgaccatctaatttatcaatacacagcatataatatacatattagtctgcctatgtgttgtataataaaaaattaattatctggtctttgccctgcttcctgacacagagctcctaaaacctttggtattttttaagtgactggagtatctttttttattcataataaacctcctttgaccatgccttggtttatgttaatgagatgacatatggcagaaccccctagagagtttcaggtttttagctcctcaccagaaacagggttagaaatttcagccccaacctccaacttctagaaaggggagagaggcctggagagtgagcacaatcaccagtggccaatgatttgatccctcatgcctatggaatgaaacctcaataaaactccctacagggcagggtttggagagctgtcaggttggtgaatacatccatgtgctgggaggatggagtgcctggagaggacatggaaactcagggttccccctgataccttaccctatccatttcttccatctggctgcccgagttgcatcctttatcaaaaactggtaatcataagtgaaatgccttcctaagttctgcaaggcgttctcaccaattactgaactggagacaggatcatgggaatttcccaagttctagttagacagacaaaagtgtgggtagcttggggatcccatttggagctggcatctgaagtgctagcagtcttgagggacagagcccttgagctgtggcatctgtgctaactgcatagctagcattagaatttaattgaattgttggacacgttcttggcatcagggaattggagaatacatttcatgaggctatggctgccatagataaattctgatggatctgagcaaaattaattgaaaaccttctgagaaggattcaccattctagatgccattaagaacatacataattcatgagaaaagatcaaaatatcaacattaactggagtttggaagttggttccaaccctcatggatgactcaagagttcagtggaggaagtaactgtagatgtggtagaaatagcaagagaactagagttaaaagtggggcctgaagatgtgaccgaatggctacaatttcagactcccacaccacactcttaaacaatatcctactttgtttattttatgagcaaagaagcaactcttttaaaaaatgttaacttggacagatgaagtcatttcttttttcttttttaaaaatttcagcagtttttgggaaacaggtggtgtttggttgcacggaaaagttccttaatggcgatttctgagattttggtgcacctgtcacctgagcagcgtacactgtacccagtgtgtggtcttttatcccttgtcacccatcaaccttcccccgagtccccaagtctgttatatcattcttatgcctttgcatcctcatagcttagcacccaaggaatggttttttttttttttcttttttctttgagacggagtttcgctcttgttgcccaggctggagtgcaatggtgcgatcttggctcaccgcaacctccgccgcccaagttcaagcgattctcctgcctcagcctctggcatgtgccaccacgcctggctaatttttgtattttcagtagagacagggtttctccatgttggtcaggctggtctcaacctcccgacctctggtgatctgcctgcctcggcctcccaaagtgctgggattacaggcgtgagccaccgcgcccagccagaatggcttcttatggatgaattaaagaagcagtttgagatggaatgtactcctggtgaagctgctgtttacattgctgaaatgacaacaaaggatttagaagattacacaaacttagtggataaagctgtatcagaggattgactccaatttcaaaagaagttctatagtgggtaaaatgctatcaaacagcactgcatgctacagagaaatctttcatgaaaggcagtctccatggacgcagcaaccctcactgttgtcttatttcgagaaattgccacggccactccaaccttcagcaaccaccacactgatgagtcagtcttcagagggtcataatgtttttgccagtggagggtcttgcctccagcaaaaagaaatacgactcgctgaaacctcagatgatcattagcattttctgacaataatgtatttttattaaagtacacacactgtttaagatacaatgttattgcacacttcctgtagtatagtttaaacaacttttatatgcactgggaaaccaaaaatttgtgtggcttgccttgtgatattcactttattgcaacgtttacttcattgcagtggtctagaactgaacccacaatatctctgaggtacaccactatttatttttttgtaacttttctgttagagctaatctttctccatcattgttattacaaaatgtagatggatgaatggctataaaatagatttaacctatatttaaatctaccaatcttgataccctcttttaaataatcaagacaaactgaatttacaaaatatgattagagcagtttgcttaaatttgtagtccctgattgaatacagatgttatgcaaaataggctgggtctggaaattacccacaattgcatccttattatttagctttatttttgctttggcaaaaaagaaagcaagtgtcttgacagagttcctgagatagttgcagaaataagaataaacctagagccaaataaaataatttcatacatgtaatcaacaacacacaaagcacaggcctaaaaaactgcctattaccaagcagtaaaatagaaatgccacaattaaaaaaaagaaatgataaaattaatatattaatagaatcaattgatgttttcactctttcattcttgccctgggaatttaagaaacaaggcaatacaatttaatcatacaaaggattaacatttcaatgtttaaaaatagtaattaatgaatcagaacatgttcttagtttctactgttttctaagccaggtaacagacagtagtgtggtataaatgtataaatcagcatagaaacttcatggaagggctatgtagtaacatggttaagagtctagactctagaccagactgccggggttcaaatccaggttctgcacttattgattatgtggtttacagatgagaaatctaatcttctatgcctcaggtttcctatcttcataatggggatagttcaaaacaatgcctggagcacagtgtgttctatccaagtctcagcttgatgatcttgtccttacttactggagtctcatgctgcagtgctgacatgtgtccctggctgttccatgtcttgtgcctaactttctcctaaagtaagaacaatagctactagactgtttctctgggtgctggcattgacaggctaaatgctaagtgactacgatgaagacttgaaatattcttcatttgaaataaacagctaactcccaaattgtacctaactaggggagtttatcatgaagaaatgtttaaatgcttaattttaaaataagaagtaaccagagtgttgcaacatgctgttaaataacccgacaaacttcaatcactatagctgtagtagagtgcattctgcaaggatcccagagtaaccagtattttggaaatgcaatgttgaaccgaccatactaattatctgctgattaggaagtatgacccagtggttgccaagtgactttagtttctttttagttttgagtctgtgcatttcaaaatttggtgttgattgtgtatcagatgagtggctgcttcagaagtcaaaagagttctctactgtgtctggggctctaatttgtcaagctgtgtcctaattgtggcttgtgtttacaaagtgtcatcaatctgaatggggaaaaacaggacaggcagttggattgatttagcgtattctgtacgcagagcagtgttaaagagcagagaccttgaaattcccatcctcttacatatgtatcatccggctacacacaggcctgctcccctgctggaatcattccacaccacacaaaacaaatcatggatggattacattatggctttttcaggtaatgaccaatataagggttgaagggcttacataaatacaggcttaaaaaaagtataaaatcctgtcatttgcagcaacatgcatggaactgaggtcattatgttcagtgaaataagctaagcaaagaaagacaaacatcacatgttctcactcatatgtgggagttaaaaaggttgatctcatggaggtccacagtagaatgatggttaccagaggctgggaagggagtgggtagaggggaggatgaagagatgttcattaatgggtacaaacaaacataaactaaatagaataagttccagcgtttgatagagcacagtagggtgactagaataaagaataattgtatatttcagaataactgaaacaaaagatttagaatgttcctgacaccaagaaatgataaacgtttgagatgatggatatcctaaataccctgattggatcattatgccctgtatgaatgtatcaaaatatcccacgtaccctataaatatgtacaagtattatgcatgaattaaaaaatttttaaagcaattttctattttactaatgtgaattgctgtgaaatgccagtgtagtctcatgatggcctgtataacccctttctaccttgaccatgaatgaccccaagagtatgcaatttggaaatatctttgcacaatattaaattcaaattatgccttcctgttcttcctagtaccttttataaatcgtaccatctttgtgaactttaacatgactgtaatgactggcaaaccggacacagttctaacacaaacgcttccttagaatgggctatcatgttatatttccacaggtacacatatgctcctgtcaaaacacctccaatgtcacaagtccacagaacgctgctcaatgtacttaagactcccaagagcattttataaacacaaattgtgtttatttctgataagaaatgcctgacttctatcacctctgtttattaagactctttccctggccctcagctatgtacagaacagactccctttaaattaaaagaaggaaaagaagtcacaatctctgttgcttctttcagagcttaccatctgcagtgggtggcctatatcttactgtaattcttatgcatcgctttcttttcattctatcaaccattgtatcaactgtctctctcattatatcaaccctagttcaaaaaccatcaaaggggttctcaatatgtataaaattaacccttaactccttaacatgacattaaagactctcatgttctgtccctaacccactatttcacatcacttctctataaacctttctctccagacttgtatttttgtcgtcgttttctctctgtgatctggcttctacttccataactctaatactgattttaatccagtgcgaacttacttcagtaacgagccttgctgaccccccactccgcacacaacagacctgaaacctgcacttctcttggcctccatgtcactgtactatcccatctcctcctccactccagcatctctgacatacttcctcatctcctttttttttttttttttgagaaggagtctcgctctgttgcccaggctggagtgcagtggcacgatctaggctcactgcaagctccgcctcctgagttcaagccattctcctgcctcatcctcctgagtagctggaattacagacaccccccaccatgcccggctagttttttgtttttgcattttttgtagagacggggtttcaccgtgttagccaggatggtctcaatctcctgacctcgtgatccacccgccttggcctcccaaagtgctgagattacaggtgtgagccactgcgcccggcctcatctccttctttagctctttctttacctcctctaccctgtctgcacagacattcatgaaggtacatcatgctggtgtctcccaaagttacattttcatagtagggctactccagagaaattagtcttttttcctcccttggttatctttattttcgttcaataaatgatgtaattatctaatttttttttttttttaagacaggatcttgctttgtcacccaggctggagtacagtggcacaatcacagctcactgaagcctcagcctcccaggctcaagtgatcctcccgcctcagacaccaagtagctggaactacaggtggtgccaccacaccatgctaatttttgtattttttgtagagacagggtctccctatgttatccaggctggtcttgaacttctggactcaagtgatccgctcacctccgtctcccaaagtgctgggattacaggaatgggccacaaagcctcgcccattttattttctaatgaaatgtctttttacctcactgcaggtagccttctacccaaagttacatcttcagctttaatcttgcccaattttaattgtgcatttccaactccttattggctatgttcacttggatatccactattaatacaaactcaacatatctaaaaccaaacttatataccaaatctctgcccatttttttttttttagtaaagtaagtattttgcaagatagatttcagagccatgtaatcattgttgacttctctctcattctttatagtcaataacacttagagagtcatgctctgaggtatcttcactatcccttatttttgactgctattgcaatccctctaaaggaggtggttggcatctcgtgtatagcacactattatctgctggatgccatgcatccatctctgttcctgcctatccatttgacacactactaatagatgagccttctgggcagatagcggaaggcagctcagcattccttccagccccctgtcttttgacatcttaaagaaaagagcctaggaagctaaaacctacatttcccagaggcctttgcaactaagcttctgtgtgcaagctagcttccaccaagccaaagcaagacagaggtgagcagtgttagggagttgccctgtgcaaagaggctgggtcttctggcaagcatgacagctgagacgtaagtcattctggggcagctggggagagattctggcatccagctccaattagaggtgcaactggtgagcagtgagtggcagaggtgttttgctagaagcgtcctctggctgctctgctggcataatgacatttaactccctttcatcataaattgttaacgtggtggattctattatcagcaaccaagaaccctaaaaacacttctctaaactcctgctttcattatctcaaccctagttcaataaccatcaagggggttctcagtgtctgcagaattaacccttaactccttaacatgacattaaaaactctcatgttctacccctaacccactggtactatttcacatcacttctctataaaccttttcccctaggcttgtatttgttgttgttatagggcttcagcttacactatcccactcatcagaaatgcctttctctgccactgacatataaatcctgcctatctttcaaagcacagaacaaggccaggtgtggtggctcatgcctgtaattccaacactttgggaggccgaggtgggaggattgcttgagcccaggagttcaagaccagcctgggcaacatggaaaaaccccacccctactatgcaaaaaatacgaaaaaaataaaaattacaaatacaaaaaaaaaaaaaaaaaattagctgggcatggtggcgtgcacctgtagtcccagtgacttgggaggctgaggtgcgaggaatgcttgagcccaggaggtcaaggctgcagtgagctctgatcacaccgctgcactctagcttgggcgacggagtgaggccctgtctcaaaacaaacacaaacaaaaaaacaaaacaaagcaagaacaagccccatctctgccatgaagccctcctggaccacctcaggcagaagtgatttttctctctcacctcctctaaacagactggatacatggtattgttagagtacatgtttttcacttatagctttgttttcttgatcatttcttctttatatgatggtaagttttctctctctacttttcattcttgaagaacctaaattgtaacatctgtaacaactatatatagttaatttatggagcacctgcttttttgccagggactgttccagatactctgcaagtctctccctgaaacaaccatgtgacaacattaaaaacaacccatcttatgaatgatggaacaagttctaagatgttatatagcttgtcccaggtcatgtagttagtcagagaggcaaatttgtactcaaacctagccaagctgtattctctccagggtaaaatatagtccctttcacaaaacaggtcctcaatagatactttatccaattattgattaaataatcagtaaattaatttttcaaatgacaatttcttgagttcttgctctgtgccatgttctctgctaagcacattacaaacatttcatttaatctttacatgatgtagataggtacgttgcttgtggaaaccaagcaaataaactgcaatttagagaaactaagtaacttgaaagatcacaaagctggtacatggaagtttggggattggaactcaagcatttggctccacagtatatgtagtgggcagtggagcatccacttctgttctcgaagatacaatgatttgacttggagactatttaacaaaatgattcatagaaaatattttatttttaaacaaaaaaaagtacgtagtacatttttttgtattacaagagccatcatgactactgtgacaactttaaaatttctagtttgcaggaggtagaaataaccaaatctaaaaggaagtcagggaaaagagagggacaggaagggtaagaggaaccttggggacaataattgtaatagactgtatttaataaaagtattttaggtaataaaaacacactttatttaataaaaataactactgatgaaacctctcagggttctcttataatataaagtctcattgctcaataagacacttttctttgatgacttctttccctatttgacttacttttcatatgcaaaattgtagtttgttcattatgtattgggttttgttatatattttccctggtaaaattatcattatggaaaatttggcaaatgcagacaattatatttctttttggaattcacataagtttattttaaatccgtttcaaagcaactgatctggaagttacagtagggaatctgaggagtttgctctagctcaagccaaatgcatcattcctttataaggatctttttgttcctttcttgataatatttttgtcattcagaaaatcaatgaagatacaaaatgatggcctatagaaaacaataaatatacctacctctcaaatgcatgtaggcagctatagtttaagaccaaacattcagttcaacaatacagggtggttcatggtgactgccaagggctgttctgtaaaggatgggtcagccctgggcctgtggaacacctttgtgctcgtatatcaagcacacatcatgttccctttatctataaatgcctgctaattttttttttttatttttaaagatttttgttccctccattaaactgcttttatctcagttttcatttttgtttcagaacatttcaattttatacattaaatttcaaattaagtaagtagctagacaaacgggactcctctgcaattaattttcttataaagtatgaaacttgcacctacccattctgctaattatgatacaaataaaaatcatactctagtgaaaagtgaggagttttaatgcctttctggtccacagtatggtaagtctcagcaaattctgctgaattcattctaaagaaaatttcacactttgtgtacatttcaaaatagtttgttgctatttctgaaagctattcagactgcattttctgcaagttgtaacagtttgagtcattaataaaactactgagaatgacttttttttcattttcctttgatgagttaagggcacaaatgatcttgataacatagaacagtttcataaatcatattgcataaatggaaggttggcagacctttgtttttccacaaatactttcgattgttggtcctgaagtgagggtatgactgctggaccatggtgatactctacatctctgaagtactttagagtcacaaaataccttctccatgttatctggacttcacaaaagtcctgcagcaggaacagaggcattaattgctacatcttctttctgtaaatgagcaccctaaggatttttgggacttgttgggtgtcacagtagcgctagtcagagagaaataagcaccaattctacacatacttcttttttcaccaccctgagagacctgggagccagaaaacgttctggacatcatctagtctgttcccacctaagccctaacctgacccagggtaagaccacgcaaaatttactccagctcacagagtgagattcttgccacgcagggactaatatcttctgtgttcttcccaagtgtaatggaaataaaagtttcccagttagggctaggtttggactctagtcccaaatacactatctctaatctttttttttttttttttctttgagacagagtctcgctctgtcgcccaggctggagtgcggtggtgccatctccgctcactgcaagctccgcctcccgggttcacgccattctcctgcctcagcctcccgagtagctgggactacaggcgtccgccactacgcccggtttattttttgtatttttagtagagacggggtttcaccgtgttagccaggatggtctcgatctcctgaccttgtgatccgcccacctcggcctcccaaagtgctgggattacaggtgtgagccaccgtgcctggcctctaattttgtacaattctaggttcctcatctctgaggtggaactattaatacctactttgtgcagttgtagggatgaaaaacaggtaaggaatgtggtgtgcctggtgcataatcaccactgagtacacaatattttattcccttttccaattcgctgttcacataacagtacttagctttcaaatttcaggccataaatgaaaaacaattcagcaattcatagtagcttccaaaaacaggttgcaaatgtctatgtctgacttttatagctaatccttaacttacaaatgatgtttgaatggtcaaacttttcattttttatttttattaaaatattaaaccaaatagtaaaacttattattcttataataatttaagattttaaaatataagtccaaatctacatcagtctgctttggccaatatatttgttataattttatttttgtgcttcctttaaaaaaattgtactgtttggtgattagaatgcaagtgatccttctattatcaagtattttgtgaagtgactcctggtaacatgattttacagcaatgaaaacccaatactttccagggtgatattcaaaataaagttatgcatataattttatgttgcattctatctgctgcatgcagtgttgcgcatggtcctgggggctgacactgcatagaaagcattttcttagaaagccacagtgcatcatttagtaccaatttcgctaagaaaccaaagaactctccagctaatactaatgtttccctccttacagtctaatgggcaaggaaggagcagatacccttagctccatgttgcagatgtaggtactgagcctggttgacttgcacacagggccagcccagcagaaaggtgggattcaagttcaggagtaagggctctcagcctgggctttcactaaaccatgctctctcttccatgaaagtctcccctgttccttcagacaataaaaataacacattgccttggatgaaaatttttctagtctgatcttgacatttttgagaaaaagggggagttgtctcttgaaagacatgttctgcatttcgaattcaccagaaataaattttaaaagaattcatttttattatttcccagatcctaaacagctctcttcacttcgtgtttaagctatgtgaaaattaaatggatacaaacaaaatatgatagaaattaaagtatatgtaattcataatttgtataggcagagtaaaaatctttactagagtttactaatacaagtgtatattcatgtgcctattcatatgtagtgaaagctacaatttattgctacattattatctaatgatgtatttgaaattagagcatttttataaaaataagtgattctgcagcagaatttcaatgcaatttgtcacatttcctctttaaactgtcattctttttttttcctgccacatgagctgtttgtcatttgaaataagctgtcaggttaaaaaatatatattgtcttctttagggggacattttgtggctgttctcctagggtaaaaccttagaaatgtgacttttaggcatgtgtgaatggcagtaggatccagtctctatttattatacagaaccttatgctctgcatatctaggtagtaacatttccttagctttatccaactgtacttgcattattttttcctgtagtatgatttgtttgatttgtttgcttggttgttactttttcaattacattacagcaaataccatttatataaattacccccaaatttcttctgaaatggaaaaggaataaggaaagaaatacaatattcagtcctattgtcagatcaaatgtcatggctattggtctggaattatgagccttgtggaccagagaatacaatcatcaaaacaggaatctagttcatcggcatcatgctgtagtactctcaaaaatgattcctcgcaacatgctatttggttggcagaatgtactaaacatggcaaaaccactgacctaaatcagctattttcaactgcttttacctccatgtttatagacatgtagttcctatgtttatatacatagtcatatagacacaggccaagagacacaaacccagattaatgaaggtcactcaccatggctatggcacagacagtaggttgacatcttcagtaaattaactgcaactctactctcctctcatccaacccaacataccagtgagtcctaacccaccaatgtatactcacgtcttagaggaaagctgctagttctagagggagattttttacaatgaaattgtgcacagaatctcaaagtataaaaaggtcaatattgatctctagttataataaatgtattttataaattaaaatcttttttatgaagccaacataaaaaaagtttgataaatcctaaaatcttattttttgtggtatcgatggcagcatccaatttatcttgcattttgtttcaattagagagtgtaaaagaatcaagatttactgaaattcacagttaaaaagtaagagtctttagcaggccattttgcagtctcagaatcctcttcactagaataatctagattatcacagggtggaaaagtactaaaataatataaattattactagttagaagggaataagggaagcttctgactgctcaaaacagtctatatcatgatctgtatgaaggtcgcatgggtgtatacaaatgtaaaaattcactgagctgtacacttaagatctgtaaactgaacaatgtacgtgtcatgccttaataataacacaattacctagaagcatgaaaaaagtaataaaagtttttgcttcaaagttaataaaaatttctaatgaaagtttatattttttatcattataaacactaaaaattagaaccaaaatgatttgctctacattactgcggctgtacatgcaaaacattcacttattatacaagtgattgccaggctgtggagagggcacatgctgaacacgtgtctcactctgcctgacgtttaattgagtctggcacatgtgtgctctagtaacgtactcaactgtgcaattttatgtgagtggacatctgcagacatgaatttgaaaacaactagtacaaagtgacaacctttctacccaatggtatataataaaaagagcgataacaggaagctgcagcaactaccatctcttgaggttttattacattacaggcattgtgctaagttcttgcattcaccatctcaaggatctcatttataggaattttaaacacatcagcagagatggtcagatgtgtgtgcggtctgcccccaaataagataatctgatagaacaaattgacacagttataggctccaagtttgtaaaaatattagtaggaaactcttttatatgtgattttgatataactgcaatttttaaaaaattaaaattcattaaaatgatccccaaacacttctataagacctagacatctataggtaccattttaaaaagcacattgaggctaattttctgacaccaactctaattctcattctgagagtttatagttgacaaagtcctttgttaggccacaataagagttaataagcttggagctatgaatgcatttcctggattaagactcctttccagtacaactattgtcttcatgactagtatttctcacatgtaaatttcttgatactttttattgtgcctcttataaatcctattatattaaatcttctttaatagtttgattactgaaactctaaattccaaactcttatttaaattgaaataactgattattaaagaaccaacagatacatgtgaatctaactgtgctaaatcacaacatccatactctcctacttaaggtgaatctgtcatttcagacacagtcacggtgcgtcatgatagtgaaaacacaaaccacatgaccaaatgacaaaggacaactggtggtcccaagaagttatatttacacaggagggctcaggtttttcaagtatgttgataaatcgctaactcattccatcacagattgaataggacctaagacataatttagtccaaactccttgttttctggttgcaggaaaaaaaaatccacaaaggtgaggcaacacttccaggtccactacttggcagtgagggggttatcagctcctcaagccacctttgaaaatctgcttcttcaacacatactgggatagcctttttaaaaaggtgacaggccgggtgtgatggctcatgcctgtaatcccggcactttgggaggccgaggcaggcggatcatctgaggtcgggagttcgagaccagcctggccaacatggcgaaaccctgtctctattaaaaatacaaaaattagccaggcgtgatggtatgcgcttgtagtcttagctactcaggaggctgaggtatgagaatcgcttgaacccaggaggcagaggttgcagtgagcaagattgcgccactgcactccagcctgggcgacagagcaagaccctgtctcaaaagatacaaataaaataataaggttacgaatacataattatacatacctgtgggtatagtttagtacagaaaacatttaacttttctatgtggaatcctgactttatatatattacagttgaaacacagttcaaccctgcctgttatctgacaatattcaatatatttaaaggatgactttgaaagtagccttaagttccccttctcctgatgaagtaatttcaaaaacttaacccttcccagctgtcagtgtgtcattctgatcttttcaccatcttcaattaccctatattctttctttaaagaatattttccagagtgcaaagatcatgaagggatgtttaaattaacctgtccctatgcaaggttcaacttctttgtaaatagcccacaaaataaagaagccattacattaacaaatggatcagattgcttatgttctctgtgctctgcaccacatgggatatctgaccctagtcttaaaatgaaacaaggagtacagacgcgtctttgtgctcctgtctcctagatagagccaggttattactgttccactctatctctttatgactggtttcaaaatcaacaaagtctggattttacaagcatgagatttgctaaaaagaaagttttcatgattttttctgcacagaattgggacgacatatgagacaatcttgaatcttatttttccccatgataaagatggctctgcctgatccacgcagaccttccacactgactgctgatttttggcatgtattgaatgctcaataaatgtaagcttctcccatgaaagagagcagaaattactgtaatgcacaaaaaaatttaaattcactggaaattctctttgaatacaaacaccctaggtataatggacaccaaaggaaatgcctcttgtcatgttaaggatgatattctctacctgtctcctccacaaacctagcttggtatcttacatatggcaaatgttcaatacacactgaataaatgaaatatgagaatgaagtatgagaatttccttctggtgtcagtgatgccattttatagaacaatgcaaacgcattcactggaagttacatggtaggaatctggataaatcagtaatgtttatctgcaattttgattttatgatcctagttttatgcaatataaacaattaactaaataatacctgggcactttacaagtacagaaatctgaaaagcacttaagaaactcttgtttttccaaatgataagagacggaaggttagagagctataaaatatggagacaggactgttacaaaagaaaagctccttgttttctactcgggacaaaccaagactcaacataaactttgggtttacaatttacaagtatttattcataaatatttttagaatctaacagatcagatgaaggaaggagaacttttaaagttcatatggataagaagataaagatgatgtacctagaataaatagtaaacagagaggaggagataaaaataactctggcatatactgggcttttaataagtatattttgaatgggtcaaacttcataaattgatgcctacatcaatctatccagataattatcagataagcaagcttattttacagacatacacaaaaacatgttgtaattagggagtcttctcaaacgcaattattggaggaactgtctaaaattttctcttcattccaatcgatctctagtgtacagaaatgaccttcactcctctgactgtcattcttatttttctcatctcccttacacatttctacatttgcctccccatgaatcttaggttcctactccgttagcactgacaattccttcctattaacctgctatatatcctggcttgtttgtccttttcataactaaactagatctgtactatctctagttcactttttttccctcaactaactaaacaggcttctcacattttattcttctggaacctcagaaagatggaacccattttcgtggtgcttctctaagctttctccctctctccctgtctgtctctttctccctgcccctgtgctgtgtgtgtgtgtgtgtgtgtgtgtgtgtgtgtgtgtgtgttattaaatcttcttccttcatctgtctccttactgcaggccttcctcccaaactgggtccttgatatctgttcctgtgaattgaacaaatcttatagaaaactctttggtagtttattctaaagataaacacgcatctacctttgagctagcaatccccttcttcagtatttacctaagagaaataaaaacatatgtccacagaaaagttgcacacacagaccttcatctagccttataatagtctcaaactaaaaacaatccaaatgtccatcaagaagtgaataggtaaattatgttatacccacacaatggaatactatttagcaatgcaacaacatgcaagaatctcaaaaacattatgcaatgaaagaaggctgaaaaaaaagaacacgattccatacatgaagatctagaactaactggtggtaaaaggcatcagaaagtggctgtctaggggtttggaggaagcagtgcatttattggacagggacacaaggcctttctgggtgatggaaatgttcagatcttacatgagagtatacaattgttaaattctttgaactgcacctttaaaataagtgttttattgtatgtaaaaaatacctcaaaaaataaaaataaaataacctcagggatcgtccttctgccactgacttcctgtctatatttcccatccttcctgatcagttccagttctagatctccaaataccaacagaagagctccacttggatgtttcattattgtatcaaactccttcactcacctctcttagctacattattcagttcaaaggcatagccattccttctttcttcatcttattctttagagtttagttatcaccaaaactatcaattcttcctttaaatacaaatcataaatcttttcccttcaagacagaatgcagtaaagagcaatcttaacatgtaggggaggccgggtgcagtggctcacgcctataatcccagcattttgggaggctgagacaggagaatcacttgaggccacgatttcgagaccagcctggacaacacagcaaaaccccatttctacaaaaatttaaaaaattgcctgggcatggtgacatgcacctgtaattctagctactagtgaggctcaggcaggatgatcccttgagcccaggagtttgaggctttaatgagctatgatcatgccactgcactccagcctgggcaagagagcaagatcctgtctcaaaaaaaaaaaaaaaaaaaaaaaagcattacattttttaatcctaaacttagagttattgttatcgttacttgctcaaaacccgccactagaggcctggtccaggcccagagtcaatcacatctgaactacttcaataacttccgacacattcttcttcctgattgttttttggcgtttaaccaatttattactcattttcatgactaataatttaccatataatccctttaaaccattatattgatttctaatatgcagcaagatgtatgaaaccccaaatttgtttcaaagcagaagccaaccagaaagcgtgggtaaaaatgtggggctaaaacaaccaatgctacatctcttaccaaagaaattatttttgagctgacagaaacgagcaatggggaaaagacaccctattcaatgaatggtgctgggaaaactggccagccatatgtagaagagtgaagcttgaccccttccttacaccatatacaaaaattaactgaagatggattaaagacttaaatgtaaagccccaaactataaaaaccttgaaagacaacctaggcaataccaacctggacataggaataagcaaagatttaatgacaaagacaccaaaagcaattgcaacaaaagcaaaaattgacaagtgggatttaattaaacctaagagcttctgcacagcaaaagaccatcgatggagtaaaaaaacaacctacagaatgggagaaaatatttgcaaactatacatctgacgaaagtctaatatccaacatctataaggaacttaaatttacaagagaaaaccaaacaatcccattaaaatgtgggcaaaggacatgaacagacacttctcaaaagaatagataatgtcaccagcaaacatattgaaaaaaagttcaatatcactgatcattagagaaatggaaatcaaaaccacaatgaggagcatctcccaccagtcagaatggcaatcattaaaaagtcaaaaaacagatgctggtgagtttgcagagaaaaggaacgttttttgcactgttggtaggagtgtaaaatggctcaaccattgtggaaagcagtgtggccattcctcaaagagttaaaagcagaactaccattggatccagtaatcccattactgggtgtataccgaaaggaatataaatcattctaccataaagacacctgcatgtgaatgttcactgtagcactattcacaatagcaaagacatggactcaacctaaatgtccatcagtgacagactggataaagaaaacgtggcacatataccccatggaatactatgcagccataaaaagagcaagatcccgtcttttgcagcacatggatggagttggaggtcattattcccagcaaactaatatggaaacagaataccaaataatgcatcttctcacttacatgtgggagcaaaatgaagagaacttacgaacacaaagaaggaagcagacactggggtctacctgaaggtgatgaaagggaggagggagaagagcaaaaaagataactattgggtactgggcttaattcctgggtgatgaaataatctgcacaacgaaccaccatggcatgagtttacctatgtaacaaaccttcacatgtaccctggaacctaaaataaaaagaaatgaaaaaatatatatatatttttaaaaatcagactaatttttgtatgtaaaaggattacatataatattttaattcaataactgtgggctttcacaaacaatttccaattttactggctactctctcattataaaatcttcactggtttgctgacttaacttggataataagtctcataaaacatttagtgaaaaattaatattttcaccctacaatgtaatgtacccaataaaagatgacagaaggatattttaaccttttgattaaagaagtcatttgtttttcccaatcaattttctgatttgcattttcctattatatattagaaaaagtgtctcttactgtgcaatttaaaattagttttatatttgcctcagaaaatgggtacttcaactacaagatcaatttcatcttctgtgtcacttgtaatagtgcttacatatacaaaacacaatagagaatggatgcagaattgaagaccgcaacactttctgctgaaaggtcatgaaattttagctcaaagattttatttccaattatttagataatagtttcaattttatattttatttgtgttttgtcactatcgtagcccatagctatgtaattccagaaatcagggggaaagacacaatagctgattatattttttgtcattttctacaaaatgagaggttaatcaatgttaatttgagtttatagactgaatataactatgtttcacagattttgtttattctcctagaataagccttttgtcaagctctgtatttcagaaacactactctattatacttggcaaaacaaaacggcattcctgagagtgaaaccctagtaataaggatttacattatgaaattaagacaaaacaaatgtagctgttacggattttaaaagttaggtcactacatgagtctagtgggaagaagttatgagaaccaccagaatcatctagaaatttttataagagaacatgactaaaattagctaaaacttacgaattagattagaaaaacagatacatccattcatttgaattgcttctataagcaacagtgtttcttttctaaaatattaatacagtaatcatcactctcctaaagctctccttctgctaggaggaaaatatttcctcaccctactgatgttgggcttagtcatgtgatttcattcacattaattaagatgcagaattttatctagaaatattacatgacttagtctaacattaaaaattaggttgacaaaataatcattttacctaagaatatctagttacttttaaattagagttaaagcattaaaataatgcatccagttttctgtattacatttgtttttccataagtacagataaaataatattaatgatatatcagatagttttaaaactaaacactggcaggattctattttattatataagtaaaagtttagaattcctttctccacaccagtaattttgcagaaaactaatcaggaatattctgaaaatatgttggcactcttatttctattaactgcatatggtttgggattcaacttttagaataagccacgatgcatgatgcattagattttaaccagctgacgacccttggctatgtgattgtaaaggagatggcaaaatatcattgaagatggccatgtaaaacatcaatgagataagattcactcttacccaagatttttctatctatatcagatttttctatacagcagcaggctattcctgagaatgtgtccttcacttttttactttcatttgatgcgggtaagtaaatgtattcaatgagtttcaagtgtgtgaagaaagtgatataaagtaagggaaaattatggcacaatggctgtaactcctggaaagtaatgaaaagacagaatgtctcgagcatttgactggaaatagaagagactgcatcctggtgaactgagttaatttcaaatatattactctatggttttctatcatgtgtactctcactggctatattaataaatgaaatagtgatgaatggttctgggaacttgtagtgaaacttattaatatttcaacattatcaccgagtatctatgtcaacacacatcaaaaatgcatgagaaatgactacctacactcactagttacacccattagaaaaatatctatgagaagtataaatgacacacataaatttgcaatgtgattataggtagaacatacagcaagaaaaaagctacaggaagatatcacgtggtgaagtatgtgaaacaaatgaaagcaaattaattcttgcaatcggtttggaatacactgtatgaccacattaaataccattagatttgaaattatgagttcttagaaattactaacactaaaaaaatttcaacataatttaaaagtaggaaaaataaatagccactatcaaactgtaagtggctcatcagttctatccatggtgtaattttggaatcccctacttaaaaaacaaaagtaaaaacaaaacctttagttttcaaaagtttgttctactttttaaattgatgaccaagaggtaataaattcacattagaatgaggcatggccgtttaaacaataaatcaacacttaacccaatagtttccaagttgttaggtaggcttaaaaaaaaaagtctgtttatacctatatcagaagacattcgatttagttggggggtgtctgtcaaattgattgtttagcattatgcgtagagtataaaatgtcaaccatagaaatggagacagaaatcactttcaaaatagcaacatctgtgtagtagctttcatacacatcttttaatgatcaagaagattcatgcacaaaaaattatcaggataaattgtcacttggaactaaagttgcatcaatttttagggaaaaaagtacttaatggctgctagaagatattagtcatatattaaaactttccagtgtaatagttatttttgactcatcaggagatatttatttaatacattactgaagagaaaaataagatgttcttcaaaaaatcaccttttagttttaatttttattatcttatttttataatttcaatctttatttcagatttaggggcaacaatgtgcagatttgttacctgggtatactgtgtgatgctgaggtttggggtacaattgatcccatcgtcacccaagtactaagcatagtacccaagagttaattttccaacccttgccctccctccccctctagtagttcccagtgtctactgttgccatctttatgtccatgagtacccactatgtagcacccacttataagtgagaacatgtggtatttggttttctgttcctgggttaattggcttaggataatggcctccagctgcatccacgttgctgcagcagacacaatttcattcttttttatggctccataatattccatgggatatacaggtatgtaccaggataaaactcactttgaaagaataaactgattcaaacacaaattggtatgataaccaatagtaacatgtacactaatatggacattttatcatttttggtaaacaattaaacagaacaaatacctatatatgtatataactagatttcaagaacctatgcctaaaagaagtacaaagcagacaaaggttttgaaagaaaaatttgctctgcatggttttttgtttgtttgtttttggttagacaagtatttacagattcccttagaaaaacagaatttttataacagcaagagaaagcatgagtagataaagagattcagttctgacttctccctagggatttgatgctagactattcagttggcctctatgaagttcagtttcttctgtaagttttaaggaattataatgaatcttcttcagttggtcagtgaaattgttcatttactctttgcgagaagcccctgcctcagggcctctgcacttgttattccttctgcctggaatgctcttcctttagctgtccatgtggtttgacctcctaccctttcaagtctcctaaaatgtaatcttaccagagttcttccccaaacacctcacatgaaatagtaaaccctgcctaccaccttccacactgcccagtccccacatccttcttgcttcaccaccacagcacttaccttctccagggacagaagaatcatatgcttattatagaatcatatgcttattgtctctctcctcccaccccctccactagaatattaagcaccacgagatcagtgatttttgtctattttatccaatgcttttctagtgtttaaaaccagtgtctgatggatacagtgctagctctggagacacaaagaaggctaggacatgttatctgtcctctgagcagcacaacatactgcagagtcacacacacacacacacacacacacacacacacacacacacacactttgtaccataaattcctgtgcccaattgtggaggttgtggacacctaagtaacactagtcatatccatgatgatgtaaatggcacactttggggtgtacagtcctcaatctgtataaccatacccagtttccttaagacgaatatctgtaggacatgaagttgatcataccatttccacttaaaacccactggtgggttgggttcatattgtctaaagaataaactcatccttcctgatccaatcctgacctacctctccaagcagctgcatctcccatctcacctcctcactcacttgtgcaccagtcattatgaccttatacactcttccacatgccaatgctcttacctgttccactcggagttacatgtcatcctctctgttctcatggtagcacttaatgtttttatcccattagactttagttcatcccataaagtttgactctgagctcctcagggtcagaactatgagtcattcattctgtatctccagcatgtaacaaggagttgaataaatgaattaatcactctttgaaagaatatatgacttaatgttggcaattcatgaaacaattcaagtattaaataatcagccaaacttcattatacttttttttttaattgaagagggaccatcactgtcccaccacagcagataaaaaggaatatgtatgggcatatggtctccatctggctcctaaatacccacagactgagttactaagggatcactatttttaattttttgaagcttagaaggctggtgggctgataatggcaaagcatatactttaggttttatctacagtcattcacagtcaatcaaagctttttctgacctccttcaaaaaagagcaatctaacagcatttatctcccctggcaagaatgaatggctccctgatttgcccatcagcagcaccacaacaggcatgatatttagtcactaacagagagctgacttccacctaaatatctgagtcaaagaatatttctttggtagtctctgaagtgaggatttaaaggtgtcccaaacctactagtcttgttaaataaaaacgaagcatcttttaatgtgccaggattatgggaagcatctaagagcaaaattgaaataatttaacactgaaattagaaaccaaatacatgagctttcttgggctttttctcagaacacaatcaatgcagctgacttaattcttgtcagcagagaagagacatggcccaaacattctcaagtttttccatcaaagggtgcaaaataagttgactcagtgcccttttaactctcagacaactttttcccaagattttctttgaatattagtaatagtaaagtttatccaaaaacactctactattttacatcttatttatttacatttcaatgtaatgttgagattaacagctgaattttttttatgtatcagagaatgtatttaatataattatttctccctaaaccaaattatattaaaataacaatggatttgaagattagaagttttaaaattaatgctggatgtggtggctcatgcctacaatcccaacattttgggacaccgaggcaggggggtcacttgagcccaggagttcaacatcagcctgagcaatatggcaaaattctgtctactaaatatacaaaaattagctggcctcacggcacacacttgtagtctcagctacttgaagtctaaggtgggagaaatgcttgagcccaagaggttgcagtgatctgagatcatgccactgcactctaacctgggcaacagaggcactgtcagaaggaagggagggagggagggagggagggagggagggagggagggaggaaggaaggaaggaaggaaggaaggaaggaaggaaggaaggaaggaaggaaggaaggaaggggaaaagattgcaattgtttcacacaagttttatgcgtattggagtccaaagctaaaaaattctgctaatttaatatagctgaggcataaagttttttttcttctttttgagatggagtcttgctctgtcgctcaggctggagtgcaggggcacgatcttggctcactgcaacctccacctcctgggttcaagtgattcttgtgccttggcctcccaggcagccgggattacaggtgcccaccaccaagcccaactaattttcatatttttgtagagatgaggtttcaccagaggaaggctggtcttcaactactgatctcaagtgatacactgcctcggcctctcaaaatgttgggattacaggtgtcacccactgtgccctgccagttttttttttctttctttttttttttttgagataaagtctcactcttgttgcccaggctggagtgcatgatgttggctcactgaaacctccgcctcccgggtccaagcaattctgcctcagccccctgagttgctgggattacaggcacctgccaccacgctcggctaatttttctatatttagtagagatgggatttcaccacgttggccaggctggtttcaaactcctgacctcagatccacccgcctcggcctcccaaagtgctgggaatacaggcgtgagccaccgtgcccaacttttcttctttttttgaggagaggtcccactatgttgcataggctggtcttgaactcctgggctcaattgattctcctgtctcagcctcgagtagctggaaatacaggtgtgcaccacagcacccagctgctttagagattttaaagccacaacatgaaaacagaggaagggagcttccccttcataaaggaatgtaggtttgcagtcagacaaccttgggattgaatatgaacttgcaaaaaaacaaacaaaaaaaaaaaaaaagaaagaaaagaaaacttctgagacctctggggagagaataaacctctccaggcctccgcttctttatctgtaggatacagacagtatcatggggcaaattaaatgaaaattacatgagttttcatagaatctgccaaaaagttgcctcttagtaacagttcttgttttccctttattactcatctcttctactattctctagtgtgatttaaaagaccttaacaccatcatacatgaggagattaacaaaaacaggaggggtgcaaggagtttaaaacaagaaaaataaataacaaaaaaaaacccttagattctaactttctttgactgttaaatacagttttctaaattaagaattatggccgggcacggtggctcacacctgtaaatcccaacgctttggaaggccgaggtgggtggatcacctgaggccaggagttcgagactagcctggccaacatggtaaaaccccgtctctactaaaaatacaaaaattagctgggcgtggtggcttatgcttgttaatcccagctacttaggatgctgaggcaggagaatcgcttgaacccaggaggtggaggttgcagtgagccgagatcgtgccattgcactacagcctgggtgacaagagtgaaattccatctaaaaaaaaaaaaaatcataacattcaaaatagcaataagagaagtctgaggaagcaatagggtatctaacttgctaccatatctgctcttttaaagagcatttatgtaaaaaagtaccaaagataagactatacatttccagaaattcactagttgtttttctttaagacgatgagcacttcatataagccatataataataaaaacaggcagagaacgacagtgaagtgctttaattagcttaaatgtaattgacaatgaaccatttaaaaagaatatccttttcataggtgcagttatcagggatgctaacatccctgattactaacactatcaactgagcattataatcaaaatcagagagagtagactactactaagctatggagtaagttaaacagtaacatgtaattcattagttctgaaaggactaattctggaaaacaagcatatctccttagcatcttgtatcttttcctccacctttcaccccactcttcctctcttcagttttactgaattatatccacatcctttagcttgttcctagtaaaacagaaattcctccagggagtgctccctttcagatgttattaggtcgagtttggtggaacttgattcttctacttgcattaataaatgagcattatgaatgtttggaatgagaaagaaggaaagggggtgcaaaaattagaggctttagataacaaagctaaacttcacctattgaaaagacatcattattttgtctaggattagagttaattataatcatttgctcttatcatgtgcctttacctctctttctccaaacacttatttcataactatgtttgtcaagttgttaagggtaatgaccctgttttatcatcaagggggtgggggatcaagaccaaaacaaaacagatgttctaaaaactgcaggaaattgtctttgtcagaatcactgaatacgtgatttttgacttggacagtatctattacaattgaaatagaaaaaacgcagagcccgactgtgggtctcttggtggctgcttcttccaatttatctaaatttactgatcctgagtggataaatgagagtcaagttaattaatgaaaatggttgaaacgatcagttcaagcacacagtttagtagactcattacataaatctatgtaaacagaggtcgattcagattgctgttgtagccactaagcagcggtctttttaatttgaatgcaggcatatttgaatatttgcagtggtgggtggggtgggtagatgtatcttggttaacaatttctgcatatgaaatcaaaaggaacattttttaaagttcattttaaaaaccagcaaaatacatagcaccagacatttaggacaaataatttactagctcaggaatgttcacgctatataaatatactaatgtcaacaaagtaaggcaccaaattaaaaatccaaacttgaacagttattgcatgaggcaagactatgagcaagaatggggaaggagacaagaagagcttcagttagagatatttacctgtggtttagcatcttgtcagaggcctacagcagaaaggctggcccagggcaaggcaatttcaccctctctggtgtcagtcttccttcatatccctttcctttctcattttcccccttcccttccctgacactctactggtggccaaggaaataagaggcaaatgtctgaatcctttttagaccatggctcctttgatctttaattgtaaagacaaatgtgaattagttgaccagggtttctaaaatgtgttgcctgtaatatatagaaaacttctgattttatcacctccctacctgcagccatccttctcaacctaactctcttagaaaagttcttcaagtacaggaaacagagagatccacagaggtcctttgaaatgttttcatttttttacatgctaatctgacattttatccttttgttatttaatacattaagtttattgatcatattacaatgaaatgtttggggttttttttgttgttgacagcctttaagtttacagaagtcatcaagatacggaaagacaaacagaaaaagaagaaagagaaattaatggtgaaatagtcatatccattaattaataaaggataaactaacagaaaagcagaaagagaagttcgcaattgtgcacactgaaagttaactttgactaaacctatgtacagaatttttaaaatttttatatttaataaaattttaagatttattgacttctctcaccacttctgtcatttgatctatgtatagaattttaaaaattctataacaattatatacttatttcagaataaaattttaatatattactattagttttcaaagatctatatatctacatttaagaggtctctgcagaacattctttttgtttcattgcacacttcccagtgtttacacatgcacattcagtcttgaatgatgactcattaactattgatgggtcctggcattctagggcttcccagttgttagctcagtgtattcttaactaaatcgtttaatgaaaacactgacatgtaatgaatctggcatctcccatgatacacatgcaacttttgtaataataataaagacaggcatttgcactattacataaaatcctgtgacttgaaaaggtgtaggctgggcgcggtggctcacacctgtactctcagcactttgggaggccaaggcaggcggatcacttaaggtgaggagttcgagaccaactggccaacatggtgaaactctgtctctacaaaaaatacaaaaattagctgggcatggtggcaggcacctttaatcctagctactagggaggctgaggcaggagaatcacttgaacctgggaagcagaggttgtagtgatctgagatggtgccactgcactccagcatgggtgacagagcgagacgccatctcaaaaaaaaaagcaaatcagaaaggttatgttgaaaattaagctccagttcctgaggtttctattaaacagttacacattaaaatatactaatacataatatgcacgtattaaaagcacaaaaatagttatgtttaagaagtcaatataattatttgctatacaagccccaaatggagtaagcatactttttttattttactttattttattttatttatttgtttatttaggccaggatgctcttgatctcctgaccttttgatccacccacctcagcctcccaaagtgctgggattacaggtgtgagccaccacgcccggctgtaagcatactttagattttagtcactacagttccaaactttaaagtttaatttaaaagaaatgcatatatttataaagacacacacacacacacacaaattaaatacacattagaatgatgcaggaaaacaatgtgattaaaatgtctatggaatgtattcatctcagaattgaaacttatcatcatttagtctaaatatacagatgagaacacagactcctcaattttaggatttagctcacacaaaatcagaatcactgtgctgaccgtggtgagtcagggattaggaagatctcagcaatctcttggattcagtgtctatgctggctcaagttaacatttgctttggagaaactaagttagagatacacaagtaagagataaacaatgtttatttttttaatttttctttctttttttttttttttttttttttttaggagtctcactctgttgcccaggctggagtacagtgatgtgatctcagctcactgcaacctctccctactgggttcaagtgattctcctgcctcagcctcccgagtaactgggattacaggcacccaccaccacgcccagctaatttttgtatttttagtagagatggggtttcactatgttggccaggctggccttgaactcctgacatcatgatcagcccaccttggtctcccaaagtgctaggattacaggcgtgcaaacaatgtttttataagtgctcaagcaggataatactactgataacagatttataggctagaaaaagatgtttttggagctcaaagttctaaactttgtcttgttaccatttattatgtgactggaaaagtcatcaacctctgatcctcagtatcttcatttataaaatcagaataatgactcttgctgtatttatatttcctcgtggttataaacttaaactactgcactagtactattactattagtactattattactaattactactataatactaattccaccaataattgaagctttctatatgccaaaactttgtgacttacttttcacacctcgtagctgtatcaaaaccttctcaatagtcctgtcagataactattctgattttcttctcacctcagagtgattaaataacttgccagaagtcacacggctattaagagcttgcatggaaatttgtatccagatctgactccacacttcattttagatcaattatatcttgttttctctgatgtattatatgtatattcatatacaatatcaacatataatacaaattatctctataacatagatatattattcattttatatacgcacagacatacacttatgctgtgaattctgaaatgcaataccaaggctctcttttctttgttttttaatttcaaagcctaatgaataaaacaaagtaggtatttaatcaacatttggggaaaataaatggatataacagaggtaaaggtaactaagataattttgagtgaactgttcattaacaagtatgtcagcaataacagtggctatttaaaccctcctcatcttcaagattatgttactaaaaattactctagaagacacatattgtatgacactacttatatgtggaagattttttaaaaagttgaattcataggaacagagaggaatggtggctgccagaggctggggtgtcagagaaaagaggagatactggtcaaagggtacaaatttgcagatagaagaagaagaaattcttaggacctaatatacagcatggtgactacagttaataatactgtactgtatacctgaaattttctaggagtgtagaacttatgcattctcacaaaaaaaaaaactatgtaaggtgaggaatgtattaattaacttaattgtggtaaacatttcactatgtacatgtatgttaaatcagcacatatactttaagtatataaagtttaatgtgtcaattagacctcaataaagctgaaaaaattattctacaaaaaaaaacatggattttttttttcaatcatttaggttcaattctaggtacaaggttgactgatagaaaagcagctattttcaataaacgagggctgaaatctaaccctgcggtccaggtaaaaggacagagaaaagattcatttaaaaataacatatgagtactacttttcaaaggatgaacatattattttccaaatttaaatcttccaaaaagctattctgtaatttcctatcaaaacaagataacaatactttgccatatttcccttgactttgtgtaataataatgatgatgataatcaaatagtgacattcaaaaataacaatttttttttttttgcagagttcaggagaagggtgcaggaggtattagaaaagatgcacataggtcttatatctcatcaaagcatgaatttccaactcattaaaacactccattctctgccctaatctcccaaagagcattcagctgaatgaaaagctgctgacattcgtgccagttcacagctagaatgacatggctgggggacaggagatgctgcagtttccattatccattgaacaccttggcaattcttaattcatcctgtgaatgtgatacttactcttgtactgctctggctatggaaagggccgtagatccagtttcattaacgctatctaaggtcacatttggcaggtcatcatcatcactgtcacttttactttgtctgggagataggcctcgggggtccatttgtgctggagagaaaaggcatatataatgaattaaaatcagtgcgcagaaagttaaccttgtcctggaccaacatcaagtatggaacttctgtgcatatcatgcaaatggaattctctagacatcacaggaatcagtgaaagctccaggttttatgttctgagtacttactgattctttttcccttcattggagttacaaaacctaaaccagctctcaagaatttcagggtatggttatagaatagaaactacgaaatccacaatattaccaactcctgagtggtcaaaagctgataacgtagctcctgagctactgttcaaccctctggtttctcctcctccttgcttctgctgccagagctctggccatttcactgctcattagcactctccctggaaggtagagagcatgcggaaaggagatattagttgcttatagctctcataataagttaaaagaacagggcttgcgtgactaaaagaaagtatacgtatttttcttacttcagtgaatcactgtttccaagttcattactactataaggtgggatttgaaggcataaaaatggcagaagtggtagcattttagaaatcttgtttatatgtgctaacagtgctcttgaactctatcctgttttacttttccagatatgattcttctccaatcgtgaatttgccaaagcaggaaacggcacaatgttctgacccctgttgaccaagactatcagatctttcaaatgagagggttacttactgtcaacatatgttaacacatatttttaaaaattacatttcatttccatctccttctccctgtgaagagatttagcaaccactgcccagaatttctatcagccctcgcttcacgcacaaactaggcatatcttttcaatgaaaagtaccacatgagctacacacccacactgttaaattgtatggctgcctaagatttctaaaaccaccactgcttgcgggggaaggcaaaatgcaggtgaaatcatggtcataatgacatttgggtacatttcataatttcatttttttggtctcaaatcactttttttggttactgtgtatcatacattacaccgaaccacatggaattgctgagaatgtaccatttttacccacgaaatggcaacttcggatgattgtgtctaatatttacagtctggctagaaaaactatacctagacggtttcaacatatttcatcacgtttctaactacacttggttaggaaagaatttacatctagtgaacctcgtgtgcacccgtgtatttgatacacatcctgactttaaatataaatataccaaaacgtgctttgcacaatggaagtgtttggtaaatactaaatttaaaagaagataattcaaataatataaagtaatggtcctcaaccaagggcaaatttgcctcccaagagacacctggcaacatccagagacattactgattgtcacaacttggggcgggggatagggagggtgctactggcatctagtgggcagacgctaaggatattgtagacattccaccatgcacaggacagtcagcctctcacagcaaagactgaaccagtccaaaatggcagaagtacccaggttgaggaactgatctagggatttaagagtctggacataaaaacgtgtcacagtttatgactttcagttcctatgcaactatgctctcatttcaacatggctaacaaggaaattgtcacataccagattatccatattttctggccttgtcttaaaaaaaaaaaaatcactgtcatgtgactctgtacctcctcaaatgttaggaattaggcaataatattcattaagagcttttgaatattttctttgtaccaccagctatgagacaaaaagactgtttgttttccatctgatctctggaggagatccactagaagagggatgttggagaaactgtagggcaaagcaaccagttccatcactatctggtaacagacagcttaactacccagtcactcgaagggcacttgaaggaaccattatcatttaagatttattttcgctgtaggcaacagaaattggctcaggctaacttatattaaaagggatgtactggaaagataatgggcagctcacagaatggaaggtcaagatgaacaaccaacactaaaggaacgtaggatccaggaatgactttgtgtaataatatgaattcagctaggaactcatagatagcttcttttggggcaatcctgttctagaatgattcatttaacagccattcacaactattcaaagccagccaagaaaatgaatatcagatctatctaagcttccaaatcacatattgtatggtgttgcatacacctgtaaatgtcaaaaatttaacatttaaagttgttgaaacatcatgcactacgatgcctttgccaagataccaaatttgcaaacagccaagaaaaaagaaaatattctgatagtaccattttgtccaagacaactagagctcttatagtaagtaatacaactcaaggaagatagaggcagttaaccatgagcaatctggctctgaaagttaaagtctaattgtatgaaagattccaaaaccttgtgtgagagttgttacatgatcatctaattatgttatgtttgtatcttaatgaaagtttaaaatatgttaaatatgatatctttttgatgtacttttcaggagcataattgaggatttctttccaatattttcaataaatattatgaaatacatctgctaccatcatgctgggaaaatctttttacccataccttcagccaagctgaggaagtaattagaaaggcttttcaaaatctgcattgctgattaggtcagatgattagcttatctgcatacttgcataattccactctatttttattaaatgtagaatagggacatcaaccctagttaacctccatcagtctttgagcatctcagcccatttaggaaggactgattctctggcatgcccatttaaagaccaaagaaagttatctggacaccagaaacaaaaaaatatcagcctctgtaagtaagagaacaggagatgatctataaacacctgaaaaaaatttacacttaagattttattgctctttaatgaaaaagggatcagacagttttgggtaacccagctcactgctggtagaggtgtcattcctcggagttggaggtgttctggaatcctacgtgagtttcattccatgtgtcaaaatcctggggagaaaatttcagaacccaacacctgaagttgaactgatatactctgattttcaaatactctcctatggtagattgttactataacgatccctccaataaatcatgtctgtctgtatccatgccctgatgtggccacttctcaacaatgactctgggcttggctctaagacttgaagtgaccaatgggacattagcaaatgtgacacaagtagaggcttgaaaagcacttgcaccttgggtttccccttttcccttgctctttttagaacctagtcaacttgtgaagaagcccgggagagcctataggagacatgctgctcagcaggcggccaatcccactgtgagccatgtcagtgagccattttagactcaccagctacattacagtcaccagatgactacaccatgagtgaccccaggtgagacctgcttgaaaacctcttggctaaacccatgccacatttctgactcacagaatttgagcaaataaaatacctgctgttttaggctgggtgcagtggctcacaccactgtaatcccagcaccttaggaggctgaggcaggaggactgcttgagcccaggagtttgagaccagcccagacaacgtagtgagacccaacctctacaagaaatttaaaacatcagcagagtgtggtggcatatgcctgtagtcccagctagttgggaggctgaggtgggaggatcacttgagcccaggaggttgaggctgcagtgagctacgatcacaccactgcactccaggcctgagcaacagagtgagatcctgtttcaaaaaaaaaagaaaagaaaaaaaagaaaaacaaaaaaaaaaaagaaagaaaaagacaagacttgctattttattccactaaattttagggttagttgtagggcagcaataaaaagttagtgcaccaggttattctcccagctccttctagagatttcctagcaatgatggagatgaactacaactacaattacagtcagcctacaacaatattaaattgaattaagtttggcctaaagctgcctctatacatgttttaagtttggcctaaagtttcttctgtacatagtgaactgtaacctaacttgacgtggaaacagaccgtaacctcctcttgcaacaagtagctgagtttcggtcaatcaaagatggccaactgttgaaaccagattcaattaaggcatatgctgcattttaaccaacggagctgtctctgtacctcacttccattttctgcatgtcacctccttttctttggctataaatataatctgcatatgccgtagggtgaagcattctgaacatttttggtctagactgttgtctgattctggaatcaaattaaagccaattaagatgtgcaaaattagatttgtttacttttaacaacattcttctttattctcctcccaagaaccaaccttgttttagtgacataaaagctacctactgcattctgcatcatttacttttcaattcaaaatattcaaatgtatttacaggtgttttggcttttgcagtatcttctttgatccttcagtattgtgcagctaaggttcttcttgggccctaaggggccatttagttatgatgaacaacacttatttatttttatttatttattttcagatggagtcttactctgtcacctaggctggagcgcaatggcgcgatctcggctcactgcaacctccgcctcccagatttaagtaattctcctgccttggcctcccaagtagctgggattacaggcgacagccactgcgccggccgaacactttttcagctcttctcctcagctgagacttgataggatgctcatatgggtgggttctcactggtgtatggtcacccaaaggtatatttcatgttttttctcttcagctcacatgagacatttaaactttgcttgtttcctcccctcatgtaatagtagactgacacagatgcaggggacactaattcattctcacctcccctcaccccagcctgcctgctgtctaaagaccaaacactcttctaacttctgttgaagtaaacttgcctatgcacccactcttaaggaaaaggacattcttctatttctataggttgcaatattaaatgtgtacgacacaacaatctaagaacatatatgaaaacttacagactaacatttcctaacaggaatgaatcccagaagcagatactgaatcccttcacctccacgcgccagggctggagaggagagggccatacacagatggaaggtgtgaagtggctgcccaggcaggcgccacagggctgatggacctcttttctccctcttttagctacggacaggctccctgctatctgcaggtgccctaattgttcgccctgccaaggctgaaacatgtcccagttagagaaaccccggcttccaggagagctgctggtttattctagaaaggagggcagagggggagtgcaggaacaaagggaaaaatgaatgtttggggaggaatgtttgggaaaattcatagtatcagtaggtagaagaatcctcctccaacacattctatgcagaaattgttccagaaaaggagggtcaggaagcttctttaggataaaaacatggctctggcttcagggaacatgggatgacttctggccctgtcatttgcaacatctgaccttgggcaatgattttgcaccgggaatcttcagtttcttctcctgctactgctgctctaaggagtaaagaagataatacatgcaaagcacttagtcctggcctggctcttagtagtcaatcatcattccattttaccctgacagtaaatttactgcttcttcactcattcccttctataacactccttctaaatctctcaccatctcctggactattcaaattaggcagttttcttttcacgtgtacctaaactgaaaataccattacagaggcagaacacatattggataatatataaaactactacttatttacatcatttatgtatttagtcaacagatatttattgaacacctacgaggtagcaagcagtcttctggctggagaaagaagagtgaaaaagagtgaacagattaaaattcctgctctcatgctgcagagatacagatcattaacaaaaaagaaaaatatatactacgtcagatagtaagtgccatatagaaaaatgaagcagggaaagcagatggggttgcatagtggcagtggacaatttttgagatggtggccaggaaaggccacatggagaagaagatacttcagcaaggacttgaaggaattgagtaagagaagcttgcaggtgagggtttttgggttttgtttgtagggtgaggggcattccaggcagagaagataacaggtgcacaggtgataaagtaggaatgtgtttcatgtgcctgaggacctgcaaggaagctgtggctggaaccaatacagggaactggatgaggacagagagaggaggcagaggagggcatgcagagtacagagggccttggagggtgacataggcttttgaattttgctctgggtgagaagggaagccattggagggtactgagcagaaggatgacatgatacaaaattttatcatttgataaggatccctctggctatctctgcctggagcatagtgggggattcagctggagccacacacacaggaatcatctatgacattaacattccctaaaaacaacactagctttttttctccttggtcacctcctgctggctgcacacagaatcagttaaaactcaggacttggttacatcaaggtctatgtggcacgtccttcctaatatatttgtacaagtgatattctgacttcatttggtttcagaatatcagttgttcaaacagactattttcctagcacatcaagacagatagtgagagaaacattcatgagtaaataaagcttgactcaaaggacggtgaactccaagattagaaatagctctccagggtcctgttttgtttactaatgtttcgacaatgccttgtttcttgtttcctttacttttgctaatgctaatgcctctacagagcagcaactgtgatggccataaccccagatgactatttaaaagttcaatcagttatgtaaatcttgggatgttggtactgtgtagatataatatgcaatttactcatttttcccccaatttttgtctgttcacttgacagtgtaatggcttctgctaccattatattaaaaaataacctcataatgttcttataattccctagtgcaaggtccacttctcagttgtaatgctgttggacctctctacagttttcaagactgttggttattccttttcactttcatttctggcttcttcttaaaactttcttctcccttggcctcggggataggcaaattaagccctgtgggccctgccacctgtctctgtaattaaagttttattcagccatggtcatttacttcatatctggcatctttagtgctacaaaacaggattgagtcgttgtcacagaaactgtaggtctggttataaaatactatctggctttagaaaaagtatttgctgactgaaatacattattctcttgggcctttgtctctctctggttatctatccttctaacttcttcatctcctttctgtatacccctaagtgttagttgctgccctaggtttcgctacctattcttttctgtctgcctctttattggtgagcttctcagcaattccaaagaattccataatttccccaatttcaattgctatctcagaagggatgaataccaaatcaacattctcagctctgacctctcccctaaacaccagtctcatttccagcatcctactgactagtattcctcaaaaatcatttcaaacacaagtcctattctttctcctggtttctgagtttcagctgagagatccttttcccagtgacccacgttccaaactttgattcatttcatttgtgcccctcattaaatcggatgctaagtgctcttgcttttacccaatgattattttcttttcccactgcttttcatcgacttccttgaagtcctattgtacaaattgtcccatggagcatttctctggtaactgaatgtatgcagggctttccttaagacattccttacttagaaatccttgactttttcccactgtctaccgaatatggttcagcagccctccgcatcctacaactcattttccactgggagcaatgatgagtcttatccccgaagcccctgaatccagctttatctagccatttccttccatttcacaattctgccaccacaatctacccttcctacagaataataccttcatgacccttcttttccttctctaactacatgcatctctcctttttaaagaatacctatactttgtatttatatattttcatggcatttttgcactttccattttgaattatagttaggcatacacttattttgtttctccaattatgctgtttactccttgagaggggagaccacgtcaattatactcccttgtacacagtaaaatgtaaagtttaatgcagatctctactgaaaatgatcacagtaattcccagctgatgagagattctgcaatataatgatgcaagtgtctagctcacatttcatttaaaaaattacattctgacttacattctaatattaacatttgtgagagaaaagtcacaatcattaaatttctattattctctgaagtcttagattatatttttggtttgggatgacatgggaatgaaaacgttcataatttttattcacttttcagctaaattccatttaatgggctttcctttcaggaaatcattttaaacactaccaaatacctctcatttctatcacatgaattaccgcttggaaactaaaatgaaggaatttcatccttcatcctagtttaggctgggtgtggtggctcatgcctgtaattccaccactttgggaggcccaggctagaggatcatttgagcctaggaattcaagaccagactggattactaagtgagactccatctctattaaaaaataataataaaatataacttaaaaattcatgtttttttgaagtcacaacagctactagagtttcatttttctaaagaatcatgactaagactacttttcttgtttataaaaagaaaatgaatagagatttacaattgtcttgtttcctgaaagtacgtcttagagcataaaaggcttttgtgatttctaaaagttcataaaattttccattaataagtaggtttttccactgtgtgtgcttccactaactctagagctggccaagagccctgaactctaggagccctctgagatatcaccacaccactattccccataacctttgccttttgttcattcattataactgctccaaaccaagccaatcagctcaaaccgatttattcaaaactgaaactactataggcagagatgtaaaataataataaagtgattttgtggtacacacatatggagaacaatgagatcaccaaactcattttcatctgcaatgtacagagaaggttttaggcattaatccatggccattttattcacttttcttatttcccttagttggtctgttgcccctatctgtgttttctagtttgtgtactgagtaaaatggaatcttttaaggcagattaaaatctgttataataattttaagtatcaccaaatcacagccctagtcttaggtactttaaatgtaagaaatacttaaaaaaaaaaaagagcaaaaaatccacctcgaacttaagtctgcttttatatcaactatgctatatacagctagatggtatgtaaatgatttaccacagaagggttctctgctagtttcaaagttgaaaagttaaaaaagcaaggggtgggcggaggcatgcagaactattgtgccacatagagaatcagtgttgctgtcttcctccaattagtatgctctccgtgcctcattttagaatatatttaaacctgcaaggttaaagataagtcttgatacataatcatgattgaattccttttagaagcagagtagacgttcttgaagatatggtctaagactatcaaaaatcctcaaaattgagaattatttatatacatactgttggacctttctatagttttcaagatttggttatctctcttcatttgtagttctggcctcttcttttttttgagagagagtttcgctcttgttgcccaggctggagtgcaatggtgtgatcttggctcactgcaacctctgcctcctgggttcaagctattctcctgtctcagcctcccgagtagctgggattacaggtgcatgccaccatgcccagattttttagtatttttagtagagacagggtttcatcttactggaaaggctgatctcaaactcctgacctcaggtgatccacccgccttggactcccaaagtgctggggttacaggcatgagccaccgcacttggcctggcctcttcttaaaaactctcctcctctggcttcagggatggacacatttgtccctacaccctgaacacgtttccatcaagaattacatatttcttgtgtacatcttcacatcacattaaaaaaaaaaaccctatcaaagttttctttctcatttgatcggttgataaacacgtatacacagagaacatttccacccacacttcacaagagttactgtgcgggccacaggcagagaacacaaagtgccattgagatgagccccgtagttgtgcagtctcactcataaactgacccccggtgcataggattctaacttggaacttaaatataagcgctatataacagacttctgggacactggaaagcagatatcttagatgttgtatctgtgaatgtcagggtctcctctgctaaaatcatgaaatataatttttctttttgagaacaaaattaagtgctgactcttcacttccccagtgcattcctcaggattgtcccatcctatggtgaatgctgtcactattcaaaaatgactgggaatatcttcgagccaaaagaacagtattactgtattttttttcctgtgtttcaatcttggttgaaggacgtatttgttcatgtcctcatcttataccaactccgaagagaaaaatttactctgtaaaattggatgaaaggtcttttccacattaattctgtttggtatgcttttataagaaagaacaattccattagtccgcatcaatctattagaaatatagatttctaatttcaggctgggcgcggtggctcacacctgtaatcccagcactttgagaggctgaggcaggtggatcatctgagatcaggagctcgagaccagcctggccaacatggtgaaaacccatctctactaaaaatacaaaaaattagccaggcgtggtggcgtgcacttgtaatccccgctatttgggaggctgaagtaggagaatcgcttgaacccaggaggcggaggttgcagtgcgctgagattgcaccattgcattccagtctgggcaacaagagcaaaactccgcctcaaaaaaaaaaacaatagaaatatgcattctctgtgttttggagtttgttaaagagatttccatattttgtaacagtgccccccttctcctgcccctgttatgataaattggctagtctctgtgaaggctggtgaggtttccacgaactagaatggtatgacttccttgggcttcaggtatggccactgcattggagtttgtttggtcagaccacttcctgagcccaggaactcaaggctctggcttgtttagggaggtggcagtggcagtatctccggaaatgactcttgaagaacaagatcaaagttaaaattctgtctcgagacagtccaggtgcagcaagtgagaacactgctatagtatacactataacaccaagagagcataggaggtacacactagtcttctctgctttcccaactttaaactgggcttacactaacttctttagaaagcccattttggttttgtgaaaagagacattttctaaagaagataagagctatgacagaggatgaggtcttggcctttgccaggcaaatttctgataaattgcatggtgcttgaggttgctgtgtgtagttgtttaataaatagaaaggttggatactgtcttttgtaatataaggaaaacagattttctactgaaaaaaaacagagaaattcataccgctctaataatatgtattctaaacatcatctggccttgatttccttgaccaaagatgccaggttacctccactctaagcacctgctgtccctgaggctagctgagatctgagatccagggtgtctcattacaccccaaccaaacccatctgctaataagagagtagctaagctttctacatgcctgccacatttaagctatcaaataagatgtcaggggcaaatcaatcattcaacatttttttttttttgagatggagtctcgctctgttgcccaggctggagtgcattgggacgatctcggctcactgcaagctccgcctcctgggttcacgctattctcctgcctcatcctcccgagtagctgggactacaggcgcccgccaccacgcctggctaatttttttgtatctttagtagagacggggtttcaccgtgttagtcaggattgtctctatctcctgacctcgtgatctgcccgcctcggcctcccaaagtgctgggattacagtcatgagccaccacgcctggcccttcagcatttttatttatctcatttctgaaaggagaactccctaaatcttgaaaatcatttcttcccactgtttctcacatccaactattcttcatataaaagaaaatataaacaaccatttaacatagggtctagtacttgctccctcattaactcgcttataaacttgttacttacagattttctttcatgtcaagtcatttcttagttaagaaattccaggcttacataaaatggctatttattttcccaaaagattcaaaatatctaaacatttcgtggtatttcttttagatcattaagttaaatatcacagaaagagctgaaagctcctttgtatttttttaattcctattttgtttccttcttccacagtattctggtgtatatccttcccattcatatttttggcccttaactacatatatgtccatgaacaatacctacagttttgctctttttaaaatggcatataacaatatcatatctacacacacacacacacacacacatatatatttttttgagacagggtctcactctgtcacccaagctgcagtgcagtggcatgatctcggctcactgtagacttgatctcccaggcttaagtgatcctcccatctcagcctccagaatagctgggactacaggtgtgggccatcatgcctggttaacttttgtattttttgtacagatgggtttcaccacattgcccagactgatcttgaactcctgggcttaagtgatctgcccaccttggcctcccaaagcacaaggattacaggcatgagcctccgcaactggccaacaatatgatatttctatttgattttttcatttaacattgtatttttgagatttattcatactctttcatttaatagtaaaagataccattttctaaatggagcagtattagttatctatccttttcgtgatgaaaaattaatttgttaaaaatattcactattacaaatgctgctgtaactttcttcatagtatacatctgagaattacggggtgcccatatcaattttaccaaatattgccaaattgatctccaaagttgttgaatcaatttacactcacattagtatgtgaatacccacgtttccccatactgttgtaagacttaatatttccagatattaaaatttttctgaagtctaaaattattccatgttgtcaattctcctcccaaatacaagattgagcatgctgtaactatccaaagaacactcccaccttccccatttatcatttggtccagaattttttatttctatttttatttattttttattttgagacagagtctctgtcacccaggctgtatgtagtgcaatggcgcaatcttggctcactgccacccctgcctcccaggttcaagtgattctcctgcctcagcctcccagggagctgggattacaggcacccatcaccatgctcggctaatttttgtattttcattagagacagggttccaccatgctggccaggctggtctcaaattcctgacctaaagtgatccgcctgcctcagcatcccaaagtgctgggattacaagtgtgagccactgtgtccgggcccatccagaattttggtgcatgttttactatcaagagttaattaaaagttatcttcatgcatatatttatctacatttttcaaaccagttctaagctctcctttccttttgggtttttctgtttgcaaaggtatattctttatgagtcttatcagcataagactcatatgtgtgggcactaagctctcagtcaatgtatgtctgaattttgtttttttttaatttcactcttaatggaattttatttcagcccagtacagaatttcaggatctttcagccctttgaggagcctattgcattgctttctggcatctgttggtgcccaaagtcttttcattcttaaattcctttgcagacaagcttttaagattttgtttagggaactcatgcttgacaatttcactgtactatatctagatgtgagttgatttttactgagtttgtctaaaatctaagattcataatctcccttaatttttccaaattccaagacatctctctgaaagttgcgttctatctattctgataaatgtcattttagatatacgtcttttagatataatgtctcttaacttttctttcatgtttttgtcagcttttctacttgtgccagaacaagaacctgggcattatcctagatttatcttttcctttatccttgacatccaactggccaacaaattctatcacatttccattcacaccaccctgctcaggctctcaggaattctcacgtggcttcctgaaatagtctccctccctgtattttcaatacattcaacccttcatgcccaaaactttaatgttaccatgttaaatcccatctacttccaagtttcctatgcttccctgtagagttcagtaaataaatcgttagcttggcacagaaggtctgtgataactacatacatgaatactgcccttaagcttcatttccgcttcttttaagtacttttcatttgaacaataccaacttatctacttgtcgaatctatctaccaggatacagtatgcccttttgtatttccaagagtgcattttttaaaaactgcccttcctttcctccattgttacacagagaatgtaactaatactttcttctgagaaacagccttctcctgaagtgatagccacacctcaccgccacccaacaccaccaccgagtatactgcccctcttcctttgcaatccacctctgtgagcctgggttcactggattacagagcttgtctcactgtggcttttttgtctgctttatccatttgactgtgagtgtattgtgggtactgtacgttgtgcatgtggttaaatcatgaatgtgtattaatcacatgaataagtgaatagaaagaaatacactgcacaattcccgggtaaagcaaaaggctgaaaaattggagattaaaatttaaaaaagaaatcttaatttttgaatctggcaggccaaattttatttagttttgacagatgagtcagagagcaacaaacaaaataaatcagtactgtaatcaacatatctgtttaaataataaggatatttttctcagatgttacaagatagaggataaaattcaagagttttataacaagtcaactagtttcatttggtttataaagttctaggtggtatcattttttaataaaaatatatacatgtccacatatatctgtctctgtatatgtgcatttacatttatacatagatgcataaataaggtctagtaccaagttcttctctgagcatattctaatatgcccgggtatcagatggacactgcattctgaaacttacaaatatgcaaggcctctgcaaattctgactgcctgaacaataacaactgactgaatagtaataatatggctgagctccccagtatcttttctggaataaggtatggaatgaataaataatgctaaaaaagtctgtggtggcttactcttgctattaaggatgattgcattctcaacgttcttcataattataaatatagaacacaatactgaaaaatagttataaaccattcagtggcttatttagacttgtaaatggacaaaactgtaatcctctgtttatatcagatcacacaaaattatatagttaaaactagtgtaaattatgattgaaaggaggtttaagtatgaaggacttatcatggtgactattaaagtaatcacaattggccaagacaggcaagaaatgtgcttgttaatagttgcattagttgcaaggtggataatgagataataaaacacataattggaggttatactatcttgattactgtagattataccaatgggcacaataatgccactaagcagtgcatcaccagtgagcactcatttgttagatgataaatgggtaatgatctactataaccataacttccagaacgtgacagaaaatacttcctatgacatatcatgataccaacacattttggacagcaggcaagatctttcactctttgataaacttaataaataatagagaactacaaaaacagaaaagatactatatggctctgaaaagacactgaaacaaaaactggaaaatgccagattttactatgaagctattctccataaccaaacacacactttattgaattcattttccaattttgaagaaggcatttctgaacatctgctatataagcttggataattctaaaactgtaatgttataatgattattagctattggctagtgctcagaattttattgaactcattaatctaagaaaaataaatataattataacagtaataataaatgttggccgtgtctttatttttgtagtttccccttgtgtcttccagaaaattactactaccacaacgaggcaagatagaacaggcgtgtctgtgttgtatatgtctttctaaccaattccctgctcaaaagagctctaggcaggggccagatatgtctaaaaatgacatggatgtcgatctctgaaacgcagtgaaccacactttgactaaatttccctgcacctagaaatgttaacctacagcttaaggctgttgtttttcaggctgcaggatgctaaagaaatgaaaatacatgatacagtactataatatcaatatttagcaacatggaattacctcacgcaattcatacacacacacacacacacacacacacacacacacgcatacttattttacatacagaatagatttcatatataataaattttaatccttgtcaaaaaactgaatgatttaaaaacataatgccacctaatttgaggaattatggaattggatatttaaaactgacacattctctagataattaaggcatactttttaaagcatcaagcctaagtacagcaaaatggctatggagtatttagaaattctgacttaattcaaggctctaccactcttaagctgtgcccttataagtggtacagaaagtgatatgagtcttagttttctcattgcaaaacactgacaataatatctacatgttggttattgtcaggcttaaagataacatatgtaaagcagaaagaacatataagcactctataaaggttatttaatattatttaaatgatttttaataaatatatttacaagatttattacatactttgctacctttttcaaatggactgatgataatttaacctttctttcattactaatggtcattatttcaaaagcaattattacgctgtaataaagtattctctccaaggactaaagcgccgtgttagcctgtttgctcccatccagaaagaccttgctgcaattattcaagttcttgttttaataataattttgacgttttctttgctggctgccacttttttaccctcagtgcccctacagataaagggagtttcctaatttgggaagggaattggcagatgagaatctcaggaggtattcagcatctataaactggtaaagcaaaatcagtagatctattttctttcagtaacaaaatctacagaaagagaagtgctacaaaattttgtgactattgggcatccataaaaatctactgagaagacattttggggaacccaagttataaaaataacgattgagaaatattcctatcacttatttttctttgcatttttatttgctattctctacttacgtggttagaaaattatattcacaaagaacataacaaatatatccaagccaagagttaaaatgctttgaaagacggaggatcttgagtcctttcctataagtaacatagagtacatgtaatgtagacaacatattttgtatcatatgcagtgtctgtgtgggaggtgacctcatgggctactttccagtacaagcacagtattcctcattctttgtgtgccctccattctctactctcattatttactcttttcctggtctgaaacactcctacctactttgagtaccaaagctttacgcttctccaactttcgcctcaaatgccacctactctccccttcttataatgtaagacttcctccagagtctagttcatgttctctggagatttacaacctaggcctctagaaggtttcctctgtttaaaaggtctctgtgtttacagaggactgattcacagcattcacgtctgacaaaggccacaccggagatgattagggggagcccttggatttagcacagaagagacaaaaaagcaatcaagaaattgaaaatgccttctaaacacagaacactggaaacaattcagacaaagctattttagattcgtgctgcggtttacttaatacgtttttaagatcagagaactgaggaggaaaaccaaatctttgttttatggatgcaacaaatgggcccaccatgctaaatacatcatttattctttctcacagagagatatttaactctgtggtacaaataaaagtagcaaagtagcatttcccttctacttaaggtttgttaaaggaaatttatgcttttaaaatgctctacaaacaccaaaaactgattgtaccattatcagcttttaaatcaaaacagcttgctatctgctaaggacaggaaaaatggtcgatttatttcataaaactttatgtacaaagagacactgcctatgaacttaatggagagaatatagagtctggagaggtaatttttattacaatttatagtgggattactcatactccacagttttcagattttatggcatcatgatgctgatgcagttaactgcagtggggtaggaggcataatttgtttcgccctgagtgggaaatgaaattggcgttactattatataagaaacttagcagattctattaattgcctggatccaatcaaagctattagttatcctagtttcacaggtaaaatattttacctgagagtaaaagaataaataagaactgactacaattttcatacagcaatatctacgtattaagactgtttggaagcccaaagaatatttcttacccacaggagttcatctccagaaactactaaaacctaaatcacatcaagtatctataaggtaccaccaaacattattctctaatattaagtgctacaaaataaaacaactagggaaacagcagaaacaatgtattcaagaacaccaggcgactacagattgacataccacagcaacagcttgggggatggtattcactcattctgcacttaagagtgtttattgtgtgccagatgttggataaggcagtaaggcaatgagaaaagatgatgtgtgtgtgtttgtgggggtggtggtggtatatgaattgccttacaatttggtatgtactgtttcagaaaagaaggcatttgagccagatcttttgtcagagaaagaaaaggcttccctttgctttctacatggataaaggtagaatgtcacctgaagggccacgcaacatggctgggacgtgagatgtatttggtggaatggcaacagactgagagggaggggtagtatgtgaggtagatgtgaggacgtgcggaggcttgctggttacatgttatgttttggcagcctcctatttcaccatgggaaggtttattctactgtcagggttcagactgcacgtctacactggccacacagcattcctaagcatctcacacaaaacactgttcctgcagtgtttcccacattaatgcattcatttcttcatccatctcttcagtaaatatttattgagcatttactagtgtcaaacacgatgttggggaaatattagctaatgaggcttaaatggtactttcatggagcttaaattgtagtgtagaattcggggagaacacctcctccccccaccacaacctctttattttagaaatgagcatttataacaatataaaccacattatataagcaccacagttctcagcagaggagcttattcttactatacgttacccaagtcctgctatatctttctctccccaaagaactgagaaacccatatacctagcaaagaattacccttcttctaattctaccatgctcctactgaactcctaagaccctagtatttgaaaaggcagtttatctgatgaattctccaagggctattcctagttctctcagttttactaagttttcctacattctgttttcctgaactctttctgtcccaagacataactgtccattgcatttattttcattttatcttattttattttacttttatgagacagagtctcattctgtttcctacgccagggtgcagtggtatgatctcggctcactgcaacctttgcctttcaggttcagccaattcctgtgcctcagcctcccaagtagctgggattacaaggcgtatgccaccatgcccggctaatttttgtattcttcgtagagacgaggtttcgccatgttggctaggctggtctcgaacttctgacctcaagtgatccacccgccacagcctcccaaagtgctgaaattacaggcgtgagccactgtgcctggtccattttaattttattttctctctctgacattctagggcactggtatccttgctcagtgggttcacctctcagcaaaacttcctagtagcacacaagttgccatatatacgcttccatttagccaacaaacctaatccatagttttaaaaaacactaagcacagatacacagaatgcagcatttttatttccactgaatagagtcacatgcaaatgtataggatgggaagtgggataagcgggtagaagttaaaccttttttttttttttggcccaaatcaaatatagtcctaaaaaattttcatactctcgaagtctaaaaacaaagtagataacttaggtctcgaattcaggtttgagttttacttaaaagggtcatattcaccacactgtcttgcaacactaaactagctgggaaaatccgggggcatggaagaaaaaataattaggggcatggtagaaaaaataactagattacctagagttctcgtgtctttcagttcatgtcattttaaaattctgccactagatggcaataaaaagactgtccttttcattacaggtctcatggttccatattacatgacttctggaaaaggtgatttggttgatatgaaagagaaaaatcaagactcagaaaaaggtagaatggtgaggagtggagggagacagagaaaaacaactgagaaaaggaagaagacagaaaaatggagggaaggtgagagaaaaaaggtgttagaactgagggggttactttgaaagggaggtgcagaaagggcaaggaaaagggaaggggctgagtgaaagcaaggagagatgcagtggggtctctctgaaactttttggacaggaaccacagtaagaaatacgtatttcagcatgactagtatatatacacaccccctgcccgcagtaccacatttgcatatatgtaaacaagttaatgaacaaaagtttcatggaataatatttatttgggtgacactctcagatacttttcaacctactccattctatttcatttctttaaaatcactcattgtgagctactaaactgatatccaaccagaaatgacccccagtgtgataatcattttagtctactgtaaactagagctggcttttaaaaagaatttctcttttaagtgccacagctaggactgggagatattcctggctttgtaaattgcccataaaacatttgttgaataaatgaactaattattaaaagaaaaaaaaaaaggtgaagctgcttggtcttgaaaaacacatacaattggccaatgatcaaagtagcatttcccctacataaaggtggctggagaaagaattgagtatgtgattatcacccagtaaattggtagctcttttttatttattggatagaaagacaaatatcaattagttgttttctaaagaatacaaagcagaatacccagttaatcaaatttccccattaacaaaggaaaacaggcagagtgaaagagctgagaaaatagtaacatagtctggaacagaaaaagaattattaagggagtaagaaaaaaacagggaacagaaaccacagccacagagttgtaaattattaaaaagccaatttaaaaccgtgctggtaatgattctaagactaagtttccctcttgaatctcatattcttccttctttcatttgttcctactaatgaaaaggtgtttacttactaaatatgttttcacatatgtatgtatttcttacagtgagtatagatgccaaaataattctacaaatacttgcaatctactatgtagaataagaattcccttgtagcataacagcacttgtactatatgaaatcagaagcatatttaataagaacataattccaggatagaaaaaattagttttttttaaatagaactattcacaagggaaataaaagatattacacatcaaaatccaatatgtaacattcaatgtactaaatattatcagagaaaacttttcaggtttggtgaaaaagtaaatatgtagattacattagaatactttaccagtaaaatgtaatttaatcatagaagtatttctttaaacacaaactaggtctttttattataggagaaacttgacctaataaataaaatagtgtgccaggttaccttattcggtagtacctaatatcaccttacaatgaaatgaaaacaaagcccattttttaaacatcttcttgctttagctgctttacctaacaaatggatttgactgtcctgtttatcttcacttccttaagtaacatctaccttttaaaatgatccgtcctgggtatccataccttctcctcttcctcctcttttctcctttaaacttttatttactatttaatgcagggaggtgggaggagctaattaaactcatttctgggcattttacagtctatgaggagcttagagttttctcctttctgctagctctcttagaacaatacagacagcttctgtctcctccctgcgccagttattatcatcgaatcttagaactatcctagtctatgccagatgaagcagcgaaatcgacagattgtaggcatttcagataaacaagagcgtaagaagccaattttttgatggaatctattcaacctcttgtgcatgcccagaagtgaaaaaatgcagataagtttctaccatgttgaaaatcaggtaaaaataaaccacaaatcaccaatgtatctgtaggaaaaaaaagggttctgaactcacagtgaaaattcaatatttcataaacatgggctgcctgcctttctctcactatttaacaagctcctatctttgttttgccataagagtgaaacactcaagtcttatcaaagcctatatttaataaacataaaccaaataacagcaatattccagtcccatttcccaataaacaacattaaaaaagtaaagaccataagtaacttgctagtttgtcgataaaaatcaaattctaaattgaagaattaacctatggctagtagtcaccatacttaagagtaaacagaatcaattcatcaagggaagcaaagataacttcacacataatcacaggtcagctatctaggactattctgtcatatggatgggtgacgccaggattccaccaaatggtgaacaaaagaggacagtcacatgtaaggtagacagaagcgagtctgtgacatgaacgaaatctctagcaactgagtacaggaaggattcatgacctgaaacaaagacaccaacaagtgagaacgctggcgacagaagaaaattagtgaaacaaagagatctgaaatgggaagttccatgggaataaactccagttgcatcaacgggacagaacctaggtcacaatgcgcaatgagttttgcagcaatctctgtgatgactgtattttctttcacaaatataaccagcatgagactaaaaatacacttgtggcttctttctataggctgctgagaaaagcaacagcctgtaggaagaaaatggggtgtatttcaaattagtctacagccacatccctttgaaactcctgaatggatgctatgaaaataacatatttttggaggattcttcaccgtgtgtctgtgtctaaatatagtaagaaagcaacattctttaaaagaagaagaccaaagaaattgcacacccaaattggattagtttcttaacagcagtatcaacatgttctactcaggtattttgggaaaagtacttcatactcaaggatctaaacacatgattattttaataagaaataatgcatttggacctataataagttattttttcaagtatgacaccatttcaataaaagtcttaatgtaataaatatgttttgctaaatgctgatagactctgcgctgctggtgttaaatttgcatgaaagaaaatgtgggatggtaggaaaccagagctgggctctttttcttcaagcaatctattttattaccgtcatctggacatttgattgcttttgtgtggctaaggaaaagacagaaatgtagcaaaaggggagaaatagcagagcatctacataagttaataaagaacaaaaggatagtggttaggaaagaaaattgggcaaagtaaaatacccacctggctgcaccaggcttctgcaggccctgatggtttgaaagccactgatcaatcacatccttgctcaagtctcactcccaggcatcaaggttaccatcaaggttactggctcaggtatagaagagaggagatgcgtccttttgtttttttctccccagatctttatttggctatgacattaactttttttttttttttttaagatgggatttggctctgtcacccaggctggagtgcagtggtgtgatctcagctcactgcaacctctatctcctgggctcaagtgatcctcccatctcaggctcctaagtacctgggaccacaggtgcttaccaccatacctggttattttttttttttttttgtatttttggtagagacaaggtttcaccatgtttcccaggctcatctcgagctcctgagctcaagcaatctgccttcattggcctcccaaagtgctgggaatacgggcatgagccaccacacctgtctgacattaccttctatgtatcttgaatttctaaaatgtaatacctattaatgtttaaatgtaaaaaaatgcctttaaaggacaaagtaataatttgggactcatggtttattttcagttatcctgcacattccactaaacaatgaagaaaaaatgttgatcttataatttctggtatcatttttataattatcaatggaactcaaattttacttttatttttacttgtttgctaataatccagtaaagagttgaaaatggacaatcctaaacaggaagaattatagaagcaaagtccttaattgcacgttattgcttatattgtactgtgaacacacctgcatcttgcagtaattaatctgaattctaaagtctatttattatgttgacaaaattgttaggaaaaagatacataatggaaaatgaaaggaactacaaaaaacagaagataatgatgtaggattattcctgatggcatataaacttgctatactatctccttcttttaaaacccctcccttgagaacctaatgcctctccagctctcattccatttctctacaactctttaaagcaaaactactccaaagaactatcgagactttcagtctcctcttcctcacctctcatctgaacaccaacttacttcaggcagtcttttgtccccaccattccactgacacactgcaggtcagtgtcaacgatgaacactccctcgccaaatgcacaattctcggtcctcattttatttggtccctgagcagcatttgataccattgacaagctgctcttgaaaacacgctccacctgcattctctttaacattactccactttcctcatgaacagatgagtttccatgctgactcttgcatccctcttcactttctaacctcacaatgctcaggtgtccagtcgtccatgcttctccttctccatttggctctcctgagatgatccctagtggtacccaaattttatttctccaaatctgtctcctctttcctctgagttccaggctcgcccacccaactcccatctcaagctctattaaaatgtggaacaggcatatcaaatttaacacgtcccaaagggaattcctctctcaaccccactgtgctcatcttagtagagaacaataggtcagccaaaaacctagaagtcaccctcacttcctctccttccctcatatcccaccatccgacccatactgcaatagtcccctttactagttcttcctagttctgctccttccccatattctttacagcatgcagtggttcaacgatttttgtaaaaggtaaaacggatcatgtcaccctcctgttcattctgaacccagtggcttcccaacatatttaaaacaaaaccaaagactgtacagcattgccttgagaacctaccagatccttcatttaccctccccttccctccccctacttaagcctctctagttccaccagcctcctagcagctcctcctcacaaaggccatactcactcatgcctcagagtctttgaacctgcagctctctctttttgcaaaggtcttccacagctattactgacacagcttacttctcagagaggccttccttgattatacctaaagctgtgcccctctcccattaactttccaactcccttatcatgccttatttgtcttcatagcacttgtagcatctgatacacatgaactgtcactgctactagaatgtaaggtccctgacagtagggacttgctcattttgggacaccaattcctagaaatgtggttggtataaggtaaatgcacactgcatatcggaaggaaggagaatcctaaacgcgcctgctcttccatcaaggcaataatgaaccaagaataactttgcctgagatctgtcttgaccctctatgccaggggtgtccagtcttttggcttccctgggccacaacggaagaagaaaaattaacttgggccacacataaaatacactaacactaaggatagctgatgagttttaaaaaattgcaaaaaaagtctcataatgttttaagaaagtttacaaatttgtgttgggccttattcaaagcagtcccgggttgcatacagcccacagctgcgggttgggcaagcttgctcaatgctttccttctattaaatattggtgaaagctaatgagtgtctcccaggaaatgtgccacaaacttacccaaaaaggacttaaattcctttgtgaggtcaaataattcctttagggttcggtttataaatatcatgtcttagattgcacagtataggctggtgcaagagtaaatgcagtttatgccattccgttgacaaaaaccgcaattacttttgcaccaacgtaataacaaaactctcctctctatgtgggaaccccgcacctcccagtaccaccactgtgggggggctaactgctacttgtccttaggtatcaagtggaaaaatgtcttccttgggagacgtttcctgacatcctccctctcatagctcaattctaaattatgtttgtttactataccttctaggacatcattccatttttcttcatatcacatattatatccaaggcccagtagagatgtcggggtgttctgtgctagctgacaacctgccattgctttagatcactattctttgcacacttggaaaggctgaggttctagcctcactagaaggcattttcacacttctcaggaaggagttttaaaaaaatctttgcatgccattctgtccttagtcaagcatcccttgcagaagtttcaccccaccccttcccaaaccctcaccactccatgagcatcacagtaaatacatgtcttcctagaacatgacatcctacatgaaaatactttggtcaaatacagctttctctatttgcgattataattaaactcattccactgggcaactccctggctggtctattttagtccaactctgtccacaattatcagttatttgtttctatgattatttcgtggaaagtcagtagctctcattagactgtaagcactatgagacagaaacaacatctgctttgcccaacactgtatctttggtgtcaataaaatgcctgataatgatagatgcacaatagacagctgaaaggacaaatggttcaactgacaggacatgtgagcttagacggatatgcgcattcacagtccttcacgtaatgtgacatgtagggtaacctatttctctatcagagaccagatacgttataccaactttaaaagtagccagtacaatcatctacatttatgcattacactttgtatttttattattagcattttgaaaatccaacttccctatcgtattttcctttgctcatgcataccagaaatacacatccgaagtaggaagggaaatgggggctccctttattctctcagccttcactactggctcaccgcccagctgcatatatgctaaacaaagaactgaggaattactgaaatgccctttcctttattcattctgtgaggtaggcaggcttcttccactagacagttttactattacctaattaatcagttaagcaataaaaaagtataaaatgctatagcaacatttgtagaatatggtgattataaaaacttagtataaactaataaaaatagaaaatatgggatgtcctcaaataatttctcatactaaactctcatcccttataatttgttattgtaaaaactttgagaagcagttccataccaatgtcttgaggtagtttttctgtttaaaattcaacaagtttttgttcctccatacttgtttttataaaaaagagaaaaggtttttgaatattattgattttggtattttttgggagagataataagtaatttcaatcatttattgataattgatggatgctagacatgtatacattatgttctttttttttttttagataagagtctcaccctgttgcccaggctgaagtgcaatggctcaatcttggctcactgcaacctccacctcccgggtttaagcgatgattctcctgcctcagcctcctcagtagctgggattacaggcgtgcgccaccacccctggctaattttttgtatctttagtagagatcgggtttcaaaatgttggccaggctggtctcgaactcctgatctcgtgatctgcccacatcggcctcccaaagggctgggattacaggcatgagtcatcacacctggcctatacattatgttcctaatcttcccaataatcttctaggctagatcatgttattatccctattttatcactaataaaaatgaagattagtgagattaaataactttcccatttacataggtataagtgacagagctagggttctaattcatacatccttgatcccaaatctcatattcctaatgaccatagcacaatctgcagggtttatacttaaatttttattcttgatatgagaaaactactgagtaaaaaataatgcatgaaacaaatatattcatgtagagaccaaattatagcatgagtcttaaaagttctactacaataattcattttccagaaaattaaattttagcaatattactttatatatactttcaaaataaaaatctctctcacaaaatgatcatggcaaacaaaaaaaatcacttttgtttctttcattagtgaatcaaaatggtatgaaagatcatgagcaacattaatatctttattaattaactttataataaaataatttttatcttattttacaaagattaggttctatcatgtacacatgtacacatatataagataatatgcaactttgcatgttttgctacttgttaatttcgaattcttaaaacatttgcaatatcatttctaaattgtaaaagaaaataaatatctgatttggcctgcagttatgttgttattattcaaatctgatttgttcagttcaatcagaagtgtcagcaatatcaaagagggtttggctcaggtaaaatccatgaaaagtttccctaattcctcttcttcctctacgttttcactagagaatagtgggactagctcctggaccattagagaacaaaggaaagagattatcaagtaagcaacgagtgtctgcatctcaagtttgcagtctaaaaagcctgtatgctctgaatcatcagattttagtttgattaaactaggaaggtgaaacttatttcacgtgtgataaagaaactcactgcagataaaacaataccttgctaatggtgaatgcacaattttgtaattcatacctgcaaaaatttctgtaagttcacaatcaatcaaatgtatttattcccacctcatacaagaaccaaaacaaccatatttactagcattttatgagaaggcagtgttttatgtactcatcgatcatattttaattacaggcctcagtagtaatatagtgtcaaagcaaaaagtaatacaacataaatcttaatccatcattatttctaggctctgaaggcaaagtacatacatattatttactttaaaagggaataagtcaatgattatgggcattctgcatttctattgaggggtggcttggtttttagattcatgggtagtgaagaaagagaaaagacagcatgatgccaccgcaatttcttctagtaaaattcagggaaaaaaaagaacttagaagaagaaaataacttcatgaccagctgcataactatcaaatttaatgaaataactagtgatgattacacatagtcatgtagcaaagttatcttcctgccttctaccctaaaagggaatattaatattgcatcttgaaatatttccagtatattgagtcatcctgtcccttaaaataataacttagccttataagaagttagtaacacaagctacatgatactactatagtcaaacacctaattctagaattattttaatggcaacttaatttataggttactcaaaagtgaatgattagattccaggcactgcaacttcacaacattgtatattattatcacctaaataaattccaactgaacaactcaacaaagaaacatccggatttacttaaaaaaatttacaattcataatcagtaatttatacttcataagcaattatgttcaccatagattgccctttccaactgaggacttaagagcatttcaaagcaagtattattttgcaaacttagatatctgaattctaacattacgtgacctatggtaagtaaaaatacactaagcaaaactggagcatatacctacataaacatagggtgagttccctctaaactgtgttctacttaaggctgaacagctggtgtctccacgttgctctacacagaacttctttagatgtagtgtttgtatacaatttaggttttgttcactgcaaaaatgaagtcacctctagtgctgaaataaatcaaggcttgtttatgtctcttacctttgccatggcctctcccatcctccaaaagcggcacgacaatagtgttgttcacatttccaggtgaccttacagctgtgtagacaacaggcaccgactgtaccaccacggggatgcggtgaacatgactcagtttgttagactgtaaattcatgggacttgaaggcggtacgggatggataatgtgcaaaaactgctggcctccaacaccagatgcagaggccacaaggggccctggagttaatactgttgacgaagatgacgctgaagatactgatgtgataacagttggggatgaggctagacgactagaagacgatgaagaggttgaagttgaagaaggtgaggaggcagatgctgtcatggaaactggggaggatgaaacggcagtaggggacgtcctggctttgtttattgacaagtccactggctcagtttgtgtttggaagtgatctacagataacgagtcctccgggggctcccctttcacattatttagcaacaggggaacggcttccatatcgggatagttgtggacgtttggagactgtggggagaaaaatggaacatatatttatctttgtttatcacacattttatcgatgcatggcttaccacttgaacgtttattactttttctcttattgctatgggacatttattcgttctccaaatatctgaaggattgctcagagacagtcactgtgattaaaactgagggcataagagtacaaaacagaataaggcctctaccataaagacattttcattccattgggacagatagacaattattaaaatactatgaaatcagtgctctatgaaggagaaaagaggccatatgaatctctaggattctaacccttactcaacactatcacaatacggaaacatattacctggcaacaatagtgggaaaactcactatgacatttctactttcatacttgttgcaagagttaccataccatactcagtatattctgagcattaaaaaagggcataaagttcttcaacctcccacacctgatcactaatttattaaatggaagtcatttctaataattagctaactcttctcaaaataatgtgcacaactacaagtgacattttaggaaataataatttaagaaaaacttatcctgaaaattataatttgtctatgaattttcatttaatctgaaataatgatgataatgttgttcaagttcacctgcactcttttaagttttaatgagcaaaatttgataataatagactccaagattttacccagactaatgtgatcagcatgctattatttgcatgaatataattttactcatatatctattcattcataaattcaacaaacatttatgaaatgtctgcttgcaagtccccaaatggcataagagtactattagtggtgtcagtctagactaaaaagagagaattagactctactgattattttggttacatctgtttggccaggttaacatagacattattttcccatttatgaggaacaaaaactttttttcactttttatggatcagaacaatacctaaaattatattaaattggttcattttgttcctcatttaataaaagattttggtgtgctattccccctaaaacttcggcatacatttaaaggaatgaaacatgtttcctaaagcctttttaaaatagaatataaattacagctccattcaaaacatacaataggcagtagcacacgggcattttactcagcaactgagaaaagaaagaaaataaatcagtaatggtaccagatcaactaaaataggaaatgggttgatgttttaatgctgtttttcctttttcttagctaacatggttacttacctataaaaacaaatgacttagaaacaattaaaatgagtcatctaaaatatctactgtatgaaattctaaatgacaagattttcagtttatgtgctgaaattgagaaataaatttttaatcttttcaaagacatttaaaaaacaaagaaaaaacaaacaccataaattgaactgctttgataaaagctattagcattatctactcttgtaactagaacagtatttcaatttcagcattatcattttatttctttgtagaataatgcaaaatgtttcttattactatattatacccacatagaaattctttgcttaggttgctttcataaaagacatcaactagtttgtcattaaaagataaaacatatcagtaagcacatattattaaacaccactagtttgactttaaatatagtctaggtaagtttttctccttttaccgtatcaacatatcaaaaattcttattttagagagagtgattacttccaccacaaatttttctcctcctgtctacttagacacaagattcctacatacatttacaaatcaaggagtaaagagtacatcactgcagaaatgttctataatgtaaatgaaagttgactgggtagacagacaatacaggagggggagctgataaatgcggaccttatctgtaaggagattgcttgtgaggcaccaagttttactgagctttgcagactgcttagtcttctctaaattatctttgtttatcacacaagtctacctcttgtgggtatcttcttaatctcttactgaggaaaatatttacctcttaagaagtttcataacaacatcttgttgctatgaacaacagggttatacctcataaataatattagctatatattatatataatatatataacatatatatagcatattatatataatacatatagcatatataatatatagctatatattttagctaatgcatattagctttcattagaaacttgtgaagccaaatattaagagcccctaggtactttgagacacttaagaattacatggcttttgcatgagctcaaaccagaatatagaaaaggctcacaaaaataaggaagaataaaccaaactttgggaccaaagaaatcttattgagaaccttctacaaattacacatgaatttgtaaaatcacagagacagacgctggtcctttttcatatgtggcagctgaaatgcagctagcacactcaaaaataatgcttcatcagtataaacaggacaaaatccttcttgtaccattcatctgtttacagcgttgacacagcagcatatcctgacagccgacactaatctcttatgcaatgattatggtgcaggtaaagtcatccataattgcagcttcagattacacagacatatctgtaaagccagaagtactgcaaaaatatggtctcaaaacagctatggcacatacttgtgttcctccttttagggaagaaaaacgacccaaaagtcttactcctgaaatcatcattagaaattcatttctttacttttaggaaatggaaaatcaaaagcattggttttgtggtgcacacctgtaatccgagctactcaggaaggtgaggcagaagaatcgcttgaacccaggaggtggaggctgcagtgagccaagatcatgccactgctctccagcttgggcaacagagggagactccataaaaaaaaaaaaaaaaaaaaaaaaagcattggttctgagatttgcatctgtaaatgtgtggttgtgctgacaggaagggagcactacaaatggccacaagggggaacgaaggctgaggagatacaaaggaaagaatcccaagtaagaaatacttagaatagtgaaaattaaatgaaaggattacaagtattagagaaagcgagaggagatacggggtatgccactcaggaaccagcctcaaaggggataagaacactgaaaagaggagaaacaacaaagaaaggtcgtaagttttaagcacaaggaagagacacttctgcaaaaaggacaaagaattccatactaacattttgcccttgtttagtaactcctcaattcttgattcattaatgaattctcatggcagtgtcaactaagtggggtttttttgtttgtttttaaataaaagcccatcatgatctttgcctgggagtggtgactatagctgaatttttgctgttgatgtccctggtatgaaagatagaagacttactgtattcatattcatgctaaaaccctccttctaacaacatgaagattgtataagaacactggatttttgtcaaagaggagagtaatttcattttccaaaagattatataatattccttgaaaaggtacactgtaaaacttaaatttttataatacatattaaataattgcacaaatacacacaaaaggccagaaaagtaaatggaacaatatacttcattaaaaacaatgtgtgtgaaaacctaaagataaacataaggattatgctgtcacattgtcttttctccaaaagtctcaaagccagttttactcacattaacccacttgataaaatattacatataacattccagtgaacatgttttttttgagtgatctggaaattacatttgaggttttctaatcagataacttttttttcctgaataaacatcttaaaatgtaatttcagctttaggcattttgttgaatgaatgtcaaatgaatctaaaacctcctacttgttagttcccagagtactagatgtgtttcctacagttatctattgctatcaactgaattttattacagtctgtctgtgaacaaaacaattttaaatgatggtcgtatattttaatcacctggaatttaaaaagaaagaaaaatatgtccggatactactctatctttggaaacccctccagggatttttctgtgtagtcagagctgaggagcaatgcataatattctactaaatgtcgttcaagattcacatgctctttcctctttagtaacaccagcaatgtttagagatggggctgacatacatgggcattcacacgtacacacaagatggtcccagctatctatctatcctttcagtcatcggtcatttaaataaattatgttccattttacttttacaaatgtgttgagaaataatttcatggcaatttttagaaaagattataaagtaacttgcctaacattacatagctcatggcttaactgtcacaagaatctttgttttgtatcctgttgtgtgatattatacaaagaaaattttatttggacacaaaagacttagattcatcaccaatccttgttgtttattagctgtgcgatcttggtatcatcacgaaaattctctaggtcttagcttatccatctataaaagtgtgatgttaattccaaactcatacaacggttgtgaagattgggttaatggcattaagtgctttttaagtaatactgagaaatgagagagacaagcaaatgagcagaacttcctccggttagaactaaaaattccaaacagaacttactctattactaaaactatctcaggaggaacttgactcactgaatgtagcgtaagatatattctgacacagaatctcataaatacagtcattgcggaggcacagtgtttactgaaccaaataaatacatgttacaaaaagctgaacaagtcatctttagggatctcttatgattatttagaaacaattttctcttaaaatatagacaactgtcatttgatacttttttttcctctactttctagctgagttagattggcccacaggaagatcatgtaacagttgatggaatacattttaactgactggcctgatttcttaattccacagtataaataacttaaatcaatccacacttcagtgtgcatccattatgacaataatataacaaatagattcaaataattgctttgggatgttggtcattctttagcagtcttattatgagacaatacaggagcatatttgtttcttgtgtcttggtagaaaattagtttacataaatttcactgtgtgacttagtgattaattgaacatgtaccttttataggaagtgcttaaagaaatttactctatttcacattaaaaaggaattaaactaaatctatgactccacatccttggagcttttaggttacgctgcattattttaaagactagtatattttaggtgaagagccaaattccttttgaacatgaagtgcacagtaggtacatggcttagttttggtgcctgggtttcccttagtaaatacaattttttattagtagtaaatgaaatggttttaagagatgagcaccattcttaaaagaagcatcccgcaactctggctatttctgctacaagtataaaagtcaccacacatccatttgtgaatggagtatgcatttcactttcctctattcttttgtattactaaaaagggaagcctatttttcaatatttgtcttgcatgagcccccatggtcataatttaccttgctttcagctcagtgattcttctttacatgttcaagggcaaactcttaaacataaatgccgtaaaagtgtgaatttataaaactgacaaaaacgtaaagcaaagtatactaaagaaagataaattgtacttcctctaaaagtacagatgacagagtaaaaggaaacaagtagaaatatcctacactgataacctggaatttggtttgaatgagttatctactgcatgcaaggggaagatatttgaataaatatttaattcaactgccttatatcaatatgtcaattgtcagtttaagaaatgattgattccggccaggcacggtgactcacgcctgtaatcccaacattttgggaggctgaggcggcggatcacttgaggttaggagttcaagaccagcccaacatagtgaaacccagtctctactaaaaatacaaaaattagccgggcgtggtggcgcgtgcctgtaatctcagctactggggaagctgaggcaggagaatcacttgaacccaggaggcagaggttgtggtgagccgagatcgtgccactgcactccagcctgggtgacagagcgagactccatctcaaagcaaaacaaaacaaaacagaaatgattgattccttaagaaaatttgaagtctatacatcaaataatgtactctctgtgcttttacatttatgttttttttttttttttgagacggagtcttggtctgtcgcccaggctggagtgcagtggcgcgatctcagctcattgcaagctccgcctgccgggttcatgccattctcctgcctcagcctcccaagtagctgggactacaggcgcccgccaccatgcggctaattttttgtattattagtagagatagggtttcaccgtgttagccaggatggtctcgatctcctgacctcgtgatccgcctccctcggcctcccaaagtgctgggattacaggcgtgagcctacatttttaatgcttttttacatatgaattgaattgaaaatgctaacctttaaaatgtgttcaatacacacatttaaatttatcctaaagttctcttacttcctaatagttatattttttcatgacctatttaccaggactttcataaatcatattatttacctgaagcaaatcagaatctatgtttacagctgactgctactctgaaactctggtttggcccatgtgtgtgatgactttaggttggtgtgagtgagtgaggaggagacagggaattttgttcatgcattctaaaattggtaagcaggacaggcgtggtggtttacacctgtaatcctagccaaggctgaggccagcagatcatctgaggtcaggagttcaagaccagcctgaccaacatggtgaaaccctgtctctactaaaaaaatacaaaaattagcagagtgtggtggtgggcgcctgtaatcccagctactagggaagctgaggcaggagaatcgcttgaacctgggaggtgaaggttgcagtgagctgagattgcgccactgcactccagcctggtcgacagagtgagaccctgtctaaaaaaaaaaaaaaaatggtaagcagacattcccaaggactgaaaacatggacaaacatttttaaacgggaacataaatgtgttccagataaatacacaaacctttagcaaatagaagatattttcttttaccatataactagggaatatacatcacacttgttagcttggaatatggtgctcaagatgttttgaattttaaatcctacttatatggccagaagaagtagtagtatcactataacaggtcaaaaacggaagctggattaagtcctattatcttgcaattgtttttaaacaacatttcacaaagcacacaaaaatgtcttaaaaataaagaggtaactattatagggttatcttttcctcatgattagaattttgttcttttggttttaaattaatgttattattcattgcatgacttaaaatattaattaaaatttcactatactgccagaaaaacctgttgtatagacttttaggggataaatctttatcctaaaccacaatctcactccagtgcctgaggcaaatgttctgtgctagatacatattttaaaatatgcaataatgtttatcatcctcgaacagattaatctctgctaccagatgggccctgcttttgattctataaaatgttcaccataaacagttatttcttacaacagtatctcatagtattgaagtatatcaaatttcagagaaagaaaacttgacctcagagtggctgtaacagtcaaatgatacatttaaaaactcctacacaggataaacatgtaaagcaaaactgtaacctttttatgtaaacaaaggcatattagcaaaacaatggctttgctttttggataacccagtggttcctttggtagtatccatgggggattggttccaggacccccctccaccaaggataccaaaactacagatgctcaaatccgtgatataaaatggcacagtatttgcatacggcctacacaaatctccccatatactttaaattatctccacatcacttataacatctaacacaatgtaaatacaatgtgaacagttgtcatttcgtatgttttcattatctctccaatcctaaaactttcaatctgcagttggttgaatccgcagatgtggaatccagggatatcgagggacaactgtatatacttgtcttctaatagaaaacacttttaaagagagatacaccaccaggccaaggcaagactaatggtgaagtggagagaaatctctcttttcctacctctcctggaaacagaggcagctgcaatgggtaagtgtcacaaatagaaaagccagagttttgaaaggccccagaacttttccatgagcagtggatttatttatttttcaaattttattttagaatcacagagtatatgtgctggtttgttatatgggtatattatgtgacactgagatttgcgttacgattcatcccatcatcaggtagtgagcacagtacccaacagatagttttccaatccttgcctcccacccccaatagtacccagagtctatagttgccatcttggtgtccatgtgtactcaatgtttagctcccatgtataagtgagaacacgtggtatttggttttctgtttccatgttagttcgcttaggataatgacctccaacttcatccatgttgctacaaaggccatgatttcgtttttgtgtgtgtgtgtggctgcatagtattccacggtgtatatgtaccacatttcctttatccagtccactgctggtgggcatcttggttgattccacgtctttgttattgtgaatagtgctgcaatgaatatatggatacatgtgtctttttgatagaatgacttatattcctttgggtatataccagtaatgggattgctgggccgaatggtagtccagctcttacttaagaaatctccaaactgctctccacggtgcttggactaatttacattcccaaccaagggcgtataagcacctcattttctctgggggtccctccaaaatatgttacttttgtttacttaacaaaagccattctgactggtatgacatggcatctcattgtgatatggcatctcattgtgatttgattgagcagtgaatttaattgcatctcaactcactatgaaattaataaaatacattcacataaaccaacactttagccttggcttttgtcttccaggtaaaggagtatacagtcatacaggtgtttctgaggatcccagagggtgacactatctaaggctgttgtaatgggccctttttggactacaactgccaccaggcacacacaggtatatgtaattaatgcatttaagtaggagaataaattgtacaaatcaagcccccattgcctagactggtcaagacagcagcataagcaaaatgggaaaagagccaggctggggacttagagatgaaggcaggcacagggaggcagaaaggaggacaactgatgttcccgaaaagggggccatgcccgccagccacagcttctgctaatcaggtgtgagttacagtgacacgaagaccctcagctcaatgttcctcttggctgggatgcttatccatcagaaacaagaattttaaaaaatgatcacagcaatgctgacaaggatgtaggaaaactgacaccaatattatgctacaagataggaaggtacgcgttttaaggaatcctgttgaactgtctcaaaagtcttaaaataccttagaactaataactacacatttaagaatctaggaactgccatcttcctctcttcctcccaccctccctcctccatacacgcacccagccacccacctacttgcacagtcacctcttgagcagaggagtgaccctatattcagaatccattcaacatctatccctaactactcaactttaaaaaataaggtaatgtttggaagtggcaccctcaagcaaatactatttaaaccaaacaaaaaaagggcctggagcagtggctcatgcctgtaatcccaacaatttgggaggcggaggtgggcagattgcttgagctcaggagttcgagaccagcctcgtcaacatggtgaaaccgtctctactaaaaatacaacaattagctgggtgtggtggcgtttgcctgtagtcccagctactccagaggctaaggcatgagaatcacttgaacccaggaggaggaggttgcagtgagccgagatcacgccatcacactcccaacatgggtgagagagtgaaaccctgtctcaaaaaataaaataagataaaatataataaactaaaattaaaattaaataaattttaaaacaaaataaaaaaggagtcaaggaaagttaaggcagatttagtcatgattcccatggaatgatctcacaatttcaagtgttggaacaccagaagcagctttctaaagacagtctttatgtttgaaagattacatatatagcaaccatttcaatttcatgcaaataagcacttcagattgttttgagagaacatcccaggggcaacatcactgatttaaatagcactgtatctacagcaaactggacaagaatcaagatgacgtgttctagaaaactttgttagatgacttaaaaaggggcctggtgaggacacagaaaatgatgttgaaattgcttgtaaagatactgaatgaaataatgacataaaatttgagagtctagggaaacttcatatgttaaaatttatatatttttgtataaaatgtgacggaatttgttttttaactaatacattcaaatattaacactcttaaggtgaaattatctacacatttatacattctagttggttacaaaatttccttcctggggaaatagggctaacttactgcagggacttacatttagacacagatggcaattttaaattttgagaaagatgtctatatggatgcgtaactttgtcttattttggggagtaaaaattagaaaccaaaacatggacataaaagcaatcaagtttgaaaccaagattttaaccttaactattcactgcaaccatttatgaaacattttaaaggtgcaaagaacagagacctatggcagtaggtatggtgtagacatcaacagtttacaaagcattatatgtaattctaataatcagacaagtttgagaaacaatattcaatggcagggaaactttttgtataatgttaagtgaaaaaatgttagtatacaaaactatacaaaaagtatgagcttaattttgtccccccaaagcattctcatttatacatgaaaataatacatggaaaaaaatgttctggaatgttaacaatagtttttccattaagtgaatttgtgggtgaactacattttcttttttatcttttttcctatattttctacagcaaatctttgctacttttaaaattttaaaagtcatatttttagaaagaaaagtattttgagaaagaaatctaaaaggggagcagaggcttttaaaatctggttttcatatttctagatcctagtgaacaataatgtcattagaagaaaatattctatactgttaaaagctcaatttgctaagtgtgtcactagtataagttttagactggtggcatgatttttccataaaaattaacacatccacttataatttgaaattaactaaggaaaacagctaaatataactgataactgaaggtatgtgattctagtttccccagtggattaaaacaatggtgttccctgggaatcccaaactgctgcattaccgggtgatttactgggcgaagaatttcatgttctagaaactaccatcaacaattacctatcagcatctgggtattacaaggccttttctgtttttgatgaaaagctttccatcagtaactatttagtgatcattactatataatcaacacaacattgtgataaatctgaggatgctacaaaaggatttttaacccttgctctggtaacagcattttcccccctagagatttaatgagatttccatcactttttaaaagtgaactacatttggaaaacatgaaaaggaaaagtaatggggaaagtttcaaccctatattctataaaaatggagagcattaagaactaatttgaggaaaacagaattgtgctctttaaatcagtgtcttcagaatgcataaactgaaaaagtaaatgttcaaataagtgttataaagactgtgaaatcaattttaactgatgattttaaaacgcaggaaaaaaagcaacatttaccattaatatttactacaacattatctggcagatggtgtacgggacaaacatttttgctctcattaggtggtggggtaaaacccagaaaactgggttcacttcgctggagtatgggaggagcctctctgtcattaggtcttttctggggcaagtgacagcaactccctcatctacagaaactggtgccaatgcacttcagtcttcagcagctttccaggttcacaaaagtctgtggggtagggagagcttctaaggaccacatgcaaaacagggagcaggggcaggcaagagctttctcttccggtaaagttttcctctctagttttacaagtgaagaaattcggtctcacggaggttgaagacattgcccatggccccagtggaacatagacctgtaatctaaacctacgggtaattcctaagactgaatccacctccccatgctgcctgcatcagccctggagaggaagagaaagacctcccgtccttattggtgaaatttcctcatggaattcatgtgcaattagtacgtggaaataccaactgaagagaatataaaataatgggcactgctaggatagttgtaagctacaacccacttccccaatataccttgcatataataaatttaatggcatgatgcagatgtcagttaccaacatcataatgtctatttcttatttagttcccgtttgttctcaagtcagcctttagaaaaataaggacaacaaaaatccttcctcatttaggaatagaatcctgcattttgtgcagtggtcatgctgtatgggatatgtgtttgaaagaaatgagaaaagacggtaggataaaatggaaaaaaaaaaatccgaaaccaaaaacctcattagatttgaaagcgagtacaattagcattgtaagcagaaaaatcagctcaccacaaatgtaatttcttttcttcctttcctttcaagctaaagactcataactttttttaaaaaaagttttatttttgaccaatgatgagtgctctttgataaaaccaatgtaataaagcggaacttttgcaaataggacaataagtgagaagaaatgcagtgtggttttgtgaaaaggatacatgcctgagttccggtctgggttgcgttttatatgatcagttcactcattgtctctcttcagtttctgattgaagatgatgttgatcatgcttttgcacagttcaggtgtctgttatctcctccagctgtaccagattccacctgttctaaattagatgccactcttctgtgcttccaaagcactctgaactttgtgcttctttctcttacgaggcggccatgggcccaccaaagatatcatttttatcttgttcttttgtagacaagcacctatcacagtccccagtacaaagtaagcacttaattaaagctcattagtaaagctccagttgctccccaaaggccttactgggtctcagattgaatatatctacgggccacatgcagtggctcacgcttgtaatcacagcactttaggaggccgagaccgaagggttgctcgagctcaggagtttgagaccagcctgggcaacacagagagaccttgtctctactaaaaataaaaaataaaaataaataagctgggtgtggtggtgcacacctgtagtcttagccatgccaaagactgaggaagaaggatcacttgagcccagaaaatcgaggctgcactgagctatgattgcatcactgcattccagcctgggcgacagagtgaaaaaaaatctatgaattaattaccccgtgactaaaacttaaacggtaaatatattaacttattataacatataaaaatgaaagttgaaagtttccagtgcctcattcttttgttaaagaatttaaatttatcaattgatatttaattcctcccactacagaactttaagtgactagtttccatgtattacaagatgatttttacaagaagagatgaaagacacacttccaaggggctaaaaatcaaatgtatgagtcatattttgtatttttgctaatttgaaatacattttttataactagaaaatttataattagcatctctcaatatgtcacagtaataggaagttaaaaaataacactctttctggttccaaaacttagtcttcatgtctatcaagtttttcaaagttagttaggattctgcatttttttctgtcaatcggggtgtaatacatggcatgaaggttataaatcctgtaactagatacaatgataaatgcatgtaccccattcttgttaattttccattccacaataaaaaacccctgctaactctgatcctttcagtgtggggattacctgtaccagcaacccacaaactctgctgctgcttcctgcgcagtgaactctacaactgcctttctcctccctttggcttatcttgctctgctccttcatgttaattccattcttctagaacttctgcattggcattcttatttggcattcttatttacactaaaggagtagttattaatggcaggtaatgtgtcccccaggggacactgagcaacatctgaagacatttttgattgaagcagtgacaagacagttcccatgacaaagacaaaagaccaagagtgtcgaagtttaaagaaaccctggattaagctatcatctttttcctactttttcccctaacatcttatatattacttttttttaatttgtggaattattccgttttcctcatttttccttctctaactcttccatatgtgttaatcatgtaaatatatctacagagtccaaacatatatacatgcacctccgtgggtatgtgaatacggcttaggtactggtatgaatgctgatgggcatgtgtgtattcttgtgacatcttagcatgtagtgcacttaaaagtcatgcaaggagtgtgtgtgacagaatatgtagaaaaattaacttgaagtgtttattacctatatatacaaatgtgtgtgtctacgtgttcctagcccttcatattataagtattaattgaatagttttcatagatttgcttaagtgtacaaacagaagagtgcagatatagttgggttttttttttttttttgaaaaatcaaagggtattgaggttaagttaaaaaccttaacacataaatgcagttgtgatctctaaattcactaagcatctgtctttccagtaaggattccagacatcagcccatgtgatgctactgttagctaaatctaggccccaaacttgaattagttttacaacatgtaaaggggaaaagacatgtctaaaaattataaacctgctgcacatacattacagtgtattgtttattcctcacaacatctcaatataaaaaactatcatgaatcacattttacagataggaaacagacgtggagaggttaagaaatgtgccagtggttctaaggcattaagtgacaatgtcaagatacaatctttagtgatctctggcaataaaatccatggcctcaactattaatgcaatactaactcccacatctgaatctttaatgtatgcccacagcagatcaggaaagactgaaatcactgtaatcaattctataaaacatttgtctcttattttgtgcaattttaagacgactatgtttcgtgaagaaaaaagagtcaaaaggttaagtaaaaactttcacagatttcaacaacatatcttagcagaattattttttcctttattggttttccttataaaatctctaagaaaacaacaactgtacgttattcaattatttattactgaataaataagaaaaagaaaagagtcaggcacattaatcacttctttgatccaaacagaattctggttcccatgagataaagttactctgtgtttttggttttaaataattcctgtgataaaatcccaaattaattattaagtaaattagcaaactcacattatatgattcattttcttcttagcatcagaactttcagtcacagttaagatagccaacattcaattatctactcatagacaggatcacagtacaagtaatcccaagtgacagataatccaaaaaggcatttatgttgggtttaaaattcattatatgattccagcagatttaccaccataattatatttattagactcatattaaaattcatttgtatttcttaaacacatgccaactgagggaggatctcagaaacatgctggatcaagaaaggaagctgatttgctattagcaattttcctgtgaataactgacaagaagtcatggggatagtaaaactaaatttcatatttattaagagtcttatgtgataaattagagattatattatagcagtattgtagaggtgttacggcatgggctgtggattccaacagacaggtttgtgtactggttctgctcttgttccgtgaccataagcaaatttcttatccttctaaacttcagttatttacttacaacagtgctaatattagcactccctacatattaagggagttctaaaaatccaattattaaatgcacactgcttgacacaaaatagttaaaattagttgtggttgttattttttgtttcagttattattttatctattttactgtagtgctaaaactagaatatccgatagtttgtattattcctgcctcccataaaatgatgccatctttgattattcaataaattacatagtatactgtagggtcaaatattagaatatgttcatctggtgcagacaggcaaatactagagatgcacagttttctagttttaaacttctggggccatacatattcaggaattcaaacttttggtaggttttttagaaggtaatagcaccccgccaggagggcttggggtggaactggatactccaacacattaatatctctgcagtaaaacacatgaacatttacactgagtgttataaagactataaatacttgtatgtcagtttagtacagtttttaattctaaataagtattttttcagaatttttaaggattttagattatagataagaagttgtggaaatggattaaatagaatgatacaactaaccttgattctacagttttccattaataatatactacatgtcataacattatagggtaagataactggggagttaaaaattcctcttggtttacataaaatatccctgaataatttgtagtaaatggaattctaaatagcaattcaagtttaagtaattactccctaatttttaaaagggtatggcagatatcctgatttgtataaagtgacatacagatagcattacccattttatacttggtttcaattaggaattaatttctctcatagttgtactttaccagtgagtgggattaaattattagatttaaggatttaacaaactattaaattcctcagtgctgatcagtagatgaagcagaacataagcaatatgattggaaatggagctgagttctctagggaaaaaacactggtctatatctattatcttcccacagatacacaacaattatatcagattgtaaatagtccccagtatgaggtagaaaaaaatctgatgcatatttataaaagactgaaggaaagcgtttatatcattcactgatcagagtaaggaaaatattattgactataaatccaaaatattcaatccaaaagattttaaattacaaaggagttcaaaagttagtctaactgcctgggtaaaatgtgctgaaagttctgttcaacagaaacatcaatcaacacaaaattcatcattcaggaagtgctaaattttcattaatcactgacatgagaagatcacagtagaatgaaggaatatatatgcgataaaagtggtacataaaagaccataaaaataagaattttgaagaggacttaatgttgtcaagtctgaataaggttagagtaatagttttcaatccaatataaaattaaggagtaaataacaagtaaacaggtttaaaagcttcaattgtccaagtacaggtataaggaagtctgacagaaaatatatgatgaaagacatatacagttatataataaaaacaacaaataaaaaatcaaggccccttccactaaacaaaaaaggagtctataataagtcaaatgttaaggtcaacttgattgcctaaattccagacataactttgtgctttctgttaggataaaaagaaataacatgagtagctctataatcacattatctcagtagtgagctgtatacatttcttaccattgtttcaaaaaccacattaaactgcaaatctttttcatgaggagctttatgaaagggacccaaagtgatgacatgcaaaataatctggacaatttatagcacgtaaaatgtggaaaaagaaaagcccaaatttcatttcagccaaggcagagtagtttgtattaaatcaactctcatattagaaacagtaacaaaactagattaaatttgtaaaagtgcattttaagacactggagagcaactaaaacaatcagaactttaaggtccaagatccaagaaggaaagaaacacaagaaaaggaactatcaatgtatatcattttttccttgaggcataatcacaacgtctgctattcacttaaattacaaaatatttcagaatactatcccaaattacttaaaactaaaagtagaggaatagataagaacaaactaaaaggagagaaatagataagaaaaataagaacaaattaaaaatttttagagttatccaacatgtactttaaaataacaatcataaaatgcttaacagataagaaaattgtactccaaaactgcagtctacaaaaccaaacaaaaacctagtcaaatatagattccaaaagcgaaaaatacagtatttgaattgaaaacctgacacttgtgtttgacagcagaaggacatagaaatgattaatgaactgaaaaatgaatgagcaaaaatgagaacgtagttcaagtgggagtagtaagatactttaaaaagcataaaacaggcccaacacagtggctcacgcctataatcccaaaactttgggaggcggaggtgggtggatcccttgaggccaggagtttgagaccagcctggccaacagggcgaaactccatcactactaaaaatacaaaaattagccgggaatggtggtgggcgcctgtaatccagctactcgggaggctgaggtgtgagaatctcttgaacctggaaggcagaggttgcagtgagctgagatcacgccactgcactccagcctgggcgacagagcaagactgcctcaaaaaacaaaagaaaacaaaacaaaaacacacaagacacacaggaaaggtattacatgtgtgtaattggaggcccagaggagtggagagaaagaatagggaaacagggcacagcaacattgaaaatactggccagatattttctgaaagacattttgctgtacaattcaagaatctgtaaatcccaagcaatataaattcaaaagaaactactcaaaagtagtcagtgaaaagatgacctcccaaagagtaactatttgaagagttacttctcaacaaaatgacagaaccagaagacaacaggataggtttacattctgaaataaaaaaaaataaaacaattgacaactttgatacttttctatcaaaaatgaagacaaaatacaaacattttaaataaaaacagagcattcatggctaacagaccatgtaaaaagaagtactaaaaaatttcttcaggcccaaggaaaatcatccctaatatagaaatatggaaatacaagaaagaaaaaagagcaaaggaaaaggtaaatatgtacataaatctaactgagtaatgaagacatcttgctaggctaataatatactgtcttaacaataattatattttgaggtttaaaatgtggggcaaaaaggggggggggaatttatagagttaaaatgtcccaagatctctgcattgtctagaaattaagtaaaaggattaaactatggtgagcatgaaaatgccacaggggcaatgtaatttataggataaaccactgaaaataatatttacactaaagagaaggtagggaaaggaaattttaaaatatcaggaaaaagggaataaaaagcatacagtgtgatggtataatgtacagtactacattctgcaattaagtagtctagtttttatggttttaaaattatagcttcgatttttaagaaaaacttaaatgtagtaactcttaaatataagaaaataaaagttgaaagtaaatgaatgaaaaaaacactaggcaaatacaaagcaaaagaaggttggtacagttatagtcatactagggaaaaaagatggtaagctagaataattactagaaactaaaaaggacagtttactgacaaaagaaccactccaacaggaatatatacatacatacatacatatatacgtgtgtgtgtatatatatatatatacacacatacatatgacatatatatgtcaatttataaaaatagtcttaaaaagcaaaggcataaagaactaaaatgagtaatagacaagcctacaaatatagtgtgagattttagcataactcactcagtaacagatagacaaagagaaaaagttagcagggctatagaagacagggggaaaaaaaaattaacaaacttatcttacttatttagaacaacgtacctgatatctatccaatacacagtgtttttcaagtacttatgaactatttaccacaatgcgaccccacagtgggctacaaagcaagtcttaacaaatctaaagggatacaatcattcagcacgccctctagtaacatggaatttcaccatgttggtcaggctggtcttgaattcctgacctcaggcgatccaaccctgtctctactaaaaatagaaaaattagtcgggcatggtggcgggtgcctgtaatcccagctacttgagaggttgaggcaggagaatcgcttgaacctgggaggcagaggttgcagtgagccaagattgtgctattgcactccagcctgggcaacaaacaagagcgaaactccttctcaaaaaaaaaaagaaaaaaaaaatgctgggtgtagtggctcatgcctgtaatcccagcactttgggaggcctgaggtcgggagttcaagaccagcctgaccaacatggataaaccccgtctctactaaaaatataaaattagccgggcatggtggcatgtgcctgtaatcctagctactcgggaggctgaggcaggagaatcacttgaacccaggaggtgcaggttgcggtgagccgagatggtactccagcctgggcaacaagagcaaaactccatctcaaaagaaaaaaggcgggggcggtggggggggggggtgatttcagtacaaagcctacagacattataaaaatattaagatttttgttcgtttgttttttgtttttgagacagagtctcactgtcacccccaggctggagtccagtggcacaatctcagctcaccacaacctccgcctcccgggttcaagtgattcttctgcctcagcctcccgagtagctgggactacaggtgcacaacaacatgcccagctaatttttgtatttttagtagagatggggtttcaccatattggccaggctggtctctcgaactcctgacctcatgatttgcccaccttggcctcccaaagtgctgggattacaggcgtgagccactacgcctggcctaaaaacaataagattgttataaaaaggtttattccgataaatttttaaattctaaaaaacagaactgtttaataagtttgcttcaagaattgtttcaaacacttatcaaataaatcacccaaatctgacacaaactcttccacggaacaaaaaaagaagaaacacatagtgaatggttttatgaagctggcatacttgttatcaaaacctgcctaaatttacaaattggcaaaacaaatccatattttttaaagtcatattttttaaaggataatcattactcttgaaaatgggtagtgactaggatgagacatcaatgggcatataaattattatttctttatctgattgttagttacatatatctgtgtttactttgtgaaaaatttgcaaactgtacttataatttgtacatctctccatgtgttatacaattttaaaaaaacttacagaaacaaaaaagtccttaatttagacctttctgcaggtaaactttaattcattaaacattatgtatgtattttgtgaagaataaagctattatatagatgcaccattattcagagtaagttttctcttttgttcatcaaaaacaactataagaaaaagagaaatatcttgctaaaatcatgccaaattatactgatggtactttttcaatgtccacaaactaaaaaatacatttgttgtgatttcttctcaggaaacacatgtaagtttatatgattgttagtattattttcctacctacctgaactattgcatttaataatacattgtaaattccaacaagtatagcaatatatatttttcagggtttaattttacattttcaaaattgtagacatatctggcccagtccccttatctttgatttctcctagattttctataattattctgcaagtacatagataaattatatctatatccatatctataacagttatatgctgagtatatataatatactcagcatataacatagttcctggtaacttgtaattactctttaatagttgttaaatgaagaaatggactcaatgacaaagtgataaatcagatggtctctgatcaatttctcttctattgaaggctttaatttcctcttaagtaaatttgtttccctttctaaatgttaagaggttgctttctcctttgacaaaacaagtactgaacagttctgtggccctggctaacttgtccttgtagttcaaaatcagaaggctctgagtagagccacgctgattccttctcgacatggttttcatgtctagcttgtttatacgatgtacgattacccagttagaacattctttgaatctctcatttatgttgaactaaaagaacttttctgccatttaaggcattgtaagtcagctttcctaaggttcacctctccattctatatctaacattgcttttcttacttttacaagctccaatataaattctcattttccccaggttgccatcactgtgacgtcatcaagcagttcttccttcttattcagaacataatcagagcacagcgtcagttttccctgattgcttcatttctcatttggcaaacacaacaaaaccaaacctgtcagcaagttgaagatttaccagatgcccatatactatgctgcaataacattttacttatatgatttgggcaatgtacacagtatctaactgattttaacagtaacatttaaaaatacatgccaacacaactttggttggtttctatggttagcacttttcaaacatttccttctttgaagtccatgccttggtatttattctgacatagagataaaaaaatcttaaaagtacttaaaggtaactgccagacggatgtgcatgtgtgtgtgtttacatggctgttttaaatacattcttaaagcaatacttgtgtcctcacgcctagacagtcattcagctttatgatatccataatgctagaacatttgccttcagagacctgatgaggctgaagtcaagagaaacggaaggttaaagtggaaattggggtggagggataatcactgagaacaaactcaaattagctacaataaagatttccctctaagccttgtcatctcttttgtctttcaaatatatttctttcttctctggaccagccaggggccttctactctccagatttctttttaatcccttgttgacttccttggactttttttctggtcaccagatagtttctttggggaaactgggatcagtggggggcaggaatcaaatttaacatttttacttatgcaacatataaataagtacaaagtatgagatatgactgattagttgttgcctgtcatccattgccactgctttctaatcatctccctgaagcatcaagctcctcaacattaaggttctgtattctgccagtgagatgttctcatttaagagtcagaaggaggaaatgagagggaggtcatcttgctggtttggttgccagcaacaacattcaacgttgcagagtcgagttactagtctgcgggggaggcagttgtgtcagctgtagtactcgcaacagcagcagcagcttctctgtctctgcttcacagctatggtggcgtgtcctgaaatcaatgatggggaggcagacctgacttccatccctccttctcttcaatgaataagcgagcattcgctatactaaattcctgttctcctgaaatacttagagtggttcgtgtttcctgtaccatacactaactgacaattgttaagagactggaaaagagaatatgaaagagaaaaaggaatgtaaactgagcggggagaaaatgcaggataagtcatcaccaggaatgcacattctaagttcctgaacacagtacaaacggagtccagtcccactccacttgcctccaaagtgtacatagtttccccatgttcctgacacctctgggcccttcacacattcgctatctctgaacacaattttctcccaaccacttttccttcacacccaactatttcctaattcctaacacatctttaggacacagttcagacattccctgtcttccatgacgcatcctgatgctcactctaggctggttagctttcctccagaatcccataatacattttatccatccaaatttttccacttcccatgctgtattaaagttatctgcctgcagatatctctcttataagacggcgagctccttgtagtttcgaatgacattcaataaatcttgccaaatgaataagaaaataattctatattttttattggtccacttgcctgaaaagactagaatgttgtttttgtggagttcgtggaagtgatcatattaaggcttgaatcaaagcgggatttcctagagaaacttctaattctccttgtaagctatttcctggaggatggaagacggccacgtgcttgggtcctgtgcctcatataaaagggaagggattctgacacatcctgttcatggtcaatgatttgatttttagtttggatttttctgtgtgtctggccatttgcactgcaaatatatttcagaatttaatctacacacctacatgtcagcaccacccactttcaccctgggtaagctgatttagggaccaaaattcttcctttagtttttcaaatccctttcaatatgaatatatatttttaaaaggaatgaaaaaaatcaaaactattagtttcattcagtattttgaatgctcaggattttaaagatggttagacagtatatggattactaaatctcctcagtgccgtatctgagggcagaatgtaaggtgggtgacccctcacatgagaactggcaatgggaagacagtgagatagaaacccagcaggaaactgtgaccactgctcaacacagaacagggaacttgggtaagactccactaatgagaaggaaggagagtaaatctgagagcacctaggaagccactggtcatcatgaatcacaagctcttgatgagtgcagaatccagttctttggtgccagaatctattctaactgatcggtccttgctccatctgctcttaaaattttttaatacctcacttagctaagacaggctcatacgtgttgtatgttagtggtaagcaatggaaggctaaagtactgtctgacatattttaagaatattctcaaaaagagccaagcttttaggagtggaagtctttaggctcagctgtgcaaaccagaagtatcagacacagaagacatgagtgaacctttgtgagagcagagaccttattttgaccactgctatcttccaaacacctggaatatttgtggtataaatgagtgaaatgaggctggtgctgttaggtgcctctctttctcctatttgctcatctttctcggttacatcatttggttagtgcattgaccatttcaccttccacatttttatgggtttaaagcctaaagaaagaatctttattttatatatatatataaacaacataatcgatgatctatttgaccagttttgctctcccctctgctcccattaaatgaggacttcaataagaattcagagaaatcacttatagtaaactcaacctttatttttaataaacaaaagggtgaataaccataaacatgaaatgaaccatgaatatcatctgccagacaactgaaaagagacaaagctttcttaaatatggcttgagatttcaatcatttcatcactagactgattttaaagagacggtaattctcaaaatctggttcatcaattttttgtttagttttggtatggttgttgtgtctttactgtttagaaaccacagcttaaaagcaacttagatagtaatgctctaaatgaccaaaactacattttataatcaaagcactcagaaatgagttattaaaacccaattttattattctttctctgtgtttatattggtttttgtggattttttctgaaaactatataaacctttgctcagccttaactctttagtgaactattttatttaaaaaataacaacacatgaacttgactgtgtttaacttctgttccaggtaaaaaagacatgctataaaaagatttaatactgttctcagggaaaagaaaatgtcaagctacaaaatatctgtaatatgtattaatatgttttaaaatatctaaaaataattaatgctgataatgtattcaaaagccctataatagtgtttaaattaagaaggccctcagaatttacaatttaaatagtaaacatatggcactactcaaaaaaaaacattgaagcaaataactcattaaaaatgcaaatgaatacaagtgaacttgcttaaaaaaagcaagtaagagaaccaaaggctataatggcaatggaaaaggcaaggtcgaggactgttcacaggggagaattctgatgaggtcaaatgcagccttcggagctgtggactacttattaaggaagtagcagttctgaatttttattacagagctttgctcatactgtgatgatttcagataaggtatttatagattgtctgaatatttgaccttggaactattttatggacactagatatattgctttttatggagaaaatagacagttctacataggtaaatcatttgcattatcagaagagaaagctgggctgaggtagggaaggtggtggtgacacttcccctgtgaaacatttcatgcctgttcaatacgtttaagcaattacgcactaccataaattagaaaagattataaatcaattagtgactcttactagcagccatagacccatgtaaagtaaatcacatgatgccctttttacaataagttcagtcttgataaactcagttattcaggaaaatgtcactgcagtgatgtctgtctattctaaattggaatcaatccaataattgacttctgttttcttcagcaaagggcacttaacactaacgtgtggtacatagtcatataggcctgaagatcacacaagtacatcctattataccaccctccaccttggcagatggcttaccttgagtgaaaccattaactactcccaattcaagtgactgaaactaagaaacatgggccaactgatcatcaccttgaaaataatattttcttcagaactgacactttccttgatactgaaattttcacttacaggttttaagtaaatctcactaatatgttttttggattagatattaaccaaagagaaattttaagaattatagctctttgcccttacaaagtttcaaagatctacagtcattactaaagaccatattttaaataggtattttaattatgagatataaaaatataatcaggaataatttgagtatggtttacaattatgtttcaacactggtcatcttagattttcatatatcatgtgcaaaagaatacttaagtgaaaagaacgtagtagttattgccaaattaggaagatcactcgccaatcaatactaaaaaaaaaagaacttgaacagatttactttgtaatatttgaaatatacaaaagaatacaattaatataagttaggaagcataataacatgaactcccatggtgagctttttgtcttttctaatatgtacatttattctcttttaaggttacaaagaccagtttgacagcttcctgcaaatttattttcattacgatatagttctaatatttttgaaaatttccaccatgattttttgactgactcatgggtaacttagaaaaatgtcaaatctcaaaatgtatttttaaattttactgtcttctaattaagtgtagtggttagaaaacatggtttttgtgacagaaattttcagaaatttgatgaagcttgctttgttgtacattgtgtgatacatttttgcaattactacatgtccttgaaagaatgcctattttctaaactgttagatacaggaatctatatatgtttattccatttaccctattaaatgtgttgtataaatcattaatctttaccagcttttcctgcttgacaaaaataattgataaaggtgtattaaaatctacctctgtagtagatgactttttaacgttttacatttgatgaattgtgctttatatattttcatgctatttttaaaaaatgcttacaggtttagtatttttatactgtcctgataaactagtaaaactatcttcacccaattgttttctgtgctaaaatctgaatgatctgaaacaaaatggctgtatttccagggcaaatttgtcattattcctttattttcaacctttgttttcatgtttaggtgtgtaaaccacatatgactatacttttaaattcaaactcagagtctctgtcttttggcttttggaattagattcttgtattaattttctattgctacatgataaattactgcaaacatactgacttaaaacaagacaatgtattattctcagtttttgtgagtcaggaatccagcacattttagctgggtgctatactcagctaaaataaaaaaaaaaaaaaaaggttttagcttgctgagtcctaatctggaggttcaactagcaaagactcaccttcacactaccacagattattggctgaattcagttccttgtggctgtaggacagatgcctttcggcttttagctgggactgttttcagcttttagtggctactctcaggtccttgcaatgtggcaatctctcagacctccctttctaggaccagcttgagaaaactctcttcccttaaaagactcctgtgataagatcaggtccattgggacaatctccctttcttaaagacaattgtgccacaggatacaacctaatcacagaagtaaaatccatcaaattcacaattccagggattatgcaaaacatgtactctaggctgaagcagacaggaactcttgggggccagccagaattgtgcattccacattcatttacgtggcttataattagtgatacttggctttatttttaccttattccttttcttattttttatgtttctatttgtcctttttgtttaattttttcaattctgatttctaaaaaatgacacagaaatacttttctgtggctgggcgcggtggcttatgcctgcaatcccagcactttgggaggcagaagtgggcagatcatctggggtcaggagtttgagaccagcctggccaacatggggaaaccctgtctccactaaaaatacaaaaattagccaggcatggtggcacacgcctgtaatcccagctactcgggaggctgaggcaggagaatcacttgaatccgggaggcaaacgttgcagtgagcagagaccgtgccactgcactctagcctgggtgagagtgagactccgtctcaaaaaaaaaaaaaagaaaagaaaagaaatacttttttgtttgcttgctgtcttacacattctattcccattcaatttctttgggaaattatacattgaacctctgttctttcagcagttattctcaattttttttaaacaagtataattaacaaactatataaggacattagaaactaactcccaatgtcctctccaaatttaaatgttattacagtctaatacttcagctctatcattgtataaaaatcctatcaatcagaccgtattaatagtattttaagaagaaaatgtgcacgcttttataaaatgcctttttttagtcattattccatattacagctcagatcatcattttgggttctatttttaactcagcaataataagttggaatcttttagctgaatgctttagaatttccttttagtctctcagtttttgttcaaaactgtccttatttttgtcaatattttgaaggtatttcacagaattatagtgagtgaccacacagctttatgtggacattgtctatcagcattttgaaaatattatcccattgtcttctagctgccactgttgatattgacaggttggctgtcagtctactggtgttttctttgtaaactgatgtcaccttcttgctagtacctactcctccatactgctggaagtagcatttctatgaaaaataagtgatcaaatgattgtcattaactattggctttgtaaaagttgttttcttcatttctatgaagatcttattattattgatatggacaggaggcaaggaaatattgggtagaacagggtggttccccagcaaaggcctcagcctcaagcctggaaactggcagctctaaagagaacaggtattccctgttttcacgcccaaatgttgccttttccaagactactctggcctgccacgactctatcctgtgctcatataaacccctgacccccacagccaccccgtcaccaaacagatgtttatatagttaatacatccttatcatatataatctagttgctacttttcttagtattttagctgtcataaaggacttcatgataaaatagcagtaactccattggcatcttccctggatgtctctcatgaatcttagactcttaatgggtcataagagttacacagactttatacctggttttggaaaagcatgaactcaaagtaaatttaattaaattatctattccacaacctctcttcacaacagaaaactatattctctatggataatcacataaaattatacaaaggctaataaaaagggaaaaacctttttccccttcttacatgggccaaaaagacataaaatctaaccttaaaaattcaatgtttcttacataaaactagactttctcatttgaatgtggcatgaagtggttccaggtaggcaaaactaaaaggaaataagataaaaatgcaaaggaagtacaaactttctattacttattttaaactatttttgacgtgggaatttgttctgcgttgtgcactgctcagcatgcctctgccttggctccggttatcttctcatggtcctcatctattttgcagtctaacttctctagtgacataagatataatttcctaaaaaagagatttttctaacaagaaaaggcagggtaaagggcaagagagtgccatgggaggaggtgctactgagattgggtgttcatagaaggcctgcctgataaagtgagacgtgatctgaaacctgaataaagtaaggatggtgtccttgtggacagtgctccagagacaggagctgggagagctgtgagtaggcaggggcacccaaggaatccctgggaggccaggggaggtgtggcaggaaacatgggaggagctaagatcagaaatgggggtgaggagcaaggctatggaggccctgtgaggagatgacaggattttgaattttatcttgagaaggaaagtttttgaatagagggctgatatgatctgatttatgttttaaaaggatcattttggctgtgatggggataacagactggagaaaaacaagaactttccacagcccacaagaaaaattcaaactactgagactatcaatgaagacactttaaaataaaggacagacctagagactcttcaagtttactgatgttcagaataacctgctgttcagtgagtattacactgtctttcacatggttttatttctgcttatgctatttctgaagcccaaagtgccggttcttcttttcacagactggcaaaatcctactcattccaaatgggccagctcaaatgtcactgtttggtgaagccttcctttatgaccctgggatagttgaacttttttctgcttctcttccaccccaacgttatgaatgtgacataaaatttgagtcacaaaaagaaaacataacaaaaggtaagtaggtaattatacactgtagacaactgctttatataactctaagaaaagttagactctccataataggaaacatagataagatatcaaaacacacagtaaaaccacaataattaaaacgcagaacaaaaatgtcctgaagacaaggggaggtatataaacacacataattctatctacatcatgccttgcagatcaatcctatgaagatatcaacaaaaacaatgacttaattactcaaagcagtagagggccttggtgccaacacaatctctacaacagaagttcacaaactggggcctgcaggccaaatcccaccagatggtgtttataaatagtggacatggaacaccacgccctctcatttgcatatccccctccagctgcttttgcactacctactcagcagagcaagagtctttgtgatgagccatatggttcacacagcctaaataaaatacttactcttcataaaacaagtttgctgacccttgctctgccccactcctccacaagctccttaactacttgaggttctcaaataagtcctgatccttcagtcgtctcagtgactgctcatgctagccgttctgcctggagcatggttctctacctcctctgcctggataatcccactgctcctttgagactcagctcaagccacctctaataagatgctcctcactctccaccgtgcacaaagacccctcctctctggtccacacctgctcatgaatacttggaaactgacactcagcccacctgattttaactatttatatacttgccaccccacttagatatccctgaaacaggaaatgttttctggacttcacttttcctctccaaatgaacaaacaccaaactgttcagcttcttagtttagcatcagatccaggctaacgaagagttaaatgagttagaagggagttcaattagtttattgcctcataggacacatcagcatggtaaagtgatcacaggccattaagcgtaggggtgaaaactgtataaggaattattcctcttaaacatctatgtagagtcttgggtcctgatgaggaattgcctccaacctgtgacggaggttcctctgctacttcctgctgcttccagatgcctctagccatgactcaaccattcgcttcctaatttgttgcttccaaaccactctaggagctggaaagcaaaacaaacatgtggtaaaactggtacctaaaactagaataaataggcttttaaggacctatgggatttttctttcacaggtgcatgaacagggctggtctcccaaagacaatttttctaaatcccagattcttggctatgttctaaatagatttgttttttaaataaataacctagcagtataactaaccaaactgttattaaatggaaagttatactttgacctgcttaaagaaaaaaactatcaaaacttttgcttttaaaaagactagacaatgttattagcaaacagaagttattattgcattagaaaataaaacatacacctacttttaagtaagtctgatatctgaaagtgttaacgtctaaacaaattagaatttttaaatgcacctattcacaatcattaatgcccaaacatgctctctagagataacaaaagtcaaatttcaggagtctttgccaagtgaaaattaaaaagaaattaagcttgttttggaaatgaaaggtaaattaggggaaacttactccatttttataagtcatatatatataaaccattatttataaaaacatagatttcacttttatttctgtatttttgcattctgctagaatcattaaagcctatttttctgtaaaagataaaaatatttgaagtaacattttttcttttaaatttctgagaagcttaaagcaataaaataattgcttccatttctttagcaaggtatgttttttcttgtaattaatataaaggagctaaaaattttcaacttatttgctcaaaagcaattaaaacctagtcaaagatctgctaacttataaatattaagaaaaccattcatttttttttcaaatggcatgatttagttatagatttgccagagtcaggagaatttcattttctaatcttttatgtcccatatgaaaagtttctcaaataatatttcttctgcctgtgttttttcaaaatgctttcactctcattttgcatctcctctgtatagacaggcaatttttgcacaacatgatttttttttcctaaataaactcagttgtttatcagatagagctaaaaagtacccgctgtatgcaaagcctaatttacactgacaaacttaaaacaattctccactttggctttcccattccaatttactgataactttacacatctaatcctggtcctagcacaagatcatgaatgctcttcctcaattttttacttagagtgttaatggaggaagaaagtggcattatgttctctatataacgttaacaaaacttattataaaataaaataaacaggtaactgggtctttttcatccatacaacccaaaataaacagcctgatttgtggctttgtctacgaaatgaacagaaattaaaaactaagggcttgtaaaacggaatgttctattagctcgcttaatattgccttccccacatttgaaaatacaaagtgaggaggggtggctatgcttgattagaacagcttagctactcttatcttttacctggtgggcttctctgatttaagctggtttacatccatggctggcacttgaaatactaacctctgcatacaaacaaatcctgaagtttaaaaactcctcttctgtaacatttgaagaagatactctttttggaattttcagaactgcatcttcctaaatcattctcattctgatcatttctgactttcatacaaatgatagtcacagcatatactgaaagagacagacgtggaatatacaaaaacagaggaacatatttgtacttagattttaatttattacacaaagtgtatatagatttaaggaagtaaataattctgaatttaaaagcaagtcaatgtatttagtgaataaacatgtaaagagttttaaaatcactgatatgtaacacttccgtttcaaaaacaggctgcatgagaaatgtcaactacagaatttgatttttatagactttggatttttgtattaccaacaaaagaacacataagtaatcatatgccacgattaaacggtgatttaaataaaaattataatatttgatccataagagccaatgataaaatccaaaatgaatgcttctaatgttttgatatcatcttaaaaacattacaaaagaattacgaatatttcaaaccagaagcaatacaatgtattgtacaccaacagaatttatcattaacatattttaaagcaaattatggaaggaaataaacagcagcctcatgtatagggcgatttagggaaccatctcatgttcaggcaaaagggtcttactcaggagtcatactctttcttcattttcctgttcattgtattgttatagtactgtctttgtaaatcgtcttctgttaaatttaaataatcatccccaaatgcaaaatgtactaatctaatcattgtgaggaggactgctaaattcagaatttcttctccaaataattactatcattaaaatcaatattatattgtccccctctttttaaaatacattctgaagtttgttggtggctattaaataaaagatcatgcattactgtacatccttttattaaaaagcaacttcaatgagaatagcaataaactctttaaaaacaaaaacagttatttgcatgagaaaaaaatgagtgattgaatcagcctcacaagtttctctttgttgaagtaccagttatcatacaagccttaggaatgcgtggcacagtactgcagaagtcagacgataaatttaaatgtccttgccaaactggtaacctgccttacataaacgacacgacatccaatcaaggtagcacgtggttagggatttttctttttctctttggtaaactgaagagatgtgacagggaagaaccccctaagatcaagcacaaaaggaaaatagatgggggatactgctgacctgaacctgatttcagcagcagttaacatggtagttaattcaatccaagctatttctattacatgtctaattatttgcaaagctttggggagagcactccacggtaaagcaaagatacatccatctttgcttcaaggagcttataacccagtgtgacaaacaggcatgtacatagtttaactgtaaagaacaacatgacaaaaggtagggcatttgcctctagtagatagttgataaaataattaactcatattttaaaaaagcattaacttttgttggaagttaaatttagggtgatatgacattgtgtgagataaaccatatttctgttccacactgagtagctattctgccatgaactctgataaaatggagtggcagtcaacttaattatagatagaagttatctggagaaagctgatcagcctgcctttctgaggtaccttctccgaatttaacgcagttgggaaaaacagaaacattttttttgaccactatgtgaaaactttaactcccctacttagtttccaaaaagctaacagaataaaacctcagtttacctatcaatattatgtctcgaaataagatggaactctttctcatctggaaggaagatattaacagtacctgccctcctaaagttgttctgaggattgaatgtgttgtttgtctaaaatgcaactgtacctatattcttctcttttctcagctgaaggacatatcaataccctgttgtggatctgaatcttattcatctttaggctagcgcaaatacggcccacaaaataccattttcccagacaacccaagccctcacaatcacattctccagtgtcctgaatctcccataggtgtcactacagaaaaaaacacttacattcaataaaagaaaagacttttgataatcatcctctttaaatcaggaacactggacccaatgccatcgagggccctgctctggtctgcctctggccatacccctcaccacagaatgaggagtctgtcaggacagaggaggatgtgcccattcagggcctgtacttcccatccacagtactccccaacagaactttctgcatgatggaaatgccctctttctgtgctgtcccatatggcagccactacgcccatgtggctactgagcatttgaaatatgcctaatatgactgaagagtttttaattttatttaatctgaattaatgtaaatttaaacttaaagagccacaggagattagtgttcacaatactggccacagagaattatatggtcgaggccatcttgattgccaatccattattcacttctttgttttcatcttccctgatgttcatcacagctgggcaaccacttcttcatgaagtacttgcttcttctgacctctggggcaccatacttccctgtttttctgcctgtatctctccggcagtcttcataatcttctttgttggctctacccattgtgctcaaactctcagtactgagatgctttaggactcagtcctgtactctctactctaattactttcctaggtaatctcacatgtcaatacgtcattcactatgaaatctctatgtccaaagacagattcccatagccaacagtgtatttgaaatcttcacttagcatttaaatgtaacaaatccagagcagcagtcttaatttctcacctctgcaaaaagccatctcctcttacaatcttccccctgtcatttttgcatcaacacctacctagtaattcaagacaaaactaaggggctaatctttgattcatttctctttcctcactccaaatccaattcataagtgagaacttttaattaaacttccaaatacaccccatattggtttacattacttcatccctaatatcacaaacctagtcccagtcaccatgatctctagtcttgatttttgcagtggcctccagacccatcttctgcattcacacttgccctcatcaccacccagtctctgcaactgctgatcaatgatgcagatgtactttaaaacaggtggtcacacaaaagtttagtgacaagtggtcatctgaatcaagatttgaaataagagaggaaggatcaagctttgctgatatctaggaaaagagaattctaggaacagagaaaagcaaggaccacaagctataaatgaagaatagcgctaattcaaagggaaatggaaaggtgctgaaaggtttttaagcttgggagaaaaacctggtacacagagaatacgttgaagggagtgacagcagaagttagagaaaccatttaggagacaatttgtgaagtctgagcgaacagttagggagatggagactaatccagataaaaggcatttttagaagttatgaactggatgtggaatgtgaaggaatgaggaagatcaaggataactcctatgattttggcttacaaaactcgaggaaggttggtgttacttattgagttatttcaggtacattaagggatagttctgatggatggtggtgttggtggtggtagtagaggtcagaatcaagggacatgacaagggcaggtacatcacaaaggcagtttccaagaagggacaaaggtcaccaggtaccagtctatggaagtgtcacaaagatgaaggtctgaaattctagccttcacatgccatgtatcctcaatgggaaatgggaggtttgccattctgactatatagttaaatagaagagccaaacggtttcgtacatgagcatggagtacagataatttctcttaattctctccacttacctttcaggatatccattaattctgcatgaatctgtgctcagtgatagaaaatctgtgctcagtagaaaccaaatgacaaaattaactagcagcaatatggcacacagctacagcagctatttttgtgtaaggtgaacagccatatcagaagatggaaaaataggggggtagggtgagggagagcatcaggaagaatagctagtggatgctgggcctaatacctaggtgatgggctgatctgtgcagcaaaccaccatggtacacgttaacctatgtcacaaacctgcacatcctgcacatgcaccccagaacttaaaagttgatgaaaagaaaaaagacaggaaaacaaatccattggatacttcaaaatgccaaaatgtaaagaaaataaaagtataggccaggcacggtggctcacgcctgtaatcccagcacttttggaggccgaggcgagcggatcacctgaggtccggagttcaagaccagcctgaccaacatggagaaacccagtctctactaaaaatacaaacattagctgggcgtggtggcgcatgcctgtaatcccagctactccagaggctgaggcaggagaatggcttggacccgggaggcggaggttgctgtgagctgagatcccgccattgtactccagcctgggcaacaagagcgaaaatccgtctcaaaaaaaaaaaaaaaacaagaaaagaaaagtataacttttttagcatatccagccagagcaaaaccactcactcactaattcagatcttgcacactcatatggttcatcatcatcagggacaccaaaaatcttcaaaaatagaaattggtgatacatgtgctactgaacaaatataactgcctaattttaatctagatagtctaatctaaataaattgtctaaagtcattcataataataaaattaatgtagtaaagatggcaaagagaattaaaagatgatatggtttagatatttgtcctgcccaaatctcatattgaaatgcaatcctcaatgttagagctagggcctggtgggagctaactggatcatggggacagatccctcatggatggcttactaccatggtaacgagtgtgttcttgccatgagttcacaggagatctggttacataaaagagcttggcccttcctcctctctcttgctcctgctcaccccatgttaaacggctacttccctttgccttccaccattactgtaaggttcccaaggccctcaccagaagctgagcagatgttggtgccatgcttctaccatgagccaattaaacctcttttctttatattaatagattgcccagtctcaggtatttcttaatagcaatgcaaaaaaagcctaatataaaaggtatcttcatttttaaaaaggttcattttgttcacatggttttacaaaaaaaacacacaaattattcctgttcatctgaaagtactttaaaatctttgtaaattccagaataagcatttgtctgatattggtcaagtattacctccatgaatttaaaaaatgatttctgaaaacagctctcttaggaaaaccagtataaaggattacatgacaggaagtgattgaatacataataatatgatgctcttttgtaaatctgttttatttatacaaaagaaacactgaatattgatcattgtatttatgcgtctgattaaaaatttcagaattttttttttttgagatggagtctcactctgttgcccaggctggaatgcagtggtacgatcttggcttactgcaacctttgcaccctagactcaagcgatcctcccacctcagcctcccaagtagctgggaccacagacgtcagtcaccaagcctagctaatcttctgtattttttgcagagacagggtttcgccatgttgtccaggctggtcgtgaactcctgagctcaagtgatctgcctgccctagcctcccaaattgttgcaattacagtcctgagccaccgcgcccggccacaaaaactttctaatttctaaacaaaaatacttcagactgaaataactttaggttacttctaatatttttattacaatagtccagctaagtcattaagactgtgttttgattatgaatgcttttggtgaagaaattagatattgctgctatttagagcactaaagacaacttgtagcatgtataattctgccattcattgtttcataaaaacttttatcagcaaaacaatatattttcttcatctttcatctgtgttagttaaaaagagaaggttattgtgcttcagtttcttaaaaacaatatggtaagtaatcatccaaaaaaataagaaaaagatatatgcacatatcttattgggactgtcacaaaagaaacaacaattttacagaaaataaatgtttttatgctttataaacctttcttacaagaatgtcatttgaaaaggaagaaatctcatcagattttaagggagctgtgaatactcaaaacttgattctttgctctatctgccgtgcttcatgctcttcctttattgtcaaaaagcttacctatggaggctccactgcatttgggaaagtcacttaagtcactccactgcatttgggaaagtatggtcaacaactgaaatagcaataaaaatgctagaactgtgttcctataaatctcctacaggatagtaaccacactgattttgtaagctaatgggattttacagattattttagatccagactgatttatgtagacttgccaacatctcttgacatctttagtcttcttctgttataatttctggtagaatccacgggagtgtgtgtgcctctctccttttagaaggggattggagagttgggtagagacacagaaagccagaaaacataggcagaagatatatgtacatataagatatttaacatttatatacaaaatgtctatataaaatatgcatgcatgtatgtatatgtgtatgtgcatacatagcgccaatctccattttatctatgtatatattccctttgcagtgacttatagcactagggtctaagttcaaattacactaagtagtattcatcatactgtctttgaacacctggagtaggcacttgcagtagtgtgtaatgtctacaatgtgggaattattacgctcactttgcacatcaagaaatgggaaatctaagaggttaactttcttttaaaatatctcacataaatttagaatctagccaattattctttttctcaattaccaagtactgtgactttaatacctgactgctaagaaaactcaatgataaatgtgtgatgtaaactaaaaaactcatattttgaaggactactttttacccaaaaggacccaagagtatcattacatttttggcacattttatatatttttaaagtataagcaaagataatgcaaaataaagggctaacagagtaaaaaatttagaaaagttgaacaagcacaaaataaaattttaaaatatttaagcaaaatgccatttgtttagaatattacaaaataaaaggaactaaatataaccatgcttttccaaacagtaggtggtgaaggtgtctttctaatacaaagtagttctgcatttttaaataaaaaaagaaccttaaagctgaattttgaagcctactcttcacaaaatgtcctctaagtaattatatgactaaattacaaatattataaagctatgataatttgatttatgaggcatatattgaccttaatcatatgtgaaaatagagaacacacaagaacaccgtctttaaacatgcccatagtaggagcatatctggtcttatttgtagtttattattatcagagcaataattactgatttcctctgattttctcccacccaacactgtattccttattttctgcctgacataaatatcaaggagcatggactttacaagctttattttgggctatatttcaaaaaattattaccaaaaatacctctttctttcaagtaatgaaagtcagccttaaaaagtttctgtgtgtttgtttaaactttctgactagaaaccccactcttcccataaaaacagccaaaataacagacattgatatcaggattatcccacgaaagaaataatcctttttatctcactgttattttaaaaaatcaccttacatacttgtaagtggagttattttcatataattttaaacgataatgattgggggaaatcattttaattttctagtgaaagctttaaaaaattaacagacacttaatttaatggattttactatgttgttaaagtttatgcaaggccattggtttagaccagcctcctgcactaggccccagcagactagaccaaatcagaatggagtcacctacactaagtaacataatcaaacctatcttgaaagagataagtttaaaaaaaaaaaataaaagattccagtcaatctgagtctgggtaataagtctcctctcttttaaccctataaggaaagtaaatttgaaacgaccaacccactcttggttctgtttctgctttccttagtccttttctgcctagaaagccaactacctctcttagttcactggagcccttgtggtattttaaagaataaggtattggcattctaaaattgcaaataaaagacaaattgatcttcaaattttgccttttgaaaatggtttctccttaaagaacaaatgtagaagaaaccagtcattttacacctttaaatactatgcaatgttgaagattaaaaaaaatacaacttcttttcaccttaataagactaaagacacaaaggataaaaataaatattttcaaaaggaagcagaaagcagaaaatattgttctggaacagtctaacattagaagtaatgcacatatacatattttttcatgagtatgggtaagtcagcaaagattttaaaaataaacttcagccagaaaacatttttatattaaaagtctaatgttatttaaaatatattttcacatattttagaaaatgtagatttctactcataccattgctatgcagataaaaattccacttgtttagaatgacccagattaagaaccatctcctctcctctcaacaagttgaatacattaacattgggacaaatgaaggtcactattcagtgttttaatattgatatatttagtaactcaaacacctctgccttaaaaagaatgttaaaaatgaaatgaaggtccagaaatacagttttcaagaatcatggaaaacaacaagttctggacaagcacactttcaaaataattgtaatcaagactggtttgggaagaaaacattgctaagctaattgtgcattttcttgccttcttaacaaaaatggagatactatcaactctttctgggtaggtatactgtttatatacctcaatttttgtcttcttctaaagatacagttggtgctgcatatgcagatgacaagaacagaaattggtaaactacagttttcctataacttttatttctaaagaagtttctgttgacagtttgcatctttggatgacttatctttatgagtaaagcagaaaaatgtacaaacttgtaaataatataattatctccgaacaaaaagtaacattgtatcaaaagccaaagtaataatctcccaagaggtcaccaaccttccagaaaactgcttcatcactactgctgtaaatgattgacttgtctatagcattcattgacaatatttttttttttctgtgttactacaagtagctccttcacagcaagtatttatcctggggcccagtttgttgttttaatggtattaacttatgaatttcaagactctagatttgggcattttaagaaggcctttttaaaaatctacaaattcttcttcatcatcagaaatctctcctgaactattgtataatctgaatggtactctggaataacaaatgaaaataatgggacaacaatggaaggcaaagagagtaaaactaataagaaatagtgatctcacttttttaggatgaattctaaactcctagagcagtagaacagcattactgttctcaagaaataaaactgacgttgaaaagaacttttagtaaagattcttaaaaacgctagaatcaaatgtccacatatatattcatttgtatttgaaaggtatagacattttaccaccactaagactttatctactctagcaggtatttaagtaaaataggaacgtataaaaaccatggccaaaacaaacaaacaaaaaacagttaaactcttattttgcttaaggttgacatctgctagtatagaaatctaatggccatcaataaggaatctgacaaactagtatccatacaacagagtactatacagctattaaaaagaatggcatagagttatggattgctagagaaagacatctaagttattctttttagtaaataaagaaactgaaagacagtttttgcacagcaacatgcaatttgtgtattcgtagtatatgcacagaccactgtctcagttacaataaaccatttactttgcttatatttgtgggaatagaggtgggtagggtgaagctactactctttaaccataacttacttaaaatttttcttaccacaataatacattgcttttgttataataaaaagaaataacataaatcagcactcttatggaaatgtaaatgtgttcagataatacactatgttcagaggcaagagctttgaaagagaaaaaaaaaaaaacccttttcttatttcctattctgctgactgattatcagcccccaaagcaggctttctaacatcttattttgaaaaggcactctttcaaaaaaatccttgccccacacctccgcaatgcttttccaattagcactgggtcagagagaggggcaccttcaaatctcttttctaatgactaaataaacacaatccatgtgatctaatttaattatgtgtatggtgtggctcttctcattaggtttagttgactcaatttctgccagtaatttgatcagttcatttttttttcagtctcattgttttagaatgcactcaatcaacaatattgacttttttttttttttttttttttttgagacagagcctcagcctcactctttcgcccaggctagagtgcagtggcgcgatctccacttaccacaacctccgcctcccaggttcaagtgattctcctgcctcagcctcccaagtagctaggactataggagcgcgctgctatacctggctaatttttgtatttttggtagagaaggggtttcaccatgttggccaggctggtcttaaactcctgacctcaggtgatctgctcgagttgacctcccaaagtgctgggattacaggcgtgagccaccatgcccagcctaatattgattgtttactgtgtgccagatattgttctatacagatttttttaaataaataaaaacataaatgtgcttgtataattcaccatccagtcaagaaacaggtgctgtgctgggtaggtaagtagaggaaatttaatgcagacggcaatagagcacagcagtcaaaacggaaacagggaagaagccaagattagcaagagcaaatccaaaaagccactttcatccctagaactagaaagaccaaaggaagagacaatgttatcagaattcagggctggctccatcagaaaggaactagaacaacaagggctcttaggagctggctaacgagcaagtaactactgccaaaaaaggctgcccgagttagtgagagacaggggaagatgggtcctggatgccccactcctttagcctttgtagttgtctgtcaatgccttccattggctgaacctacttggaggcaagtgagcaagcagacgggacatagtttgcagaggggcaggaaacagataaagcaaggagacgtttagacttcagtaatgattagcatttaagctactcaaaatctataaaacttttcgctctcaagatgtctacaaaccatgcacaccaatgtatatgggtacatatacttgggacaccacattcacaatgaaatgatgccctgtaagtaagatacagagtgtcatcttttgagcctgcagggatctaagagagtctcctaatctcccaccaatatcatctacttttttattcttttaaaaatttctctccaggtaattcataagaggttgtcaccatgaatgccattatatttttaatttagttactgatggagcatagataatattatttactttagcacgcccactctactaaactcatcatttaacttaatcacttttttctctcatttgaggtattcaatcaatttctcttaagctaataaaatgttcatttcattttatttagtactttttgtatcgcatatacacactgaataggcttttctaaaacaaaacaataataatgattgtgctaggaggttgttggcttatcttctgattttaatgaaaattcttttgactttttccattaaatatactgttgactatgggaaaaaatacccaatccgcttttaaataagttctattttttagtatttttataaggaatagctgttgaattttgtcaaatgtcaaaatttagtgagaggattatagagtaatagttcttatttatcaacggatttccttttgattccttcttctatctctgttttctcttaatcctcctatatttcttggcttatgtggaaaatgtcttggcattatataataaagccagccaacaaacgtatttctttctttcttgctgggtatttccatttatgaaccacataattacaatctgacttgaatctgtggtttccccaacacaccccctgtagattcatcattgctggataaataagttgcttttttgctgccaaatctatgtttttaattcagtttctagattcagagctgttctaggtggctgaggttattgtctaacttctgagtgacagaagatttgtatagatacatgagatcctagaacggctcccttggaacacttttgctctcacatggtgaaaccacagttaagtagtttttccaatggtgtgctttagtctctagtcgtcttaaggataagatctcaccctgacaaccaggcaacactgttcacatcacataattctcttgtgtacttggtttgggtgatggaatttttcatatatgaaattatatttaagacctgaaacattagaaaagtaaaataggtgctctgatctatgccagtcctcgtatctttatagtgggtggttagtaatgttgacattgaagacaagggttacagggtgaattatgaaccatatataaaataaagagtgggcggcactacacagggcacaggaggaaggtcaaggatacatcagggagaaatgagtgacagggagcaataaaaggctgacctgactgagatggagggaatggacaataggtagtttgatattagattaacaagttttgcagacctaaatcagaattttgattataaccaatattgcaatgagaaatcaccatggaattcttttttttttttttttgagacagaatctcgctctgtcacacaggctggagtgcagtggagtgatctgggctcaccgcaaccttcgccttctggattcaagtgattctcctacctcagcctcccttgtagctgggactacagccgcgtgccaccacgcctgactaatttttgtattttttagtagagagagggtttcaccatgttggccaggctggtcttgaactctgacctcaggagatccacccaccttggcctcctaaagttctgggatagaaatcaccacagaattctataaatgggaagaatacaaagtgatgcaacagaagatggggttttgagaaatcaggtcccaagtatacttcacattcaaaagaagatactaaaatcaaaaatagttgctataaggcaaaacatgctggctctttcatgttcatgatgactcagatagtagattatattgaacagttagttgccaattaactagctttaaaattttggatgagaaacagtttctaatgaaattaaactgtcacactgagaatgagatttttttcaaaagcaatggaaatgtaggggactttctgaatgtctatgtgccaagcaatacgcattctgaggatgatggatgaaccctgctacagtgtcagggagcctccaagtctctgactgagacattacaaaaagctgacagtaaaaatgtggtatattcagctttatctatgaaggaattgttaatagagaaatcattagagcagcatagtgaggtgtgataagagtttacatccccatctaattcatttcttctttgaagcatttttaatatgtaataaaatttctctgaatctaggctctcttcagaattagcaattctcttcacattttgttatttaacctaaaacctaaaaactctttttgcccatggagattcattaaatccatacatttgggccctaaatgatagactcacttttttcttttctatactacaaagccatataatacaatggctttcttggttctctccaagaaaatgatagagatgagtatttggaacgttgaagactttccttttattagttctgtgttttattatcctaaaattctaaactcataaaaagttcctttcctgggcaaagtctttgtcatattttatatctggtttcaagaggcaacaggccggcaaaactaatggtgactttcagatctagcaagtctatctttggtttgggggtcacatttacatacacccatacttaagctctaaatttgtttcccatggcaaaaatgaccttatcatttctgagttatagtggaaggagggaatatcaaatttacagcatattgaaaacagttaataaatccctctgatgaaaaatttaaaaaaaaatctgcctcaaatgaaaacagttcactttgctaaccaaaacacactacagctcagtatgagtgctgtttccttatttttattttgaatgaactaacagctttggtaataaattcagcttcccaagcgcaacatgcatctacaggccagacatcttctgatttgtcaaatctctatttgacatatccatgtttacgacccttgggccctttggatcccactcaggtggaactaaatccatcagctcccccatccgaatcaggtattcctccagggctctctattccagtatagaccaataccaaacgacgtggcattccagaacagaaactcctgcctcattcatgtctcctcctttttcaacccccaaattctgtcagtctttaaatgttggctatttcataccccaaattgctctctaatttatctatttctcttcacacctgttacacatccctattctaagccaccatcatatatcacacctggattaatgcaatagcttcttaactgatcttccaggattccttctgcttcttcaatctattatctcccaataactatctacttatcagcaatctttctaaaatacaaatctaatgatgcaatgcctctattaaaaaatgttttggttgttctccaattattttagcatcactttcaaacttgtctcataatgtggtttctgtttattcctctaaaatcaataagcccactcctatgagcccctacttgccctattagtttcagatattctgaactttaagttcttcaagattctacattctctgttcatgcaggggtccttgtaaagatagttcctgccagggtacgctcttctccctcactacactcacctgcctaactcctgcttctccttcaggcatctacatagatttcacttcctctaggagagattacttacctccaaaacctgaagtattcagcccttcttaatatatatttcctatgacagcatttcttttcatcttaccaaaaatctttctcccttttgtatgatctgtgcctgtgacaaaataaactcctaacaaaaaattcaagggtaattaaccgatgttaaacaatgattatcaggtcaataatcttcagatacaaaggacaacattctctctctcattttcttaaagaaaaccttattacaggatacttgtagaatgtttcctattaaatttgcccactaatccaaagctgaagacagagataaccacttcctatttaatgacagtcataaatatctagggccagacaattccctcagggctttttaagatgtggctaaaaaagctctcctacttacaaccttcatccaagcctggcccacttattaagtccataatgaaaaaactggagagaaaaaagagtgaatcatggagtcatgtgtcctctgtctgggatgacagggtggggaaaggaggtggacaaggaggggcttaccctaaccaaaggtaaatggataggtcccaatagaatctctcataaaaatgacagtacgcccaagaaagggtaacttactatctcagtccttgactggacacacatttacacaatactccttattgattatccttccatttatccaaaaatgagaaaaaagaaattacagaccaacaggtaatgaaggatggacgggtgaggacacagcccacactccctccttacggcattacaatggtgtgagagtcccatggattaagggacactgcagaggaagctggcttgtaccctacaaaagttatccagccatgccaggcaactgcagcagaaagaggcaatgaagtgtgattctggtggcaacagtggaggaagatggggtaaacaaaagtcatgccatcaccagatgtctgacatcagggaatggatgctgcccaggaggccccccagttggggccaccccccaggaagggggctggagtcatggccactgggagactgaacacaaacacagctgccctactttaagaggtcctctaagaaggtggaataaaagcaagcatgatctatatgggaaacaccacatcactaaggccaccagcagcaagaacgagaccaagccggaccagactatgaagtgtatctcattgctgccttctctccccatatccgtctgtttccacctaatggaaggaggggaagtaagtgacttggaggacaataatctctcaaccccaaaaagcacaccccaagatgagaaacagaaagctgaatctgaaaaaacagaatatatattccctcccctgagctatgtggaaaagcttaaagttggatatgaggctttgtgatggttactggcttaaggaatatgcagacagctggtaaaaacatttttctgggtatagctataggggtgtttccatgaaagactgacatttgaatcagtggactgagaaggaagatccgcacttatccaatgtaggcaggcaccatccaatcagctgagggcccagacagaaccaaaagagagaggaaaggtaaatttgctctgtcttctgaaactggggcacccttcttctcctgctcccagatatcagcactccaggttctctggcctttggaacttgtaccccaaacccccaaattccctggttcttgggctttgggacttggactgacagttataccactaacttacctggttctccagcttgcagacagcctactatgagacttcacagcctccatcatcacaggagccaattcccctaataaagtctcctctcatatatgttgtatcctatcggttttgattctttagagagccctaatgcaaacctgaagagtgaaactaaactgaaagtttttcgttaaatagacaaaagtcactagtaagttataggaaatacttgagatgtcaataaagaaaaggaagatagccctatcagactcatgaaaagtataaaatcacttcacgtttatattaatactttagcaagttcaggttattcaataatctgactggagatccggtcgtcataagggatttagcatacaagaaaattaaattatccaaggaagacaatgatttgctagagtagatgagagttggtatctaattagacctccacatgttaaagagaaaattcatttaagccatttcataatactcaatatacaaaatcattttgttgcaaactacttcctttaaaataaatttattaattgctagtcacaataactagcagtcacaaaacaggtgtccataaaacatgagaatacatcctgaatcttttaatacattttttcagtacattatagcataattttaaacatcagtgaaatcaatttattcaggactctacatattatggaatgattacatggtttccaaatatgcaatttcattatttctcatgaaaaatcccattaagtacatagaataactgtgaaactcctgtattctctcatttaaaaaaaaaaactaatcgtgcatagtaaaaaaattgtttctccaacaccacaattgaaattgcattcttgaaagaaagtgaattcattctgctgccaaaattagtcaaatgtctacatgtttttcctttaacaataacactgtattggctcactagatgtattcctcatgactataaatggaggaaaacaatatactcctccacacacattctcatcagggttacatttttgtgggcccgtctgctttaaattttacaccaagaaaaatcttgaaagttctgagttctagttttaaaaccagaagataaattctgaatcatagactgttagcctttggaaaccacttccagggtaacttaatttcaagacgatttgataggagtgtctttttctttaagagaaatagacctctgtaaacagtcagtgcatatacactaaactcatttaacatacatgggtcactcttaattgtgtttttgtgttgctgtttatgttgtttgttcaaaaacttcatccacattcagcaaacatcctacaattagctacgacttcacctacagagacaagtagcacaatgtcaggttcctaatattcctttgaaatttacttcaaagctgggctaaacaaatcagtcagaaagcttcagccaagtagtccacccacattcaacctttttctacctaatgataattacagtctgtagaacaggcagtctctaataaacagcatcaactttagaacacagatgtctggaggggcctttttgttgccatagaaatatcttcagtccaccttgtcctcagcactaaacattatctttacattagcctcctattaagggtgtgtgtgtatgtgtgttgggctagattggaggtatatattagcccaaattataggattgctcactctgtcctgatggttataaatgattgtggtccttcattctaaaaaaaaaaatccccaaaatggagcacacaaatcttcctggtgacagcagcccctgactaataggttcttgctcccttggctcaactgaaaacttccctaatgcagcaaagcaataaagatcagcaaagaattctctatgttccttctctccattctaagctccggaggtcagtggctttctaaagtaaaggtatcatccacagttgtaaaacaggaaaataaatctcattatatcaacccaaacatgaatgtaatttgagagtcattaattgagggtagggatctaagggactgtaatcctgttttatgattatcttaaaggttgtttttaaaagaatcagatgaacttccctgaagcatacaaatggcttaaaactacaaattcattttacatagccataaatacttttagtggaaatattatacagtttgagactataggtacaaaatagaactgattcacctataatgcttatagtttaatgtgctgattttaaaggccatttaaacagaaaatcttaacatgcataaagataatttaaaaaggaaaagaacaaaagtgtaattacttggacttttattatcccaaaatacatacggtgtgtcagagattaagtaaggacagaaagactgaagaacagttttagaagggtaagagattcagaaactgtacaggagagtataaaaaatgttttaatgctcaactattttgaggcaggcattatatttctcagtcattttacacacctaatttgtttaattcaaaaatgccagacattgcaattggccttttgacataggttatctcaactattttttaaaaaccatcatgggaggaagtggcattagaatatcatttccatttttatagaagcggataccaagcttaggaagattaagtgacttacccaagttcacagacgtgcttactgggctgccaggaagtgaaaatgattctaattcaatagctctttccagaactgcattacggcatgactttaggtgttactttatttaggagaatggtcgcacttacacaaaacattctaaagtgttctttagacaaactttctcagcacacagtaataattcactgttaaatcacaaatctttaatgttccctctattcttttaattttcaaagataatccctaattgtataagtactaaatatcccacttcactttcaatgaggtaactcactgaggtgactttcaatgcaatgatttaaagttccgtgttactttcaataagatgattgtaactaggattgctgaaagtttaacacaaggagaaacctaaaaaaaattctgtccagcaacatgaccctgagttatttggttaatgccatttcttttggagaactgctgagacatctatctgtatattctccattagtttatctaataggacacagctggtttattcagatcagttctcctgtatgtggcactgataaattatctttataattattttgacaaaaatgttggcccacaaatcaagacattatattttttcatctgggttaccccaagttttcatgtaatatgatctaacaaaagatatcttctcacttggctggtgtctaactgatacattaattttttaagcaatgctggttttttttaaaggtctgttgtctgtgtggcatctgtgtgtgccagaacatgctgtgatagtgatgaagtgatcttcatatcaagagatgggcaataaacactaaaattaaccaccgagtctaaagtcttattaattatggcattccacaaacacataaggctgtaagtaaaacagtacaagggaaataaaagggaatgacaaatttgatataatatttggaaatatattaaaaagacaaaaacctggctatcttttcaggatattcattttactatgaaatttagtaggatttgtacctaaagccgaattcaagaatagaattgtatacttactggtaaatgtttattcacaaatcaagtcatacaattctcaaaaggtagatcgcctaaattttaacaattgggtgtgtgggaaggttcatgccctagaagtatcacaatcttcaactactcttgaactcaatctacaacagaatcaagctaaagatacaatactgcaggggtccccaatggcccatggcctgttaggaacctcgtcgcacagcaggaggcgagtagtgggccagtgagcctttctgcctgagctccaccacctgccagctcagctgtggcactggattctcataggagcgggagccctactgtaactgtgcatgtgagggatctaggttgcatggtccttccgatgatgtgaggtggaatagtttcatcctgaaaccatcttccactcccacacctttggttccattctcggaaaaatttcttccataaaactgggccctggtgccaaaaaaggtgatgactgctgcactagtgaacatgaggcagcagttggcatcaaggatgaccataatcagacatttttaaagacaaatacaacatgggcaatcaacaacctttgggcaaacctctggaaagcaaggctagcaatggagatataacagctcagaaataggcaatcgtgactttcagattttaaaaagtcacatttaaaggatttacctgttaattatagctattaaggatcccctaataaaatccactacccgacacgtcctagcacaagtgcaacaaatttgttttctgggatgtataggttgattcatgtaacaatcattgcccaaaaatcttttaagttctgttccttggatggtttaatctatcgtaaatgcaattttcattggagaagagagaataatgtgctatttcttatttacctacttcactaagagatggaaagacagtttctcatgttttctttctttcctttttttttttttttttttttttactaattcagttcatttaactttgcctccagcagctcaccataaaatttgggtccaaaaaggccaaggaatgtattatcagaaatgttagctatctctaggaaaatctgtcattcatttaagtgataatctttaaaattagcataactatattctggatcattttattacgagactatcatgtgatttcaatgtctgagtttattaccattgtacgagcaacatgctaagttacaactgtaactcccagggttggtttagcaggaaagtgatggaggcagacttaacagtgatgcgtgtagttcagcaaaggccaaatgacagcactgggagccataatggtggtttcctagtaattcaaacagaggaaagtagcaagaatacactgatctcagaataccaggcttgtcagactaaaaaatcctgtgctttaacagtcagtggttgacagcaacttatcctaagcaaaaaaaaaaaaaatcatctaaaacagatgtcatggtaatttcaattttatagctttctgaagtgttgattctatttaatttgcatgtttgttttgttttcatggctgtataaagacctattacacaagagttcaaagcctgtttttaacatatacttaatctcatgcaatattataagccaaaaaattaaatatgattttagaggtattctattcaagatgatttttcccctttagaaggacctattcattactcaaatttaacctgcagtttaccattgcttctctgttattcagtcacctataactttcaaattattgttttacttgtaaaaggcttttaatctttcctgccaagctaaaatctgagacagcgctaaccttttttatgttcatggggctctgttgaaatatgatatcatcatggataatcactgctaaattaatcacctaggcaagtaatagtacaataactttacaaatacacaattcagagtgaacccaacatatcttaacctaagtccaagaatctccatgaacattatttcttgttctcttgccattgttaatttacgttttaaaaaaaatcaattccagaatttaattcccaattactttagtaacttgaattaatttagtaacttcagtaatctggatttgtactgtattgttccccttatatcattgcagtacacacataaaagcagataacatggtgaaatactgcactgaaaataatcctttaactctggatatataataaaattttgttaatgtgcaatacatttttttttcacatgaaacatccatcagaagtttttaaatgttcatgaggatggcttctctacttgaaagtttcatttcaaaatgctattattcctccaaacttaattaacctatctaaaaccaaacagatatcttttcctcaaattacttcatttcaccttcccaactcttctccatgcctgtgttgtaatcataaaaacctagaatgcaaatggctgtttgatttcttttccttaatatcagatcattcatttgattacactggagtttggtttaatatgtgtattgattgccttttcatcattactcctgtatcattcatccaagtcatcaactctcaccacaacgattgtgaccaactcttagctgatgtcaccaactccaatttttttagtcccccaaatgctctaaaaggaaaaaaatactaaaatagattttttgacagatactctaatattcatatttttgtttatcctacttgggatactttgtacaacctgaatcttggaatttgcatgttttattagttcataaaattcttagacaatatgctttcaaatattgactctcctttttctcctgtgggaagtctgttaatacaatctatcattttacatttccattttcctttgtgtgctgccttctgggtaattcttacatatattttccagtttactaattctctttagctgtgactcacctgcctcttaatctattccatttttttatttctacaatatttcccatttttagaggttccatgtggttcttgttcagatcttcctgattactgtcaacagtttttcattacttgctcacttttgtggttcatcttttatttctttaaataagtacatacagccactctatcttctatgtttaataactccaatatctgtaactccttaagtgtttaaattctcagtttcattgctttgcctaattctcacatataatgtcctacctcctcatcaagttggtgaaaaatgattgtgacctgcctgatcttagtctgttaaaatcctggaaacatacaatatggattctagcgaggggatttctgtctgcttcttctgaaagtcagggtgctactgacttgaaaactgtttagcccatctcaaaaggtcctactttaatctgggtatctcaggttcaaaactttcctccttattacttgcccaaatctaggtattcaaatagtgatgtttatatacattggtcctcagagcaatcaccattacagttaccagctctgattagggctcatctgttctattttggtaagggggacagtagaagcacatttcttctaagagattttccactacttaatccctgccagtataacccaaattgtgtttatcaaagatatggttgtgaaaagatacatcattgaatgcaaagtccatattattttctcagcaacatcaacctgttagtctccattataaaatatatgatggctctttattcattggagcatattaacctcccctgcctgttggtcaataatctgttaatgtcttatgtctacctatggtgcctccagaagcccccttcttccctcactgagccggcctcttgatggttcctcatgttcaatacatattctgcctccattcatacagcattctccacatttagactatcctatcctctttgctctactgatctaaattctgcctactttcaaaacccagctcagacccactttccttcatgtaactttcctaattccaacatttatttgtccactctcctcagctctcagtcttctaagcttaacacaaaatgatacttaattaagaaattcaaaaaacatgaaagatccttataggccacctattaatatttcagtccccaaattcaaaattaatcaagacccagagtagttaagtaacttgaagaaggtcatccaggtgttagatggcacagttcatcctggcatctggttccacaatgtcagtgcagggctcattttaattgatacttcactggtctttcgacacttctgttatcccctctgaacatgatctctgcattcaaggcttcccctcacagtgaaagcctaagtcattacaacgacccacatgattgaccctctcccttccttctagcaaacaccaacctctctggccacatcatctcccacatctcttcccctggcttttctgcctcagacacaatgcctttttattattcctcaaacacagaaacacactcctccttcaggtctttgtactggctgcccacttgcctggaatgagaatagtctagattaactgcctgacttagtctactgcatctttcaggtcttggttcaatgtctacctattagaaataggcctgagcatctaattaaaatattaatgcttccggccaggcgcagtgactcaggcctgtaatcccagcactctgggaggccgaggtgggtggatcacgagttcaggagatcgagaccatcctggctaacacggtgaaaccctgtttctactaaaaatacaaaaattagctgggcatggtagtgcgtgcctgtagtcccaagctactcgggaggctgaggcgggagaatcgcttgaacccaggaggtggaggttgcagtgagccgagactgaaccactgcactccagcctgggtgacagagcgagactctgtctcaaaaaaaaaaaacaaacaaacaaaaaaattaacctttctgattaatctttaaccctcctaaaggttttcattttctttttttcttttgtttttttttgagatggagtttcgctccgttgcccaggctggagtgtgatggcatgatctcggctcactgcaacctccacctcctgggttcaagcgattctcccacctcagccttcagagtagctgggattacaggcacccaccatcatgcccggttaatatttgtattttcgtagagacagggcttcaccatattggccaggcttgtattgaactcctgacctcaggtgatctgcccgcctaggcctcccaaagtgctgggattacaggcgtgagctaccgcgcctggccggttttcatttttctttacagcactcaccactgatatttagttgttgatctctatgctatctgccccactcctcaaagaaataagttcatgattgtctattttatccctactccctaaaacagtgcccagtacatggtagaagcacaataaaatatttgatgaatgaacaaatcaatgaatgacaacacgaggtacagttacgtaatgcacagttggcattgtggcaatggccagagtataaagaccatacagagatcgcccttctccagtagtgctcacggtacaggagaaaatggacaacaatacgtacttgctgatcaacagatgcaagatttatacataagatctttcagataattacaaaatcttttgaaggtgcacctaaaagatcaccttctaaccctcccagcccaaggtatccaaagtaaaatttgcaaagtcttcaactaggttccgtttccatactaccagtggccgagcataaagcacttgtcagaaagaggacctcatttttcaaacaatttgactagttaataagtttttgcttcctcatatattccagttttgcctccgtataacttccaaagtttgtactaactctgcctcctgaagtacacatgatgaagcatacaacatcaacaataaatctttcaaaaatctgaaaatctgttgtcttttcacatatatgcctgttcctctgtggactaaatgctttttgttacttcaatgatgcttaatatgggatgattttcaaatccctcaccatcctggccacatatacctaaacagattgctcattttcagaataaagtatgttgccctcacaggacagacatagcatttccagcacaaagtcaagggaattttaataactgtgatatccagacagccattcatcaatctacatataccaggcatccactaggtcccaacaaacttacgtttgtttaaaaacaaaatttttataggcgcatttaaatatctattaatcttcttggtgttaacttcattcagtccacacttttccattttgtccaaatagcttaagggaaacatctttaaattctttggtttttcttgatctactattccaagaatcctctcaatttggttattttgtatataatcaccctgtacgtgtacatttctatataatttataaattttctaattttatactttcaaacgttattttttttggacacatttaatggctcagcaatgtgagcagaacagaattattagcctcattgataaattgatatgcaggagctcatagagattacagcaagttaaatgtatagctggaaataaattccaagccttttgattcttcatttgtactaagtctcctccactggcccaccttctgagcaggctttattttttcagaaatattcatatttgctccaaattaacacaatctatttaatattattttccccagaaaaagtttggaaattttaaaattctgtagtgtttgaaagtcacatctttgccctattttgaaggtgtaatatttgatagaactaaaagcaggcttaatcctgcttttagaactcacgtgttctagtactcaaatgcctaaatatatttggcaaaattttgtaatcaagtcataaatgtaacactatataataatcttaaactacagattgttctgcaatttgtctttattaaagcaacttgaatcttagccacaacatttttaggtagtggaaattgtgaactatatagcaatgaattcaaactcttgacccttaaataaaaaactttataagataaatagttaagaggggtaggagagagagaatggttgttatcataggatacaaagttttagataacaggaataggttttgagatctatggcacaacaggctgacaatcattaataataatgcactgaatattaccaaataaccaggggtgctatggtttgaatatttgtcccctccaaaactcatgttgaaatttaatgcccaatgtggctgtattgagaggtaagggctttatgaagtggaatgggttaatccattcatagattaattgaataattaatgagttattaatgggttatcatggaagtgaaactggtagcttcattagaagaggaagagacacatgagctagcaaactcagccccttcaccatgtaacactctatgtcacctgggaactctgcagaaagtccccaccagcaagaaagccctcaacagatgtggccccttgaccttggacttctcagcctccaaaactgtaataaataaattccttttctttataaatgaagcaacaaaaaacagactaagagatttattatcaaatttttaccatgaaaaaagataagctaggtgattgatatattagtttgacttagtcattctatactgtgtgcacatcaggacatctcactgggccccataaatgtatacaattatttgtcaaaaatattaataaaatttttaaaataaatgaataaaaataaatagttaataagaggcaagagcataaggtatggtgttagatgaatgaaaatatttattcaaatttcatggctattaaaattaaaaagtttcattaggaagctatttcaactttggttcagaaaatcaatataaaatgacaaagaaagacccaagtctaacactataaatttagtggatatgcaggataatctttgaagatgctatttagcaaaattcatggcttcagtactgcccatgtactctgtagattaacagattaacagccagacacattcctacagtcagggacagagaaacagaacagtggtttagaagttcacagaaaggttcttgaataaatgcatatgcagtgaatttctatgaacttgagagtatttatttccctattctaactgaagaattacagatttttgaagagtacctagaatgtaataaacactatgtcagaagttatagaaataagaaaaatgttcagataataagacagtacaaactaaaagttgcattctttatgtactgaattatggaaatggattttgtctttgtgccttcattctacgtctttattccaaagcaaataccatataaccttttcaataaaactctgtcatgtaggccagagactctgccatcagctcgtgtttctgttccttttatgtttctgtaggatacaatgatttagaataggatgtgtccagggcttgctttttttgttttgttgcaataaggacattgctgatggtttaactactgacttctccttcacaataactcccaaaaggtagtttctaaaatagtttccacacagcttctcaggaaaatgctgcccattgtttatttaatgagggctactagagctataaatatttagtgttctttttctcagttcattatgttcaagtttgccttttcttcttcaataggccattaaaaaaatcaccacagtttatcagcccacaggtgtgggttcccactgtgtggccttcctttaagcaactcccagggaaaaacataaacttaaacactcttttgtggatactgttttgggttgaattgtgttctccaaaatgatatgttgaagtcctaaccctcagtacctctgaatgtgattttatttggaataaggtcattgcaaaggtaattagttaagaagaggtcatactggaagacggtgggccctgaatccaataagacaggtgtccttataagaacaggagaagaaacacacagagacacacaaggagaagcagagacagagattggagtgacacatctacaaactaagggacaccaaaaattgctggcgaacaccagaagctagaagaggcatggaagcttctctcctacaggtttcagagagcccatgtccctgttgacatgataactgtggacttccagccttcagaactgtgaaagaataaatttctgttcctttaagacaccacgtttgtggtcatttgttaaggcagctcttaggaagcttatacataggctaactcacacaccagagttctttgttaactctttaagcaacaacttggctttttatctcttttcaggttttacattccttctacaatattaagctccttcttctcccctcactcacagcatgaagctttaggcttcatcctctggcttctccctctctctctctctcatatccttcccctacttctccatgttattatctttcataacttatctcatgcgttaccttctccaagaaaccttcccttatttctggccaagatgagcactgtgctgagctgttttccccaagcagggcacacatttctccgacacgtatctgtcttccccactagaacactagctcctgaggcacagtgtttctgtttctcatcactgtaccctcaggactgagctcactatcaggcacacagtgtttgttgcatagactacttttgttttgcattttcacactttcttcttcccatagtctagtctcgcctctccttacacgtcacttagtcatcagtttggtagtcagcaagtcattttagggtttccttccttggagaaaatccttccacatgtaaatctagcaaaaaccagctgatgcagcacttgggagccacagtccagctacaggaacgagggctagtcctcgggtttgccataattttaaccatcaactgtaaatcacagtgcacatttcattcagcttgatggtgtgtgacaaggccagaaggagaagcatttagtggatctaagcatgaataagaaaactctttccttcctaccaatacaatgaccaagagactcctcagtcctctgttactcacagagtatactgctcctctcacatagtgagaaagggagaactggactggatgggctaataaataaaataaagctttcatgttggcaatgaccaaagtaacaaatttaaacttggcaaaaagacagaaaccttttaatacctttaaaataaaaagatttttatttttagaaagcactttttaaatataaattaatatcaccttcattatatttttatttcagcttttattatttgaagtataacacttttaaaactgtacaagtagcatgggccaaatttctaaacatggtgatacaaacatattataattgcatctggaacagctttataaacatttttctattaaaagaaaagttttttttaaaaaggaggagcagagtcaactgttttataagaaatcatttatactgcatatccatgaattaaacaaatttatttttaatctttgctggtcgctggccagcccagctctgagtctttaagctgactggcttattcctgccaacatcaataaatgttccctggcacctttgccttccatcctataccccaaaccactttgctctgacctaccttaaaccctattttctgacttatttctgatatctgctcctgatcccttgaatttccttttccaggtccttctctggcacccgggtttaccacctctgagagacccactctccctatgtggctcactctgctgtgagtctgggcagacatgagaagaccaacccactcgtcccctgggaccctaggcttgctgcaggcgttcatcagcagggggtggttgtgcttattaaagccccaagaatttcaccaaagtgaggcattttcactaactcctaccttgactgttctgagaatagtacacatagcaggcactcaaatagatgtggagagagccaaataacttttttttcattaagaaacaaacatctataaagttacagaaaaaaacaaattctctggctggcttttgataatcagtatgagttgcacgggtgaagcaaatttaaacaaggttggagaacgcctctgtgaaggaccttcttccccacaatcattcttcaacaggaaaaaatgcaagagacagcacacggggctattctagcacagtctcttccttcaagagagctctcatctgttacgttagcaaaaatatagtttctttagtaaatggtctgggtggggggtgatgggcaggggaactatgtgttttccatttatgttttcatctttttttttccttttgggatcctacatttcccctcttgctcgtttttgctttcattgaagaattcccaaaagtaagttttccattttacattctgtattagtttcctaatgcttatataacaaattaccacaaatggaatggcttaaaacaacagaaacttatcctattttaattctggaagcctgaagtccaaaataagtcttctggggctagcagggaggcatctgcagggctggctctctctgtaggatccaggtgaaaatccattcttagcctctcccagcttccagtggctgctggtattccctggctcctgtctgcgtcactccaatttctgttccatcctcacactgtcttctcttctgtagccaaatcttttcctgcttccctcttacaaaggcccttgggatttcacttagggcccgcccagataattcaggataatttctctatctcaaaatcctcaacataattgcatctgaaaaatttcttttgcggatgataaggtgacatgcacaggttccagagattaggacatggatatctttagaggtcactattcagcctcccacagcctcatttccgtagaagtgttgcctttccaagattgcctgcctgcctgcctgagccccacacacaagacgttacaccctttccctgcagtcgctgctctgatatacccaggcttctttttcagttttgtttctttttttttttgagatggagtctcgctctgtcgcccaggctggagtgcagtggcacgatcttggctcactgcaagctccacctcccaggttcatgccattctcctgcctcagcctcccaagtagctgggactacaggcacctgccaccacgcccagctaatttttttgtattttttttttttttttttttttttagtagagactaggtttcgccgtgttagccaggatggtcttgatctcctgacctcgtgatccacccgtcttggcctcctaaagtgctgggattacaggcgtgagccacggcgcctggcctttttcagtatttttgaatttaggattgactttctctcttgatggtggatttcagctcaattacatcttctcttttccatgcaatttttctaaaaactcagctctccacaaagacttgagaaggaaacttgagaaatctcttttccagaagttagtgtttacctttctacttatggagagtttaaaatttgtagtgttctctgtcttcctctcatgccaaaaacatggagttttatgattttatctgttctgttcttattgatcttgcatagatttttagaggattggaataatttggctttcataattaaaaagcataaatcctgtatgaaacaggcaaataaacagtactccaacttggggaagagctaatacttacacacacacacacacacacacacacacacacgcacacgcacacacacacacacacacagctttaaagtgttaataattttacataatcgctgacactttgaatagttattcatagaaataacaattaattaaaagatacagctttattgaattccagaactgggatagagcacaagaaccagagctatcaaacatctagtaaatatctctgcctcactatagcagaggagccacgaggttatttcttctgcaagtatctaccccacaacaccccagaatcctcaaaagtaaaaaactgaatgaaattaatgtcattatgttgaatgtagcacttttggtacaatgctttatatagccaatataaataaacactgtcaatgtctttgcctcctattctctgcctgtaaaacagcaatcataatatttaagtaagaaccatctgagaaatgttatgatgaattagccagagtctgtaagttactttgcagtgagggcttaagtatgatcatttaggtttgatgtatggagtgagaaggtagaagctttagtgacagactgtagtcacataaattaatatattaatatttaacaaagaaatgggagatgaggaattgggatgtctgcatcttctacactgtaagtgcaaggactgactttgagctcctgtagttatataattgtccttatttgttaacttcatctgtccccaattaacaggtaaaaaacatattcaaagcagtaaatggtgtcagcggttattttgaaggtagggacatgcacactaatattccgtaggccactcttgtgctcaactaggtcacagaatggccatctctttaaatcaaactttgcagctactgtccaaatttggacgagcatcaccaaaaattcactatccaaggttcagcatggattatataccaagtgtctgattggccctgccttaaaaggaaacattccattttcttagtgtccattttatctgctacaaaaatgattactttataaatgctataaaaaactcaatacatagcatttgtactaggagacaggcacttactatactaataaatctcaacacctttcctggtactaccccctctgcctagagtgattcctctcatatttacactaacctttccaatgcctagatcagtggtcaccaccttggagcccttctacaccttgtaaatcagatataatcaccctatgcttagaaatctattatttttaaatacctatgtttttgtacccgcccatactgcttatgacatacatatatgatggcaacatagaagtatatttaagagcccagcttttagtttatactatgtaccaagttggactctaccatttatttgtagttaacaccctgactggcagatcattcttaagactcagtttcttcaaggaagagaaagatagtaatagttaacctcataagtttgtcagaagaattaaatacatgaaatactaaatctggcaaacaggcaataaacaaacactagctaatatttttattcctgctacaagtatcctgctttgagtgtaaactctttgtattggagattacagattatgtatttggtgaccccacagcatctaggccaatgtcttgtacataataggtattcagaaggcattttaaaaatcaaactaagtaaaaaattctaaacaaacaatatttgttgggcttttctactgtgaagacacagtgagaaatgaaaaaaaaaaaattcctgacctttaggtcattaaatgcttaatctagttaaaaagcttagtctagctaaggggtagtctttaaatgcttagtctggttatatacacacgtacacatatatacaaacaaatatatacaccaacatctacacacacacacaccatatacacacacacatatctatgtatacagagagagagagagagatgtattttcctgcccacactcacaaaactaagtgaaaagaaccaaggaaccagctcaaaagggaatgcagacttggcaaacacaattataagtaaaacttaaaacatactttttctttttttccccaaatattcctccttttgtaactcctcttcttactcctactcaaatctttgtttccatggcaatatttctaccttgaagttccaccactgaaatgtctacaactatgtctactgctctctcttttaaattgctactagaaaattcaatcctccagtccatgatgtagatggactacataaatgcctactaacttaaggcacatttctcacctcatcccccagtactatacaagatattttttttacacagaactattttaggccgatttttatacttgataaaaaataaactccaagaatttcagactctgtgatgtgagctagatataacccaaactcattgagactcaagctctttacccaatacaaagacaacatttagagagctacttaacaatcaaaactagaaaataagaaaggatgccagtaacagaattatccaacaaggacttatttcttaccacctgatcttgagtttggctagacactggatttctcctgccagaaccccagaagtgttaagagaaccctaactgctattgtgaggtttgaactgatgaactctaaaccgtgctgctattagactctttaatgttgctcggtttactcttaattcctgttttgagttgtgctgccaaagttctgaagacctgaaacatgtcattacctctgaattgagttagtttgactactctgaaaaccagtctgattctggagaatccctgccaaatgccacaagctaaacgggtaccctggaatcaaactgttggtactaactcaaagagcacatctgctcctgagcttctgggaacaaatgggagaacttgtaactacccaggagcactgtccacatccacagaggcccccagatacttaaagattatttttaggaaatcttgaagttcacagaaaattcattgatttagttcagctgttccttcaagaattctaacaagggagctcctaaagtgtcacccaggatttaccatgaaaattcctagaatggttatccataagttgaatcaatgccctagaaaatttgctaaccccatgacagaggagttctgactcctataacaaaacctaacagtaactaatccaaaacaactgccttttatgatgctgctagactgcacagagacaacctggattttctccattaatcctgctgctgatcttgatacaggaaagaacactgtctttctctaaatcctaaatctagaatagatagaaaacaaaatgaatccacagtaattttttttaaaaaaaggtctaaattccctcaacaattaagtccaaattaaaattggctacatcactgtacagtttgccctaacgggtaaataatgctgtttattgttgcatttcactcgtctccaattcccaactatatcattaacattgcacgccatattgttgtgaatcaatcctctaatttcatttgaatgcatccagaaatctggatattgtaatcaatatattacaaaaagcaacataacttcataaggatttgcaacatgttcattcctcatgtgaggtgttctagtacatcagggttgccctgcaacccacttggagattatatccttagattctgaacccttaactgagaaatatcgaagcttattgctactattatttctttattataaatttttctcccctgaattttctcaacttatagaaaggaagtccggccagcagcattagttaccccgcattccactgagagaatttgctgtcgggacatccactccctctccgttcgggtgctctactgttagcatcttttctccttcaaattcagaaagatgcaaactagcttgaaaagcctgttctaaacaatactgcacagcagtgccaatactatgagatgtaactggtgcttgtgcatgcaaattaatttaagtataaacatacttcatgtataaattacatgaatatgcacaaatattacacataaatatttgtattgtgtgtatataagtttatatctgcataaacatacacatatgtataactatgtacatatatgcctatgtgtgtgaagcttggttgtgtcttcatacatttttttttaatgtatgtaagctaagtggagataagtcatcttatgggccaggtacaaggtcttgctcaagaaaataccagcccagtatttaaaaaatgatttaactgcttagtcaagtctttctccaaaatttaaaaactaaaatgtgattgtaacatacaaactttcaaaatcccctttctctattttccaaatctgaaacacttagcaaatccatccctcctgtccacagaattctctatccaaacttgccaaactttttgaggctcttagttcccccattcccatccctaggcaccctttcaaagttaatttttctcccatttggcaacagttctctgtcctttcctaaaagttacgtcaaacacaatggatttcctgcttttcacttctaccccctccctcaagagtcatctctctctctcctgttggggttcagaaaataataccccaaagtatggctctttgacttgctgagtattttgaactaaagcagcaagcctcagaaccaagaggtctttctgccctgctcccactaccaggctcttacccctctgccttctccagaagcacagcgaggggctttctttgaggttcccttatctgaggaaaagcagttcctccagaattaatgcaacatcttgggtctccttctaaaatctcatcaaacagagattaactgataggaaaggagagagagcagacaccacacccataactcagactttgtcccaagctacttactgtctgtttttcaggcccactcgtctcccctaaaaatcattcactcttcctctaaaattgcctacatccccccacttccctcccttctatgaagagggtatttaaacttcaaccatctggcccctcttgatgtttcatacttggtgtgattcctgtgtactgacccataatcaacttgtacactttttctcctgttaatctgtttactgtcagattctttcatgtactcaagttgctgaactttcagaaggtggaagtagagttcctttcacccttacactcccattctccagattctatataacaagggcctacaacacaaaagctggcagaaagaagaggctataaatacttatgtattaatattttttcttgtcttgtgcctaactcaatattttttcattatctgtgtatactggaaagtatactcctaagctttgagttcacataggcacttacatattccacaacttaatctccccagctgaaaattcagttgtaagaatcaaatgtaatggtaaaatatgcaataatacatattaatgcaaaaatgtaataatacatgtgtatatatgagatatatacaagatatataatacatgttaaatctaataatacatgttgatagtaattcaagtatgttaagaagtgcctcccctggggaataaataacacacattttaaaacccatgcttaacccatatctttctagatacgtgtcttttgcagttatctgcagctaacccctatacagtgccctgaggatggaggaagtgtcctcttgatttgttaaagtttaaaagaaatactacaccactattatcacacctagagattacaaaggaaagaggagctttagaatctgtgggctttctattatgtggttgcagaatcaataattagcattatgttttttaattgtacacaatcttttaattaaaaaaagtcatgcttttcacagtatgaagaatcaggattttctactattgcatacaattgttttggtatctagtttgcatttaactgaattaatttattgtctagtttcaatgaaactattttctatttacactgatattaccttcaaggagtaaaaccttcatattttctttacactgaaaattactttattcttgccctttgccttaaacattttacatatgaattgcagaccaaagtggcgtttgctttttcccccttcagttgtctatgttagacattctacagatactcctggtcataaacagatcattcctgtatttcaggtacagcacaggactgaagatgagcttaacatctcagcacccatggaaaagactggcaaaatcaagaagctgcacagccaaagagaaattaggaatttgattttggactggaggaacagctgagggagaacagtgtgacatgaatcttatgtgtaagattttatacaatttgtttattaattttgttttgttgggggtggggaggtataatctgtctcttcttacaaccaggagagaggcagattcctctgatcatccatgtcagagataatggaatgagaattctctgtacactgtatcccagaaacacagcatctctgacttcttgtcaggctcaataaattaaaagacagtgaacactgactgggagcacactttctgcactgtcctaggtattgtgcaaggcttcagctaatccaaaaccctacattcaaacttgtaaaaaccagacatttcttttcagataatcagaaaaatacatgccagaaaaatcatgcactagggctcctgattggccaggttagcacagactgaatattaacccccaggcctcctctgtagggtggctttatgtggtactcagccaggcacagcagccctgccatcagaccttccgccacaaattcgaaatccagcatctcaggttcactccaatagtgactcttattctgtacaaaagatgtggaatctttggagatgtcatttaaatgccaattttcatgcttcctcttcaaagttatggcacttataacatcaatattttaaacagttcaagtattttttttatcttctaaatgagtcattcactctcttagcagagaagaggtaaaataaaatgtcaatgactaaaatgtgaactactgcttcaaagatagagtgagtacatttctcatgattcaatggtaattggcttggaacttggaaatacaatgctgcctatgacaatggaaattcactggactctgcaggaattcaaaggctgctggagaaagtgtcccagtattacccatatctcacttactatacttcttataactcaatttcctcccaactctcacggagttttaaaggaatcatttgtgccactcagaatgtatatgtatctactaagcaatttcagctactaaaaatttctcagacgtctccaggctgcagcaccccctggctcctctaacaggctgtgcccatcagacagggcagacattctgagggtcagggcagtcactttttaattgttccattccagaagggtgggtcctgtgatttagaaagcagcaccttagaaatcacagtccccagaagcccaatgaaccagggaccttattaccctcatctgtgtcagctgttctcagattgctgttaagcatgagaaccacctggggaatctggtgaacacccagggtgtttttcttcttcccacagatcctgatttggtaggtctggcgtgggaacccaggatattttacagtcatagtctgcagactacactttgaagatagttgtattccatacaccaggcttccgagttgtgaggcagacatatctcagacactgatcatcaataccatgcaggcacacctgcattttctggctatccactggaaataattatcaaatgatactacatgtgggtaaaacatgaatttttcacttttctcttgggaaaaatgatgatcacaatacttttattccatcttctcaatgaactgacacaaacatcatatgaaaaggcaaaagaaagcactctgaagcatgcaaagcatatacacaggtgtaaagtaggactcaggtagagcatggccaactctttaaattacaaagtacataacgaagtatattatcctaaaatatgaattatacaaggcattttaagtacaggtagatttcattttattgtgctttgctttattgtgcttcacatatactgcctttttaacaaattttaggtttagggcaaccctgcatttagaaatctattggtgccacttttccaacagcatgtgctcactttgtgtctctgtcttacattttggtttagtaattctcccaatatttcaaatgttttcattattatatttgttatggcgagttgtgatcagtgatctttgatgtaactacagtgattttttggggtgccatgaaccctgcccatagaagactatgaacttaataaatgtgtgtgttttgactgccccacccaccagccattcccctatctctttccatctcctccagccccctattccctgagacattaagtattgaaattaggccaagtaacaaccctacaatggctataagtgttcaactgagaggaagggttccatgtctctcactttaaatagaaagctagaaatgactaagtttggtgagaaaggcatgttgaaagccaaaacaggctgaaacctaggcctcttaaaccaaatagccacactgtgaatgaaaaggtaaagttcctgaaagaaattaaaagtgctactccagtgaatatacaaataagaaagtgaaacaactttattgctgatatggagtaagtttgagtggtctcgacaggtgatcaaaccagccacaacattcccttgagccaaggcctaatccagagcaagtctccaactttcttccattctatgaggctgagagagatgataaggctactgaagaaaagtctgaagctagctctagagcttggttcatgaggtttaaggacagaaactgtctctgtaacataataatacaagataaagcaacagctgatgtaaaagctgtggcaagttatctggaagatttagttaagatcattgatgaagttgagaatatacattaaacaacagactttcagtgtatacagaacaaccttgtattggaaaaagatggcatctaggacttgcatagcaagagaggagtcaatgcctggcttcaaagcacaggctgactctcttgttacaggctaatgtagctggtgactctaaattgaagccagtgcacatttacaactctgaaaatcctagggtccttaagaatgatgctaaatctactgtctgctctagaaatggaacaacaaagcctggatgacagtacatctgttaacagcatgatttacggagtattttaagctcactattaagacctactattcagaacacaagattccttgcaaaatattactttgacaatgtacctagtcacccaaaagcactaacagaggtgtacaaggagattaatattattttcatatttgctaacacatccattctgcagcccgtggataagtagtcattttgattttcaattattattattaaagaaatatatttcatacagttatagctgccatagataatgattactttgatggacgtacacaaagtaaattgataactttctggcaaggattcactattctagacaccctaagaacatcctgtgattcatgggaggaggtcaaagtatcaacattaacacgagtttggaataagttgatttcacccacatggatgacttggaggtgtttaagacttcagcggaggaaggaactgcagatgtggtggaaatagcaagagaactagaactagaagtaaagcttgaagacatgatggaattgcttcaatctcagataaaattttcacagatgaggagtcgctttttccagataagcaaatggtttctttagatggaatctactccaggtaaagatgctgtcgacattgttgaaacaacaacaaaagatttagaatactttatgaacgtagttgagcatgcagaggcagggtttgagaggactgactccaatcatgaaagcagttccaccgtgggtaaaacactatcgaatagcattgcatgctacagagaaatcttttatgaaagaagagtcaactgatgcagtaaacttcattgtttcattttaggaaattgccacagccaccccaacctcagcaaccaccaccttgatcagtcagtggccatcaacacacaaggcagaccctccagaagcaaaaagatgaagatttgctgaaagtccagatgatcgttagcattttttagcaataaagtcctgtaaaattaaggtatatacattgtttttagatgtaatggtcttgcacacttaatagaatacagtagagcataaacataagtttaatatgtactaggaaacaaaaaaaaattgtgtgacttgcttaattgcaatatttgctttattgtggtgctctggaaccaactctgcaatatctctgaggtgtgtctgtatcttcaggatatttcttcaatgctccttttctctctctctcttttttttttttttaacataaataaaggagaaccaaaggtagaacttacttttcagaactaatcaaactatatcactctaacacatggtttttagacacagaataaatggttcggttttaagcacacgtagtttctctgcgtgaattactcaagtaattgtgtctctgcagatcagggtacattcagtgcatatctgtagaattgtatcatttcagtaaaatggagagtctgcataatcacattcaccccattttagaagacaactgagaacatgacagaacagcactcaactccgtgtctcctttgaaaaaaaaaaaaaagtgccaagttatcccatgaattcttcccaaagtgttaacatggaattgaaataaagtcatacgaaatagcataaaaaatgtgaaagggtgtcatgtatgaaactcaaatgtcttaccacttaaaatataacacagcttttatgtgaacaaatacaataattcccattttatctaaatgaactctagaacagttgaacaggcttgaaaatccagtaccacagaaagaagtaaggagttgcaccattgagaaggtgagaaagggaagaagactaagcagccagctaaaagtgggagagcccagaggcttctccccttgatcactcctctcctccccaaatcaatactaactcaggattcttattttatattacaagtaacagttttcttgtacaaagcaatgaggaacgtaccctctcttactggaaaacatcagctgtggggcagtaccttggtacaggataagccccattcccatccgtgttttccacactatctccatccagcccataacaccctttcatcttttacctcttctccaaacctttactaacaagagtcagctctgtttccacctctaacattaggccagaacttccttatactaatattaacatctacctctttattttattttttattttttgagatcgagtcttgctctgttgcccaggctggagtgcagtggcgcgatctcggctcactgcaacctccacctcctggagttcaagcaattctcctgcctcagcttcctgagtagctgggactacaggtgcgtgccaccacacccggctaaattttttttttttttttgtatttttagtaaagacagggtttcaccgttttagccaggatggtcttgatctcctgacctcgtgatccgcctgcctcggcctcccaaagtgctgggatctctttttttttttttcagacagagtctcactctgtcaccaggctggagtgcagtggcatgatctcggctcactgcaacctccgcctcccgggttcaagtgattctcctgcctcagcctcttgagtagctgagattacaggcacacaccaccacacccagctaatttttgtatttttagtagagacggggttcccccatgttggccaggatggtctttatctcttgacctcatgatctgcctgcctcagcctcccacaatgctgggattacaggcgtgagccaccacacctggccaacatctatctcttaagtccacgatgatttctggggatcttgtccatccacagtttttactgaaaaccgtaaactatatacaggcacttgaaatatgcaggcagttaaaccctttagctaaaggttaagtgttagaagttctaggcgataatctcacaatggttacaattatctctgagatttaagcaagtgatcattatgttttcatgtgatacatggtgaccacaatactctattccatcttctcaatgaattgagaaaataccaaataataacacacaagtaagtgctctcaattatgcaaggggtatatacaaatggaaagcagtacttgttgctatttttctttataccacaaacactgaataagtcagaggaagtacatttccaacactaaggaaatgcaagcctaaattaaccaaatcagtttctatctactaatcaatagatggcattatttcaatatgcatttttcatgaaacatgataaaataatgagaataattcttcaagacctgcaaaaatcaatgatttcccatgactgtcttacctaacatgcttttggcatttaagttgccactttgtatcacaaaaaaagcaacgttaaacgtagctgattctgacactgagaagctgggtgaccctcaagttccttaaccattattaattacagctgtcctcattggtaaagtggcaatgatcaccacaagattactagggtgtcagataatataagtgcccaagcacataaaagcattcataaatagtaccccccatagacattcttattgaaaattcaatattaggatcactctccaagtaaactgtggggctccttcaagtcagattcttgcctaccttcatccctcataactcacaccattttgtgactaaaaatgaatgtgtttgaaatcaaactgagaagagaattaatccacatgataaaatttaagctcaattaagtgctaaattgggtgggtagtgattgtaagtagattcaataaaagtgcaaatacaagagagatcaatggaaatgctttctggaagagggattttgtgctgggacttgcaagacaactatgactgaaataaactaaaggaacagaggagggtgcttcaggttgtagtcactgctattagctaagaaatattacatatattaacttctttactttcccagaaactccatgaggcagatattataatccccattttacagataaagaaactgagacagattaagtagcttgcccaggttacacaaagtgtcagagtaggacataaatacagaaaatttggcttcaaaatccacacatcgtatcgcatagtcatcaaaataagatctactgatcagaaaagagagtacatctcactgtatcagctgcaaacaacagaatcccctccgtatagtttaagtggatagagacactttttcaaatatcagctcagaaatctcagtacatcagagaatcagccaggaacaacatgggtggggcaaagcgcaagcacactaggtctgctccagtaaaaataccactgctgccacctccaagtgtgtggtgccagaaatgtcacagcctctgccacaacgccgttaagtcctaaccattgcacttgcccaaacagctgttctgtgtgcaggcagccttacattgctcccttctgcatcccttttatgcatggtacagcagatgggcaacatgtccatatcctagcagcaagagagtctaggaaatgcagatgaaaaaataaagattctatcttgggaggactggaatcacaacacaagaaagtaacaacatgtcaacatgataaataaaagatgtcaggcaatcacaaaaggccactacacaccctgatcacaagcaggctgaaaggttctgagaaataaagtcagctatataaagtagggtcagattatataggtgcaactgcatttgaaaacaatttactctgtccaataaaggccataggtctcttaacaatagcaagacattgtttagggaataatgtaaagatgattggttcaaaaattgcaagtgccagaaacttgaattttttccccaccatttagaaatgttatatcataaaagcatagtcatatgcatcatttttttaaaaaacgcaaatatctattaaataaactctattaaataaactggccacatcatatgtcatacattatttttgcctcttacagttttcttatatttcttcaaggatcattttctaagacaatggagacactgaatgctaataatgttttatgtttttggaaacaatttgaattaaaatactacatattaactagaaaagttttttattcaatttgggaaattgaaagttttttaaaaaccatcattcatttaactgtcacaaccatatatgtttctgaataacgtttgaaatgctttctacagtaacaattgtttttagtagttcatgtttaaggaaagacacacatgataagacatagtatttctgagtaaaatccagaatacagaattaaacacatctattttaaaatggcaattattggtaaaaggcaagtatataacggcacaatatcaatgttttgattttacagtataaacagactgacagtagcaattttttcctgataataaagtaataaagcacagcattactttggagcatcattaatgttaaatcttttttcaacatctatgtgaataactggaaacattttttttttttttttttttttgagacggagtttcgctccttgcccaggctggagtgcaatggcgcgatctcggctcacaacatccttcgggttcaagcaattctcctacctcagactcctgagtagctaggattacaggcatgtgccaccatgtctcgctaattttttgtatttttagtagagatggtgtttctccatgttggtcaggctggtctcaaactcccaacctcaggtgatccacccgcctcggcctcccaaagtgctggcattacaggcatgagccactgccctagccacatattttaattttcaaatctgaaatattttacatcacaaaactcaggagaaatgcagattaacaacaaatgcaatggcagttactttttgattacttgacatattgtgtactatgctaagtattatgtatacaatttcacttattcttgctgaattcatacattttattatacctgaatttaaacagaaaaatgttttacatagctctcagacacatttctacagctcaaaaacactgcatagaaatgtgaatatacccaagggcaataatccaaagaagattaaggcaaaatctctatttatatatatttatgtcagtatagaagtcagaagctactatggcaaataaaatttgagaggagaagagcaaatttagcatagacatgcaatgtcaatggaaagacataactgtctctacatctatcttctaacttcataaaacgacatccattaagggttttgatgatgatgtctatgaaaataatgttattttgcaaaattgctgatggtgaaagaatgttaaattttcaacagtatgtaagttttcatgagtataatgctgattggggaaaaatataatcttgaaaatatatctatgatcagaaccaacagcccctgcactgtttatagaaaatgcttcacctcaaatattttgctttttttttttttaccatttacaatacattgactatttttaagtagtctgaatactcatcttttatatgaaatttataacaaaacttcaagcaacccagaaggctcattcgactaccttgttagagctgacttagctaagggaggctcaaggttttaaatgcacagttgcattaatttatttcaagttaaaaataaagtgtgtaaccacagttaaaaaaaaaaagaaaagaaattccttctttatctgaattttaaagaaacaagactgccttatttagcagataaaggctttaaagagtgaataatctcaattattatcttcatgaatttactgaaaaagatataattagttatgacaagaatatggcaatgaaactggagtttgagagttaaaatcagtcatagagactatgagtcaccttgaacattatagttcatttaagatagatgaaaagaagttcatatttccttatgacactttcttcgcattttcttaagacaacagaaaggactgaccaatgacactgaacacagtttccttcttctgtagccacagatatgatcacctagtaagacatgaaacagatcaaaattgtcaccaggtcgaatgccttcagagcacagcatttttctcagtgatgattctctgacataatttgtaaagaaaacaaaacaaaaaaaacctgttgacatctttattgttacattggtttctcaaaacactaggggagttttctagaaggtgaatctaatatgtggtgtcagttctgctcaatctattgatttcaaaaattgatagacacacagtgaaatagaattttgcccatgtggtgaccagggattatgtttgcccattaagtaaatacaaacattattttatataaaacaaacatatcttatgtagtaaaatattttttaatcctatgaaattaaggtgaaagagtgattcaaaagagttcacatttactgtaggatactgcataaaaggctctgtgactctaggcaaatttgcatttactggggtactgaacaaaaacttttcacaagatctatattagattcttcttacacatcaatatattagtaggaattatgtctggtatcagatcatgtccaatgtgataactagttacaatgatcaaaaccaagttacaaagacaaataccctgcaataatgaaaagactgattcacaagacatggactacagttcagtgcctgttacttacttgttgtgtgatcttacatgcatatcatctctgcaactttatttactaataaaaacaatattacatctactcaaaggattactaaggcagacaagcacatgaaactattatgttctcttaatgaattgacatccttattatgagatgctcaattttatctctggttatattattgttctgaggcctactttgatatgaatacagggcaccaacattttggttttgctgttatttagtgtttgcataacgtatctttttctatcctttcactttttatcttaaaacaatgttcaccacagaattattatgttccaggaagaaagttttctaaactattaatagcttttatttcaagatgtgatcatgtcttctaatttctcttgataggtttttttatagatatttaaatttttctaaaataaaatgttatcagacataagaattccagtttctgatctgaggacaggccttgtacacaggcaatcaacaggactggcatggctaaacacgaatagtctcacctttcatacgaaacttcttcctctagagttacaagaaggatgctgtcaaagccaaaattcatctaagttttcattgtaagtataaggaaggccatatactcacacatggttgctgctataacaaacagatttcttaaaaatcactgcccctttgaactatacaaagcaatctgctcaagtctccccttagccagtttagtaatccatatttgctctcctatacagttataaatcctaagccctctggttcaaaaaatgtttttttttaaattcttaattgtggtaaagaacatataacataaaatttaccctcttaaccatttttaagtgtacaactcagtagtgttaactatattcacaacgctgtataacagatgtctagagcttttttcatcttacaaaactgaaactctatactcacaggacaactccctatttccctctcccccaacacctggcaacttcattctactgtcgaagattttgactactctagattctatcctttgattactctagaatgtaccatcttgctatctgtactctgttccttttgacttttcttcttttagataaattgaggggtttttttttgcagtgtttctggttcatctccactattggtcctgacaactgtatctggttgttttgtgtgggtggctgctctagaatttacaacataaggctttatcacaagttatcacttacgacttactgacctaccttcaaataataccataccacttcacaagtggtgggagaactctacctatacttccttccataaccctgtcctgtgctgtcgttactactcattttcattcaatatgtcacgaactccaccatgcattgttatatttgctttcagcagtcaactgtcttttaaaaagatttttaaattcttttatattgacccatatgtttaccattactcatttcctgtataaatctaaattcctacctagtatccgtttctttctgcctgcaatttctttcttctttcctgactgatttcagataagaagactgatttatcttccttcatgtgtaaggtgtattttttgccccctggctgcttttaagactatgtcctttattacttgtttctagcaatttgattattctgtgttttagtgccatttattctgcttggggctcattaaacttcctgggatttgtgagtttatagtttccatcccatctgaaaaatgttcagctttttttcttcaaatatttttttctgatctccctcttcttgaaagtccaattgtaggtatgataagcaacttgctattgttccacagctgcttactgaagctctgtttttatcttaagcctctatttcttttctctctgtgctttgtgctttattttggataggtttttattatttatttatttatttatttatttatttatttatttattttgagacagatgcagtcttgctttgtcatccagactgtagagcagtggcacgatctcaacttattgcaccctccacctcccgggctcaagtgagtctcctgcctcagcctcttgagtagctgggattataggcatgagccacaacgcctggctaatttttgtatttttttattttttagtagagacagggttttgccatgttggccaagctggtctcgaactcctgacctcaagtgacccacatacctcggcctcccaaagtgctgggattacaggcatgagccatcgtgcccggcctactttggatagtttttattgctacgtattcagacattgatcttttcttctgcagtatctattaatgtcatccactgtatttttaaaattttaaatacagtatgatatggtttggaagtttttttccccttcaaatctcatgttgaaatgcgacctccaatgttagaggtgggcctagggagaggtgtttgggtcatgggggcggatccctcattaatggcttggtgttgtcttcatggtaatgaatgcgttctcactctgagttcacaagttgttatcctggcaccagctccctctcaccacatgatgcacgagctcccactttgctttctgccatgatttatttatttatttatttttgagacagagtctcgtgttgctcaggctggcgtgcagtgatgggatcttggcttactgcaacctccacctcccgagctcaagcaatcctcccatctcaacctccggagtagctgggactacaggcatgtgtcaccatgcctggctaatttttgtattttttgtagaaatggggtttcaccacattgtccaggttagtcttgaactcctgcgctcaagtgatccacctcccttgggatcacaggcgtgagcacttggcctcaggtatttctttacagcaatgcaaaaacagacatacatggtgtatgtttcatctgtttaattttttatctttttgtaccttccatttctcttctcatcattttcatgttttccttcacatttgtgagcatataagatacaaaatagatgttttaagatctttgccaattatttgtcatttctggatgtgtttctattgattcatttttaaaacttggttataagttctattttcctgcttctttgtacatctggtaattttgatcggatgccagacattgtgatttttacatcattcagcactagatcgtgtattctttggagtgcatttttgttctggtatacagctgagtgacttgcagatcagttcggtcctttcaatgcttgtttctaaggcttgtcagggtaggtccagagcagtctattccaggactcagggccactaagctgtgacccttccaagccctcttcccaatgcctcacatatgaagaggtctctccaccctgatttctgtcagctttatgtgagctccaagaattgttcaacctactgctgtatggccgacctttccttgccttcctccaatacacaggaagataagtactcaccaaaccctttagtgggcccctctggagatctccagagctctctctttgtgcaattccctcctctacagtattcttctcacaaactagttgtcctaacttctccaaataccaaaccctgtctgcttagctcagtgagacggcgaggccctgtttgggttcttcctccctgctttgccgcccggaagttacctccaagcagtaagctgaggccactgtagagttcatcacgttttctgctctcctctcaaggaccatcgcttgttgtccaatatgtgaaaaaacatctcttatttcatctgagtttctagttgttcatggtgggagtcaattcccacaagagttaatcctttgtggtcagaagcaaaactcctctaaaggttaaacaggatattttggccaggcgcagtggctcaggcctataatcccaaccctttgggaggcaaaggcaggtggatcacgaggtcagaagatcgagaccatcctggtcaacatggtgaaaccccgtctctactaaaaatacaaaaattagccaggcatggtggcatgtacttataatcccagttacttgggaggctgaggcaggagaatcgcttgaacccgggaggtggagcttgcagtgagctgagatcgtgccactgtactccagcctggcgacagagcgagactccgtctcaaaaaaaaataaataaataaaaaaggatattttttgtgatgcactttataaactctgaaccggtatgcaaacattagctcaagaaaacacatctacagagaaaacacgcttgatggtccagatttttttaaaaaaattcttccacaaagacaaggagacaatgcagaccatgatcttgtagaagctgaaatattctggaaaggttaatttgcctgaaatcaaaatgctcaaatcactcagagtatttaatttccttaagaaatattcctttttacaaagcactgaccctataaaaatgcaaataactctaggaaagggcactttacattctcttcaactaatgagactgtggttagaactggtcatctgttggtaccttgaaccattacagcaccatcagagcgcagggacatctggattgtgggtggcaggagaattaagttgaaagagaaagtacattgctaaagggaagaagggcagaattctcaacttcatagctttgcccagggcaggccctgagggaaaggatttgtctgcctgctatatttcccttgggtactatctgtaattactatcacagctcattgattttcaattccttgtattaatatatttattggccattctgacattattaaaatcagtctaactctgcatctttagtggaggatacctcttcttaaaataggagttttgcaagagcagatatttctttccgcttaaaaaaaaaaatggtcttctcacattagccataacacagcaactgcaaatgtttttctttgaagccaggtagtgacatgcaaagatttcactacagatcaaaagatctcaagcagcaggtcatcagagaatattaaatgataagcaaactcgtatttccaagataattctaccaatttagtcaaacgctggcccctgttccacagcaggagagggaataatgagcccctggttaaagggtaatgcaagtggcatttttaataatgcccttttttcacttctgataaagtcattaaagtaacactgtcttactacgcctttacgcacagatgtacactagatcgttagtgtaaaattaaataggtttactgaggaaaaaagttaggctaattgttgggttttttccccctaatgctactgaattttaatgtaatttatttcctgcgttaagtaaacattccatagcacatttccaggttcagctacaatacctgcacccgtctatatttctttattaagcctaacgactggagtctttttcaaaaaagcacccgtctccaaatcctctcaattccagtgtggcaaacagcctctcacttacaacaaatagcacatgaatgaatcaccacttattgagccctgccgattcataagctcctgtgctgagatgatgaggaataacaagaaacataaagcataagctctgctcttaaggaagttacattacagctgacttcatgatgctagtcagctcttggtgatataggaatagcttcaacaccttgttattaatgtcctgcagaatggtttctaagagttactgcaagctgcctctagggaaaagactgagtctcccttatcctcttttgttctgcctctaaaatgagggagtgcataggaatctctggtctggccaaggtggatatttcctggtagttaaggcatggagtattgacgtgattctatacttgtctgcggcaatgcctgcaccctttctagctacatggctatggcaaagaggcatcaggctcgcttccccaagggtaacagaaaggaatctgtcttccactcaattactgactgcttagagcacttaaaatgagcaaaacacccaatctctttccctgtttctgccgcactattgccgctcttctctgccggcccacggatcagaactgtacctggttctacaggagagaagagaggcaggataaccaatggcttcaacacccttgcagttagtgtagacactcaggtcagctccttccccgcggcagattcctcagacttaggaaataaacagtgagggtgactaagaaatgttgctttcaggtctccctctgagtcctctgcacctatgtagttttcaaaaatatttttatttagagagctcatcttttctttttaaaacattttaatttaaagaatttcaaatacacaaaattaggcagaataaactattttcatttttttggttccatgattctgtttttattctgttattgacattattttttgtgttccattatttcacataataaactctaatcagaatttgaaacattcttccagatatccttaaataaaaattcaaattaaaaaaagagttctaatttcagatctacctaccctatgtctacttggagaattatgaattaacatagatgttgaaatctctactagatacttcatgagaattgcagcaacataaacgaaagtaatagggcctttttctcctgtttttcttcaaaagaacactgactcagtacccaccaaaggcaggcaggctcctgtgaagatgggtggttaattccatcttccaggtgagtaggattaaaggagagagactaagcatgacccacacagctggtaccaggctgaataccatctgaactcaggtctttctcactttgaagtctgtgaatttacacttccatacacaggaagcttcactgcagtaagactcataaatgcataaacagaaaggctctgtctcaccccttgctcctcaccaggatcatagaatggcagacttcacctgggagagaagccctcatctccagcacccccactgtatggatgagggcatagaggcctggagatagaaaataacttcccaatgtcattccagctggtgaactgcagggccaggaataaaatcacatagtatatctctggggcagtatcctctatatactaccttatctctgggtgtgatagttctaatactcttcttgtttcagtcctttgcttagtaacatgttagaacatccaaaggctaacagcatttgggaagctcttgtaacagcaggacgcacgcaccaaagtcacagacaaagtcattcaagcactccttgctgtgcccctgaagcgtatcacaagagcacatgcccttcctagaggctgccagcagcatgtgctgtgttaccgacaagcaagaaaaccgaagtcacatttcaggtgactgcaataattatctacctagctttcacttaactaaaaatgcaagagtcagagaactccaaacagaaggcacacagaggtggtgcccatatgctaccacacctatccggttcacatggctacgagatgaggactcctgtcaccaatgagaatgcgtatttccaatatttacaattttgatttttatgttcacaataaccctatgacatagagcaggttgacaattatctattgactggttttatatttttcaccatgctaattataatgcccagacaagctgaataaataatgtattcaccatgtgccagaaactataagagatacaaaccagaaatataagaaatagtccttgtcctctaggagtttacactctgattgaagacacatgaccacatacacacagcataaatctcattaagagaatgaggcaaggcagccagaacttttcacagaagagatgcaggcctgttcccagtctgtctttaacctctgaaatgtgctcctcaggtcctgaattccttggaggggtggggagacatgcagagcccacctgacagcagaagacctaaaggactctttctaacacgcagcagagaacaactacatgcctttctggtgcactgaaacacaagggcatgtagagtagcatatctttaaaatgctgtgtgcagcctgagataaataccaacttttcttcaccaaaagattgagattagtatctatttcttaaagacagagtaccaaaactaggtttttcagagtgattatacattccaaccaatgtaccaccttcaggctttcttcaagctttctcattcattgttgtgacacagacaagtttctatcgctttttgttcactgttaactaacatgtctcatctttttcaaaagtccataatcagctgggcatggtggcacatgtctataaccccagctacttgagaggcttatgcaggaggatcacttgaacccaagactttgagtccaacccgggcaacatagcaagcaaaactctatgtcgtaaaaaatagataaataaatgcccataattatacatgtgagtgtaattatttattgaaatttcactaatgtgtttttcttacaaagaattaaacttcaaccagcctttaagtcataaatgaggaagtcatgaaatattccaaattctggctctccttatctaaaaatagttctaagattctgaacattatatggtatataacacccaacgcatcttctcaatgaaaaacccagcaaagtggccaaaaatgaaagtcaccaaaattctagactttgtttcaaacaagagttgatttaaagcattacaaaattgttaaaattattgtattctaatagagttaaatcattatacatttcattaaacactacaggctgattctcttgaagctttgctacaaaagagaatgaaattgtatctgtcatatatttaagaggtacacataaacccaaaggaaaaaaaaaagttctatttccctccaacatgcagaatctaaataagagttaaaataccaacatcagctccactcacaaggaggaaaatcgattttcatgaacaggcattaggcaatacctatgaacccacaacttttcatgtccctctctaaggacaaaaaaaatgctttctataaataatgtgacatggagttcttattcacactgcaaaactgctgggaatagtggcttttgttttttgtgcacctaaatatttcaggtagaccttaccttgaaaccaaaaaataaaggggaaagaactatatggatattgttaaagattaccaagactggtgacagcaacccacgatcctggctttgaccattggtctggggctaagtttctgactggtttgctatagtttttgccttcctccaacatgcacagtttgaacagattgttatttcaagttgaagaaattattgtgaaatgcagactgctttttcacttttttttcccatgagcagtgggaaaaggctatcctttctgaatgagacgccaggctctatatgagctgagcagaagtttattttactaaactcatgataatgcaactagattaagaaatgaattaagaaaacagaactctaaagaactaagacaaatcctccccatggttaggttaatcaataaaggttgaaactatctataaggtttggaaggtatatacaatttaacttagtgaatccagctagaaaatccagttgaacacatgactttttctgaaaggttttctatactgaaccaatgttagtaattgccacggtcttctccttcatgatcctctactgcctgtgtcttgggctgaatctgttatgaattggtcattatatcatgtataggactgtggagtcatgttattggttgacatactccacaaagttcatttcaaagctacaaaactcaacccagaacatagaggtgaaatgacatcctctaccacgatgaggctctgttcaaacacaggcttacactgaaaaacagaaattatattgagatgccacacagcctgctatgtgatgctcaggtatgcagaagttattgaagagaccctctaaatactaccatctggatccataaccttgaatgttctcattatgaaatccttttgggacattaatatcctaaccctttgagtgggatcccggatgtactcatccacattgatttttatactctaacagtgagattttattcacatttaaaatttcttttgaatgttcaagtacaaaacattgctaatttttagttatgattttttaataagagagacactgataaggtaaagattatatacgtatttatgtccttctatcagtcacctgtgctgcctcagtggtggtggtttaataaaataagtagccaacaggcactcagccacatgagcagcactttatctcttaaagttgccaatgctgcaaccaattatcctgcacttatgctcttaactaaaccagtgaagccataaatgttcattataaaatctatgtcattaaaaaaatatgcactcatagtccttgtattttcagtacccataaatgaattcattggtttggctatgtactgttaaataatctttctttcgcttttagaaatttttcaaattcagtgacctcatcaactatcccctagtactcctacagtaagaaagggcaagtacaaatgtcaaaagagaaacccatccaacaaacagtaacattctcatagcggtactttgtcatttcctgattagaatcaaccaaactatgatgacactgaggttatagtcccaccttattttttaatacttcctctttgctttggatttttattagcttttcaaatcatttaccaatttagatatagccatatggttctaataatgtcactatgccttccaaattttaggatactatcccttccaaggaaataatagttgaagttgcaaatgggtacagatcaaccacaatctcagatttttgtttgttttaacctgagagagaaaagcttaagcaagggaaaccgtagaagtgctctgcaaacctcaggatgctctgcagaagaatgccactctcatcaaaaggagtggggcattgctggaaacttgtgcttaccccttgttcagattccaaaagctctgttttgactctgactgccggcatcccatcaagcattaacattctgttctcaaaggtgttgatattctgagaatagaagggagagagaaagattcagctctaaagcattcaaaagaggacctctgggagagtcttccctcattgtagtacatttagtattgctaacctaattttttaaacaataaagaataattaaatgaaaatatcagcataaccaattatccccctactctgaactttcatttgaaataatgaccaagcagttgaattaagcagtctgattctctgacctctgggttggaggtcagactgtaataaactggagtatggaaaccttacgttaatttatatggggctgcaacaattcatcacactttcacaatagtggaaggaaacagaaggcaagtttttctcttcccttagttctggaaattgcattgtgcaaagatatccataaaggagaaaatcacataaaaatttataaactctcatattagtcaaagcctaaatcatttaaaatcaatataattccatacatttaatttttatgtcatggcaattctggtcaaatgaaaatttctacctatcaacctccaaatatctactttaaaaacaaccaacataaatcttagattaagagtgaatttttaggctaaactaaataacaaacaattatttggtctttattctggtatatgttttgctcaatttaccacctcttgaaaagaaaatcttatctatattgtagctcaataacatttcaaacaccatttataaaagattaaatcaaggttattttctacgtaattgtcaccgccttggggattttctacagtcagcaacccaggaagggagtcagaatcacacttcagtgctcgcctaaggcccaaatcaggctcatatttttaaacatgtttagaatgctaatttctctgttacatattgactcaactacaaatctgacagaactaaatttgattgagattttagaatggttatttttacttaattacagaatgtaaccacaggacactaaagtagtcttattaagagaaaaaaaaatcagtttctaaatattttgcctacctggtgaaaaagataagtataatttctaaatcttcaggtgttcacctttaatatggttgctttcctacaaaatagcaggttaaataagaacaactgggccaggcacagtggctcacgcctgtaaccccagcactttgggaggctgaggcgggtggatcacctgaggtcaggagttcgagaccagcctggccaacacggtgaaaccccgtctctactaaaaatacaaaaattagctgggcgtggtggcaggcacctgtaatccaagctactcgggaggctgaggcaagagaattacttgaaccttggaggtggaggttgcagtgagccgagatcacgccattgcactccagcctggggaacaagagtgaaactccatctcaaaaataaataaataaaaacgactctcctttcaacaaatcataaattacatgttcttattaccaaataataccaacagagtgcagtatagtgaaactatttctcatatttcttgactcttctttttgttaagaaaaatgttccaagaaataaaacatacagagcctccaaggaatcaacaaaaaaaaagcaaatttactctggagttaatgagcatttaaaaagtctacaccacctagtctataaggtgataaaaagaagaaaacaaattactgtcaatattatttccccataaatgttcaatattttcaaaactggcaggatactttttaaaaatgtttgcttttgacttgtcccttttttcagaattttatatcttaatagataatttagagcagaaggaactgtggtatattactggtgagcttgggtgagttgttctaaacttgaaaccctttcatggaggcctgtgggttgttttcacatggggcagggatctcaaatcctaatgtgtcactggcttccgaggttggcagcagccagcttggcttaccaccatccagtctcaggaaagccttcctgcagccggccagccctcgactctccggagtctggcagcagctctaggaatccaccttaacaaagcaccctgtaggctgtttggctggtagacaatgaaggatgagctgatattgcttcctaccctggaggagttcttgcccagatgagaaggcaagaagatgccttataaggaaggcccaagcaaaagaggagaaaagacaaagagcgattctggaaaagcagatttaatgaactgttagaatctgattagaggctaatgtcccttttagtgctttgtaccaatttacagctgatatactttaaccattttccccactggctgtgataaactcattagtttaaaaaatggaagctaaccagagtctttgaagttaaaaactgataaatcataaaaacctgactgggtctgtgttccacttaacacatttaagtatcactatatattcatgatggtttttctttaaatttatattgttcttgaataattctacatgcaataaagtcaagatgtacggtttagtttcacgtacaagtgaaaaaaataaaacattctcgatttttttaagaaatcaagatttcctggaaatctttctatgattttctagaatcattcacagccacaactataataaacaccataaataacaatgttcacagctggggaactaagcttcaactgttaaactctttcaactagtgcagattcaatctgtatatatgcctgttgcaaacacatgtgaagcatattcaactctgcattcacggatctaacctcaatcctcataaacaaaagcgttcagtatcacagcatgctccaaactatctaggaaggtgtgtgatttttatacaacacatggtaattacacagcattgacaatacagtccttgaagcaaaatattgatagatgtatctcactgaactaagatcagatacatataatctcagatgaatgtagactttaaatatgtactagattctaataatctggaactgctgtcaaacatatcttgccatgatcttaatcaaaacacatttgctgtggaatcaatagctcaactgattcctaagagatgaataaaattacagttatcaattttagtaatgtagtattctttgtatatttataacaaacattttgatgttacacaaccctcaagaaatactttatgtatgcttatacacttgtttcatgagtgaattgtttgaattaatgaaaaatcatccatagaatttgttagttggctgttgaccaattccatgtgcacgggatgagaaggataatcttgatatcccatttaccaaatatgaattggcaatggccgggcgtggtggctcactcttgtaatcacaacactttgggaggctgaggtgggcaggtaacttgagctcaggagtttgagaccagcctggccaacatagtcaaactctgtctctacaaaaaatacaaaaattagccaggcattgtggtgggcgcctgtagtatcagctactgaggaggctgaggcagaagaatcgcttgaacccgggaggcagaggttgctgtgagccaagatggtgccactgcactccagcctgagcgacagagggagacggtctcaaaaaaaaaaaaaaaaaaaagagttggcaacacagtagtcgagctgacattcgctctccctgtcaaaaaccatataatcacaacagtcgttgatcccaacatctcaaaatattctgaatgtaatgtgcagcaaggaaacggactgatcttcaatgaccagaactcataaaaacatacaatggggtgactttccaggtcaactcctacaatgtgccctcctaacctcccaaggcaggtcatttcctttctctcctcctgaccttgactcattttgcacaaatggagtaataaggagctagctaggcaatactcaacagttctaagcttttaaacaagggttcctgtcataagtcaaaaataactgctgctatttgttttgctctttgtaaatacaggaaatatgatattttattgaaatacacatccactttaaatcttcacgttcagctacaggtgatgagaaataagaatatgtcgcccctgccccacatctacattatgctagacagtgatgtaagggacatatgaacagtcaagattcactgcaccaagttggttgggacactttcatagcagattctttttttttttgagacagagtcccactctatcacccaggctggagtgcagtgacacgatctcagcttactgcaatctctgcctcccagggtcaagcaattcttgtgcctcagcatcccaagcagttgggattacaggcatgcgccaccacgcctaattttttctattttttgtagagacggggtttcaccttgttggctagcctgttctcgaactcccggcctcaagtgatccatctgccttggcctcccaaagtgctgggaatacaggcatgagccaccaggatggcatagcagattcttaaaggtttgcaatgcaagagtgccaactggttaaaagtaacatcctgtgggtacctcttcctatagaaaaagtatcagaatcagattacagggcaattaggggtttgcataaaaaagatttcttagagaattcaacttctctcacttctaccctaacaaccacaaacaccaataacagcaatttttttcaagtcctattgcagatgtgccagttccactaacaggttaacaactaattgcaaaacctttgcttatatacaagcacattagtgaattcctccctctctctgggtaagggttaacaaacctaatagattgaaatcatgtttaggtaattatttcagttgtctactgccatgcaacaaatcacacagtggcatgaagcaacagtcattttgtcattatcttggtaacaaaaataatacagatatttgcatatttactgtgagccagatcatgtgccaagagctgtgcatatagctgctcatctaatcctcactgcaacccaagaggttgatgctgtattatctgatgttgaggcatctgagacataaggaggttaaattgcccaagcccacacaattagtaagcaatacagctgtattgaaaaccagtgagtgtgaccccaagccagcactcttaatcaccatactctatgtacctacctgtccactcacttacctttctctatatcaatatgcactcctaatacaatagaaaaaaaatatgaacaccttattgaaggtcccaacagagacattgtggaatctcagtaacagctcctccctgagctgggctaatttagctatggaactaaatgtgaaacttgtggtcactggtgagtagcaacgatttggagaatcagtctctggtttcaaagctatttcaaagctattaatattttttttccctttaagtcaagttttccacatattttcttaacttgatgagattatatgtttctatcctaggaagatctcataattaatttagccagtaacttcatttgctacccagcttttaaaaaatattcttgcctttggtggctcactcagtattttcaaaatggtttcatggccttcaatgaaacgctaacttcaccttctacattttatactcaggacagatgcctctcagcattacatttaatttataatggctaagtgtaaaaacatccttttctctactcacatatcctcatgctgataactcagtttcatagagggcatataactaatcaaagtaccagaagtgggacaaaataaacatcccttcaaacacagactttgccattctagcccagcctttcatcttacattcttttgcatcttaggagaatggatatcaatgtcaataactgtattttattaacagaaataagagccaaaaccataggcctattgggactctcaactaaaatcccccatatgtttcaatgatccaaattacattcttctgaaatatttgtcttcggtttcaaaaacagaatccttccattaaaatcctcacattgaagcatatggaacagtatctctcctaaagactggtaaaactgtctatgtaatgcagcaatttttaatttcctgatagcaattatcagtctgtttcctatgttggtaaagtgccaagctatcacaacaatgtgcagtttatactaatattttaaaaaatatttcctattagtgatagttgctgaactagccatgaaaagcagatgttcttattcaagttgcaaatggatgcttttcaaaagggcaaccaatccaatccaaactgggagccaaaatttactattggcatttccaaaggcctcaatacatttttaaggattacaacagatgcatgcctactttcctttgttcattgggcagaggatggttaaaatgacatctgagcttccgaataacacttttcaccccagcatttacacaaattgtactagaaaagtatttctgtcattcatactctgaaaaactgcacacacttgggggttgtgagttggctaaatctttccttaaatattcagtgagggcctctacttgcccgtcattccattccatctgcaccacagtcatgaaccatggataagaggagtgttcagaaagcaagaaaacatcatggcaagagaagtattaacctaccaccaaccaatccctagagaaggaggacaaaacttcagttcagctgaacaggtattaacattatgaggagagatctgacatgtggaggcaggtattagggtagagatggacttacaagtgggtttgatgtcaggtaaagaaaagaattgacttcagtcctggaaaaggaagccagaaacaagatcctttctgggagatgaggctagcagaaactaatgctcaggacctacccacaacagtccagagctaggaaacaggagtagagagaaaccagaaagctggctgggtgctccagtccatgatgccaggcctccttccctgggcacatgcttggacacagaagccaggcaccatgagcctgggcagaagtgccaatgcagcaggcaggcctcatagacgatcaagaagtacatttgcaatacaaccacaatatcctcacaagtttccctaattttacaaattatgataacagttataataacaataacatttattcaacacatgtaccaggggttgtttcatgtgctttacattcattgcatcattcatacattgattcattcccaatatacttattgaaggccagtcactgttccagttatttatgatatatcagtgggcaaaaaagagaaagttctgtggagtttcattccagtcatttaatcgcacatcaactttttttaactacggctattttagatgagaaaattattaaagtttggagagattatataatctgtccaagattatgaaaatgacaatgagtctaaattcaggatgacaatctattgttcattgcttccagagatagagatcctcaaagcacagggtactttggcactgctacaaagctgtgtaagcctagaactgtgcaagcaactctggctagtgggtttcaggctcctgatatatcaagagaccaagtaccacggctgaggtggaagcagcaaggcaaaggcaaactgatcccatatacaatggagaggagagctctaagctcattctaaagttcttgccctgacctacagcaggtgcctctaaccacttccccaaccccattgtccaccattctgttcaggctacatcttgaccatatcaaaaatgctcctccctccaggactatgtgcattctattccatcacagtattcaccactacctgacagactctttatatgccattacactagaacataagttccaggaggacagagagttctctttttgttcgtaacagtactcctatcctagccttgaaacttacaccattaagtaaataaatatctgttggactaataaaaaaatataagatccaatcattctccaggatctaggagataagcttgttgttgacagatgggatgagcataggcaaaatcttaaagagatatgaaattccccatattggtgaacaataaaacagaatttggcatggctaaaacataatgttcattggagaagtaactagagaaaagaccagaaaagttacttggagtcaggtcatgaagggttgtatcagtcccttcttgcattgctctaaagaactaccggataccaggtaatttataaagaaatgaggtttaactgactcacagttccacaggcttgtacacgaagcatggctgaggaggcctcaggaaacttacaatcatggcagaaggcgaagaggaaggaggcacatcttacatggctggagcagaggaagagagcgaagggggagttgctacacactttcaaacaaccagatctcctgagaactcactcacaagacagcagtagggcagtggtgctaaatcattagaaactgcccccatgatccaatcacctcccatcaggccccaccttcaacaataaggttaaaatttgacatgagatttgagtggagacacagagccgagccatatcaagcttcttatatgttatggtaattcatttcttcaaaaatgtttctgtaatgcctgttgggtgctacttgctaggggtgcaagtgaacaagacggaaaggctccctgccttaagacagcttgacgtaaaaggggaagaaaagtgtatgggcatcacataacaggtggtgacgagtcatgaaggcttattaagcaaaagctaagtttaagcgttgtttacagaaagacaggactagaagcaatttggaagctgacttacaaagatgtctgatgtgatacaagagaaactgcagccagctcacagcccaccacaacaggacatgggaagaggtggtgaggtcacagtggcagtgggaagaaagaggaggaaaaatatttgagagacagttcagagctgtacagcctttgatgactgagatgaaggaagtgctggtggtaagaaagagctgggagaagagtgtcaagaatgacaaagatttttctagattttccactaaggttaagacaggaaaccaaataggaaaagaaaaccatgtcacaatcctcctatatccctcaaaggacctactacattctgggatacatgaatatctgggtatagtatttaatttcaatatattttgcttacctaaaatctgttacacagagggaaagatttctcttaagctgcgcaggttcaaatcatataaaaaagactaataaagtcaaatttatccaaacatggaaatacaagtttggttaaaattaaaaaaaaaaatgctatcaaccaatcctctgattagccacattttcaaaaaaaatttactaccattttattctacaaactcatggttatcaaaaccaaaaaacaaaatacaaattgctatttgccaaagtagaagtttgagtactgtacattaacatattcattggtcatttccctttatgaaaagttgtttgaatagtaatgaaaaaaacattcacaacactgaagggagtatgtaatgaaataacatcactggtcttttgtgtcaagagaaaatgaagattactattaagtattaagtcatatattttctgtgggaaacaaaggaaataattattgacctaaatttccaccttttcttgtgtacaatgatttcaagttgctccttatcaaacccaaaatggattaactttctacaacatggatcagtgagtgtttagctcctgcatagcctggaaaaaaatagtgctgaagagttgggaaaaataaaagaatgtataggaataataaaaatccaagttaagtttttaaagtgtgaccattccaatgaaaacaagaaagagcaagcaaccttaattttttctttggcagccagaaaaatgtgcacactgctaaacaagtaaactaagtaattaggttttgttttttctttcttttttttttttttttttttttttttgagacggagtctcactctgttgcccaggctagagtgcagtgacgtgatctcggctcactgcaagctccacctcccgggttcacaccattctcctgcctcagtctccggagcagctgggactacaggcacccgccaccacgcctggctaattttttgtatttttagtagaggcggggtttcaccatgttagccaggatggtctcggtctcctgactttgtgatccgcccacctgggcctcccaaagtgctgggattacagacgaaacccaccgcacccagcccggttttgtctttttctaagaatctacattcattctcttcatatatttgtaatttaaatatttagttaaaactttgtgcttatatgtaattttatcttcctctgaaaaccttgagcatggtattggtttctagtggaatgtatgtttccaaaaaaaagtgaggcagaaaaaatgatctttagatttttacttcatccaagaaaggttatcaaagcacataaaagcatgacgtagtgtttgccttgttattacaaggtataacaaaagtagttaggactaaaagattatttcaatactaactaagttgtagcagtttgcattgtctagacagtcatgtcagacacctaacaagaatggccatgcctttcctctttttcccaccaacactctggatgctcacaatgcagagaagaaagatatcttgcatttctatggccaaatgcatacacttgacccaatatataatctatcaatttttcaagaatatccacttccaagttaagatttttccagatttcccaaatgatgtctttagttatattaaattttacgtataatccaattactgtactaatttgacatttttattggcaatgctgttaaatatctaattcatttcacccaaatatccccaagaattctgtacactttcattattgcatagagtacaagttagaataggacattgccttggagcatgggcctgatgatcagacttcctggtttagtctctaccatgtatataagtccaggtgtatgagactttcttctggtttcagttttcttatctgtaaagtgctgataaatttctgcttcatataatttttttaagacttcaaagaggcaatgtatataaactgcttagcacataatgtcttttacaaatgttaataggtaatatttaaataattataattagtaatagcagtaatagtggtatttcacttattcttcccaaactgatttttagaatgggtgtactaacctgattttctttgactctttgcagaaaccactaagttttgtgtgttatattctttataaaactattacataactaaaacagaaatgttaagagttgttttttataaatgatgacaggaattgacagaaaactaacccacacaattaatacataattgtggaatacattaatatataattatggtaaatggcagcaatgaattattttatctgtttaaaactgtgacgatgtacacaccgattacacagaaatacaagtcacttcatcctaatgaggacatctaatgttttctgactactaaagacaaccatgaagtgtctgatagtgcttcctagcaagcaaattctatatttgacatagtgctaaataaaaagctttactggttctcctttatgtgattatccagaaatatactgtttaagagaaagacatttattactgaacgtatttaacaaacagattactggagaagttatccacaaagtggcctgtaatttgagccctggaaaactttcaaaattacttgaggaaatcaaaagaactacaaaggaaataagttgctaaatttcaaaattagcctgcatttagggcaatatgaagtcagcaataccaacacctctgtgccattacacatgttcctgtcatcaccctgacgatgttctttccccacctccgcttttccacattttaccaaccatgcttgtctcttcttggaatttctgtaggatgtacatgcatgtacataaataaattaaatccagcattcttttttcctttctggagtatttctccaattctaaaacgtaccacaataaagtcataaaggaaacaaaattcattcaacagaaatttggaatacatttttaaattaaggaattatataactgcacagcatttactcaggccttgttacttcctgccagcctcttaataagcatgacccataaaaatagaaacagtataattttgaataactgaataacttatcatacccaggaagtttctattaccctcttttgctatttgatgctgaatatggctaaaataaatgttgccaatagagagagtatatttgaggaagtccattgttgtaactcacatattctttgagaccagggtttcttgacatctgcactacagacatttacaccagataagtctttcttgtccgggctgtcctgtacattgtaggatgcttagcagcatccttggcttctgccactatatcccagtaacatcccctcagttgtaaccatcaaaaatgccttcagaaatagccaaatgttgcagaggagaggtagtaaagcagcccatttcagaaccactgttttataattgctgattctatgaactcattagaaaagaaccttaattttgtccaggcatgctgggtcacatctgtaatcccagcaccttgggaggccaaggcaggaggactgcttgagcccaggagtttcagaccagccctggcaacatagcaagaccccatctctacaaaaaataacaataaaaaaaactagacggtcatggtggtgtgcacctatagtcccagctaatcaggcttaagtgaaatgatcacttgagcctgggaggtcgaggctatgacccataattgttccactgcactccagtctgggcaacagagtaaggccctgtgaaagaaaggaaggaaagaaagggagggaagggaaggaaaaaagggaaaggaaaggagggaaaggagggaagggaaaggagggaaaggaaaggaaaagaaaggaaaggaaaggaaaggaaaggaaaggaaaggaaaggaaaggaaaggaaaggaaaggaaaggaaaggaaaggaaaggaaaggaaagaaaggaaaagaaagaaaaggaaaggaggaaggaaggaaccttaattttatgttgaattatacttcccaataaaataatacctcaatattgaaagaaaataacacctgatataaaaatcatacttataatttgcttcagaatatatctgctgggaaattagcaatactttaaaagataattttattattttccttaaattccttctatcctttctgcatatccaagtttctccaacaaacaagtgcaaagatcccagaaaagggctgcaaatttgcttattagttcaagcaatggaaactgaaagaaacctgaagatttcaatattaatataacaactaaggaaatctctctggccccattcttagacatggccaatgaggatctactaaattagcctcagaagtctccaaagtaactacaattacccaaattaatatggtgacttaactttcaacagggaactagaagacagagttttatccttggctctacatcagattggctggataagatctttagattttgcattccttcacaaaaacaaagagtgacccctgtatcaagaacaaaatatttcacaatatgaactgaaatataaacctgtttatattttattaattttgttagaaaaaagtgacataaaatttaatatatccttgtggttgttccatctagtttctgtgaagaacaataaaaatgatcacaagttatgtaaataaattgctaaagaaacgagggaagggtgctctttataaaaaattaaaagatacgctgggcagtagggcaagaaacacaggtttaaacgttggatcctttctagaagatcgtactgttgattcacaggaataaaagagggaattggttttagaagacaggagatatgcagaaaagcaaaccacaaattcacttcttttcgcacatgcagttttgttgcaccgtctatatctgtgctgtctgggtagccacttgttgcaactactgagcagctgagacatgactagtccaaatttagatgtatgcaaaaagcatattggattttgaagacttagtataaaaaatagaatttagcatgtctcataatttttgaattaattacatgttgaatggtattttgattacactgggttaattttttttaactttttttttttcttttgagacacagtctcactctgtcgcccaggctggagtgcagtggtgcgatctcggctcactgcagcctccgcctcctgggttcaagtgattctactgcctcaacctcccgagtagctgggatacaggcacacaccaccatgcctggctaatttttgtatatttagtagagacagggtttcaccatgttgaccaggctggacttgaactcctgacataaggtgatctgcccgcctcagcctcccaaagtgctggaattacaggcgtgagccactgtgcccagccaatttttttttttaaacttgtaaaatgtctactagaaaacaaaaatcataacttcttttagtgtctactagagtactgaagattacatatgtggattgtattctatatctcttggacaaagctgttctacattatcatgtcagtggctctcacactgaattggtaccatgatcttacctgtagtttccacccaatctttctggaaattgaaaggtggcggggagtgggaagttttgaatgtcataaaattggaagaatgccactttcctttatcacccagaagctagagatgttaaaagtccttagcgtatgagtcagtcccaaacaacgaactgctctatccacaatctcaggtgtgccccaactggaaaacacgaaggtgatctcatctgctaggcagacttcagcaactaattgctgaaacctaactttgtatctttagcactggcctctttatccccgaagatccagaactatattccaactgaccccttaacatctccaactggacattccatggggatggcacaactaacaaatccaaaccaagttcagcatctctgacctccacaccccccttccaaaaaaaaacgcaggcaagaaagacacatcttgctccgcatcatgaattttccatcaaggaatgacatcatcattgacacaaccctatttctcaggctagcaactgttcccttgctaccccacataaaacttgttaccacaattcttggccagtcacagccggccttttctctctattccaattgtcattgtcccatatatgatggtattttctttcatcccaccaccaaagacattttgggacagagggaaattgttcctctatgtctacagcttaactaatttaaccagcatcagaggaaaatcttggcaattgttgatgctagataaaatgtaaggtcataaggaagccttagaaaatatgtctgcattttatataaaatatatattatttatattagatatattaaaggagaaatgaagtctactagtagataaggataagtgacttacatagcagttaaaagtattatatataattagatgtgtttaaatatagtacatgtatatggtaatgtactacatatgtaaaattatatatctcatgtaatatatttacatatgaagtgattctcattatggttatttcaggcaaatataaagagacattttaggaaccttatttctcaacacattatcaggtaaatgctgtataaaaacaaagatattgcttctagattttaaaagggcaatgcataataaaactttattttgctcctaatagtttagtctgaaagatcagacgatggcaaaccaccaccaccttttgaaagttaaaattgcgggatcaacagcctcaaataccgcaaaatgcaagctttttttgttttaccattaacttgaaaccctactaaactccctgaaaaaaactggagatacataaatagatgagaaacatcaggcctacaggcatcctggaaaaataacaatattcacagccaatgtgagtctcaaaaagtgactgaacaatcgacctgcttccagtattaaaaataataattgaaatcaatctaatgtcaaacaattgagaactagatgaatagattatgagacattcaaaccaccaaatatttatatattaaatatgtagctctttgtcttgatataaatgacgaatcacaaagaagtgaaaaaaacagtatgttcctataactttaaaaataatgcatatgagacagaaaaagcatgctaaaatgataaacactcaaaattggagctgatagaacatggagtgagatttttcacttgctttgacatgttttctcactttttaaaataattttaaatgttatctatacaattaaaataaatgcttgacagttcaaaatgtgaggcaaaaaaagagtcaagtgggctaaaaaaaagaagagccaatggttgggataaaaaaaacaaagttcctatacaggttagcaatcataaagtgtaaaagagtcattttggttctctaaccagcaatgtgcacatacatacaaacacatacacactgtcccatatatactcatgttacagttacaatttaactaatacaaaacttaaaaatatgcagctgaaactgaaacaatgtattgtctaagttatatttgtaactgatatgctgaatctgttatacagcttgaactgcactatcaaaacgtttgcaaatattttcattatgcagagatctatgttatactgttaactcatctgagaatgatatgttttttatgttctagggagttccttgacaatagacaaatggacacattatactattatcttgtgctaagtatttagcatccttaaaaaagaaattattggccaaatactttaattttatttatttatttatttattttttaactacagggagtagccagtgagtgtacttttaaagatcttactcataggagaaataaatctttcctggttctgtctggggaaagtacacaagaacaaaaagatttacacttgtcagatttttgaataaaacatactatcttataatcacaacaattagattctgccctcctttgagcctttaatcatgatagccacattctcagattatataacaatattggaaatgttttttgagaaaattcctagagagttattatgaagaggactgtgttctcactaacaatgcatttttggaagaactaaaaatatcctctgggtattttcttaaaaaaatctttccggtttcctgcctagcatgtaagaagcttagaagtagccactccatcctaacaagtgagaagctgaacaaaccgaaaaaatcaacaactcttctcagatctgttagagaagtcacaggcaaatacagtcccgaaattggagacaaagatggaagacacagagaaacagaacttaccagggaagaaaactctgtgagaaccagtattcaggcaggaaaccccaaattgtaattgacggattgctagggactcagagtggacaactctaggagttaaaaactccagggggaccaagtcacagggggctcctgacatgtgtacagtaaaatctgcaatcttacctaaatttaataaaacttaaggagtgtgtgttataatgagactttagggcaacagacaccttaccaaacaagacaaagatggcaagttagcatatgaaaagatgttcaacaccatacatcattagggaattgcaaattaaaacaacgagatgccattacacaactattagaatggccaaaatccaaaacactaacatcagcaaatgtaggggaggatgtggagcaacaggaactctcatttctggtagaaatgcaaaatgggcagccactttggatgacagtttattagcttcttacaaaactaaatatattcttaccataagatcacactgtcactgtctttggaatttactcaaatgaactgaaattatgtccatgcaacctttatagcagcattattcataatccccaaggcttggaagcaatcaaaatgtccttcattaggtgaatggataaactgtggtacatccagacaatggaatattaatcagcaatagaaagaaattagttatcaagccatgaaaagacatgcaggaaccttacatgcatattactgagtgaaaaataaatttaaaaagccagtctgaaaaggtaatatcctatatgatttcaactctatgacattttggaaaaggcaaaactactgacacagtaaaatgatcaagagatgccaggtcttaaggggaaggaaaagataaacaggaagggcatagaagatttctagaacaataaaactatttttatgagactatgatagtgaatacacatcaatatgcacttgtcaaaacccacagaatgtacacaaagagtaagccctattgcagactatggacttcgaatcacaatgatgtgtcaacgtaggttcatccattgtaacaaatgtaccactgtcgtgcaggatgctgaaatttttaaggaggttgcgtatgtgtagggatgaggggtagatgggaactctctgtactttctgctcaattttgctgtgcattcaaaattctaaaaataaagtgtattttaaaaatctcttcgcaagtttaatcacaaattctactttttaaaattcaaaaacaaaaagaatatactctgtaccatggtctccaaaaaaagcagttaaaaataaatggacaattcgataatgcatttcctaactcacttcaggggtactataattaatatttagacatatgtaaaaacactagtgcctaaaagtaaccacgattgccaagtctataaaattataaaaagtagcaaggtgctatctcaagagttttgaagaaacagaccattctctcacacaattttatattacttaagcatacttgtaacagagattcaaacataattctatcaccccacattactttttagcattttgtcaacaccaatagaagggattggttaataatttgaaataccaggcaacatgggcaaatatatcattctgcatttaatcatttttcccctagcagtaaagaaaattgctatctggtatacttattaaataaaagattaaaatacaattaaataaagcatagtcattttgtgccagaagatgtaagaatatgtgtgttctattgggatagaaaaatcaaagtttctatacaggttaacaatcataaagtataagagagtcatttatacacacacacacacacacacacacacacacacacacgtatatatgctgaagtatagtacttcagtatacacacacacacacacacactcggaattatttgtatgtccctgaaaaacatccagtgggaaaaaccatcgcaggcattgagacacagcactctgcctcaactaaccttaacttttctatttattttcaattttagaatggattatataaacgttaaaaaatggttttaggttttactacttccaacaattaggacaagtcattcaacaatgtttttggaacatctgtttatatcaactaccttttaagttaaaaagttttcggaaaaataactccaattttctatatggaaaagtttcgtatataatttagtactcgtatgacgctaataatgccaatggataaatctttcattttcaatactaacttcagaaaatcttaatattttgacatagaaaataagttgtcaaggagaagcagaaatatttatctaaatgtaattacttgaaaaaacattgtttatatttatgcaagctactaattttaaataagaaatcatgtacagcttggatgctaaagtctgattgattggttcagaaatgcaaacacccaaaagaactggcaaaaagattgtgcccctcaataacagatgagaagaaaacctagcactatgggattatgaggtggaacttaagcaagaacagtctctgaggttcaactcatgcgtttgtttctacaatttattaccagtgaaatcaacaaatggggaagctagcttgaaagtactgacagattccttctgaagtattgtgacaaatgtctaattttataccattcatgaccttccatccaaatagtgggcaatggaaaagtaatatgtgtgacagtataactagtaagagaaaacccaggtaccctgtactttcacacacccacaccaactacagccatggatgcagagacataaagagtccacaagaaaacacaaatattaataagtaggtccatgcaacagtgagcatcttactggctcctacccacaattcattgatctttgcatctcccattgtttacagaatagctcacagaacacagaagctcaaaacagcctacccaggtttttttccaggttattggacattgacaatagcaaaaccaccgctcaatttcagaaacactctataagaatcttaggtcagccgagcacggtggctcatgcctgtaatcccagcacttcgggaggccaaggcgggtggatcacgaggtcaggagatcaagaccatcctggctaacatggtgaaactccgtctctacttaaaaaaaaaaaaaaaaaatctaaggtcattctagttttagtgtatacccgaaagctttttggaccccccaattctttcaaaaaggtatcagaagctggacatggtggctcatgcctataaatcccagcactttgggaggttgaggtgggaggatcacttgagcccaagtgttcgagactggcgtgggtaacatagtgagacctcgtctttacttcaaaaacaaaaaacatgatcagaataaatggcaggaggcacattaaagagaatctgacacattaaggttgatatgaacctagcctatgacattccaaggaagccaaagacaaaacaggactgtaagcagtgcttcccaattattttcacactatggaacatgcaaaaaaggtagcagctccattgcataccggggtaagcagtttagcttggccttggcaggcagtcccaaggggtagggatgcacatctcaggtacacttgtaacccatctgtgagggatcagtgtgactccagataccataacagtcaaaagcctttaccttaggatccaatgccctcaacatggctacttcacaaacaaagctaccatcaacagcaaaaaaaaatagtgctgagaactttatactttaataggtcaatgctgccaccattaaaaatacattatcccatgacaataatacatatttcagacgaataatacatatttcagactaaagactttggggcaaaatattttaatgtcaagtctccataagaaatattttattctaaaagcactttattttgatggctcatttcttcattcttccatcggacctaactaatatatacaaggattccagcctctaattacctctgtacagtcctctacagtgataggatgtgtaggccaagcagatatgatgggtggggaatctggctgtcaccaagccaaagatcttgcgcttgtatctacatggctgtttacgatccatccccttctgcgtggtccatgcagtgataacgtggaggctgacttagcatcccaagggcagatgcagacaacattcacgcacataactgcacactgctccaaaacttctgctcccctttccacctttcatctttccctttccagaagcaaataaatatattaaaatttcccactctcaccaaaaggcataagatgactggaacctctgtagaggttattaagcccctattataacatgctcttcaagctacgaaatgacaattttataccaatgagctttcttttccaagttcttctgatgtagctgctatgtaaattaaattaagagcaggccactctaatactctagtaggcggggctgtaaactgcagggcaatttggcagaaaatatcaaaagccataaaaatgcatgtacctttcaatctagcaattgttaactcttggaatttatcctaaggtaataattaaggatgtgcaaaagagtattaatttccctgctgtttgtaattactaaatcttggaagcaagctaactgcccccaaattggatagtggttaaataagttatcacagaaacataaaaatcacaaatgataattctgaaagatgtagaaatgtgcccaatatataatacaagcttgtgcatgtcattcttaagtatcaaaatcaaaatacagataaattatatgaagctacctcattattccaagagcagttaaaattatggtagctttacttttctctctgttttctgatgtttctctaatgagtctataatgaacatgaatagttttgataaagagaactaaaagaaaaaaaagtaaaagtttagagaaaaaaatgccaaataaaaagtatctgaaagaggaaggattaggaacaagtgtgattgtgaggccctgaaatgtgcagccaacattggtcatgaaatctctgttccttggggatttgtaagaaaagggtagccaagtctcatttgaggacagcttgaatgcagtcctgacctctgtggcctcttgtagctccatgtgcaaaaagactcagccaaaattcaattttcactcactgacacacaaagtagtcaattccttacatttgcccccaatcttccacaatcctttctcctgttcaagagacagcaaccttaaagtcttctacccagcaacgaaacccaatgacactgaatttatatgcccagtaatgtgccggcactttactcaggaaacactgtcaaatgttagttaatattccaaaacatgcagctgacttctagctaactgacttgtccatgttaaagaaaaattataactaatttcagccacttaaatatcccagactgagaaaaagaaaatgtaaaatgacatgcattgcatattgacctgtaagttttataactaaaaatcttataaatagtaaccaaaatgacttccaggatatgcgtaaggacaattaaaaatactcacttctgacaagttcctttgctttaaaaaggcctctaattttgttttctaataccttcctatgaatgcaaatgtaacacttcccaaatccataattaaatgcatctttgacttgggaatctgttttcctggcccatgagaaagagttcacagaagatggagagtctgagcatcagaggggtttaaccaagaatgatccattaaaataggtttgcaccagttaccaaaactgagaaaaatgagtttgaatctgtgcagagaggcacagaaatgccaaggtgaaggagcctgccaaggctggaatacacggtcactaaacaaataacgcatggtgtattcaacgccagaagaatacagtggatgatgtgtaaatgagagtctaagggacccagctccaagacaaagtcaagattttaaaaaagaaataccactcctgctgagactctcatccttccgccaaggaggagtccatgccatcacctttgtaagcaaggcatctgatatagataaccccatacaacccttaaggtgtattattcttggtaccaaacatgtgtcatttttacaaaacagtcatccagtcataaggcaggtctgtctcttcatcaataagcctcacttatacagcattcttaggaatattgtgttctcacgagtttcgttttctggatgggtgaggggttctctcttttaattgcaaatttaaaagagaaaatactaagtacttgggatggaaataatcctaatatcttctacatagaaggcaagggacataagttaactttttcctgatgactcagactaataattatgagcatcagtgacgatgaaatgctgcatactgagataacttcagggcccactgaagtgtatcgaggctcagtgacctgaaactgctgtgcttcttgagttcttgtatctgcatattagagtctgtcaggctactacttctcaatatggtcatgttctttttatagatgctccttctgccctatggtgaaacagaaagaacactgaacttagagtgaagtcaatttaggttattatttctagctgaatgatcctggataagtcacttaacatctttgggcccaagtcaaatgaggaacttcaactatctctcaaggtccttttctttgctcagatgcttaatttacatttgctgcttctcatctgttgtagactttgaaatgagaaaaataagtcagctaaatttgcataggaagtaacataaaatagaaatataagcacacaacatgctctcttgtaagtgaagcataaataccttatgacatctatttgtcttctcagaggccttacttgtgtaatttgtagtcactggtggggtctcagacagctatgatttctggataattatgattctatgcatgatatttcactatatttccatatgcttctattttacctaatattctcaaggcaaatcattatttgataatagctttatttcaagccaccgaagaagagaatctgtgtatctttcgtcgtcatctatgcttgtcagcaaactgcaaaatgaatactctcatcttgggactttgacttattcaatggtttcaatgacactgaccacttaagaaagttttctaaaagatgatgcttttgaaaacataagacacagtagaaatgtaaagaatatttttgcaaactccacgaggaaagataatttattcgtcttttattttctagagtccctaacacatgatttgtctattactatcatcatcaggaacttaaaaaaccacatccaagtccacttctcttctccctcgacacgttgatccctgaagtccaagtcatgctcacagctgtacttccagctctgcacagatcatccatctccagctcccacctctcccctgagttctggatctctattccctatcataacctccgtttggatttcccataaagtgtctaagaaagtttatattgcctcctcatctcacatctctctcccttaccccatactttaaaaaaaaaaaaaaaacctatagcaattattcgaaaattcttctactatattggagtgggaggaatactaatccaagagcatgctgggtgggtgctgcatcaggagggaagaatatccaagaaatatgaatccataattactgacgggccagaatacaaaagctacctttttggaggttctaaagcagccaatcctaggcaatgactggataatcaaagtttatactgcctgaagtgaagtgaacatgtgactatataaaagtagagaaaggggttataaagcccatggggctgggtgttatctacaatcccctaccatttatcccacatccaaaaggactgctggcaaacaggccccaggtaagcttctaagttattctctactgccttcaacagtgtataccactgggattttttacacttctttccttcttcactttaggacatgcctacaatgagcttaccttggaaaggataaactccttctttagtgacagaactccttaacatccttcaagccctcattcaagtgtgggtctgcaaagattcctctacttctgccatggtaaaagagtcatttcctcttaccatgttcagattttccactagattaagaactcctcagggatgagccctatataacacttacctctgtctccccagtccctgggatactgcttggcaccatgcacaactacaataagtattcaagacatacatggaagaagtagtactttcacagctctcacttaacaataggccaaggccattctcaaaatcttcttcatagggctaccatcaaaccttcctcttaatgcagtacagagagagagaaaatgttttatgtttacctgttagatatatacaaacaagcctcttgacctacctatcttttgttcttaacatagagacctccttataattttagacttcatctaaccaaaacctgacaaatcccacagtgcttagttaggttcaacaaatgcttgttgtttcacctcctcatgccagtggtacaagcagagttataggtccttaatttgatatatagctggtgcaattttgtatcaaactaggtcaatccatcttgcacagttcatgctttatttccagtgtggcagagtgagaaaacacagagggtagaatctgataagatggaggatttaaaccatagcaccaacacttcctccttgtgtgaccaatttcttatctctaaaaatggagatactataatctacttaagttttttatttattattaacctaatgacaagacacatagcaaggcactttataaatcataaagcattgtacaagaactggtgctggtttttttttttttaatcacaatatgtcttagtgcaatgatggcatactccagttcagatgtactgtcttgattacctcagatccgacatagctgagaaaactgctctaagagttctgacttcctgggatcagtgtcacagaggatctgagtgagcttcctcgagccattttgggcaggctgaagaagcttgttagtatctatatgcttccaggttggcggggccagcttctgccagttctaccatatgccaactggcgacatacaggagcatgctagtgctaccagctccacatatacacacccacttccacccccaagaggtaccagactgtcggacaacttggccgctagcctatgaaaatgtggaaatgctgaagaaacattagccagcaaagcacatactggcagctgaatcaaatgtttaggttcttcaatgtacccaaataaatcgtttgtgtgttctaacaaatgttttctttggaaagcatttttcagtgcagatgcttcaaaagtacccatttttaatgggttaaatcaagggctcaaagcagcagaagggtggggaatgtttttaaacaaaattgcatcagctgcaaagaaaaaaaaatgttaacattgactgagagaaggcatctttgaaaaacagaaaagttgtcagtagttttcaaagttaaatttttatggatttttaagtgttaaaatattgtaagcacccaaaaatgagaaagttactcgaacctggcaagggacaaaaaactgtgctaattttaaaaatacatattgataaacatggttccgccaaaaaaatgcaatcaaacaaggagtcaagaagttaggaattataaattaaactcttcttgccagagacttttaataagcaattgcaaacacatttaaggatttttataatgaggataatggtttgggcgacaatcataatgcaatccaaaaacattaacttccttcacaaaatagactacataaccaaaccccagacagagctcctgacatactgccagcctctaatgcaggcacagtaatacactgtaagagacagaacaaatgatccctgttcttaggcaacaatgaaatgtatatataatttatttcggctatatcactcttttccagtttaagtccacctccatgacagtatcttttttaagacaggaaaaggtactaaaccatcaactataaagttgatactatggaggcccctgattttaaaaaagcatggtgggtatttctcctgaggctccaaacaaggaaactccatcttaatagtgactagtttcatcaccatcaagagaccttatgtaaaactactgacgtcaatgaaaatactacattcacaatggtgatatgaactatgaataaacagagctaacaggctcggcacaatggctcctgactgtaatactaccactttgggaggctaaggcagaaggatcatttgtgaccagaagttcaagaccaccctgggcaacacagcaagaccccatttcatttatcaagaaagctaacagatttttttaagtgaattgatcagatgactcataaggtaagggctttaaatagtattgttttctactcacaaattaaccagctgtacaattacactcatcaaatcagactttgggtgctaccgaatcattaagtgttcattaaatcaaaccaaatgatatgaaatgatgctcaggaaaagaaatgccaacctgtaacaaatgctaaagacaaccttaaaattctgaaatgctttgagtaaagggaggaaaaaacataatatacacgagtatgtaaaatcacagcaacatgttaaaagatttaaaccacagacgaagaatttaaaggctaacattatgagttttgattcagcagaataaagaaacactgacaataacaaacatcaacacctgaaactttccccattatcctaatacattttcactgtaagtgttccattaaagaacgtctttaaaacaatcttcaaagttcgactccctataactaattcaattaataaaattatcaatacaattgaataatagtttataacagcgtggtggttcctcaggcacatatagcccatctttaatacatattatgaataatttccttatgagacatctcagtaatattgagtataacaccaattgcatttaaacataaatgtcataagctggatgtgaaggttgattctgggtttcttataaaccacaaatttcagtttatttttatcatctagtatgcctcagatggaattcacagtaatcacagctacagtggagcaacttcaaacataaatgaaacaaataaccggcagatcgatacgaggtgacagactcctggctgaaatcttgccccagcgtgacccactactgcccttctgcactctaaagacttaatgaatcaccagaagcacactcaaggttgtgtgtgttttgcccgtgtgagagctggatttatatcagtaccaaaaaaggatcatcccctgccatgagaaaaatacaataaagaacacgtttctacaaggtactgggcatgatggtttcatgcagcatatgtatctatcgtataaacacttcatcattttaaactgaaacaccaagaatgacagaaatcagaaagcctaatgaggggataattttaaatgataagcaatttgtagtaagttgtttctatattggcaaaaggaaatggtgcaacagcaatatacaaaaagcagaaatgtaaaacccatttagctttctgaatatgttttgccccaggaaatgcataaaataactttgttatttaacactgcagatgcacctgtgggcaccaaagtactcttagttatttaaaataattaccctgtggagaaatcttaaggtctttaataaataaaaatctgtgcaatagggctcttaccaataaaaaggaaagccacagtgtgaaacaaaatgccaccaatctcccttagcggtagcttcctgccattctgctcaaaggtacagaaatagtctgcatgcctttatactaagttcagtatctgagtggctctttgaaaaggcatcattgtccatacatcaccaaaacagacagagagggcaaggacattttgacatacttgcacagaatccagcccagcccttttccagaataagtcccattccactcttcaccttgaattacagcaaaacggaagatataataaccaattctcaaagtgtagctccctagagaaaatggataggtctcaactatagtatgaaaaggcagaaagaaagattaaccaacacaagacatagaacatctgcccagcaagacaaggtaaaacaaagtcatagggaaaacaggtaaacatagcacaggacaaaaaggaagtaaagaaagaagaaatgaaagaaagagaaggaagaaaacaagcatgcaaaggaggaaaaagcactcactcctaacatttacacagcttaaaagcagaaggcttcatgttacaggacttccaaaaagtgattatcaacgaatgggagctcaaagatgaaatgataagacaacagaaagatgtcaccaagccaataaaacataccggagaccaaaaatttatcaactcagtactcgtaaacacaataaaaacagcatggaaaggaagagacatgactaaaaataaaggaatatgactaaaaattgaattaataatgtagaagaaaggcttaattccaaagaatacagaggaggaagacaaatattcttttttaatggagaaaagataagaggcacaaagaacaaagagagcctgaaaattgctgatcctgaagaacccaaaaattggatagaaaaatatttcaagtaaaaatagtataaactttccctaacacgaagaacagattgaaataacagacagtgttccaggaaaaattgttacagaatgatccaaaaaaagttatatccttaagtcactgaacttcaagacaaaaaaaaaagaattctgcaggtgttcaggcagaaaagagcaattcacttatgtgggggaacaaagaagtcaaactggtctcacccttccattaggaacactcaatgccagaagacaaaggagcatcgtctacagatttctaagtgcaactcaagaatttcacaaggccaaataccttttgactataaaagaaaatatatttaaagatgcaagaagtcaggaaatgcagcatccacaagaccttcataaaataaactctttaataataaaatccagtcaaatgagtcattaacagagacgctatggcaaaaggattactttgacactaaaattctgagaaaaagtgtgatccgattactttattaagtcaattggaacttagagtagaaaagtagctgtttaatatactcaaatataaaatttctcagggaaagaagaatttgtgatattttcttaaaattatttgacaatgaaacctagttgacaaataactgcaaatgaaaagtgatgataaagaaccagggattaacatcaaacagatttaaatgcaacactattatttgctgtttgtttagtagataaactctttttaagagcacagtacaggtttcttaattttccagaggatcaggtagaaagttctacattagcagttagctcgtaaatttattaatcctcaataaatcagtaaaagggaatcttaaaactcaagagcaacttttattgtagctttatcactgtacgttcctatttttaaaaactattattccattagtaaaagatgtatgttcatctaaaaatctaactaaatattgagtatgtaattcaaaagtaactttttttgttgtgcttctgcttttttcagctcttttctgcctataaggccaatctctgctcagctcgagaacactcgttctactgtatagaatgaggtattgtccaattctataattacaaataaaatccagttagatctttaaactatatgtgttgtaattttgttttgttacaggcttaaaaagatctcattttccacacctgattttcttggtataatttcttacttccttcttatgttcaaccccgcatacactcaataatgaaatcttcattttatctgcctcctaaacatgctccaaatctactcatttttttccatgtctacagccaagcttaggcacagctaaagacaccatcaccatcagccccttaattctcttgtcctactttatttctcgatccagtgctttttatatgcactcagagttccttaaaatgcaaatctcatcatctccatttctttccgaaagctcctcacaaacacaccttcttaggttataagtctcattatactttgggctcctcttcccttcaacaggtatatttctctgagcactttactctcaaatccaatcagtctttcctcagttcttcaactgtgccgtacctcctcctggcctatgttctttctccaccactcctaaccctcctttggcttacctctaatcatctgtaggtctgtctcttttagcttaagtttcctttgcactgaaaaatcttcacaatagaaccccaaccccaaccaaatttaggttgggcgatcccgctatgtgcagtcacagaaccacatacttccaatcaaagctttcccacactgtatggagaagtgcctttctgccggtctgcatttactagtaaaccccatgcaggcacacattacacccaccgtattcatggttggaagctcagaaactggcatgtgcctggcacataataagtcattaaaaaaaatgttgaggaattaatgaatgggccatgacagaaagtgtttttgttttggggttttttttttccccccacagctggcccatacattataaaccttattttaatcctctctaaagcaacaagtatgaaagttgttcttcacagcaactctcaatacactcttgaaaaataaataagtgaaacagatacaaaaatggatttaggagcacgcccctctggagcacctcgaagttgacaaatgatcattccaaggaaccggttgctcaagatagaaattgaagtttcatcatcctcacactctctctttcagatcaccctcaacaacaatcatcagtatctctcagttctacctcagaaacatgatgaacttccctttatctctatgtcaggtgttaacactccaagccaagccaacaccatctcatgctgccccacaacagcctccctactccagttgtttgcaattttctaatccattttctatatagaagcccatgtcatctttgcagaactcttgatcatgtaactctcctgcttataattttttaacgactacatttagagtgaagtgaaataatatcctcatcacgctgaaagaaactaagtagctggaggatgtatgttaaagtcagactaacaggcatttaggtaagatgcattacaaggaggatcactaagcaatgagacagagtcaattttctaggagtaattttaaaaattctaaatgagtacacctacttagcatagttcaaaacgttatgaagtcaaaatttttagaaacacaaggagaaagtgacagaaccatcattagaatcagagatttcaaacaaatctctgatgggagactggccaagcaaaaatcagtaaggtcgcagaaattttaagaaaagtaagtgaaagctttatctattaggcaaatatacaaggatgtatacaataagaagacaacatactttttttttttttttttgagacaggatcttactctgtcacccagattggagtccggtggcatgatctcgactcactgcaatctccgcttcccaggctgaagcacctcagcctcctgaatagctgggactacaggcatgagccaccaacacccggctagcttttgtattttttttgtagagatggggtttcaccatgttgaccaagctggcctcgaactcctgagctcaaagtgatctgctcacctcagcctcccagagctgggattacagggatgagccaccgtgcccagctagataacatacattcttttcaaacacatacaaagcatttacaaaaattacccttgaactaccccatatagcaaagccacaaaaaattagtatcaaacagactacacgctataaatataacacaatgaaattagaactggtaatttagtatagtggtttaacatagaactctcagaaaaagttataatgaaatatataaaaatgaataggattgaatgacaatacttcacaactcatgggattctagcaagttattttgtaatattgacaaattaattctaatgtttatgtggagagaggctaaagacctagaatagttaatataatattgaagaagaacaatgttgaagaaatgacattacctgactccaggaattactataaagctacagtaataatcaggacagtctggtcttggcaaaagaacaaacaaatagattagtggaacagaacagagttcagaaatagacccacataaatatagtcaactaatctttaacaaaggtgcgaaggcaataaaatggagcaaagatagtctttccaacaaatggtgctggaacaacttgacatccatgtgcaaaaaactaaatctagccacagagcttatacccttttatacaaattaactccaaacagatcacagacctaaaagtaaaatgtaaaactctaaaaccctagaaaacaactttaagagaaaatctagatgatcctcagttcaaagatgatttttttagacacaaaaccaaagacacaatccatgaaagacataactgataagctgaacttcattaaaatgaaaaatttttgctatgtgaaagacactgtcaagagaatgaaaagataagtaacagactggggaaaaatatttgcaaaagacacatctgtaaagaccgttatccaaaatatgcaaagaacgcaaagttcagaaaaaaaagagtgtaaaaaaatgtcccaaagaccttaacagagacctcactgaaaaagatataaagatggcaaataagcatatgaaaaaaatattccacattatatgatatcagggaaatgcaaattaaagcaacaacgatacaacaccacgctcagaataaccaaaatccagaacactgacaactccaaatgttggcgagcatgtggagcaacaaggactctcactcattgctggtgggaaagcaaaatgaaacagccactttggaagacagtttgttagactcctagttagtaaactaactcttaccttaggatccaccaatcatttctttttttattttttaacctcccaaagtccaggttccaggcttaatgatctagtaatcttactctttggtatttagccaaatgagttgaaaacttatatatatctacacaaaaatatgcataccgatgttaatagcagtgttacttacagttgccaaaagtagggaccaaccaaggtatccttcagtaggtgaacagataaactgagacatccagaccatgaaatattcagtactaaaaggaaatgtgtgctatcagtcatgaaaagacatgaaggaaacttacatacatattgctaagtgaaagaagcaaatctgaaaaggctacacactattataattccaactatgcaatatccttgaaaagtaaaactatgaagacaataaaacaatcagtggttgccaagggttggggagacagagggatgaacaggaagagcactgaggattttcatggcagtgaaactgctttgtatgaaactatatcagaggatatgtaccattgtacatttgttaaaacccgtagaatatacaacactcagaggaaacactaatataaaccaggaactttgggtgataatgatacctcaaggtaggttactcactcaactgtaataaacgtatcatcctggtggggtatgttgataatgggagaggctacatgtgtgtcggagcagaggcaattatgggaaatttctacttactctgctcaactttgctatgaacctaacatttcttttaaaaacagtctgcttttaaacacacacacacacacacacacacacacacacacacacacacacaaatcatggaatacagctaatgctgtctggagagaaattttttaattaaagattaattttctcagcaactaaatttagaagacaaagaatatgagaataaactcagaaattttaagaaaaagacaaagctaacaaaatagagaagaaagatacaatggaaataaacaaaaggaaatgctttggaaagactatgaaattgtcaaatccttggtaatatttaccaaatgaaaaaataatgtaaaagcaatcaatcattatgaaataaactaaataaagcacaaggggagacataagtacagatacagcgaggttaaacatataatagactactgtgaacatttttgttatgggctgaattttgtcccttcagaaattcatatgttgaagtcctaacctgtagagcctcagaatattgagactctatttagagatagggacttcagaagaggtaattatgataaaataaggtcatatgggtagatcctacttcaatggctggtgttcttataagaagaggagattaggacacaaagacacacagaaaaaaaagaccacgtgaaggcacagggtgaagacagccatttccaagccagagagggggcctcagaaaaaaatccaccctgctgagaccttatcttggacttctagccctcagaaatgtgagaaaataaatttcggttgtttaagtcatgaaatctgtggtactgtgttatgcagccctagcaaactagtacaatcttaccctaatgcatttgaaagcttacaataaaccaaatacaatttatcaaatctgactcaagaagaaactgaaaacctggtcttattaccattaaaaattgaattttaagttcaaattttacccacaaaaagccactcatcccagataaatgggttctaccaaatccttaaagagtagataattgtttatgcacattcttccaaaagatagaaaaagattctaacatagctaccaaaacccagtcagaatatttttttaaaagttacagccaatctcacttatgaaaatagatgcaaatatcctatataaaatattactaaacatatcccagtgggatataaaattatcatgatgaagttgaatagaaaaagcattaaacatatttataaattcaacaaaactaaatattaaatcaaaataaaaagtaaaaatctaccatctcagagaaaataatttctatacatttaatcaatcctgaatatctaccccatcatccctaccaaaaaagatgaccattcaatagaaaaatggtcaaaagacaaaaatgattccaaagaagctgaagtccaaataatcaataaacatatgaaccattaataacaaaatgcaattaaaactacagtgagacactatttaacgcacaccagattgaaaaatcttcaaatgtcagcagacacccacagttagtacggacgtggtaaaatgggactattaaacagtactatttaggaactgttgcaggctgggcacagtggctcacacctgtaattccagcactctgagaggccaagacaggaggatcacttgaggccagaagttcgaaaccagcctgggcaacgtggcaaaaccttgtctctataaaaaatacaaaaattagccgggcgtggtgatgcctgcctgaagtcccagctacttgggatatggaggcaggaggattgcttgagccagggcagttgaggctacagtgagctgtgtttgtgtcactgcactccagcctgggagacaaagaccctgtctcagaaacaaacaaacaaacaaacaaaaaactattgcaactacatgggaaaacaattggacattatccaggagagttgaaaatttctctacaatccagcaattctacttctgggtatatattccagagaaaatcttctatatttgtaccaggacacatttaaacgactcttcatagcaggtttaagatagcaaaaagcttaaaagaataggaatgtccattgctgaaaaatggataaattatggtgtagtcataaaatagaattctattcatttgtggaaataaataatcttacctatacgcatcaatgtgaatgaatatcaaaaacaacaatgtcaagtaaaaaaagcagatcataaaaatataaacagtatggtactattcatatgtctcaaaacaaacaaaagtaaatgatacatagtttgaacatgtacttatatatgatgaaaagaaaggaaattataatacaaaattcaggataaatggttatgtgtgagactgctactgtctgaatgtgtccctccaaaattcgtgttgaatcctaatctccactgcagtggtaataagaggcggtgccttttaggaggtgatttacgaagctgccttgtcccttctgccaagagaaaatgcagctaagagtaacccctggccagacactgaatctgctggagagttcatctcggacttcccagcttccaaactctgagcaatacatttctagtatttataaattactcagtctaaggtattttgttacagcagcccagacaggctaagaaagggactaaaaggggtcttgaaaaaaaatactggaaacaatctacttttttaagttaggtttctctgttatcatggcttacaacttacacagtcaatacatatatattcttttttatctttcaaatacttaataaattatctcccctgtgctttgttgactagagtgattaattcttttaattggttaaacaagaactttcaaagtctgattttgaaaaacattaacttcattgactaggatttgctttattaaggtgatatgctcatcacacaacagaagcagttattttatttttaaggcatgaatagaaacttaatttgcaatacaaaaagcacaaggaaaagtggttaagaaaatcctcagaacactcaacaaactaaaagaaatgaaggaggaggaggaggttccattttggggattttcttggtcccatatgcattgaaaggtaaatgtacacttaggcaaagacaattgtcagaaaggatatcttccattattgaaaggtaaacgtacacttaggcaaagacaactgtcagaaaggatatcttccatcattgaaaggtaaatgtacacttaggcaaagacaactgtcagaaaggatatcttccattaaaaaataaaaaagaaatcttgttgctagatgccttattataaaattgttgggttatcacaaatgtgtagatttataatcataaatacacttggtataggaaaaaaacactcttcatatttgttactatatttagcaatagcctaagcagtacattcagagcatttttaccaagatatcagcctagccatggagagtaactgcttaggaaaatccctctcttgccatttttctcatagttaagtcctgtaaaccagaccctttccctcatctaccacatactggaaaactctatcttaataaaagaaatgttcagtatttcaggttttctgtcacccacttttcatttatttcaggatttcatttttctttcttctgtcacatataatcatactctttaacactttttttccaaaaaaaaaagaaaaaaaagtaaaattcattctcatttttctctcattctccttcttttgctcttactcacatttcattcatcctcttgttcaaatattcattgaaaagatctctataaggcagcttaatacttatccagtatgaggctcgcaccctgtccctgtctaccatcactcctctcaccaaggaatccctttatctttgttcctggaagttcaagtgtacagggtttcctagtcctgtactatggctcaaccagaacgccaggcaaccaaccctggcacagtctaagacttaacatgcgattaaaaagccacttgctttccagccctgctgtacagaagctgccctatgccaccacctttcttggtgccagcatgattcaacttagtgatgtcagcacggacctttcactacccatcccattcttctctccagtatcagtgccttctggttcgtgaacctctgtctgaattaactacattcctgcttatcgggtgttctccagcaccgtgtcctcccagttactgcctgccaatcttgcctctaacttactcccagcctttatattattcattcatattctgcatacaaactattgctatcattcttgctcataactttgctctaaactttactatctggacaagtccctggtgtcccaattattcacatatttccatcatgtacaaaatcagaatcctccttttcctcatattatgttttctctttcctaaactctcaatcacaaatccctgaggccacaaagccctggccccagcctgactggtctatggcattatagacaggcagtcaagatcccaaatccagggagcagagtggcctcaaccacaacagacagcagtaactgagtcaagtaccatatgaaaaagcaagaagaggccacaaataatcttgcaggttctcagagtcgtgcagaattcataagcagtgaatccaggcaggtggtattctagggcagatgagccttcctcatgtggagacgtccattcatgtgacagcactgtcctctccactacaagggtgggtcccaggagcagtgcttcagacagaaatgggaaaatcaaggaaagaacaggaaccaacagaggtctataatcctctataagatcctcgggtggggaggacagcaagcaggtagagctgcaagtgaaatggcagagaagaggcaaggaaagacttggtggtggatttgaactatctcaactacatgtctacattttcagaactgtcttccctgcagcatgccatcatttttgggttataagagccaccctggcgggactcggggcagtagtgaagcacctgccgcatgcatctcacactgggaaggtgcagctcacacacactgtcgcctatgtgcctgctctcctcgctggcacagggaagcggctggtccacgggattgccttcatctgcttattttattcataggccatgacgcgtcttgctcagggaagggtgccagcttctcccacagttccctggcctctctgaagttagaggcttatgatcagtgagggtctatgtggactggcatgtgcccttgtacatccagtgtggccttcctctcctgcgctccactctcatccttccttcccgactgctagccctggtgatttcagctctggcgccaaatatatagaagcaacagccatatataatgtgcttaactagttcctaccatcataggaggtcaagtccttttaagtcccatattcggcacctttcccctcattctgtttctcttttcacaccccaactgatacagaatttggcaccagaactagttccagaaaaacaaaacgttacggattcctccagtttgaagatgaactgtagctgatgctgttttccagaaatgttcactacagtatctccagtcacatgtgctcttccagaatgtttccactctcccatcaaggggtgggggatatgtcccctccttttgaattaatgagcctgtctttataatcacctggatgaacagaatatgggggaaatcacatggcatcacttccaagggtgacacagcttctgcctggtgttatccccccacccaccttccccagtgcgcagctttactgttaaggaagccttggccacatgaaggcgttgcagccaacagactggctgagagccagcactaactggaaaacatgtcgacgagagtcttcatgattgcagtcatccgcctttgaacctcagcagccactgagcagagcaaggagaagccgactccaccaagtcctacccaagtagccacttcaagagcaaaacacatactgcttttgctttaagccactaacctgggatgctctgttttgcagcaatggatgatgaaatcgtggttgtcacaaggtgcccagattccaactctcagttaaaaaggacactcaactctcagttaaaaaggaacacctacccttcaatttgagtgcacatgattgaaaacagggaaagggattactcacggcagaagggtgcaaggccgacaaccagtgattatcacagtgtgcaacattagaaggaggctttaaaccaggctcagggtcccaaaccccagactctgtgtaactaccatcccctttttacttacagtcctggctctaacgactctccatgtgtttgctctcaatcttccagcttctcattgtcaagcggcctttcattttcccctagatgccagctattagcactctaaattaaaggagtcatccctgagatgtgaagctattaaaactgcaaaaggcccctctcacagattttgctccccttagactctctgctgtgtgaagacggatgaaaagaaaaagctatacagaacttttcctcactttgataacaaaaacaatcaaaaaaattcccccagaaaaagttctttgaaatctaaaggatctcactaccctgaaagaggcaacagccctagcctatctgttaatttcaatagatagctgctggctaggtattaactaaactttaaatacagctccggagccacagctgcaagagatacaggatgtcttagtaagtgtatgggttgtaagtaagtgcatgctatcacctcaagagcttttaacgagataaccaaacatgtttcctgaaactagatttcagttttatcagatacgctacaaataacaacattcaaaaacaaaggaaaatttgttaggccaaaaggtctgatgaattctaaaagtagttcatctagctttgaaggcacataaaaccatagtatcaccatgtgaaactgtggtaaacaatctactgtttgcaaaaaattagatatttattagattttttataatgggaaattttaatattatcacttgcttcatttagctgcaaaagtgatttgaatggacttttttcttccaatcacaagaaggaagaaaattatattttgattgacataaatcataatttgcttgactattaatggaattagcaaaatgagaattctttcaaaattcccaaccacatgtttatgacaaaggtaacatgtacctgcaatcacagtcacttacgtttttgaaaacctgtggctggcagagtaatggccccctaaagatgtccatgtcctaatccctgaaatctgttaggttacatggcaaaggggaatgaaagtcacagatggaattaaagttgctaatcacctgaccttaaaataaggagatcatcctggattatctaggataggccaaagtaatcacaatagtccttaaatgtgaaggagggaggtagaaggggagaaccagagagatggcagtaccagaaggacttggcccaaagctgctggagttgaatggaccaaggaacctgagtaggctctagaggccggtaaggaaatggaatcagtcctaggacctccagaagggaatataatcctcccaatactttgagtttagcccagtgagaccattggacttctgaccaccagaactgtaagataaatttgtgtttttttttcaaaaccactaagtttgtggtaatttgttacagtggccatagaaaacaaattaaaagcctttaataaaaataaattcactttcatattaagtgtcttgctctaaaagcacaaatagttgaagcagcatgttaaatatgaataatcaattgattcttaaattggaattttgagaaacttacactccattagactataagatacactgaaaaactgattacgtgtaagacacaaaaaatcacacttcttgagtcaataattattaacattattaaataaaattctttagaaaaagtaagaaattctcacctaacatcagcttaagagaagggaagaagctgccttattaaaataatatacaactgttgatacataaaactatatagatattatacttcaataaatgtttttaataatcaattactatgctgctttaacactataatgttctcagtaagtaaaaaaattttaactaaaatgatatttgaaagacacttgtatcatttttatgatcactcttgaaaatttctggtaaaatataataattactttggtaaggtactctaaatagcttagctgaagaaccactataatcaagtggccagagaatgaaaatgtgtaaacagggaagagaaaaagaagaagggagggagggagcagacgtgggagaggggagagggagaggcagagagaaagtggggggagaggaagtgaggggaagagaggaaattggagagaggagagaagaagtgggagaggagagagaaagtgggggggtagaggaagtgggaggaaagaggaagtgaggggaagagaggaaattggagaggggagagaagaagtgggagaggagagagaaagtgggggggtagatgaagtgggaggaaagaggaagtgggggaagaggaaagaggaactgcagggagagggagggtagagagggaaagagtgagagtgagacaaggaaggagaggaaggtagaaaaagaaataagcctcaacagattctggccgaaatgtaaatctttgacttgtgtttgtcatttcaaatactgtctaaataaagatgtcatttccagagtctcccctctgcttccatggcacagcagtgccccttaggagaagggctcctgtcttccttcattctgccacttccagtagatcccctggaatcattgattatcacacatttatctttaagaagaaatttttcagggcacttttgtgcccaaagaaaaaatacacccttttgcatttgctaagaattttttctaaactaacttttcttggctgctcccatttcttacagtcagtgtcatactggcaactcaaggtctagctcaaatgtcactttaaatgtgaagccttccagaacccacatcccaattccctggctctaataaatatattatggcaccaatcacatacaactgtagaaacttatctgcccatctctgagataatgaagtcttcaaggcagagtctaaatacaatttgtctttctagcccagtgtctaacaaataataaatgctaaatatatgtttgaattgtagtgtttgcaacaccacaggacagaagttgccaacattctgtaagtgaaccaataacatatgccccaactaccacagcatatccaatgttatttcctccaagagaattggcgatgattctattctttatcaacacagagtagaacaatttggaagtccccagtcagaccccaacaccagaagctgccatataagaagaacacctggtacccatcccagcatgctcttcagtcaaaggaaataaaatatacaaatgctggtctaagtagccaattttcctaaagctaaactgactatactgtaaacatgactaacacagcttaaaatgataaaaacagctattttaatgagcactagtaactaccaggcaatatgcaaatgctttagaatttttttctcatttaaccttcacaataattttatggagtaggaactattactgttattgccatatcacagacatggcaactgaaatatacaagcaaagttgaacactggcagaaccaggatggaaaccagacaatctgagtacaaagtcatttttttaaacaccacagcaagttcaatattctccatgtgccccttaaatccatttaaaaggttacttattcaaaatggcaatgtaaaggcatttttacagccttcttttaaaacccactgaaaaagggcaaagcaaataaaaaaataaaaaataaaccctccacctttagtgagagttaaaagtcacaaactcaaattcccaatcaaagcacatctgtcaaatactgtgaaatgtgagaggcaactgggagctgacaaacagctcctcaaacctcaaacaaaacacagaatttcctaaaagtaaaaatcacagttacacaagacctattcaatgaccctttgattacgatagacatcagactaagtgaatacagatcaatttctcagaaagcagagaaagtgttgttgaaagaacaaacacacaggcactgccttttgtggagcctagctccctcatgaaggggttcatgcgctccctcatgacgtggcagaaggaaggaagacaggagcccttcacttaaggggcactgctgtccaatggaagcagagcagactctggaaatgacacccttatttacacagtatttgaaataacaaaatcaagtcaaagatttgcactcactagctcatacccaaatcaccagtgctcctgctgatactgtgctctggcaaacactagccccatataaagataagcgatactcagggagagtccatgagaactgcaggtaaaagcagcaaataccaaaagccagagagaaatgtaagcaagaggccaatgaagaacaatcacaggagaaataacccaagcaaacagatgaggaatttagacaaatatctcttcatagactccaaaaaattaaaataattacacataaaagtttctttaaaaaaaaagttcaaggcagaggtacaagtgtaagttcaggaagtacaagggttcacgtaatacaataacagaaaactaaaagaaacgaaaataagtcgacatagctatgaaatatagccaccttgggaacaaaaaagtaaataatttaactgaaaatatagttttttaaaaagttcaacttgaaagcacactgagtgaaattaaaaagttaaagatgaaggccacagatatggaaaatcaaggagaaacatcacacatattatcagggttactaaagagaagaacaaaatagtgtactttaaataaaattttaaaacttcctgtcataaaaacagactctacttctcagagattaagagcaagatccaagaaaaaatggaacagaatgacaaaaagtaaaacaattgatgaagttcctgaactttcaggtttaaaataaattgttcattagcatcctggacaaaaaaaacaaaacaagaacaagtgaaaagatcagtttgcttcaaacttcacagtgacaccaaatgccagatgacagggaagccatgtctccatatttctgagggaagtaataatactacatagctttgataattacaattaagaatcataaaataaatgtgaataaccttaattttaaaagaatagtaaaacaaaaagaggaaaaagggagtcaggaagaaactttgttaattttcccatctttctaacaaaaagtcaaaagattctgtttcaagttaaattcagtcatttcaaaaaacagaattcaaagtttgggttttttttaattaactgttaataatatcattttggtaaaaggatattaatatgaaattaatctattaggcttaaattcaattcttatttttttcattccatcagaagcaaactaaaaaatattctttgtaagagatgcaaggtataaatatgatcttatttttaaaaaaccgtttctaattatttgtatgtatgtacacagagaagctataaataatgttcaccgaatatgaacagaagatatgaggcacggagatgatggggctttgcatgctttaatggttttaaaatgagcaacgcatcatcttttcaaataatgaagctatttctctccttcaataattccataatctttcccaaatctctgcatatcattttgttcccatttcccagataaataagatacccaacactgaagtgacttgacagtaaaaggagtgacccaattcaagacgatattttaataaatactatgatacacatactagttggtatcattatcaagtctattgatgtggctcaataaaaaaaacttttagtacgattatatatgcctggaaataggatgaatgtaacacgaactaagaaattccaaggcgtgctcaacataacactaatgcagccaaccaagtcttacggatagtagccatgcaccaagtgcatgttagaattaatgacctttgagggcacttcgatttctgaaaatgtctgactttgtgatgtgaaatcatacaatgtcatgaagctctctcacactaaaaaacaaataatatcaataccatgcacacttttagaacttgacagttttaaacctttttcacaagaatgtccttttttcacacccatagcaactcttgaaataggcaggacaggtgttattagttcctctttgcagatgagaaagttaaaattcacaaaggagagggcactggggttccagatcaaacagacagataattgcagagctaaggcctgcctctttttgattccacttttattgtccaggcaactaccctacatacacttacagcagccaatgctaacaatccatttcatttacattaattgcagcttttggagcagctatggctacttagttcaaaatggaagaaaagctggattgctgctattacaatccctctatcctgtgcgaagaaagagccttggaacttggaaaagaaatttaaagcaaccacaagctacacaaccatcactatgaaataaaccctttttgtgtggcatgaaatcgctcacagaaaggcttgctcttgttctcttgatttccaaatgcataaagtaaaagtcaccccactgctaatgctaggtggttaggcagctgttcatcagaggtagtcgcaaagcaaagttttaatgtgaactctgataagctggactaatgtatatgtgggatgggtatgttctgaacacctgctctaagccagctgctgagaagcactgggtaaacatattgaaatggctgggggaaagaaaaatgaagcaaagcaaggagccaggtccacaacaagccaccatattcacagagaggacaactgctgaaatacgctgaagtgtgtatccaccagattttatgctggtatttgtgagcaggaaataatggacaacaggaatctttttagaatttatttgtcgttttctaaaggcagatggtaaagggacaaatccaagtgcaatgaagctgagtaaaggaagtaacttaatgaagtaaagaaaaacttaatgcaaaagttgtgtttgttttttgtttgtttttgtttttgtttttaaggaaagggtggatgaagactgctcctgaaagtaaaactctcagtatggacacaacagaaattttataaatcccaagtaggctatttaaattttagaacctaagcagaaaggcacagcatgatattctgtggctcttggcaggattttgtcaccactggcaaactggaaacgtacaaaacagttgtaaaagccatattcaaatcccttttcaactatggcaatgcagcttccactgctgacattttaaaaacttcgtcttaatattgactttgtcaatgtatttgaaatgtaaaaaaagataaattttcaaactctgcaattttctccctgaatcagactttgttaaaactaacagcatctgattcaagcagacttaaaaacaagcatcaatgtattctctgttcaaacgcatctacaatggataaaatgtatgaaaaatcattttttaaacacacagcagtgaggctgggcacagtcactcacgcctgtaatcccaacacattgggaggccaaggtgggaggatcacttgaggtcagatgttcaagaccagcctggccaacgcggtgaaaccctgtctctactaaaaatacaaaaaattagctaggcaacatggcacgcacctgtaatcccagctacttgggaagctgaggcaggagaatgtttgaacccagaaggcagaggttgcagtaagccgagatcgcgccactgcattccaacctgggtgacagagcgagactccatctcaatgggacaaacacattaaattaaatactcactgctcctttctccttaaagacttttgaattcatgaattatgagctataaggcacaattgttcagaatgaatcacataaattacagtcaatcataatattttcagggtctgtcctcagggtaactagtaacacaatgattctttttgccatcatcttcatttgtcataataaaaattagttacagaacatgacactgccaaaatttataaacttacaaagctaacattgatcttttcaaatataaaaatttaatgacaactgaacaaaaacataaagaaatactatctcaacatcatttctaaaggaaagggataaatacattttgcatgataggtaaagaacatttccatgtttacatagagaaaagtaaatttactacctttgccactctagtcttaaggaatacataaaatttttaactttactgtataaatggaattatcaatggtatgctggagctagctcatcccctgctcatgagagccaattgttgaattttaaggaatcttgcaagccaggtggtaaagccttgaaaccatccataatgggaataattacaccacaggaattgacaaacactacaatcaggcctctcctctcccctccttctcccagagaaccactttactaacacaccactgatccacatgcaaataagtccacagtacagttaatcctcactaagtgaatgcacccacacaggcaacactgaggtcatgaaaaagaacattactgatacctgcagaagtctcccttgaacaatatctgaatcaatatgcctccacaggtctaaacactttacaaatactagaaaggagcaattttagcaatgaggatggaagaaggcaatttaagtgaaagatacaaccttgaaaatcacttgtaagtagctgtgaaggtaggctggcagaaaaagacatagcaagttgtgcattgatttggaagcagcaagagtaatatgggaaggaaaatatgaaattgtattgctgagcagctacatgaggaattatgaggcacatgcttctgtatgagacctgttcagtgtaaaaccctacttacgaaatagagatggtttaacatattgtaattctcttagtgtcacctatgatttttacattgtaaccagtagaaactacaagaaaatctcaactaccacaaataaggtaatacccaccatttgaggactgttgaaattcacagcgccccccccaccaccacactttcattcatactgtatttgtaagaaaccaaatattaaagttttccatgatgatcctacttctaggagaaaagcagagacttcaggggcataggactgcatttgacagcaatcatgcaccatatggcactggtattagaattatgtttgtagaaaactgatgtatattaaaaaaaatctggcttctttttttgtaccagtgatcagttgcatcaagcagttttccattttttaatattcatctgaaagttgattcttaaaataccagcttaagttctggaaaagaattacagctagacttgcaggaaaaaaatgaggagttgcttccatataattttttaaggggctaaaaggaaaaattacattttacagatagatatgcacatgtaagtactgacctctgtctcgtattcacacaagaaggtactctaatgagaataaactgcccaaaagtaatgctcaaagtagcaatattttcaatgcaattttaacatctgactaaccaacctttattgtttttctcttcatatggatattcattcatccatttgttcttagagtcacattgatcctgcaagaaaaacacaaagacaaatgatgagagaaagttctacaacttgatgttattgctcctttggggaaaaaaatacatcttaattctacagttccttaagctcgtgatcatagagctgaggaatatcttttcttcagctatgtgttgttggcttgctcttcagcagccatcaaagggcaaaatgcagtagagggaaaaacaccagctatgacactaggacaagatcctgggcactaaataattaagacctagacaaaaatgagggaggaagggaggaggagaataaaaagaaagggatgcaacagagagagacagctgaggagaaaatggccaagtaaaaaaaaggtttataagtaaatttcctgtataaaagagaagtcccaaatactcaaactggaacccttggcttcattattcttagcaactgagagaatttaaagtaatgtcatttcattgggggaaatgattgtttctttacagttgatacaaatgtgcaaaataatgaatacaaataaattcggtggttccatgtcagccaatacccaagtaactttaaaaaaatgatctaaattaatatatgtcccttcttttaaaaattaaatataaattaaatatttatgtggtttctaaaaggtccaaaatctccaggaccattaggatatcaccaaatcattaaatattattgggctggggagttctgattataatagaccatttgccctatttggatatatcttacaagtcttcctatgtattctctctcagcattatgttacttgcttcagaatttccatttcatgaggcaaattttctttggcattcagttgagccagcttattaggcacagttgactttatttttcatttggaattacactcaagaggggacacaccctggagttctcagcagcgcccattctgtgccaatgtctatgggccgtagcactgggcctggtttcctgtgtatgtttccatacatttgaaaagaactcactcactcataaaggccttaaatgaaatgcagcagagttcacaagctccataggcttgaccagtgaaggaaactggcctttaattttattccagttttaaatatatatgtctctcttgctataacaatgtctcaaaacatgtcccctaatatgcactacagcttttaccaggcatgctactaaaaagggaatccaacatttcaatattatagtggcagactaaaaacattctcttgaaattcagagtataattcctctatttaacatgattaaaccataacatggtatcctttgaaatacttaaaaagtcacctaacacacagtgttctcaaagatgttttgtcctttctagtcttcaaaatatatctaatccaatcggttccaacttcttagccgaatgttcaatcaaggtacatcaaaacctggctcattatttttcacagggtagttctataatttttttcatttaatgtgccataggcatgttctcatataaacttaataatgcttaatccaaaaattcataatactccactgagggaatatatcattatttacttcttaacttttgccttataatttgtgacttttattacgaatcacacataaacacccttccgtgtaaatctggtgtgcaccagagtctctgctggtctgaatgatgcctttaagcaaatggaaaggatgcctcctctggacagacacaaagagcctccaatcaggaagaaggcaaggcctgcaagcagagcccaccgcaaactacaaccaccactcccccaggtaacctcatcctacactaccgcacttagctgtaccaatttatattcccactaggagaagacataaggatgaaactgatcagaggtaaattttataaccaaggaaaaagtcagataatgtcaaggttcttacaaacccctgtcttagtcccaaatcttatggcatggctcttcgtggtttgtcataccatctacatttgcaaccttctacaatttaaatttatatttctgtagtttttaaagcatgggacggcctgatacaaaactagtttttgctttccatccaattcaggctcccaagagagtgttcaagattcatctcttgcctttcagcccctcatactttaagtagcacaaatgaaggtaacagatgaggacacagattagagttgagaagacctgtctgtccctagtctcacctctattatcttccggctgtgtgaacttaagcaactcgttcaacctctttgatgcccagttttcttctccaagaagcaaggataataataataataatacctgctttatatacttgcctactctaattgcagtaatgtttatacagcaatctgtaaaatgttaaatgtcatacgtgtaagaattaccactttttaatcaacagcctagatatcgaataggaaataaaaaagatttctctaaatggaggccacatgatagaacagatacatctctaattttattcatgctaaggggcctttagtttttccccccaatccctatcaaaagcaagccatgatataaaataggaaaatggcacatttccaataacagttaatagctcatcaatttccgaattaaatttacttagctctgccaaataggtttctgaaattatccagtaaatcttcccaaagcacagaagttttaaaggccagtggcctcatcaaaatgctcatgacgcatggttttggtcctcattttcctggcttcaaaaatgtttctcaattgtcattaggtgaagaaaagcaaaggattggtcgcttatttcaatatgaaaaacatgaaaaatagcaaggcataaaatattacacttttgaaagtattttaagattacttttaaaccaaaatattgctgcctggaaccatgggtaaatactcatggttttagaggagagactggagaaattccagttacacctgtttctctttagtagctgcaagcaatagagaatgatttttaaattctttcctttctctttttctgtcttgaaatttccacatatgatcactcaagttcctttataactcaaagacagtacaccctggacaacagaagtgaccctggccatagtgaaagtgaatgctatccactttaacaaataagcagctactctgtcacaattacctcagagtacaggcattatattatactacagtaccagattgcttgctcttcatcacatcttaaatgatctattatgttctcagtctttaaaggttagtgtttaatacattttaaatgtattaaaatggacccataagtatacttgttgctagatcctctgagaatccctttatgtatctttaaatagagacagagaaacacactagacatctaactagccagggattccactctctgctcaaaggtaatttagttgctctgtttcgagtgaattgaatggtggtgctgatatagttatcttatttggaattctgtcttctagattcaagtttacaaatcactgcttcattagttatgatcttgtgttttccagcaccgattttaaaaatcaactaataaaggtttacatacatattcaattcagttactgtaatttttaaagccaactagggaagttgacaggcaggctttgtgcatgtcagtctgtgatgttatgtaacaggtccaagtttgccttgctctgcgcatcaaggtttctaccacataagttgcttttcttctacttaaagctatttctgtttcatctgtcacagtgagttatcttgggaactaaaaatatttgaaggttaatctaaatatttctggagataaatgcaaatctaagtgctacgttttcatagctattttgactaaaaatgaaaagtagctaaagacacaaagaagaatgcttgttgctaggtgacaggtgacacctactgtatctcttctgaacttgtacagcatgacacatcttactaccaagaagaggcacttggatttccactggacacacataattctctacagagaagcaaactagagttttttaacacaggacacagttagcaaatcatggctataggaaaagagatgcctctcacaataggagagaatagtacttcactttccatttcaggtacacattttcaagtaaagtccacacatgaaacacatttaactttcacaattcatgattaagcattaaaaagtgataacagacatcacttcaattagggtaggtggagtccataaagaaagcattattctcctataagtatccaatgctcactaaatttagtaacacaaggccatcatagtaaagatctcataagttaaaaaaagaaagcacaaaaagcttctaagatttcctggacatattttataattacacacctactttctagcatatatcccttccttcagacaaaaacccaggcataggccgggcacagtggctcacgcctgtaatcctagtactttgggagacccaggtgggcagatcacgaggtcaggagatcaagaccatcctggctaacatggtgaaaccccatctctactaaaaatacaaaaaaaaaaaaattagccaggcgtggtggcgggcgcctgtagtcccagctactctggaggctgaggcaggagaatggtgtgaacccgtgaggcacagcttgcagtgagccgagatcgctccgctacactccagcctgggcaacagagggagactccatctcaaaaaaacaaaaacaaaaacaaaaaccccaggcacaaagttccaccctctctcctttgactcatcaggcaatccaggtgacaatacggaagtttcaggaactccatcatatccagcatgtcaggatctcacatgaacgaatggcatattccactccatgtgagaaaggctgtgatgccatcatggaaaagatctagctttgaaagccagaaagaaggaacatcagccttaacacttgggagtaatgtgacctggggtaagttgtttccattttacatgctccttttgcccccttgttaaaccggtatcataagccctcctccccactttttttaaagctaagaatattaaaaaagagaatgtgtataccagaatgtctggtatataacgggtattcaagaaatgtcactcctatttctacccccctacatttataatcaagtgcccaaactccttttccacttcagctttcttgaaaactaggaaaagctatgtccgaaacctgatataaagttatacttcctcaatatcaccttcaaccatacttgcttatacgaaggtcctgggatccacagaaaatggaatctccactctaggatctcagagtatagtgttcataattcctccattaagaaaattcaaagatgcaacagccaatggcaataggagaaagatttcagaggtcaataataacccatattcaataaagatccccttggaattctgttcgttgcataagtcgacttaaaatacttcatttataaaactgtcccccatttccagttttatgtttccttgaaattacgcttccacccaaggattcttcactacttaaaatagcagatactactacagaaagtaaaatttaataattaaagtcccacttggagtaaggtatgccccaaagcttgagcagtcacttaagaacagagctcactgaatacacagcccattttcagaaggagaaggtaaagcaaaagcacactgacatggaaattactcttttaatctgttttcagcttccgtttcattacaccccatcattctgtgcacccagagaacaaataagtctttaaaagaaagtaaccatagcaaatgaattaagcatttcttttacatatattgtactcaatataatggtttgaaaagtaatttatgctatgctcagattcaaatgtaattgccattttatcaggactgcatagtcaaaaatctgatttgtactgcaaaggattgacaagatgattaaattttgtctttgtatgtctaatttatgtgatttaaattgtaacaaaatataaacatgtgccatttggacatgcacgtaagtaccataagtactaccacatgtagtactgcattctgccaaaagtaacttggccacacacacatttgcattgccagatgaagaacactcacatctttctcttaatcccatctatcaggaggcatttttaactatcatgctgaagatgttaaaaatctttggggttttgagaggctggtggaaggaagggaagaatagggtgcccatttacccagtaatctccagcactacttgtaaaatgtagctgcgtgatgtatacatagaatgccaaattaaaaatattgaaagcaactgaaaataaaatcaaacacatatttggtaccaattacaaatgcatagttcacacagcctaagaatttctctactacttcacttcaacaggtgttgttggaacacagctaggtacaggacattatggggtaaatagttaaaagttttagatactagagatctatgacacaatcaagaaaaaataagttgctttgctcagtatgcagtatacatatttggctttcctattaattgttgcctgtatgcttgggctgccaatgctaagcaagataaatcctattcaaatgcatagtaaacagtttgcttagtgaataaatttattttctagcccatcacaacaatagttgattaaaatatgttgctcttatccacacttttgaattaattcatgtgaaataaaacaaatatttattaaattgtggtgaaaacattccatcaaactgtgaaacttgagtagaaaaacaaatggtacatgcttaattatggttgacatttaaatgaaatttgcattctcaaaatattttgcgataattagaaaatattagaagacaaagtattttaggaaactttatgttcaatctctttgcacatctgagccaaagaaacttttaacaaaggtagattttataatataatttgaaagatcaatcaaaggacttaatagatttgttttactgacatgttgacatagtggtccagaaatgagacactttatttgatatttttaatgattatcttacaggttgccgagtgccttactgaacaatagctctgactggctgaattcatcaacccaagtttgtgtatttagatatcatctatgtatctccgaatctgctcctcaacacacagctagctgtcataatacataatcaactagtatttctcaacaagcaaattagtagactgtcaaagggattgcttaaccatatgcttctctcattactacataatcccagaaaataaaagtaacatttgtttagaatgacaaattattttcttatttatttacttttttatctttatttatgttttcgagacagggtctcactctgtcatccagactacagtgcagtagcaccatcatggctcactgcagcctcgaccaccccagactcaggtgatcctcctgcctcagcctcttgagtagctgggactacaggctagcgccaccacattcggctaatgttttgtagagacggagttctgccatgttgcttaggctggtctcaaattcccaggctcaagcaacattcttgtctcaggctcccaaagtgctgggattacaggcatgagccactgtacctggtctgactcttactataagaatcaaaaacgactcctttaaaaatggaaaaatactaaaattgaagaaggtcaactcaaccatattctagcaactgctggcaggtaataaaagtcactgatttataatagtgatgcacattacatggcaaacacattctgttatcaattcacacatgaactgcctatatgcaaagaactgagaacatcaacaataatactccatggaacctgacacacagaagctcacagtcaacaaaggtgggctgaatatggataaatgacataattataacactaatatctaccatctcttgaatgttttaccatatggttaacaatgactaggtacttttacatatattatttaattgaattcatggaagaaccatagttattccaggcaagttgaactgatgtccacattttataatgaaagtaagtgattaaagttaacattctgtaattcagattaagatgccatccttagtaacaccatagggagctctggtgaaagaacggagtatagtgggaagtggaaggaaatcagtttagtttcacagaagtgcttacacaaagctgagtcttgaaaaatggggaagacaagacatttcagggaaaagagatggactgggtagtagatttaagtctgaatttgagaataatcatacatgtatgtgaaaatatgcataacttacaaagaatatatgtagagtgagtaccccatgagttaacatattagtcagcccatccaactgaaagagggactctaatgtggaaaagaagcctgttgatatgaaagggggattcatttcaaggaaataataaaagcaattctgaaagtctaacttctgtgtctcaggtgtgtatctgtcttacaatgcaaagggatttattaggcatgctaagtcaggaccactaaaatataatttcaagaattttatgaaaaaatgactaagaattatgtcatgttccacacgattcttgatatttctgacactgctggccaaagatcaaatattgcacagtatttattattcaaatatgaatcaatgaaaatatgcttacagatggtgtttctgcacatgtacacatacacagctaagctctactgaaaatacagacagaagataaaatcctgaagaataagttatgtaagtttcacaaatactccaaaaaattaaataattttgaaaaatattgtagcagccaaggaatgtcaatggcattttcaaaagtaatcccaaaacaaaaactgccccactgcaggcttaaaaacctatttggagacacacacaaaactaatacgttcacaagtgaaatgacatgatcaaataattattgagagtaagcaggttaagggctcacacgtatcccccaataagaatagggaatgtatttttatattttaatttaaatatagtatcattcaaaaaacaccaggttttttaaagaatcctttcagttctctaactttattcccaaaggtggctaaacacatcttgtgagatacaggaaaggaaagccactagccaacaaactgaattaaaattgttcagggtggaatggtatcaaattccagtagtaaaagtagtagtggtgacagcagtcctggcatcagcaaatatttaatatgaatttactatgtgctagcaactgttctaactactctattgtctattaacttgcattaatcctcacaaccttgtgaagcgggtggaattattagtctcattttacagatgtggaaacacagagaagtaacttgcctaacaagcggcaaaggcagaattttgaaacctatagtttggctccagtcttcatgattttaagtactgtaacttaaatgattcttataaataatcttggtataacttcatcatgcaatgcacaacagtgtggtatctttttttgtagaaaatatgcagaaagccaacagcaacaagagagttttggtgttttcccctcaagcagtttaaaataagatatttctaaactaatgacataaactcagatgcttttccaatgaaggaaaagaaaaacatattccaaatctgagattatttgaaatcgtgcccaatattacaataaagccagtattttaagtttctccactaattagaaattaatcctttccttaaatcatttaaggtttgggggatttttcaaagattttaaaatttgtgtgtaaagtctcctacatgaaacttaggattaatgaatgaaaattctctttctcctttcctcaccaatgatatccaaacctgtgcacagacaaaaaaaaaaaagggaatttaactttcacttcacaaatcaactgcattctttgataacgtctttaaaataaaagccaattatgaaaatacatttcaaaaaagtatttctaacctgtgcttgaggctgttaccctaaacaactataaattacataatttgaaaaagtaatttatgcatagttttggcaaaatatttccctcaactcttagattctttgctgattctgaaggtactgctatgaacataatattaaacaatctcaataaggtaaccaaataataaagagcctacatctcattttaaaagctaagcaaataaacttcaacgctgtcaaatagttaacttcctaaaatgattgaaatatagaaaaataaatataaaggaactataaaatctctataatcatatgtactaattctcctttacataattatacataaataaatatccctgcctatcagtgaggattcaaaggtgaaaaaagacatcgtataacatatatttcaaaatttaaaaaggctggcagcggtatgctgcactttggggaagcaccaataaatcaaatctgtgaacagtaggcaccaggtgtgtggtttgacacagttcatctctccatgaagccaggatggaggattaaaataactgcatttcagttcaggaaaaacaagtagatgacaacttactagaaatcgggaatacagctatgaagtattacacatgactctgttcaactttaacatgaaaagcgcagccatacagcatctaaatgaatacaagagccacacaaagggcatggcacatactatttggagatctttataaatggcaatctttgtccaaaacatacaaatttccttcatcacggacggttgctggttgctaacctctataatggtgttattgtatttacccataagcttcaaattacaacatgcttcagtcttcagcttcataagatgctttatactacatactactacttcaagtattctttttaaatgcttttgatctggctcagggtgcttcccttcctgtcaccacatctgggttctcattctatactctcctccagcatagaagtcatctctcctgccttaaaaatattcagatgtttactatacaacactttagttttggctagttctactgcttcatgtagttgcagaacaatttctgtcattgctcagacatgtaatcacaacctattaactattttatccactccctctccgccatggtctctttgatcactgatgtctatttggcattatagataacctgcacctggaaaattctcctccatatttcagtgatttctctgattcttacctctgttctctctaaccattaccatcagatgtcttttgaagattctctctccctacagaggtatcttccaagagcctccctaactttaacacatgctttctctctgtgtttgatctcctaaaagttaaactcttagtgtcgattaccaccaccccaggtaactcccaaaggaacacctttgggcaaaatttcccacttaaatctctactttttgtccacatatatgtatcagtgaacaaatcaaaatacatttatcatcttattgtacgtctggaattacgacagccatggagatttacagccaagactgttcccctatacatgatggcttaccatctagggaaggagacagcagcacttccaagaactcaaaactgaagtcactatttttccctcaatgaactgctttcccctttcagtcagaagtcatcagcaaccagttgcttcaaccttatctttgagtcaatgttaacacccttttctaccattgtataacaaaaatccatccttctctccaaagactctttagattgacttttgcaattttcctttgccacctcatctcctttaggtcctcatttaacaagtctgaacgattgctcatctctagtctctgctctttccaatgcacatgacaaacatacctggctaatgtttgagatatttcatcacgataatcccagtctcaagaatttacattatttttttccagtacgtctcaatttacatttactttcacagcccttctgaagaggaaggggtttcctcctcttcctctgggaggggttccatctctgcctgcagccaaatctctcctgcattatcatctcctcacgtagacacaagtactgaataaaatcaacacagccaactattttttaattaaccttagaatttgtaaataggactgcctttaaaaatctactgtaggcatcacattttgtggtgaaatactgaaagctttacccactgaaatcagaaaaagacagaaatcagaaaaagacaaggatatttttattttttttttttgagatggagtctcgctgcctcccaggttggagtgcagtggcgcgatctcggctcactgcaagctccatcccccccgggttcacgtcattctcctgcctcagtctcagctgggaccacaggcgcccgccaccacgcccggtaatttttttttttgtatttttagtagagacagggtttcaccgtgttcgccaggatggtcccgatctcctgacctcgtgatccgcccgcctcggcctcccagtgtgctgggattacaggcgtgagccaccgcggccggccaagacaagggtatttttcattaccccaatacagctaatgtcggaggttctagcaagtaccataaagcctaaagatataaaataaacattagtttaaaacaaaattgttattattcgtggaaaacataattctgtagcagaaaatatgaagaatagtcacaatattagaattaacatgaatttagtatcatcactgattttcgtatgcagacatacacaaatcaatataccaaaacaaaaaacatttatacctggaaatttaaaaaacaatgaaatgctataaaacaatgagaacaaacaactggtacatggaaaaaaaaaaacgcaatgtgaaataaaattaaaccagttacaaaagtgcacacaatttgagtccattcaaaagactcaaaaacagttaacatcaattgatatgaaatcaaagtaacagttacattgagagagtgacaatgaccagctggaaagggatacaaggggctgactttggggatggtaatgttttaatattttatctgggtggtagttacatggatgtgttcaattctgaacatttactgaggcatatacttatgatttatacaatttttgcactttttatttcactaaaacaaaaactttcctgtaagataaattttgatcagaccaattcctaattttgagtcatactgcccaaattatagagcaatgtccagtatatgcatgagtcactccaaaatcagctaccaccaaggaccaatcaattaataagagagggtacatgagccactcttgtttggaggaggccaagcaactggaaacacatctggtattccatccatctcataaagtcctttacatcagcaacagcttttaatgcaaacaagttatacaatgcattttgtttggggtttctgttgttctttgcaatatgatgaattcttatggctgacgactaaatattatttgattcgctaatgaagattcacaccaaattagatggagaaaacaatttggtcatttttccttaattaaactgcaatactaccattaactactgtatgtgccaattggcaagtcagttaaactttctggtctcagcatcctcatttatgaaattaaggggttgaagatctttgagtctcctttcattaataaagttgtggatcctataaatcctatattttgtacatgcacaagtctgcaagacaactgtaatgagctggaatagattaatattgttaacagaatttgagttctgactctgcactgatgaattcataaaatttaaccaatcttctcattcccagtagctcccaacctgcttcaggcaggaataaaatcgataacttatgtccattgtaaccagcactcctcttctatttactacataccactctgaaaggagattcttaggagatacaaatgaggaccatggagtgaaatattttcactatttcccagctgagcctgtgaatgcaacagtagctgaaggattctccaaagctggccgaggatggatttgtggccttgaggaattctgaaggtgagtagagaggatttcttttctaagcacagttcaataaagcactgcattgtaacagtttatctgtgactgtaaataatctgtttccctactgttttatcacagccacttggaatgctcaggaatctatctgtcactatcttgaaaattttaaaggagtatattacttacaatagtatttcagcagcacaaatgcaattcataaatcaggttatgtgtcaggcagtgtggtaagtactttatacacattatgttaagtaatcttcacggtaaccttgtgaagaaaggatagtaacctccacttacaagtgaagacagttcaacagctattcaaccaaacagctggaatttgaacccattttgtcagttcccaaagtccacactcttttcctcatgccattttgcctctccctgaagcttctggtctgtgagctagatggaagtgctatgccggattgttctgtaggcagcagtcagaatgggttttaggggaacaagagagaaggagagaaacgtggtaatttttgaagaactccagaaacagcatacttctaaacggcttgatttgctggcatgtatggtcctataagtacagtcaataaatgtatatagttaaatatggccagatctcagaagtgctacatgaattgtcactgcagcatttactttgtggatccaagcaaacacaggagagtctcgtgctctcattctcaagttttaaccaggagccactggcagactgactctagctaccatttgggaagcatttctccacaagtagtctgtgactgaaggagtttaaattaaacaaactataacgaagatcttgtttgccagtgtattttacttttatttgcttttacttttattttgagacagggtctcactctatcacccaggctggagtacactggtgagatctcggctcactgcaacctccacctcctgggctcaagcaagcctcccacttgagcctcccaagtagctaggactacaggcatgcaccaccacacctggctgattttttggtagagactgggttttgtcacatggcccaggctggtctcaaactcctgacctcaggtgatccaccctcttcaaccacccaaagcaccaggattacaggcaagcaccaccacgcccagatgttttaatgtaggttttctcaaagacattatgcaagaacaccaccctacacacataccccaaaagtcccaggggcctcagaagttactggaaagcaactcccccacctattttggtaagaccacgaacaataattgcagagttcagaggcaataatgtttccttaaatgactattcccctcctgatgctggatgagatgtggcatgctacaccctacattcaacacccagcttttctgtttccaagttatggcctagccataatttctctaaaatccagttttttcacatccacaaatggcttaatgcctactttgcatcattttgtcatatttggagaatctaaaacatgtaatttgtacaaggcgtttgtagttattattttttcttatttataagtactattttggtttttaaaacacagacctaatcaatactactagatcttagaagctgctcgtgtctaacaaaatcaaaaaaagctgcatgaacctctctgggtagtctataatcttaaattatgctaatttaagaaagcagaaatttagttaataaatacaaccagatttctagaaacatgcattaatgtcacagtctccttttacagagaggcaatagaagactggttcatggtttttcaaagtaatatcatccaagtaaactaaaacatacaaaggaacagatcattctgaaaatccatcatccagcattcctacttatgtagattttttggctttaggtttaaaaatttaatctattccagaattagactttgattttcagtaacttctactctctcctttttattgcctctttaatatcagtgatcttattcccttaattattgggaaatctatatcttgatccttcactatgaactttaatcattcattcactgaatcaacaaatacttaaactccttcctcccctttccaattaaatctctagtgtagttaaaaataaaggaggactcgatttcagaaagcacaagtcagagcaaaaaaaaaaaaaaaaaagccatggaattatgaattggaacagtataaaatttctgttcacagtactgcagaggcaaaatgctagaactgctagtggtgatttcactgaccaccaggcccatgtgtccacagagcatctacatgtagctagtgcaatttaagttgttctacaagtgtgcaatacaaaaataactttaaaaagttcactaaccatttactaatcattttctattgatacacattgaaatgataatattttggatatacagtcggccctctttctctgtgggttctgcatccatggattcaattaactgcagatcaaaaatattcaagaaaaaaagaatttccacaaagatccaaaaagcaaaactcgaatttgccgcagactaagtactacattaaatccatgtgaatgaaacaatgtgtgggcattgtgttgtgaattttaagtaatctagagaatgtaaagtgtatgggaggatacacataggttatatacaaacagtatgccattttatatcagggatttgagcatctgtggattttggcatcagaagagtgtcttttctcccatgaataccaagggacaaacagtactgggttaaataagtattaatatattattttaaatttcaactatgtcttttcactatggtgattaggaactctaaaattcctgaaactgattcagttatgtttctattgaacagtactggtcaaggttccacatttcaaacccttgtatgacacactgggaattttcctggcctttaactgtattttatatagaccttaaaacatccactaaactccccaaagacatgttttcttgtttaatctagcatttaatgcatctggatgtaaatgtatcacatgtactgttaatttagcacaatcttcagccccttggagagctataattgtgcagaatgtatttgatgcttcttggtacctaatttttatctcaccagattatcaacctttagttcttagaaaattctacaaagtgatcccaaaagtgctggatgtgtcttccaaagcacagtcattcgtgcacagccatgtctgaatggaagtgtcaagagctttccataatcctcatagactattaaaacgaaaagagtcccagaggaccagaaatataacccaatatctattcctgagtacactgtttcatgtcctgaagcagggctgcttttttaaattgataaaataaaatgtcacctattttatatcacatccctgctacattgctgatgggaaatgcatgtgacaatatacatgattaaaatgagcacaactaagtatattatgttacagtatcatctggaaactcaggccaagccatcctccaaaattcttaaatgtcaaacctctgacaacattttcattcagttgttatcttactgttgcttctagttatgtttttccttaagcattcttctgagtaaacaaacttgcttagcagttcataattttcataacaggtaaaagtgctgaaagaaatcactgtacacttaagctattttgcagtacttcagttcctttacaactagcagtacttaaaaaacaatcacatattatatctaaccactcatcatttttttcatggagttatacataaagacagtgttttcaaatatatgacctctactaactatccctgccttacttcgatagagcccgttatgggtgagcaaattgccaaactggaccatttttctgaggaaacataagcagctaattcaaatctgtgacatagaaagaatacccgcctggtaaagaacatgtagatttctttcttctatgtctgtggaaggcctttaagagttggcagtcttcaacagctgggtacgaacacaagaaaggcccctcatgggaacggattccctgaacccctaaccttgggacatcctggggaatgccaggctgtgcctgaagttaccaaaaggctaactgggcatctcccaactttattcccatcattctccaagtgtcagagaaaatcactatctcagcatacctataacaacccacagcacttgaatttacttaggcagctacaagtctaaatgctaaaaagagccagggttgagaccgaggtggctagccagacagagtaaggctgaaagtggcagggacaagaaatgcactctctggagagaaccactgctactccactcctgacaagtttgccctacagttatattcaagtgacatgcataatctctgtttctaaaatttgctaattttaaaatatttctgtattaaactcctatagtaacaacaacaacacaaaaacaccatctacatatcagccagttcatgatatgtgttgtaccattctttccttcagattcaaaatatctaggggggcaaagaaattctaaactataaggatcctagatttctctgggcccttgcaaggaggaatatgaactcacataaaaaacatgcagcttctactgaagcatctattttacttgtagggttttttgataatttatattaaaacgaacagtatattatgactatagttcaaaagtcacataaaataaagcaaaaagactcaaattcactgcttgcattaggctactttcttcttcttttcttttttttttttaagagatgaggtctatgttgcccaggctagtcttgaactcctgggctcaaggtatcctcccatctcagccttcagagtagttgggactacaagcatgtgtccccacagctggccaacagcaggctactttcaaacactcacctggaattattttctatttctgaggaagagtttgagaaataggctattgagcataacttgcagggggcaggaaccttttaaactaactctgaaaaaataacattttaaaagattcttccacaatttggagttcttgtcagcacaaggccatttggattgatgattcaaatataacttgtactgtgaaaacgttctagaagggccctggaacactgtatttcagcagttgaggcacaccagcccagtggatagaggacaccccactaccagaatgatagatttgcttattccatgctaatgaagttttcttcttcctatgtcctgcgtttgtttactggtaacgaataaaacattaaaacagccatttagaatataaagcacagtagttcctgcaaatggtaaagttatgctggctgtagtttagggtactaaggctgttatttatagaataaaacccattatcactactcaaatattgaacatgcgtagtttgtattcaaagataaagttgccacaggggactattgatataggaaatatggctggagagatatggaatgcatattaaaatttatatactgaaaagaaagaatgtatttaacaggtatatttaatattccagtagcattgaccgcaattgttaaagttatatatgctgacatttcagttataaccttctattttcagtgccttcgcagttcaatccaaaaattttctgcaggcccaaaagtatgtactttccaaggtctccgtctgtaaagggctttttttgttaatgttcagcagattgaaactttgaaaaccaaaggcaaatttgaatgtgtttttcctcacaggaccaccaaattttgaaatgaataagtaaggatttaacacaatgtttttctaagtaaagctgtgaggttaagagtttgccatggttaattcaatagcaaatggtgaagtcaggaatcaaatccaaggattgtgaatccaaaatctgtgctcataactactacagtttattaccttttcatgatcatagctggatagaggcacatttatatataataaattatatactattagtatacagtagtatgtaatataaacagtagattatatacatctaattgtaaaacaatgctagaaaatgtttactcttctaatctttctagtatcctgcaactcttactattaccatagactgatccatgtctaatttattgctattgtaatccctagtaaacttaaaaggtgtatgtgtaattctttgtgcaatttctgaagtctccactaggttataaatttggtgagcacagggtaccataaggctcactgaactttctaagacctattttcttctaatataaatgatgagtaataacagtgcctgtatcataaactggctaaaggaattaaacgaaataatgcgagtgcttatcacagtgcccagcacataggaaacactcagtaaatgacgattgttatcattgttattattacttttatccaccctagtgcgcccatgagtttcacagggttgggtgcatgagagaatctcagtaaataataaaaagtcttaaaatattcattaatttaagcaacaccccctagatatacttacatacaccctctctttccacaggcatagcaatctctccaacatgaatatttgtacactgttccctctatctttataaaacactattacccaacctaattttaatctggctaactcctactttgcctctaggttctgactccctttcttcccaaggtaggtcttaaactctgagactattacgggactcacttatgctttcattggactctcttcttgcccctaatcatcaaagcatttaacaacaagcattcttaatatcattgtatttgccttaatacaccaccagactgcaaaattccttagccagatactatccttttatcatggtaaaggcattagagatatggacataaaagatggacataacagatgtttactaaacattggtttttaaaaaaagagcaaataagtatgtctattggaataacttttccattattctcatcctccctagcaaatgtctcactggatttaggctttggttcaatttctaaaatgaaccaaaaggaaaatgacagataagcccattaaaaaagaaaaatggaccaaaaacaaacaaaaaatttggataagttcctcccaagagatagccaaatggccatttacatgcgaaagatattcattaatatgaatcattaggaaaatgcacattaaaaccaccaagagacaccaatacacagccattagaatggcaaaaagacaatgtgaagaataaaaacaatacggagtatctggaattccagatttggtttgtttgttttttaagagacaaggtcttgctctgtcacccaggctggagtgcaatggcatgtgatcatagctcagtgaagcctcaaactcctgggctcaagccatcctcccacctcagcctcctaagtagctaggagtacaggcatgtgccaccatgcccagctaattttttaaatttttggtagagacgaggtcttactctgttgcccatactggtcttgacctcctgacctcaagtgttcctcctgccctagcctcccacagtgctgggattacaggtgtaagccaccatgccctgcctctcatgtagcattgacaaatgtctaaatgacacagttacttaggcaaactgtttggcagtgtctactaaaatgaaaatatactccttaagactcagcaattctacttttagaaacatgccctacacttttttgtgtacatggtgcaccaaaaggcacttctagaaaattcacagtgcagattcccaactgctgtaaactggaaacaatccaaatgtctatcatcagtaaaatggatgaataaatctgtggaagctttttgataaactcataatggaatattatacatcaattttaaaattcatatggacccccaaaataatgttgagcagaaaaggccggactcaaaacagcacatgtactcgtggcattcagggacagtcgtctatggtgataggagacagcacagtagttgacacttgtgcaagaggctgctggtaatgttttatgactatctggataaatactgtgtgtatatcttcattttgtgggaactcatccatttgtacatttgtaatatatgcacttccttgagtgaactacactttagtcaaaaagtgaactaaaaatgagcgaataaataagtgccctcaacctaaaaaaaaaaaaaaaaaaaaaaaaaaaaaaaagtcaacacataaggtagttatgtgaacttataagttatgtgaattatctcacaaaaactttatgaagtctgaaatcctcagaaccagacaagtcatttgattctatttgagatcttatcttaatcatatctttaactcttctcttcattgggaaattctattttcatctagttgctgaatacagactacatatacacaggattaacactgccataaaaagctatagtacgttggtaccaactttatcaaaagaggccctccttcctgtcccccccaccccccaaaaaaaaacctttttaagtgatggtacacagcaataacaggatcattatctttttcgttacaaatagaaaaatatgaaggaaaagattttcctgagataagttggcgactgtcaaaaaagacagaaatgatacacacacatctatacatgtatatgtataataatatttatacatatatctaaagcaaacagtctgagttgaaagaaattggccaagctgcagtgaaaggcacagagaagcaggcgccctggcatatcaatgattgtctaaccctccagggatgaactaaagaaaggggaagaaagcattagagcagacagttccagagctgtcaccaaggagcactgtcatctctgctaggctgggagagtacacagggcatgagattattcagtggtgcatgccagctccactctaccttcctcaataatatcatggaagaatgtgataaattaggattggaacaaccaaggccaggagaaaacttttgaaaattcttataattactgcttttttttttttttacttaaaaaaatatacacacgattcagccataataaagagggaaatcctgccatttgtgacaacacagatgaatctgtgtgacattattctaagtgaaataagccaggcacagaaaggcaaatactgcatgatctcactcacatgtggaatcttaaaaagttgatttcattagaagtagagagcagaatggtggttaccagaagctggagtagttggggagatgttggtcaaagaatacatatttgcagttagacaggagaaatacattcaagacatctattgtacagcatactgactttaattattgatatactgtattcttgaaaaatactaagtgacattaaagtgttctctccaaaaaacagtaactatgtgaggtaatgcatttgttaattagctagatttaaccattctacggtgtatatgtacttcaaaacatcatgttgtaaataatacatacaattttatatcagttaaaaaaataaacttgaagaatatatacatacataggtaacatcttcaataaatgaaacttcaatggaattttaccaatttaaattagtaataatgtttctgcacaatgaattattcactaagggggtgctcactactgttgaaaaagtatacaaaataaatctatatatatataatttccacaaggcaaattaacctttggaaatgggccactgttcagatcattcgcaaatgtagtttttactgaacatttctgtctcaatggcaatggtgtttcactccataacgttcaaatatttaggtatcatcctagccttatcatagatgattcagcaaggcctattacactgaaaagaacccatgttttatcttttactgatgaaaacaatcgatatcaggcatgctttattcagctaacagaaattacaaaaactgtgtatgtatttttttaaagcttggaggggaaaaaatttgttttaatttataataacatattagaggtctacatttctggatcaagggtcttcaaatggggactcacaattgaggcaaactaagtcttattttaggaacatttacttacatatacataggtaaataaatcaaaatgttaacttattatgttttaaatacaaatatgcagaaattaggattggtcttgtctactgaagttcaagtttttaagtggttttaccaaagaggattaacactcaaactttcattacaaaactatatctctactcccatactatcaactatccatatgaaaacttcaaactgaaaagagtttaagtaattgaatgtaattccatttcactgtaactctctttggataagcatattcattataaatcaatacaaaattatagaattatcacagagaaagcagtttccatttatgctgttcatgctgaaaatcagatttctctgtcaagaagcttactcataataggtctttttaacttacaagtcccttgcaacaaaaactctaacatcgtatgtttaaataaaagtaggtagcagatcaatataatgttacatctcttgtaattagattaaaatacaatttctccttttcctggaaacatctttttcttgtggaaaatgctcccaattttaacgtttttaagagaataaaaatgtactcctttatttcctcagcaaaagcaaaataaattgtgcagactccaaactgcattgaagccccctggtcttttctttcaggaacctctgtaacagtaacataaactcaagtccatggtccccgtgatcacatgctctcattgctcagggtcatggcctggacattaaatataagtgtcaggcagtcataaaatcttaacaatttcaaaatctttagggatcaaatataaaatgacattatgttgtgaggggactgaaatcccatggcctgtggccatgtcttaaaggtgcttgacaagctgggaaagaaaagaagaaaaacccagtctgccttaaaacaaatcattcctacatggaatttggttataaaaaagactttacatgtctcatatttatattcactaacgtatcttttcatgcaatatatacttcaaaaagcaatttcagaaattgtttaataatatttgggtttttttccaattacacagtgctcgtaaatgaaagcaactcccatataaccaaagcatcttagaaaaagcacgcagtccatgccaaggatagaatcaagctctctcaactctattcaacctatcacagctgtgctgaagaaagaaaacgggtaccctaatcactacagggcaaaccctacaaagatggcagcaacacattaatgatgcctaccacatctcactcaaggtcttagcacgaataggaagcttgacaaaaggcaatgatttagaatgcactctaatttttaaggaagtcagtgttatggccaggatcaggaaaaatgaacccaagacacatgttttctgagatttacaatcaggtagaaatagagaagggcaaggaaataattgtttagacttttccataaaaatatggaatggaaggctgggcgcagtggctcacgtctgtaatcccagcactttgggaggccgaggcgggtggatcacgaggtcaggagattgagaccattctggctaacacagtgaaaccccgtttctactaaaaacacaaaaaaattagccaggcatgatggcgtgtgcctgtagtcccagctactcgggaggctgaggcaggagaatggcgtgaacccgggaggcggagcttgcagtgagtgaagatcacgccactgcactccagcctgggcgacagagccacactccgtctcaaaaaaaaaaaaaaagatggaatgggaaggagacactactgctgaccacttcattcacaattctgaaaaaaggactgacaagtctcatggttttccattaccatcaagatccagacccctcgacgtctgctactacacagctgtgccaaaagcaaattctaccttggagaaaaggtggtttcatgtaaagacggtgaaaaggtggtttcacctaaagaccatgccaagaaaaaggagacgtcaaaagaaaagaaaaaagcattttgaattaaaccaaaaagaatgattggtgtcatgagaaaaatcagtttgatgtgttattaataagttcataaaattgctactcacatcaggaatgatcaggcatttgactcaatagcattactcccacttttctcatcaagaaaaaaaaaagatgccttactataataaatcctatttcattaattctatgttagtctagggcagtaagggtcctggaagttggcagttgattgtaattccatgtttttgagaaactttcagtagaagaggctacaaataggacatgatgttcgtttgtgacgcaggggattctgtaaaatgactgctgtggaagggggaacagggaaaagtttggcagcatagcataatagatccagaggagggttgcatctggctagtacaggcatgggagagctgactgcacacatctctttacaaccccatgactacacttcagtagcttgaaatccatcatagtctgtgtatttacatcaaggaagtcagcaaatgctacaaataagggccttttattcaggaagtcgcttgccagtatgccactggttagttccaaaggacaaatctcactgatagtctcctatcaagaaaatagaagtgctataatctacctcaaaggattgataagcaaattaaataaagcaagagtgcttatcagtagatacacaagaacttcggatagcaatgactatgagtgcttttaagaactgccatcaagcatagatctcagaaccaatcttaaagaatttcaccaatgatgaggtctccctaatgtggtctcaaaacatagtgatggtcatcaggagggtagtaaagcatgtggacaaagcaaggaaatgagtgcaggatgaaggcggctttcattccaagtcatctacatgcaaaagacctgctttaaatctgatctttttgtgtcttagatattctaaatatactgtcattatgaaggaaatggcaacaatactagatattagtcactagtacagcatcagaggtattaacaacatatctcttagtcaataacaccacaggcacaacccaaatgacaagtctacaaagtacaaggcagactgcaagatggagaaataggagcttcttggaaataatcacataatacgggggcaacattcactgcaaacagaatttcagaaaaaaacataattatacagacatttttatgtcctgcacaaaaattatctgtacttatgtctatacacacacattaagtcccctctgtacaggctcaatggattatacacaactgaaacagccaccagtggccacagtctcccacttctgccacatggcatttttcaaattttgtctcccacttctgccacatggcatttttcaaattttttcctctcactgggtatcccctcacatctatacttttgcaaccttacactttcattctcatttccttcatgtgggcccaagacaggttttcccacagaacatgcaatggtgcagaaaataggagggaaaagggtaaatccaaaaaaaaaaaaaaaattgaccccctctcaccccacctgcagccacctgcacccacctgcagtgaccactccaacccccccaacatataacgtattggccgcctcctttgaagatgtctgggaaggccttgaattatgaaaaagaaagaacacagtacagaagaaggtattttgtcatgctgagatctcatccatccatccactgtggaaaaaaaaaaaaaatcaccgggagcttcaaaactctcttcgacctaactctctgcatccctaaccaaatggcaggctgcatccctaacctctggtgttggggctcacgcatcagtaagtttcagaagccaacaaactgattctaatgtgcacctggctagttcttactcttccctctgcactagtgattctctgctctagctgcatattccaagattcccttgggaagttttaaaacatacagatgcccaggccctacccttaacccaccagattagaacctctggggatgggatcctagtatggaatagctttcccataaaatgccaaactgaagtgatggttgaaaatgaatgttcttcacctacagatgtttggttttgtttttgagaattttcgagaacgttaaaaattacttacatgtttgctaaaaaacagacttacaggggagaaactcagagaccgtgttcttctctacttattggcaggtgtattagtttcctagggctgcagtaaggaagtagcacatgccaggtggcttttaagaacagaaatctactctctcacagttatggaggctgaaattccaaaatcaagttgttggtagggccacgttctctctgaagcctgtagagcagaatctgttccatgcctttctctgagtttctggtggttccaataatcgctggtattccttggcctgtaaatatatcactccaatctctgcctctgtgacatggtgctctccctatgtgtgtgtcttcttagaaggacacagccatattggattaaaggccactctactctaggatgacctcatcttaattcattacattggcaacaactctaattccaaatgagatcacattctgaggtcccaaaaaggacatgaattttgtggggacactaacccaggaactaactagcaggaaagggggctgatagctactatggccagagcatcagctgttcattgtgaagaggtagcagattaagcaagtttctggtgatcttgaagaaaaggggcatgtgaaatacagctagggttaagacagttcctaagagatcaaagtgcaaagagattccaacccctaacagttttatcaccaccagtgcactggagccccactgcaactcctagcctctgaaatatcaagttgtgtatggcttataactttcaaatccatatttatactgtcagagctacagcaatgcccctaaaaattcatacgaaaactcaaaacattttccaatagatacactgtcatatacagggttatcacataatggcagtaccatattctaatttgggggatactgtagaagaaataagctttgtggaattaaccacacctcacagacagatacataatcatcaactatatttcaggagaaaatacattctcaattccaacttcatgctctaacaaatatccaacaaaatagtaaattctccatggcttaccagcttagttgcccatctaatggtttatgtatttgattgtactcactatatagttaatacagaacatttgtttccaatttaaaaaatgagtatacgcatcattctgtcatgctcaagaacttatttttgatacactaagagcccttaacagtaacagcagcaatcagctggaccactgccgagagagggcaggcatgcacacacaatgaacacgtggagtgaaaatatttttcaccaaaatagtaattccataggtacaaattagttaggccactgatatttgtgtcttcttcagcttcaagtatcctataaaataattgacaatattaacgagtctgtattattcatttaaatattactttaagagagataggcaacatcatttgtggaagccacattttgtttctatatatgcaaatgcacttgagggggaaaaagtctctctaaaacataggaaattaggagaaactccaagtaatctaacagattttcacttatttcagctttaatatacttcaaatatttgatactctacagaaaccacccacctcttccctgacacttttcaaactttaaccacccactgttttcctaactatgttaagttctcaacataaataagccaatggaatctccctttataaccagctcagagagaaaaaaaatctcttctatttactaagctgacaggtactttgatctctcacagactcattcaggtaacaatgtacatatgacagagtttaaagaaagcaaactcctttggaaatttaaagtgtcttagaagtcatgaacaaatgcaaataaactgaaaatgcaaaggggctgtatctctatcacttgcctttgcttactttgtttgacagctatgtttcaaagtgcaagcaaggaaataaatccttcaatttggctgtgatacttggaaagaagcttaaagcagtttaataacagcagtaagattaaaccataattctacaaaaaaaaaaaaaatccaaaaggtggcaaaaggaagtgcctttatgcaaatgtcattgcttcccaactacttctattttctaagggaagaagtctctgttgctaatcgactcataaagtgtctgaatatatctgatgctcactactgctatagcttcaaggtcattttaaggttcttagtttcgctacaagtgggttgtgaacattagtgagttacacatgttggacactttggtttgttcagagttaaaaaaaaaaaaaagaaaatcagtgagtagtctaaacagatgcaagagttctggcactccactgcataggacataatcatcatttactaacatatactgaggtaagaaaggtacccaagggaatttagaactgtccaggtttatatactgcctttttataaacagtcactgtcgtaaatataatgtagattatattgatgaataaagtaaatgaaacacatttgactgactggatgacattaccaaatgactgcagatatagctaaatgatgagcccaggtagatacaaaggcatcttaacttcctccgacttgacaactgtcagataaccacctctctagagtccccataacaggctgaaaacattatttggtaaaatgcaaacaattaaataatttggatttgctaagatttctctagtgaaacagttgagttttgggtaccctaactcacaaacttgacattattaatcatcataatttatgccaattatggatacaatgtgaaatgtcaatttcctatttttattataaagatcgattgcacatggattgcaaattcattacatgaaaaaattaactcaagattttgaagaaaaaaaaaaaaaacctttaccttggaggaaaactgggttcaaaaacttagcaatacttcaagtaccaaaatatatgtgtagaaaaataaagagggatggaagaggaaaaaaatcagttatttcatttccaaaaaagtgaaatatctgcaaatcaacctctttttagttgcatgcttctctaatagaactgtatgtaattcctttatgtaaagcctaacttatatagtgaaaaaacatcaccttgtattatacatttaaaaatggttaaactaaaattttaagttgtatttcacaatttaaaaagaaaattaaaatagtgatatttaaggttcttctattacaaaataaggaaggaacagttttcatctttgtaagttacatatgcatgcacatatttccatgttagatacagttacatgacaatatataatgttttaaaaagggttaaaatagtacatttctgttacatgtattttactataattaaaaacaacaaatacctgatttggattcaaatatcagtatcattcaccttgatttctatccagggtaatctgaaaaacatcgattctaaccttctgtaatttgtgttctagaatctacttacatcaatctttaaattttttgaccactctacctcagtcccacaggagaccaaaaggtaggaaaaagattccagggccccatttgtgcttcaagtcgatcagctagtcccacggtgaagtcaggtgccctgatacagcttttcaggtcttttcctgtgtgaatcaccacctagaaaagtcaggggcctgcctttggtttctaacaggaaatggtgccactgaagtgcaaattcacacggtggggaagctgcagggctggagcaacagcagagcagaaagagccagcaagttagacagtgtttctcttaaaaatagagtagaataaagaagcagaatagaaaagaacaatgggaaagagatgcagaattagtttgacctaaaatacgaatcaactgcttatcaataagccttaaaaaacaacctaccttacagcttgcctgagaatttgtgaagaaatacgaaggcaatgagaactcaaagtgtaaagctacttctttcatatctccatgtcttcttctctaactgtcttcttttctctgtagttctcacacttccccctctcccttttttcatcatctaattctacagctcaaagaaatccccccacttcgcgatgtctgttcattcaacatgcatacattttgtcttgggagcggggggagaggggtaggtatgagtggcatatataattgtttttaaaatactagggtctgttctataaatgaagcaaaagcaagctaaggaggaagacagagtatagtcacctttaatagtaaaactcaattaggctttaacagtaaaactgaagataaaggttccactcaggctatttataaatacccttaaaaccaaaaacagtggtttctaattctacatgtagtgacttgggcttcagatacttaagagtttaaagtagatggcacattaagaaatcagcaattgaatctacaagatggaaatacattttaaagttttttggcctcttttttcttttttacttcaaaaactttaaaattttcccataagagtttcaattgtgaccatacacattcttcacataaaaagtcaacaagatgcattaaagagtctttttaatttagtttcaacgtgtgctttattataactgtactaccaattccaaattatttcatcacgattacccactttaatccaaaacagtatgtcaacaattatttctgtcccttgtaaagaaagaagaagaaaaaaatgagatatcacttaacattgattgaattggccaatttaatagccattatatccattgctagaaagtggcaggaagaaccttatttataggttgcctctggcaataccaactatcagaactcctttgaaaggcactttcctttcaagagtcaaaagcacgttgatagtctttgacccagtgataacattcctagattaatcctacaacaacaaaaaaaggaaaaactgtaagtataaaaagtgcatggaaacacgatttataatctaaaaactggaaataatttattacgaggaaatagctgatttaattatggttgaaaactgtaatggactagcatgctgctattataaactacatttaagaaaaatggaaaaaagagcttattttgcaatattaagttaaaatgacctgcgtatgcagaataattagtaaagtatacaaaaacttctatcaagtaaatgtggtggtttcactagaaatatttagcttaatttgtattactgtcataatttcataacgtttttctaagtacttatagctacaatatatatacatattttataatccctaatatttttaaacattaaagtagattccaaatggcaatatttattgaaagactataaggattagtaaggtcatatctagaagttctcttactatgataaatataagaaacatggctcttatgaggaaaatgcttcaagttttaaaatgtttacattagtaagattttataatgcatctaggtgcagcagagagttacaatgtgtaagagaaggaagacaagggaatcacatcattttataagtttaaattaatataagaaaaagagaaagaattttcaatttttttaaaggggcataccttatatgatcaattaaaaagatctagagaaatagcagtaaaaacatatgatattaaaaaaggtttgcagttatcactattaatagttaatatttaccattgagtactaacttccagatgccctgccagatagtttacatagttcccttttacataattctcagtaccacattaccaagtaggtaattttggtaaccgtttattttataaatgaggaaagtgaatctcaagttaaaaacataacttgcccaaaagattacatggaggatatctaatcaataataaacagtgggactaagaccaaccaagtaccgatcctctattgcctaccattcccaaataccagtctttaaaaagaaagggatttataaatcatataaaaccagcacttttatttctatttcttcatataaatgttctagatctgcttttcctcagttgtttttttatctgttgttgaaatgcaggatttgttaaagtatatgtcaagaaaatttcaccatgattggtcaactacttagttttcaacgtttcccattaaatgtttccaagtaaattaaaattttaagtttaagatcataaaattggtacaggcatgttatctggtcatatttctatttaagtcagacttaactacaccaggaataatttggtagaatatactggatcacataaatctttacggttctctgtagtgtttaagtcaccagtgatttctaaggtaagtatttaggaaccctattaacgggtttaggcatccagggtacctagtatcactcttacagtttgttcccaggcatttctcaacaagtctcattctatacatcaggataagtctggcccctagaaaggaccttgctttctagcataaataacacctaaggacctcctaggcagttagctcccttcctaaatcaaatgtttggttccctatgagttaagtttcataacttaatctcctaagaacactgcttatcaaatcttacctctgacctatagttaagtgcatatccagagccaggcacaaggaagctgaagtgaaaaagtatggaaaggaaggagagttgaggccacaggaagagcctgattcactccacagatgcctctaaattacttaaagttctgtattttcttataagtatatgtgaatttcctccataaaactccacagtagatcatttcatagcacattaaaaaatttttaagtgactatttgtcttgaattatctgagaacactgatagccaaatataaaagtcaaaatgtccttagagatttgaacctccaggctaaaataaaagtcatggataggaatggagtgggagcatattttgttttagccagtatggtagccaggactcactagaagaaaacaaatgagaagattaccaaaaacagagcccattgacaatagagagactacctctttcggacaaagcaaagaacagtcaggaaagaagctgttagagaagagcagagcaggagcacacactctgcccaatgttacacgttattgcctctcttttcctattcctgattcagactctgtgtctattactgccaatatatggtcattagacatcaacttctttcattagaaaagaggatatttcaccctaccttaagatgggccttaattaaatttctaaatacctagatgaagatgtctgaacacctctactgtttcagaaaaaaaccttcctgtcctttcctcccacgctctctctcattttggcccccatccaagagaaaataattatatggcacagataatatttaagccaattagtatcacttcttagaagcctatagcaaacaataaaggatgcatttatatgttaatacaagccacaaaagtagcattctgccatgttcctatttcatttcagggtgacatttaagatagcatcttacttcacaagatttagctcattacaatcacaaattttgactcttgatgtacccccttgacatgaggaaactgtcaaggtaaagatcttgactaatatcagaggtagaaacaagtggttaaactaagactcaagctataatttctctaatcctaaacttcattttgaacggctgcactatactgaagattattaaagtctacttcctactctttataatatctacaaggtactatatatttttaaaatacaaatatgcacaaggcactgtgctatatctcgaactacaaagattatataaacagtccaagactcagtagattcacagactcagccatttgctatttcttctagatggaaaccttccttggaccatcaaagcccatctttttgctctttggaaatttggaaattctccataatgtcttccttgactaagtctcctctagcaatactattgactttatatgtgatttaaaattcattcatgcaatttcttgtgattggatggcttcataaattagatttacactcaacaaacagactgtgtcttctgctttgttctgaattaccagttctaccaacaatatgctatatgttgagtgaagtagacaaaatcagtttgacaagggggcaatctcaggtacacagaactagataaatcttaactctaggtttatgagaaattatcatcatgtctcttttattttatttagaggaggtgtatgttactggtaataacttaactctttggtagggcactacttcaaattttaaaaagatgtgatttaaatcattactattaaagagatgtaatcttgtaccaaaccagactttttttatatgtaccgttaacataccgccttcttccatctacaagcagtgcattataaaacaactcaaataactaaaatagttaatatcatgatagatattccatgttgcatagattaaaagataaagttacttgaaagattaaattaacttatgatttagtgttccacgtgattcttttccaacaaatacaaatctgaaaaaaaatgtgcttctcaattttcattcagttataaatatgtatttcaaagatgcaataggctactctaaatgtcgggctaagcaactaattaggtcttcatcttcctctctctattaattattttaggtaaataggaataatctcatttgggaattattataagagaaattccttcactgaggtgggaagctaggctacaccatgtccaaagccccacccaaggcagagtttcttaattaagaactctgttcacaagcgtacagaggcctcctcacactaatcaagttcatcatttttcacgtaaaaatccatggaatgttgttggtgcactataaaaatacagtttggaaagtgaaaataaaacctacgatatgtagtaggagcttccaaatctgttaggcacagacttgatcataggactctccttaacatttctaacagaaactgaagaagaacttgtagtaaaccaatataataactaagccttgtagaaggccttcaaatactttcttatatgtatctagataattgcatctagatacatttatgtagccgcataaatgcttcacagtgggagctctccatagtctggtctcactttactttaattcctatgtcttcaggaaaaccagccaaaaccttactgaactgtacatttccaagctgctcattcttgtatctgctacttgctcaggctattttgcctacagaacgtgttctactttcagtcactacctacccagcgttcagtgtcaactcaacgcttgctttctccatgtatcttctctatgacacatgagtattattcaaccttaaccatcttatatacaaccccattctcatgacccaggcctctctctatattttcatctgaactttgtaatttaccacctgatcatataactatcttaaatacagattacctcttcctgaagttttgtatctacacctacagcattaattctacatcttatacttcttctttgctgctggcagtgcttggtattcagtaaatacttgatggctgaccaataaaaagaaaatcacctctatactaatattttaattttccaaaaagtatttaaaattttaaacagaaatatgtgtttaatgttcaattgcttttattctttaaaactccatttctctgtatctaccctaacagctacctccacaaacgtcacttactaatttcctaataatgccccatgggtgttataaaaaatgccaattaaatatgctatttctttttctccatcttttcctcttgaaataaaacgtgacatgtactgtatacaaattaaaaccagtgctgcctgcccttcttatataataaaaacattaagaaatgaaaacaccattgcttttatttcctcttaagaaaagtacaggctaaaactctcagactctgcaaaaagtataaataagaaagttgagatcccttgaagttctacaactaacaggatacattgttactctatttggtgtatgcccttttattatacatgcacatacacaaatgtacaaattctgaagctgatccttaaaacctggctccacacttccaactggtgtgacctggagttatttagccccctgttatttctgttaactaatctataagatagggctaataatatttactcaaaggaatgttataattaaatgagataatcaacataaagcacttagcctagtatctaacacacaagtgttcaacatgttactatagatccttgacacaaatgctattttgtaatctacttcctagattacttaatatttcatagacaaacttccatagcaaagaattcaaaaagacttttgttttgaatggcagcttagtgttccttctatcaatgtgccacatttatgtaactatctccctattacacattttgattgcttcgcaacttttaattataataatctgatgagaataattgtagctaaatctttacacatactcataattatatttttggaatatattcctagaagtaaaatttctgggtcatagggtaatcagattataaatggttaggcatacagaaagtatacattcacacgtttcatcagtgcatatatatgtgtagttattacagtttcttccatatggccatctttttaatcttacccaagctgaaagccaaaaaaaaaaaaaggcactgttttaatttatatttcttggactaccagtgacattaaacatcaactcatctgtttactggtcatttacgcattcactttttttgttttgttttgtttttgttttttgagacagagtctcgctctgtcacccaggctttagtgcaatgacgggatctcagctcactgcaacctctgcctcccaggttcaagcaattttcctgcctcagcctcccaagtagctgggattagaggcacccaccaccatgcctggcgaattttttgtattttttttttagtagagatgggttttcgccatgttggccaggctggtcttgaactccttacctcaggtgattcacctgccttggcctcccaaagtgctgggattacaggcatgagccaccacacccggcccatttatgcattctcttgtgaaatcccagttcaaatattttcccatctttatattgggcagctgctgccttactttatttaagaggtttcttcatgaaaaatattttcactgtcatatatgttgtaaatggtttttaccactttatagttcgccatttaaactgacaaaacttttattataaaagtgtttgaagtagtcaaattccaacttacaatttctagatttggagtcaccattcagaaagttcttctctattccagatttacaaagatattcacttaaatcctattttagtaccttttgtctattactctgattcgggttttatgaagcaaagtattagggagatacatctgaaatcttagagcattatttctgaaaatatctcaggttggacaaagcataatgcctaggcaaactgctgtattaagatgctatagaagaggatttgtctaagcttccaaggtagaatactataaaaaggcccatcatatacactggcttaatagctgtcactatttttagcaattaatttttatcccaacccatatacctctgttctgatttccaggcctttttatcccatagcttacctcacatctgtagtcaaatattacttcctcaagggaacacagcctcaccagtttcctgttatatgctagcctagaatttttccctttattcaacagcagctctcgggtggaagtgatacatatatacagtaatccctcagtatttgcggttattggttctaggactcccaccacaaatcaaaatccaaagatgcttgagcccattatgtaaaacagtagcatgtagtatttgcatataacctatgcatatcctcccatatactttaaatcatctctagattacatataatgcctaatacaatgcagatgctacatacatagttgtgctgtatttttaaatttatgttgtctttcttttaatattttcaatttcggttggtggaatttgtggatgagaaacccttggaaacagagggttgactcaatttatattaatgtggttatctgcaccactgcaagaatgatgattatttttgatccccattgcaggagctggcatccaaataggtgctcgataaatatgtctcaaaagaaaggaggaagaaaaattcatagtacatttttttgttttgttctcatttgtttgtttttaaatgtgatgtctgaatgaagccaaacaaaaagctggtactacccagttctttagaagtaatctttctctcacaaatttttagaaaagctgaagagaatcataatcattctaaaaattcatttctgaggggttgaaaggggaatgaatttttcatcctaaaatgatctgctgtcatttcatatccttaaaaatgggtaagtatcagcatctcttcagacgctcttcagttttaaattgtacacaaatttttaaaattttgatttctaagactggtaatttgagagtaacaattcaaatctctataggattttgcaatttagaaagcttttttacttttctataaacattttatttactattcataactttaatgtgacatgggagttaatagggaagaacctcatcttaaattaacaggtctagtggtagaaggacttgaacccaggatgtctgaccggtccagtgcactcattaaccagccagccacggccacatccccagctcctgcctcagaatgctcctatacactcctatccgcaaggcctagcattcatcagctccttgtgaaccatctgacaccacccactctctaagtcttcacagattttcctcagaccatttccatactttcaacaatgtatcctctccatacttaaatattccatggcctattttgcattgctggtaaatctccttttctcccacttgcagataaatcctctgaagagactcttagttcttcaaagaacgaccttaacttcccacggtacctaatataagagttaaaaattgattgttaataaactggaacagggaggctatgtaccaaaaaaatgaaaaacaagctatttttaaaggccttgcctgacactcacccagactcattgtccccacgcccacccacaggctcccagatccccacacagtgcacgcacaaacacatgaacaccaccagcaggaacacagcattcccaagaaggtttttcaacctgaggatgtggtaagatttttctatccagatgacagaggagtgtggcctggaggcttttctttgcaaaacaggtttttcttgctggcttctgccctaacagacattcactttgcatatccctgtggtgggacaggaggcagggtagaaaaagaagtcagcagaagatggtgatgaaattcccaaggaagttccattaacctgatcttccagcacaatgaaatgtgaaagaataagacagggaagaggatgtagaaaaagtgccttctgttttatgccaacaagacagctctcattttgataaatttataaaccaagtgtaaacttgaccatgttgtctgtttttatcttggtcacataagcgtaaaagattttcttttgggccaggagccgtggctcacgcctgtaatcccagcactttgggaggccgaggcaggtggatcacgaggtcaggagttcaagaccagcctggccaagatggtgaaaccccgtctctactgaaaataaaaaaattagccaggcatggtggtgggcgcctgtaatctcagctattcgggaggctgaggcagagaactgcttgaacctgggaggcggaggttgcagtgagccgagatcacgccattgcactccagccaaggcaacagagcaagactccgtctccaaaaaaaaaaaaaaaaaaacttttctttctggaaaatgtgaactatttcctgaaagaaaaacatacaaaagcacctgttttttcccttctagatcagaagtttccaccttgcttacataaacatggatcactgtatctgcaacccagcctgcagtatgtcggaagggacggattcccttacaatacacactcacccatttagaccccccatgcctaccacatgcatccatctttacaacctcaattatgcacaagacatccacagccgccaattaaaccgtgttgaacactccaattcattgcgtatgagcctgcaaattttttttgctcacagaagcattttctaagatgcacttgtcaatttttagctcattaatactgtggatcccaatttttagcattctacttaagttttgcaacttgatacattttctggataatgaacacaacatgtggtctctaagttctgattaataggagtggactcccattatgataatgttgacaattcattactctaggaaagccaactttaagataatttttttaaacagaaaatgtgtaaactgatcatggatgagggatgatctgtggactgggcaatgaatacagataaaatcactgctgctgtctcttaataacagaaacatcttatagttcttcatgccatagttaatgcagaagctaatgtaaagcacaaggtcaggatgattaaaatcctgttatgaggggtcagggttagctacaaaacagtagcacaggaagccttgtgggcatggaaccccacatacacaagatctgttatcttgattctggtggtagccatgcaaatcaatacatgtgataaaactgcctagaactgatacaaaggacacacaaatgagtgcatgtaaagtcagtgatcctgaagaagatctgtggattataccaatgtcaatttcttagttttggcactgtattacgtcatgtaagatgctaccagtggggaaaactggtagggaggagacaaggaatctcctgtgtctgaggaatgggagggggaattcctgtgaacttataactattcaaaataattttttcaaaaaggctgtcagttgcaaacactgttagacatacatgcattcagtcaatcatgtattcattcaaccaacatttattaaccacatactgctgcctagcattgctctacatgctggggctacagacacaacatgatatgatctttgatctggaagaactcacagcctggtcatccacgacaaaaagcagtgcaggagggaagagaaggtacaatcgtactcgacatggagaacagacagacatgaacacctgaagttgatccatatatattatagtccagctccacattaaagcaaatgtatttgtcaatcaccattccattcacaaatgactataaacgactagtataaaatgaacatattaacctaaggttcccatcattaaaatatcaaccctgtggagaaatttttgctgaagttatttctaacttcaggacaaagaaatgttcagttaaagtaagttgactgcttttgtaagaaagggggttgtgtttgacttcaaaagctcagtatttcttttaaattcctttttaagatacatctttggaaatgttattaaaattgttcaagctaaatttacagcttagtttaaaacatgtaaaacttagggacgataacatcccaggggaaaaaaaaatgctttatgctattagaatttgaatatctataactagcaaaaaaaaaattaacctcgaatagccattactatttttttaatacagctatggattcactttgcacaatatgtgtgttcctggaaaggttttgtaaaagcagacgatttcattttaaattcattttaaattaatattttatttacgcatttttttcctttgcttctaattaatttcaattaacagtatcctggtattttaatttattagtctctctgccaagttggtctaatcagatctttgggttccctatcctaacattacatctgaaaaatgctacattaagacaatataattctcagctgggcacagtggctcttacctgtaatcttagtactttgagaggctgaagcaggaggagtgcttgagttcagtttgagaccagcctgggcaacacagcaagaccccatctctaccaaaagaaaaaatagccaggcaagttggcatatgcccgtagtcccagctacttgggaagctgagatggaaggactgcttgagccaggtgaagccagtgagcttttcagtctcacaccaccatactccagcctgggcaacacaacgagaccccatctccaaagaaataaaaaataaaaatacataaaaagtttaaaaactaaaaagaaaaacataattctgtaaaaaattataaaataatttttatttaatgatattgtgctttggccttaaagatttattacaaaatggacagtacttctggaaatagggggaaataaaaaatgaaatatcaatgttatatttcaaaagcgtaatacaattaggataaagatagaaattcttcacacatctttagcctcagcttggatgagtgctgcattcaagatgacagacacaaaagatggtaatgctgactccactaaactgttgtctgacacataacactgtcctgtcatgcctcaattttcacacatgagctattgctcaaaattcagtataaaatagtgacttacggctgtcaatgtaaaaagtatggcttgctcgaacaccaactcatggatgtcaaagaccaagtgtggttagtagacaatctagatgaaagtattcaactgtgggtttaatgcattaaaatatataaatggtaaatcacatatataggaccctttcttcaaattttccctaataaatggccactacattatctttcaaaacttatctgttaattcaaaatctgtatatcacagggttattaataaacaggacagatgtgatagccacagactaagggaaaaacacattatcacttcatttatatttttttagtctaacatgtatcaggcataatgccaggtgctagggattcaacagtcacagacagacaggattcatgccatcaaggagggcatctatgaggaagagaaaaagtgtgctcgtgctgctggtctatggaatacggtactgtgctatgcagaccaggcaccactcctgacgactgacacccctagtggatgcactggccatctgcagccccggcctgggacattgggattccagaagacctggggagcctccattgtatcaagaacagtttcaggaatgaaaaagacttccagtataaaaaactcagtgccaacatcagaatgcctacaaattctcaccttttccattttcaaacaacttgagactgactaaaaggttcttggaaaaactcacttagacacaatgaatgcattacacaggaaagctgttaacaggcattttctccatgattcctttagggagtcatcccctctgcttaaatacacaccctacatataatatagtcatacaaaacagtattcccgaagctgaggaagtcaaaaatgttcataacaactctcacaataatccttgcctctgcaaagcaggccagaatgaaaaccagcttttctgatttccatctgccctctccaaagctcaacttaaaagcttgacatcatctttgacccctccttcacccagacctttcccattctattagttgccaagtcctacaagttctatctgagaaaacctctcaaactgatcccttcttgtccatttgcattgccgcaacagttgtctagggtgacaataaataaacccacaatacaaccccaaataacatctccaaaattctttctccccacaaagatatcttagctgacaaccacactagactacttatacacacctttcctccttagcactccgctcacatcactccttccacctcaaatacctcacagaaatcccacctccttcacatcctagctttaaagcaacttcttcagaaaaagcatgcccatattatctaccatctctgaatccccacaatattttgcaccattcatgtgccctgtagtatagtttctcatgtaggtatttattatggaagtatttatatatcaaaagactggctttgtcccacacagttcagggatgagttttatttctctttttgtgattactgtccttcagataagacacggctcacaggatgagattaataaatatttatcaaatgaaactggcttccaacattcatgttaagatgctgacttactctcaaattcaagcattgtgtaagtagagctaaaattttgataagtgggaggatgggggcttttaagagttcaatttgctgcagcaactcttccttcttaaaactcatcaaaatcaccagcatccacggctcagcgtaatgaaagagaaattaaaaatcaaagatatagctatgaaattccccagatcgctgatttacacacacacacacacacacacacacacacacacacacacaccccttcaaaacagaaaagaaaacactcagggcagaatagcaaagttttcagagcaatctcctgagtcagaatgctttggtctaatatttcctctactacattattgtgtgaaggtattcaagctatataaataccctgctccttaatttcatctacaaaatgaagatcataattcatataaacatctaaaaaatataagtgctaaataagtgctatacaagtgtttgctattaacattttctgtaatgtatagtttagtcataacttcagtatgaagaaggggttatcggctgggtgtagtggctcacgcctgtaatcccagcactttaggaggctgaggtgggtggatcactttaggtgaggagttcaagaccagcctgcccaacatggtaaaaccccatctccactaaaaatacaaaagttagctgggcatagtggcaggcacctgtaatcccagctactcaggaggatgaggcaggagaatcacttggacccaggaggtggatgttgcagtgagctgagatagcaccactgcactccagcctgggtgacaaagcgagactccatctcaaaaaaaaaaaaaaaaaaatgaggttatctactggccactggctactggccaattctgaatagataaggtcacacgtgcattcagcgttaaggacccaatcttgaaaatgtatctgacctggtagcatttcaccctgccaggtaacactccatgtttttaccgtaacaaagacattaaaaggtcagagtgtcccaaagattgctttttagcttctttttagaagcaaaaccagaagagtatctgccttgattgagctgtgttgaaaatcactggagttaggaccataagaatcctaggtacagtctgaatgtgaattgactcaacgacttaatggattgccgagtcttaacatcaattaagacagatccgataagtatgtccaaaagggtaataaaataattcagcaggtcttcataaatatgaaatattaaatatttgcaatgtgtcattcaatcagacagataagatctatgcttcagagaacaggaactcataaagcttttaaatgaatacgaaaaaagcattaactgaggcacaaattaaaacagacagcacagtgaatctctatgggcaagaagcctttctagtacctcaatatcccaggagacacagcaaagtaggaagaaacctagggaaataggaataaggattcaagaaagtagcaaagtttagtggggatctttcacaagattattccaatattaatacaaaaaagaaagggcaaaaagattccacacatgataaataagatcggacagactgaaaaatctctccatgaggttaaacagattcccttcatgagatactatgttttcattaattctgtaaatttcaaaggctgaatgaaataagggtctagcactgctgaagcttgcgtaagtatcccactcatggtcagaggaaaataaagacagtaatcctttgacagattaaatgtttcaaacctcaaaaattaatgcattcaaatgcttcaaaggaatatgtttattgatgagtaaatatggttatggggatagaggacaaagataattcataatagcttgatctaaggccattctgtgctaaaacaggagtaacgaaactaagacaagtataaaactcattccaacttccgtacaaacatgtaacaggccccagtgggaaaatggaatttaacatgtgtgcgtgcatgtttctgtgtgtgtgtgtacactctgcttttgtaatggtttgactgatttttgatatttcgctaaaatgtaatgaatcaggattatacaaatatcttggtccttgactacgacaacccataaaagctaccaagctcccatttcttaaaagcacaaattgattaattaatacaaagggataacagcagtatgtgactgaatttaagtttttcccttagaattccttgaggaaagcatacatttctctactcaacataatatttatgtgttcaatcaagactaaaattgtaaaaattgggcaatggatctagttttggcaaattaggcaggtcctcacagcaattgctgtgtgggttgaaagaagagtgggagagcattcaattcattaaacactcctacagcattctatctttactaacaatcttgcagagaattctgcatctattcttattgctaccaacaatatacaatattctttaatacataatatttcatttctatgcctgctggcaaagctgcaaaaaacaaaaagaatgatatggtcaataaataatttctccagtcagaatattaatacaaactttcttataccttgcccttagatgaatgattcaatgcccaggaatataaactaccttgtaaaagtatcagtgagagagaaaaactctgcacactgaagaggaatgaaaaggaagctacccagaaacaagacccctactccacacactgaccacaaccgccccaccctcttccttcactagcactgtcatttgagatgtcccattcctcatctgtaaaatgggataataaaaatgcctgccttgcaacaccccagtggcaacaaacacaccccgcacccagatcttggtttctaataccatttgtcaataagaggaacgagggctctgtgatgaaatgaatgattccaggactgaggcaggagatatataagatggtgtatgggtatgagtatggcacatcttgaaagtaccagaaagtagagaagtacaattaaaaaaaaatgtttgacatacaataagggagatatgtcagagagatacaaaagtcaactaaaagagttaccaatggcaagctgggcatggtggctcacgtctgtaatcccagcactttgggaggccaaggcaggtgaatcacgaggtcaggagatcgagaccatcctgaccaacatggtgaaaccccgtctctactaaaatacaaaaaatttgccagatgtagtggcgggcgcctgtagtcccagctgctcgggaggctgaggcaagggattcgcttgaacccgggaggcagaggttgcggtaagccaagatcacgccactgcactccagcctgggtgacaaagtgaaactccatctcaaaaacagaaagtctcaaaaaaaaaaaaaaagttaccaatggccaaagctaaaacaaattgggcaacaaaataaagttgtactggattataatccacaatataaaataaatatccatgaatccacactgatataaaaatgatgtgataggtaggtagatagataagggggatgagacaaatctcctaagcagaataattccaaataatttatgtgtatacttcacacccaaggaggtggagtataattccttacttctgaagtgtggggtccacacagtggcttccttccaagagaacagtaataaagaccataatcctttattacggaaaagaacaactttacagtggagaaagctgacaacccctatttcagccaggtaatcaatgtcagtatggagatgataagtcattttgacagtatgtacccttgatgtgatgtaatgagaacggcactttacctatgtggtcctcctcccaaaactcatcaccctagacttaacatgagagggcatcagacgaatctcgactgagagacactctacaaaatacccgacgagcacacctcaaactgccaaggtcatcgaacacaaggaaagtctgaacaattgtcacagccaagaggagtcagatgtgatcacaaaacctaatgtggtatgctagacaggatcctggaactcaaaagggactgcagatgaaaactgaggagatctgaataaagtacagtaggttctcagataacatcattttgttcagcatcatttgattacagcattgacgaaaatgaaaaaaaaaaaaaaatagatccccagcccaagccactgtctgtgtggagtttgcatgttctcccacgtatttgcatgggtttctccaggtagtccagcgagctcccacactccaaagctgtgcccattagggaagctggcatgtctgcatggtcccagattgagtgtgcgtgtgtgtcacctgcaatgggagggcatcctgtccagggctgttcctgccctgcgctccaagctgccaggatgggctctggccaccgccctgaactggaataactgagtaattatcttattgatttttattaatctttctgaaatgtatgtatagctcctatttatttcagtggttaatattagaagtgttttgttccttatttagaagctgggtgatatttctgtaaccagaaatttgccataggaacttaactcttgttcctatcaatcagtctatagtaaatttggcatgtttagacgttgtttcacttaaactctgggtttctaagaactatctgtgacttaaatgaggacttactatatgaacttttatttaatgtatcaatattggttcactaatcgaaacaaagatcccataccaacctacgatattagcaacacgggaaactgggcatcaggtatacaggaactttctttgccatcttctcaattttcctgcaaatccacaactccaaaaaataaagtttatttttaaaaattcctgccttgccttccatacaaggttaaatttttcagaagtttatggaaacacatagtttgttaaaaggctacaccacttaaaaatttaaaataaatttaaaaataaatattataggctttcatttttttcacttttttgaaaaaggaaagcattccatttcacttcagagggttctttccaaagaatttttccatccaggaaaaaagaagaaaggaaaagaaaaaagactgaacaactatgtcactgggtgggacccttggagaggatactagaaaaaagagagttactgtaagagattacaatcagaagtgaatcatataagattattagtttcttaactgtagttgtgacagtttgcataaatacactgcaaccactctaagaaggaatgtttcattataactaacataaatgatcattacttagacaaatgttatgatttttttaaccacagatactttcatttgatattactactgtgtcctataaaggcaaagaatattttgcattttccttactataccatataagacttaaaataccaaattatatatcttaaattttattttttatctcttcactatcattgattctcctataaattattgactttaatattcattgttttcttaggaaagaactactgaaaaacaggaaaaaaatcaagaaattaacatatatattggtttttaaaccacagcattatgaaatctaaatggtatataatgcaactggatgtatatttatcttccgagaatcctctccaaccagtcctcctctatgccagagaaatgccacttagtctacatgcttgggtaaggatgtcccctcccctccacatcagcagtggtcatatgacccaagcctaacagctgtgaggatttgccccttagtcaccttgattgatttaggaaataggtgaccaggccaagtgttaaattatcagaaaagtgcttgctttaaaaagccaggccaggcgcggtggctcacccctataatcccagcattttgggaggccgaggcaggcagatcacgaggtcaggagatggagagcatcctggctaacacggcgaaaccccgtctctactaaaaatacaaaaaaaaaaaattagccaggcgtggtggcgggggcttgtagtcccagctactcgggaggctgaggtaggagaatggagtgaacccgggaggcagagcttgcagtgagccgagatccagccactgcattccagcctgggcgacataatgagactccatctcaaataaaaaaaaaaaaaaactttatgatggaaatttgaggcaaccagcagctgtattgctgccacattttgatagcctaagataaagcaaacagaggcaaaaataaataaagtaaccaagaagtgaatagagagagtactaaggatactagtcaaattgccacatgcagcagttcttaaacacggcttcacctcttacgtgtcccattccataaacgcttttttgattaaacaagtttcagttagtgtatcatttaagattaggtttggctgcaagtgtcagcaaacttaaaaggacagtggcttagacattactgaagtttctatttctcgcattccaagtgcaaagtcaggcagtcaagggtatggaagctgtgcttccccaagcctcacagaactcatgtacattccagctcatagctccaccatgcccagggtgggacacacccaaatggttcaatatagcactgagacagacgtccagctgtcacacccacattccaggcaacagaactgaagaaagaaggacaatgtggagtaaaaggaatgtactgggggactttacaggtggagcagctttacaagctgctcactatacatcagcttacatctcactggctagaacttgctggccacatgtagaggctggaatacgtcatctttattctaagcagccacacacacaatgaaaattctattgtcacggaagaagaaaggaaggaatagactgggcgacactcagcctctctcacagctgggtttctgtaacttccaataagacaactatcacaaatcatatgctacataattgctgttctctcaaggactgttttttttttcccaaaatgagaacttttaggcattaaatcactgtagtatttatgttttgggaatcccatacagcaatgacacatacttagagaacagaatattaacacctaatttcacattttagaccattgagagtagagctttatcatgtggcccaaagttgctaacataagaatgtgaatttaataaggaattaaattctggaatagataaggaaataagtcaagaaacccaacaaagccctggtaaaacataaataactgacagaaagggaaacttaaatggccaactagaatatgacttctgagtaaagaaaacagactgattatgaaccttgacttgcactctctccccaattcaaataaagtaagatggaatagatttttctttagatacagaatgtgagataagtcaataagcacaagatttctgaaaaggttaaaaagtaagtggaagaaatgatttggcagaccctggaaagccgaatgagggaggccggccaattgtgaagaaaaataacaagcaacctgacacagccaacaaaacctcccagaatctgggacactctcagctccctacgaccagaaatggcggtaaaagtctagctaaaatgaggaagactgattgacagtccacttgagaattagttagatttccacatatcctcgtgaacacagctggaggactgtccttctcagccccagaagtctagcagtttattgctagtgcagagtcaaacaaagggcctccactgagagactccatagacatcttgtacaagagaaaatcataccaagaacagagtgagggaacaaagagtgataagatgtccagtttcttctcattcaaattgcaaactgctggcagcctggtctacaatggtaggcagaagcttgaaaggtttttctatggaagacctaattagccctagactcaagcctaaagacagttcctgccatcaagggtgcaacacataatagcccagccaggtgactctgctgagaagagcacagactagctcagagctttcaggaagctgcttagtgccccacacagagattacagacattattaatgcactcaccaaataagaggacgtcattaaaaaagtgttattctcagaacaacaagaaaatgttcttagaaattaaaaatatgatagtaaaaattaaagaataaataagaagacaaaaagacaatgatgatgtggtctttcagaaagcagaacaagactgaaaacaggagcaaaataataataaaattggaattccagcgtgggataatccaacatttgagaatgagagctaaagagagaagagagaaaatggagataagaacagcatcaaccaaataggggatcccttgctcttcaaattctcattctccgaactcaggaaccaaaaggaagaggaaagtaagttctgcaatagtatctttggaagaaacagtaccccaatcctctgacatgtcctaacactgttgcttgccatctgaactcagtaaatgaatcaatttggataccatgagatttctggtgatggtggttttgttgttgttgttgttgttgttgtttttaattccctaaaggaaggacttacgtttacagaatgatagggcccactgagtatcctgcaaaacttgacaaaaacaggccacataaaggcatgtcattgagaaattcagaacatctggaacaagacacttctacaagatttcagagagaaagaaaaaaaaagagtggggagagaaaagtaactgacaaatgtattgggaatcttaatggcatcccaatgtaatctagagtggaaggatgctttgaaatcccaaaggaaaattatttccaatcttcagttatagaccatactacattatcggtcttgtataaatgttaagatattttacacatgctggatttgaaaaaattcacctctcctacaatctccctcctcagaaaggatgatatgcttagcaaagaagagagtacacaaagaaggaaaaaatcttgatatgaggagacaaaggacacacagggagggaaggatggttacaggtaagcctgaggatgagggctgtgtacaaggcaaagcacacctgatggccccaagaagatgtacttgacagacacctctggaatctgaacgcattgagaggagaatcagacaattctgggtttgaagcagggataacaacatcagaaactgaaaacacagaaaaaattactgttattggtctggtcaatgatttcttcaatatgaccccaaaagcacaggcaacaaaagcaaacatcaacaaatgaaattccatcaacctaaaaagctacaccacaaaggaaactgtcaacagagtgaaaagacaacctacagaatgagagataatatctgctaaacattcatttgataaggagttaatatccaaaatataaaaggaactcaatagcaagaaaacaggcaaaaaaaatctaaacagacatttctcaaaagacgtagaaatggctcatagttacatgaaaaggtgctcaacacaactaattatcagggaagtgcaaactaaaacaacaagacatcatctcacagctgttagaatggccattatcaaaaacacaaataacaagtgttggtgagactgcggagaaaagggaaccgttttacactgctggtgggaacagaaattacaacagccattacagaaaagtgtgtaagttcttcaaaagttaaaaacaggactaccatatgatctaccaatcccactaccgagtatgtaaccaaagtaaatgaaatcagatcagtatgttaactagattatctgcactcccatgtttattgcagcagtaatcacaatatttgtaaccaagctaactgtccatcaatggatgaatggataaagaaaatgtggtgtgtgtatacatacacacacaaacacacacacacacacacacacacacacacacacacagtggaattccgctaccaactctgtaagaactctgcacatttagggacatatttcaggcaaactggaaagtatgcttgggtggtggtgcgaggaggggcatgaaacaggaagaagagtagaactggggaatgaagataaagaaagtaaaatgagtgaaacagcagaggtgtcttgtcttcctggtactagtaagagtggtggggcatgaactgaggaatagaacagactcaaccatgtacatcagatgatcaaacataccatcaccactcgccatcacaccccgcccctaaaaaaagagaaagggggagaaagaattgggatcaagttagaaagaaacagaagtaggatcaagtaaaaaggaaagggaacttggaatcgtaagataaaaatcccataaagttagagttatacaggaagaataagttctaacattcctttgcacagtagggtgactatagttaacaataatatagtgtgtatttcaaaacagctagaggaatgcattttgaatgttctccacaaagaaattatacatgttcgaagtgatggatttgccaactaccctaatttgatcattacacattgtataaaactatcaaaacatcatagtataccccacaaatatgtacaattattatgtatcaataaacataaaatgaaacttaaagaaaaaaaaagaagataaagattccaaagtctggctccaaaaccttcaaggtgtatgacttaaattttacctttctatgcctcagtttccttatatataaaaaagaaagaactaactttttagagtgattctgagaattaaaccatagtctataaataccagggttttaaagctcagaaaacagaaaacagctccatgtgcccatcatttggcatcagaaacattgtgcacattgtgtaggtctctccaaaaaaactgggccacagacaggaattgtcacgctgcctgggtttacctgctactcattagataattctgagaattacattttaaaataattgttggaagcgtctactcttttttttaagttttctattactcccattcttgagatgactattttctactgaaaataagttttcggacactacagaaaggaaataacaatgagccaacttattaaagctgagaatcaagttactaggcagggaggcacattatttacccagcccagcgccacactccaccatcatgtggcggccagatcacatgacacatgattcaaagggagaattcttaagcaagtttccactctagcttcctaagttttaaagtcaatgtgccagagtcaacatttgcacatcacggccataagtaaagaatcaagtgaaatcaaacgtcattgcctctacaaaaggacatccttactggtgtctgtccttccctcccattactacagctgagatgaaaagttgaagggcaactggctctctctcccctgtgtatcatctcctcatttctgcctcataaacttctaaaatactccactccctggctagtagggtttttcctcataatctctgccaatgaaatatcttgttttccctctaaaacatcagtcttccctggctaccatatgctctatccaccaccgtcatacaagaagtcattaagaatgcacatgtgtacttattccgcaccaggagggcccttgtgtcaatcaggaaactatattatctagattttattttcaatctggttgtatgttgataatgaacatctttcaatacttgctgtaataaatgaaaatacctaaaataattaagaataaattatgttcaaagtatacttaatactgcacataagcaattctactgaatacagcattgatagtgaaaaattccatttgccatttatggtgaaaaactgactatatcctacacatactttatttatactaaatatacattccttgtaagagagagatctctcacctttcattaaactataaaaatcatgctaacaagaaataccatatattttctttgtctttccttccattaccactaacaacaaggatgatcatgtgtcaggcactgtcctaagtccttcccatgtattaattaatttaatgctcttaacaacctaatgagctagggttcacatcgctgtttcatagatgaggaaactaaagtatagagaagttaaaagcccgctcaaagacacacattaagcaagcactggaacaggatacaaacccaagcagtcagaccctgaaacagttaaccactggcttccataatagccagaataatgctttgcaaaggtggaggttacatgcctggaaaattggactcagcacaagcagatgtgtaataagtatagaatgaatggttgcaagcttgaattattgcatgaatattcttggactagaaatgtttttaaaatattgcctaaaattatatcagtacattgttaagagggagaatgaggtggagggaaagcagaaaactttgtggcatgtctgcattttagtcacaatgaatggtaaaatgggacctagagacacatagtcattaaaagaactaaggataaattcattctgtgggattaatgggtacagaatattactatgaacatttagaggcatatttcttagtcgtaattaagaaagtatttgtgtcatatcttaatgaaatcccactctcaagaaacatttgcatgtatttcatcacataaaaataatcttagggcactgtaaattttaaattgctccagaatatcttcaataggtatttcatactactcacagtatgaaaattcttagaccaaagaaagaaaacaacaaaacatataaagtctgctcctaactccaaagactgacaactgacaggcttgtgaaggccactggaacaattcataaagagaaatcaaagcaactgacttcagaatgatcatttaaattttcagatgctttggccaaaaatttggtatcatttatacatgatacagaatataaaaaagccattagggtagctgtagtcagaagctggagtttttccatcagcataaaaatcccacggagagtcagctcaccatgacctgtatcaattcccttgtagaggaccaagcccgagacctgatgggagaggctggcaaggaagagcaaggaagtgaatacttggttttagaaagacagaacaaaagagaacttcaagattatcaagttcaaatgattcattttacaaatgaaaaaacaactcaaggcttaatgcaggagcacataagcttctaagatcagaatccagggccattctcacaactgtgctgcctcctttgttaatgcaattttttggtgttcctaatatatcaaggttcctatacattttgctaactacattaacaccattggcttttattcactggaccgtgtactttccattcttgatagaattgcttgtacctcattttccaaaataaaaacaatgtctacgatcttaagaaaaattactcataagcttaaacatcttcagtgcacatatacactaatttgaaattagcaaagacttaatactaaagaaaataaaagttcattgtattatactttgtatggacacatgacatttattccaaaacatgataatacagcatcacacacatcagaacatcgcgatgaagaaggtaagaaattacaataacagggcaaagaaattaagacaaagagacgtcaaatatcttgctcaagagcacctagcagaatatgcaattgtacagcagccactgacatttaccaaatatttttaaagcatcagaaaaatcatgttaagaaaaactgccataagaaagctaacaaagttgtaacaagtcaaattctgccctttactctctcaccaaaatatcgtgtagtgttggcatcaagtagttggaagtttagacttctatttctcaaatccattccatttacttacatgtctttaaaaggcaaaaccctagctgtaaagcaatttattagaagaaaaaaaatgtttgtactgatggaacacaacaacaaatcaatacaaagcatttatttactttgccatcagattatctgaggatgtctggaaactgtattttcttggttctttacaagatgcaacagaaagctgcaaagcgtgctccagtaggtctgatctcgtatcacactgtgcacatatgatgtgcatcaccatctatgcaagaatatggaaacaaactataggcacagtcaaccttccacagtgtttttacaaagctcttctgttttcacctgggcttagcttctctgcagccagagctcaccatggctcttaccacggacagtcaagatacgtccaaaggaaattttccctgtaacactggaaggtaggataagcaacggtggcagagggaaaaaaacaaccaacaacaatttaccctaaacactgagttgttctagcagcaggtggacaataagcagtgtatataaaacctcaagtctggggccaggataaacggaggcatgtaaggcccaggaaggacaaacagcaggcttggataatgatatcaaaacaaccccaagaacagtggtagatgtgcacaggtgggtaacagaggcagaagaaacagaaagaagcattgagcatgagctgtgccaacaccttctgaggctatcctcaacccagttcaggaaaacatgggtgtacctgagaactcagatgcagacacctgcagatacttgccagaagaggaaagcagaaggaggtaagagtccagcagctcccaaccacaaatgtttttaaaataggatataggaatggaggaggtctgagggaggaagaaagggagagcaagagggagggaaagagggagagaagcaggcaagaatggagcccacactgtgatttaaagaggaagaaaaccaagaaccatattgggtgtacacagcagcccatcagttatgcaacatacatgtaacccaaatttcactgactgtcacttctttctaaagcatctgttaggggatttgttcctgtatgttcgttggtagttttttagggcctggcttttattgctcacttgtcattctacttacagtaaagattaataacacttcatatggtgtgtgatgaataagaaattcaactgacacggcactaggtgtaaaattatgcagtacatccatcgctttgagtgcatgagaattcgatttaacatgaagagctccctgcacagaggggagaagtaaaacttatctaagtatttgccatgcttattctacaaataggctcagaaaagtaatctgtgaaaataaaaattgtgttacccatctatattgttgaactaaaaaatgttatttcgaagttacagtaaaccccaactcatctaaaatctactagaccaaaaaagccgagattaccataattatttttggctttaattctatgtgtaaaagaggaatggaaaaatatttaagagccatgtctgccttttttgggaggggagagaaggatgaaattcatctcagtggaaaaataaatctgcatacctacacacctcccttgtggggcctggtaaaggagtgaaaagacctggagaaagtattaatgggtctctagatgagcaaaaggaggcccagaagtgggtgtgggcacaggagccagagaaagttgcagtgctctgtgtaactcagactcaacattatttttgtactctgcagtgagagacagagagaccagccatgatgagctgccagatacaagctgctgaatcctgaagaggcacttttaaaaaacatggtctaatattcgatttcaggcttttttgtttctgaacttctgaacttttgttgcccttatcttcattatcttcataaagtttacccaacatgatcttaattttaaaaaaacagaaaggcaagggaaaagggctgtgttcctgtgtgggtggagacaaagtacaacagggacagccagttcataatggcgagacagacacaaagctggaaatccagctgcctgaaacctccaccccatccccagggaccgagagggaactgtgacctcctcccatccctaatctcactgggctcccaaagaacaggttacagcatgtactacactctgagaagacaaaagcaatcgaaacgatggctacaatggtaactgttaagaccaaagcactcagctagtataagacaaaatatctataaataaaaaagacaattttgaccatatcaatcagtcacttccacctcctaaactggaataacaagttgcttttcttatccccagtcattgatatacagaagagacaagtcaattcaatggccagaaattgccaatgatgaaattattcaactattttaaaagagaatatattatcagctcttaaaattgagcacaaaaattcaaaaatgagagacagtaacatcctgaaagttatttttgttatacataagggaaatgaggaaaaataagggaatggtaacattcaaagggagaagagaaagatgaagagtaagaaggaaggaggtcaaagcatgtacagtgaagggaagaatcagatgaaaacagagatagagacttggaaacagggaaaaacaaaaactgaaagagttcatgcagccactttatagctatgtaatttttttttttttttttgagatggagtctcactctgtcacccaggctccagtgcagtggcatgatctcggctcactgcaacctccatctcccaggttcaagcaattctcctaccgcagcctcccgggtagctgggagtacaggcatgcaccatcacgcccagctaatttttgtatttttagtagagatgggtttttgccatgttggccaggctggtctcaaactcctgacctcaactgatccacccgcctcggactcccaaagtgctgggattacaggcatgagccactgtgcccggccagctatataatctttgataagtttctcagaaccttagtttcctcatctgcaaaatgggtgtgaaggaatttatctcataattttatctttttttttttttttttttttgagacagagtctcgctctgtcacccaggctggagtgcagcggcatcatctcggctcactgcaagctccgcctccgggttcacgccgttctcctgcctcagcctcccgagtagctgggactacaggcgcccgccaccacgcccggctaatttttttgtatttttagtagagatggggtttcactgtgttagccaggatggtctcgatctcctgacctcatgatccgcccacctcggcctcccaaagtgctgggattacaggctcataattttatcatttaaataatatatgcaaaagtaacacacatataaaaatgcatagccatacacagcagagtgtaaaagaaggaaagacattttaaagtataagatgatcatgaatgagacctgctactatgaacttggattgttgttcttattttctacttatttgatttgattttagattcagggtacacatgtgcaggactgttacacggatatattgcataatgctggggtttgggcttctaatgagcccatcacccataaatgatcattgtacccaaaaggtaatttttcagccctattcccctcctaatctcctgccttttggagtcccccagtgtctattgtttatgactatgtggacccactgtttagttcccacttataagaacatgcagtattttattttctgtttctgacttatttcacttaggatagtggccttcaggtttcatccatgttgctgcaaaggacaacagtttcatatttttatggctgcatagtatttcagtgtgtatacaccacattctctttatccagacaactgctgacagacatttaggttgaatccatgactttgctattgtgaatagtgctgcgataaacacacaagagcaagcattttcatagaatgatttatcttcctttgggtagacacccagcagtgggattgctgggttgaatggcaattctatttttagtttcttgagaaatctccaaactgctttccacaggggttgaactagttgttcccacgagcagtatacatgcattctcttttttctgcatccacaccaacaactgttgtttcttgactttttaataattgctattctgacaattattatcatgtgtaagatgatatctcattgtggttttgatttgcatttctctgattaatgatgttgagcatttcttcatgtttgttggccacttacatgtcttcttttcagaagtgtctgttcatgaccttggtccactttttaatggagttttttttcttgttgaattctgtgtggattccggatattattagtcctttattatcagaggcataatttgcaaatgttttctcccattctgtagattgcctgtttattttgttgattatttcttttgctgtgcagaggctttttaacttaagttccatttgtctatttttgatttagttgcatttgcttttggggaattagccataaactctttgtctaggccaatatccaaaagagttttaccttccagggcttttatagtttcaggtcttatatttaagtctttaatccatcttaatttttgtatatggtgagagacaggggtccagtgtcattcttctgcacaaagccagccattttcctagcaccatttgttgaatagagtgccacttccccattgtttatttttgtccactttgtcaaagatcagttggttgcagtatgtggcttgatttctgggttctctatttttctctattgatctatgcatctatttttgtaccagtaccatgatgttttagttactatagctttgtagtataatttgaattcaagtaacatgatgcctctagctttgctctttttggttaggattgttttggttgctcgtggtcttttttgttttcatataaacttaaggatttttttttaattctgtgaagaataactttggtattttcatagaaattgtgtcgaatctgtagattactttggacagtttggtcatactaacaatattgatgcttccaatccatttgtttgtatcaattaaaatttctttcattagtgttttgtagaacttcttcttaagaagacatctttcgcctccgtggttaaatgtatacctaggttttgtgtgtgtgtgtgtgtgtgtgtgtgtgtgtgtgtgtgtgtgtgtgttgtaaatggggttgagttcctgatttggttctcagcttgaacattactggtgtacagaaatgcaactgaattttgtacactggttttgtatcctacaactttactgaagttgtttatcaagtctaggagcctttccaaaaagtcttttgggttttctaggtataagatcatgccatcagtgaacagagataattttacttcctcttttccaatttggatgtcttttatttctctcttacctgattgctctggctaggccttccagtactctgttgaataggagtggtcgttttctattttctaaaatgttcactgatctctattcacaggttttaacttcttgaactttactcctgaaaaagcacttcactattgatagagcacttatttcctaccagaagagaaattattttctagtagacaagggtgaggggaatagtaccatctcatgggctaagtctagaccttggtccctgggttaccatgtgtggtccaatactttcaacacaaacaaaaatgcagctatcgaatcaaggccttgaggcattgtacaataaagtaacattcatcatagcaagagttcacattaactttggtctttttatgtaggaggtaccaaatgaggcatttcagatatattctctcaaaacatcacaacaatcctttaaggttaagttctatcaataaggtcatcttataaatgaggaaactgaggccctgatatgttaggtaacttagcctaggtcatgtaacactgagggaggaactaggtttcaaacacagataggtgggttctggagcctagcttttaatcactaagacaaatttcatgatccttaagaaacttctaagttccaaagacagatgaaatcaaggtccagaaaaatttaatataagcatactacagtttttcctaattgccctctaaagtggcacgccagttattgcacacagtgactttcaattagactcatccatctaatttccatgatacttcctagactgtgagaccacagataaaaaaaacactctggggtctcagtttcttcacctgtgattaaaaacaatcccaatgatgtcccaagttctagcaaataatgaaaaattactctgcaacctctgccataacttccaagtatcccgaggctaatctgatccttttcccactgaaacatggtggcactctctgagcaaaagtctttaatttgaaggaagcatcctcctaaataaaggttcaactactttgaatacgtaaagtattgtagaaatcaaggtcacacatgatttttataccttgacgttatatgatagctttctgaaacttttaactggaaaaaatataaaagttgtgcctttctaaccataaattttaagaagtaaacaaaagaatatatgaatacataagccttagtcacatataaacacctatactacatactttggtggggtttttttgcactagtgcttgctttcagaagaaaagtgccagcagagtcttcctcagttgtcttgagactgtggttaccctatttctaataaacaaggcagcttcctgtctctggcttctcattgctaaatcagggttgaattctggcagctttcatagccctgacccctgagtgcacccatgttaaagagtgtctgctttgcttcattccttattgtaaaaaacgactcatcatggagcacctcttgttttaaaatcttgcttttcatcagtgaagctcaaaatgagttaatttcttacactcaaaacttagtctctcattttctctatatttgtctctatttggttgatgtatctggactttttctaagtctctaaagggatgaagctgtgtacacttttagatcgtttcggaagtggttaaaacagcatcctgtagatgattttatgatcaatcaagtattcatttatgcttttctcttaagcatctttagtgactgagcccataaggcaagagttcatagtcagacaattaaaatgcacttcatgttacaaaacaatttttttaaacaagtgatagaacttgttcttaagggcttaaaaatgcaatttacaagtattttcttccactttggggttgttctgaagtaatttactgtgcagcatgatattcaatttgtcttcaatatgctgataaattatctataaatctgtctttgttttgcttgtaatctcttacagagctgtgtcagcaaagggcatcctttgcatttctgacccttttgtgttaaaaaagaaaaacgaaaaaatccatctagctctagaaacaaaagatttcatctccagcttttcaccatcaccattttcctaacccacaggaacctattttgttggatggttggtcccttgacaatgagaccccacttgaaataacctgaaaaggctagagatcctcttcacccactttctgtgtgggccattacacaagccctcatgcttcccagagatgtcagagccccagccggtgtgaaatggtgatgctgtcagtcagcaggaaaattttttgcttcggaaaaacctctctctccgagcttcctctgtgccgcacctccagctgcctcggtgcaccatgtcagggtgctaaaatagctcaggcttgatgacttcactagttctcacaaacaggccagttggcagaactctaatgcagtctgctcctgagtggaagacatttttttttctccccaccatcctctaatatgaatacttagtttcattttgactctggaagaagtctcctttctgggagtcaattcagcacaaacttaatgcaaacgtttcaaaatgctttaaggaggcttgaactaaagagctaccctaaagccaataccatgcattcagactgcactattatttcctatgctaaccttcaaggacatcaaaactgctaggtaaattaaccttatttaacaaccttcatatttcatttatcttagggccaaatatcttcctcaagaatagtattaataactgataatcagccaagattttaatgtcttatttctcaggtttactcctttcccacaagtaaggaggtcaacagaaaatatcaaagtaaaaattaactaccactacatgtactcagcataaaatgacagggggcctttaaaggcaatgtcctgtaatcacagcaaactttagtgattaatactcaaatagatttgaaattttttttacagtataaggtactcatgcactaaaaaaggtgttctgtattagactaccaaattttattttagtatttataattttcccttatagtttttcacttccttttgtaattaccacatactagcaaaaaaatactgcaagaaaactagaactttctgatgttccagtttcctaattcagtgctgtgcccaagctgccctttgattccaaaagacagcatttagattaactgcttcagtgccctgtggacacaaaatttatgcccaaagaagaagcttccatatgattctatagacatgagctaataaaataatttggttcactggtttaagatggttcctctaaaaggggtgcaatatccctgtccccaaaagaggaaaaaaatcacaaacattctattcccagcacccctcagttcctctcactatctgtccattacaaacagcatctaaataccactgccatcttgcaatggtgatgatggaaaaccacccctctccatcaccaagaaaaacatcacagggattctcagagaacacataggctcatatataactgtatatttttaaaatgcattttaccatacaatgatttgttcattccataaacatttgcctagtaccttgcatgtagcaggtattacatatgattttctacaggcatgaacagtgtcttcgtggatttcactcactcaatattaagtattataaagtcacataactttagcaaaatgagacatgggtggctgcaatcgttttgtttatgttaatccagtgacttacaaaatttggtgttgatgatacatccaaagaagcattggagtccagaattataataaccagggacattttggacatagtccagagacatgaccctgaaattaagagttatcatgtctctctgctgtagaggctaataaacaaagacacaatggagattctgaatgctgaaaggtcaattataaatgtcattacagacacaataattcacagaggaatgaaataggctgagtagtttgtgatgctgactgtactaaccatcaaattttagaccataaaggaccttagatctaaaaatctcacactgtactaatgatgtctagaaagtctgtgtgatttgtacaaagtcacaaagtcacacaggtactaagttatctcagaatcaatgttagttttattcatcctgcattcttcccatcatactactctaagtctgattcacacacactcatgtatacgttattctactgtttttgactcatacacaaatatacatgtacacacatacacatacttgtctgcccaattcaaacaaaaacacacacttcagtactctgcttctgattcatatatacatagacacaaacattatactcccatatcctgattcatatacacatacattccactatcctccatctgcttcatacacacattttactgattcatacatacaatctgcatatatgtatattactctgtatctgattcttacacacacacacacacacacacatgtatatatatatatacacactgtatactactctgtatctaattcatatgcacatacatattggcatgtatatacacactgaaatttaaaacagcaaatcatggtcatattcaaaacacatatattttaaagtgagaaattcaggtgtgagccagacacttgtgtaactatgtcaaagttactataacttatacaatgaagtaatttatctggatcttcatttacctctataagagtcccccaaagaattgaaagaaataagacctatcatgatgcagaaattcagtgaacccataggcatccatctacatgaaaatttttgtcaggtcaaggatgagaatatgagtgtttgtgtgttgtactgttttctgtaatatgggatagagaagtggatatacacagaatccagggacagaggatcatattctgtgtccttgttccaggataaattcccagtttctgagcccatgaagcagtgtaggagtgacgtgagggaagtgcatgagcaacgtggcttgggaccgcaactacaaagtgtgacctgaggaacatcctcccctctcctcaagggctggcaacgtagagggctctgaacgatctctctagacatgtgacatgaggattctaactggagttagaatctcaatcatgagcccctcacagaggttttatgaagaaggggagcaagcagtagacagagatggagaagactcttcagggtaactagctgatacagtaattcacatgtacatagaagacattcctggggacgcggacataaaaagattagggagactttatggaggctagaggtcctgcaggagcagggaggtgcataaacagaaaatgtggattgttgtggattatatgctccatccacatccacaggtcagtaaggcccgtggacctgcaggcaacactgagaagacaagactatgaagaggaaatatggaacccaacatctgtgggtttcagactgtacgatgttattctcaaaaagtcgactgaagcagatggtgaatattatgaacacttgttttcttaagctacttgctctaaaagtccagcacacttttctttatccatagtttttcttcattattaaatatatccattaccaactcgtaaatacattatattgaaagagcctctgtaggctgggcctggtgactcaggcctataatcccaacactttgggaggctgaggtgggaggatcgcttgagctcaggagttcaagactagcctgggcaacatagcgagaccttgtttctaccagaaatcaaaaaaattagccaacacgcacctgtagtcccagttactcaggaggctaaggtgggagaacgacttgggcctgcctagaaggttgatgctgcagcaagccatgatccaaacaatgaggaactgcttttatgagccctttagataaattatagttttaattaaaatataaaaataaaacaccaagaataatcatggtgatgttatatgtgaatatatatctcttcctggattttgcttaacatttaaatatcaaagatagctgtctttgatagtcctcccaaactgggcagcaccatcactctggccttcgaagggagctataaagctcactagtagtcaactcttaaaaatggggcattattcctaaaaaggaaatatacagctttaagcaaataaacaataggtactttgaagaccattttaaagaacttacccatagcccaagataaacatctgctaaggatcaaaaagatcaggccctgggcaggggcttggggacagtgtggacagggacacacatagctaactgcttttcaaaaattggaaaattaaagccctcctaccaaggattacaagaaaaccctcaaagtttagcaggtcaagtacaaactaataatcaggcctgccaagaaagaatttgaacaaccttgcaaagtattccaaagaaaataaaaaatgttgcttaacaagatacaacccttgaaaatgaagtgagattttctgcaaagcatgtacatcagatgaaaaagagtctgtatatgaaattgaatacctttgtccttggtctctatgaagtattaaaaatattgtaaatactaagttatctttggaaacagattgcaggaactaaatcaaacaattaccaacttaaggaagagtctaaacctaattattacattagatataacaaaagcaaagacctgtttggcattatcacagtgttaaaaactcaagaggaaatgtgtaaattgttggcacagatgtaaaacctgaattacaactaatcactatatagaaggatgcagttgctaatcaggtacctatccacaaaatgttcaaaataaaggcctttcaagtattgaagaaactacatattgaagaaaaaaaccacaggaattaatgatgtgatatgattgagcactcactctacttggtagcaatcaacagacagtaaccaaccaaagaatagttttagttttaaaaattacattttgccatggtgaaagcagtggataaatgacagagaaacagatatataagcatgcacacttccaggagacaggtgctcaaaatggtcttatttaacatttttataaatgatgtcagggaaggggtatacaggaaagtaggcaagtttgtattaagctcttctagttaccaaaatgccatgtaacagagataaaacatccttttagcagcaatctgataaatatggtagaatccttttaaccaacttccgcttaaccaactgtccagattaaccaatgagctccattccccttgtaaatcatactgactgatgcacctggaatgtgaccagacagctggctcctctctgagcagaccgagtacctcagctcccatcagccaaggcacatttttaataagaggtttttatcctaaacttgtttatgcagtaatgccttatttttaaaatgtgatttaattaaatgatacattacttaaggaagtgaaataagaggatgaaatgcagcacagtgtctatttctacgaaaaataagttgtatgttttgaaaaattttaaagattcagctactataacaattttttaaaacaatttttaatactgaataaggaagctatcctaattgtactacaatggaaaaaataagaaatatcttcaaaagtgtttacttctctttaaagaaatatcagaaataatggacaatccatcatggctgtaatcctggtaagaagcattaacactaaactccatctagggattcatgctggaagaaagtgtggatcctacatccaaagattgatagaagatgtattttttacgtgttatgttcaaataaaatttttttcttttttttttttttttgagactgagctctgctctcttgcccaggctggggtgcagtggtgcaatctcagcacactgcagcctacacctcccaggttcaaacgattctcctgcttcagccacgtcagtagctgggaccacaggcatgcgtcataacactcagctaattttcgtatttttagtagagactgggtttcaccatgttggctagactggtctcgaactcctggcctcaagtgatctgcccactttgacctcccaaagtgctgggattacaggcatgagccactgcacccggcctatttgaataaaataatgaaggtatgtatacatcatctttatactcctctatcttttaactaactttttgacaaactgaccaactattgattcttacttctgtcaaggctcctgtgtatttattgtcatgtcttctatgtgccagggactgtgacagctgctgtgaatacaaaagagactaaggttttagccctccaagtggtcaaatgtaatgggatagacagacatgctaacaaacagtagctattcatcatactaagcattgtaagcaaaggtgacccctgaattacacaggtttgaactgcctgagtcaacttacatgtggctctttttccccaaccaaacacaaatgaaaaatatagtactagagggaagtgaagctctatatatggagggctgacttttcctataggtggttccacagggcaggacttgactatgcaccgatcctggaacaaatcccccgcgaatatgaatggacactggaaaagattctgttaagcatggaaaagaaaataagtctggagagagtagagttgatggtggtgaggcctgcagagtgagttatggtgacacagatgaggtacgaaggcacattctgacagatcatacgtgcaaaagcatggagcaacaccacaggtccaggtactaaacatcccaaatagtggagaggttggaaaggctgggtagaaacaagaccaggaggacaatgttatttgagttttagaccataaattatggggaatcatatattttaaacaaaagagtgacacaatcagacatattttagcatagtatcttttccaacagtttagaaaatgaacacaggtaacagaggcagaaaataggagattacaaaaatagtccaataaaaaaatagaagaagaatattaagaaaggtatatcagcatgacttggtgactcatgagacgtgaaaagagtgaaggataatactgacttaaaaatggttcctaggtttaggaatgtcgcatctggtggtcaaagattcattaataaaaataggaaatgaaggcattttaaagcaacagataaagaacaaagttgtgaacatgatgagtttgaaatgctatatatccaagaaagagatgacaaatatgaagctggccctcaccagctagtgctcaagagaggtgaagagatctatttaaggactcattactctatgggtagaatttgaagccgcagaaataaatgggcacatgatgtaagggcaaatagagaaacgaggaagacagatgaaactctttcaaatgccaaatttagagacaagaaggagaggagacccatccacaagactacaaagtgacaggaagcagcagcagcataggaatgacatgagagccaagagaagaaaattaaagcaggaagtaatcaaccacatcaaatgcaaaagcgaagtcaaagaagataactcatgaaaccactgtgcttagcaggtaaacgaccactagccaagacagagcttcgcagcaggtgtgtacactcaggcaccttgagttggagatagaatggactatgaagtggggacaagctcttaagaagctctccttcagccaagggccaaagagggcaagagtcttttctagaggatgaaaacagaggaatatggggttttgtttgtttgtttgttttttcaagatacaactttagagactggaccctgccagcaacagccaccatccaaaacaactcaccttccgcagagtgaggggaaggatggaagaggactaggcagggataggcccactaattggtcatgaagaagctgataagagttcttgacttacagagatctactgtcttggtgaagcagatactaatctatgagagtgagaatggcattgttaaggcagcaggaatgagaagggcaatgaagttttaaagctccctgggtgggcaatgcagcagaccttctgagactctggggttgggtctgtaacatttcccttatagataagtaaaagatatttcatgaggaaaaaaaaataattgattgaagtttgtgggaacatggatggcagttgtgaataaacaggaagtgggtccaacagtcactatgaacaacttatagaagacagctctctaatactgttaacacaacacaaatatcaacaaaatataagcattaccaaatagaactcaaaacaaaaattacctttacagaactgtgatgctcttcataatgttaaccaccacaccctaataagtaatgcatgttaaagatgacaactacttacactttattcatcatgagaatggagagtactatataaaaataatatggagtttcagtctagaaacataaactaaataatctatggaatcctagttgccaagaattttataacaccatttgtccatctcatcctggcaacagtacacacaggagtattttattaaaacctgagacaaatacaaataatataaagaaaatgaatcaattgctatttcatatggcaggtgttaaacctataatccgcaagactaaaattttttaaaacttcatcaagttttaagaaatgactggggccgggcgcagtggcttccacctgtcatcccagcactttgggagggtgaggtgggcggatcacaaggtcaggagatcgagaccatcctggctaacacagtgaaaccccgtctctactaaaaaaaaaaatacaaaaaaattagccgggcgtggtggcaggcgcctgtagtcccagctactcgggaggctgaggcaggagaatggcgtgaactcgggaggcggagcttgcagtgagccaagatcgcaccactgcactccagcctgggcgacagagcgagactccgtctcaaaaaagaaaaaaaagaaatgactgaatggcaaaccgaaatggattcaaagaaacaagtagtagcttaaagaaattaagatacgagtgaactacgttaaagaggcaaccccatcatgaagctacaggggagaaaactgattggtcatgggtctgactgtgtatggtgatttcttattttaaatcaataccaatgggaaagaatgaacaattctccacatattaacagaagagtgttagtgtaatgtaatgaatagcatcttctaaattttcctccccaacccccccacctgaacaactggacaatctaccgcagaaacttacatcatactatatagaatactggggtagtatccaaacctccttatgaacctccaagttctctctacaaaagaaattttaactagaaatgcaaatttacctggaaatagatgaaggcagatcaatgccatttggcttcacttcaaattatattctacctttattacaactcaagtgattatatattatcatacatttcttttgtacctattagcacttaatggagtgtctggaatatggtacatgctcattaaaaagaaatatgaaaatatgataatgaaaaatgcatgaattcttatcaactcctaaatgtctactatttccaagatctttttaagaattaagaaatacaaatatatatatatatatatatatatatatatatatatatatataaaagattatctacaagaaactaaacaacgttaaaaatagcatacaatctgccaggtacagtggctcacgcctataatcccagtactttgggagaccaaggcaggaggattgcttgaggccaggagttcaagaccagccaaagcaacatagcaaggtcctctacaaaagatttaaaaagttagccaggtgtggtggcacatgcctatggtcccagctacctgggaggctgaggcagaaggatcctgagctgcaagctgtgatggctccactgcacgccacccgggtgacagagcaagaccccatttctgtgtgtataaatacatacatacatacaaaaaatagcacacaatgactacaatgtaagctacaatttttgaaactctcctttcttaaataacccagcatctgtgttgtcacactcctcagacactgctgaaggttgtcaagaagtagctaatatgaccattgatatggttttgctgtgtccccacccaaatctcatcttgcactatagttcccatgatccccacatgtcatgggagggacccggtgggatgtaattgaatcatggcggtgggttcttcccacgctgttctcatgattgtgagtgtctcatgagatttaatggttttataagggcagttcccctgcagatgctctcctgcctgctgccacgttaagacgtgtctttgctcctcctttgccttctgccatgatcgtgaggccgcccgagccatgtagaactgtgagtccactaaacctctttttctttacagattaccaagtcttgggtacttcttcatagcagtattaaaatggactaatacagccatctatttgactgatttttttttcttttttgctcaggaattctgatcacatgattttaaaatacaagattttttaaaaaatcagttatttgccatagattgagggtaggacagtggaatcacatgcagtaatgttgacctttgtacttccgtaaatctctctaagacttttttgaggcataggaagttctaaatcctgctcaatgctgcttaaggaaatgctttgttcaggctgtttttagagaaaacagtcaataactatgcttgtttctttgagttcagctgcaccagctgctgacttaatgacactgaaattaggaagttttgttctagtggtggccacacagaagctccattggtatacccaaagggttaccaaacaaaatattttttaaacaggcacacaccaacacacatgtccacaaaatacactatttgcaaaatggaataaggagtcaaatggcccaaatacaaagtataaggattgaggggggaatgcagtgtgagggaagaaccccaaagactaaactccaatcacttcatttacaaaacaaaagctgaatttacttttgaaaatattttcctaagagcacggggcatgctatgtctctagttatcattatgcatggtcgcatacataaatttaataatgccaatagtaacagcaaagactcaaacagaaggaatgccttgttaataagctttgcaatctttcttgccccattttatattttcaatagaagcactgcagaaatatacataacccagcaatctatacctgtttactcttatttagaagacattttctataggctgagaggctggaaagctagaaataaccaagtaaaagaatcactgattaaaaagcaatgtaaaacactgtcccttctgctactgttttctcattcgagagagagagagagtgtgtgtgtgtgtacgcatgcacagatgcatgtgcacattttgctactctgaagcactctttttcggtatgtcaagtcaactctaaaacatccaagcaactctagggaagtacaggagggatgaacaaacccagtgagctctgataaactggtacaggaagacagcatgtgtcctcttgctcccagagaaggaaatctgccaagaggccaaacagggttctaaaacctgcagaaggtctcctgggacagccttctctaacttaaaacccaccaaaatatccactttccctatcatctaactggactctgatcttacccaaaactccataattcagtggatcccaggtaccaggtaccattccaatgcttggaatgttcctggatatcaatgattaggcccttatggcctaatcacctcttaaaggccccacctcttaataccatcacattggccatgaatttcctttttattttttaacttttatcttaggtttgggggtacatgtgaaagtttgttatataggtaaactcatgtcatgggggtttgttgtacagattatgtacagattatggaggattcatggagaagggataccaaagttacctgtcttaaccaactacatcctgatggcttaagcctggctaaagctggcatgttcctgactagaaaggggaaaaagacagacaaatgaggaagtgacagataatgcttggactgttcctggatatcaaaaaggcataatttctacaaaggaactgaagcacacagcacagcagtatgccaagagggctcagctgtgattctattcaattcaacaaatatttattaggcatcttctgccaactcaaatgtaagaaggattccaaattgtatttatatcctcaggatataaaacagtgctggaacagacagtaggcacttaataagtgttgaaggaaggaataaaaggaaaggaagaaagggacaagaaggaagggaaggaaggaacgtctacagagcaggaatttactaagcactgaggatgtgaagataaaaaatatggcaaattagcttcaaaggttctggccagtgatttagtcagggtccttttctccattttctaatctagctttggtttaatcagtccttcttgaaggatcagacagataaaaggtaagctaggttaaaaaaataataataagctgcaggtttctgttactaaaatctgatagcaagaatgtaaagcaatggctctcaatcctgccacacatcagaatcatacaggaaacttaaattggctaactattgacatgtaggtcccatgccagattaaattacccattaaattacaatctctggggagtaggtaaaggtactggtatttttaaatactcatgtgattctaatctgcatcaaacattgagaaccactgatcattaaacaatgctatgtaaagttttctgcctatattccactgtgaacttaataagcaaaaacataaatctacatttaataaccacatgtatgtttatagctcctcccacaatataggaaactcatacctttaaacaaacatcaatgtactttgtttctctgactacacacaaaaaagtggaaaaacagtaagacactgatataacaacaacaaaaagccatacacacaagacaggcattttaaacatctagtaaaattttcccagcccagcacaccagcagaaagtgtctctaaatggctgagaaataattacagtgtaattaaaggttttcaaacacaattctgacattaacttgaagattaattattttgttataattacctatactttcttaaaagcagctctgctctttacagccaaaaactgaaaacaagccggatatccctgaataccactactttaaaagtaggttttcttatgttctaaaattaattgtggtgatggttgcacaactctgaatatattaagaactaaagaactgtacattttaaataggggaattgtatggtacataaattataccttgataaagctattatattttttaaaagaaaattttaaaaggtagatttactttcttcactatatttaaaatacgactgttttcataattgcacatcttagtgcatttgtgctgctatgataaaataacctagattataaaaacaaaataacctaggtaatttataaagtagagaaatttttttcctcacaattctggaggctggaaagtccaagatcaaggggctggaaggtttgtcagacaggtgaggggtgttctctgcttccaagacggtgccttgaccctgcattctttggaggaaaggaacactgtggtgttccccacacagtggaaggtggaagggcaaaggagctgaaggctatgtgaagcctcttttataagggccttaatcccattcatgagaggagaagccctcatggcctaattacctcttagagatcccacctcttaataccatcacattggccatgaatttcctttttattttttaacttttatcttaggtttgagggtacatgtgaaagtttgttatatacgtaaactcatgtcacgggggtttgttgtacagattatttcatcacccaggtattaagcccagcacccaatagttactctttctgctcctctccctcctcccaccctccaccctcaagtcgaccccagtgtctgttgttcccttctttgtgttcatgtgttttcatcatttagctcccacttgtaattgagaacctgtggtatttggttttctgttcctgtgttagtttgctgaggatcacagcctccagcttcatccatgttcccacaaaagacatgatctcattctttattatggctgcatggtattctgtggtgtatatgtaccacattttccttatccagtctgtcactgatggacatttaggttgattccatgtctttgctattgtgaacagtgctgcaatgaacctaagtatgcatgtgtctttatggcagaataatttgtattcctctgggtatatataaccagtaatcagattgctggatcgaatggtagttctgctttagctctctgaaaaattgccacactgctttccccaatggttgaactaatttacactcccaccaacaaggggacacattcaaactacagcactgtatttggactatgagtactccacaaaatattaaatcatgttttaatatcaaatctcacttctttttcatgttcttctatactcaagggtatattctatactaaaagaattatggcttcaacctgtagcaaaattttgaaactataaaagttaacattaaaaacttataattaacagtataataattagggggcaggggatgaaatgtgattaagttagtgaatcactcagagtgatgcaccgaaaatgaagcaggcctaagagcaagaagtcccaaatcctagttctgacccccatcatttgtgagatgagtaaccttggacaattgactcaaaatggtgataaaaactgtaaatcacaaattcattctgagaataaactgaagcagtgtttaagaaatcatttgaaaattgtttggtggctttaaaaagtgttgaaattattttggctttgttgcaaaaagagaaagaacaagttctcggacatggttactttgtccaggaatctcccaaatttagttctctgcccaattttccttgtagcatcagttaaactgccttaatttttcttgtctatgtattttctcatctataagagggagatgtgtttgtcttttaagaagttattaaacttctaaattaagtcctccgcttcactctggagaataaatgcagctgatgtaacaaactggtggcctggcttctttcatctgccttttagaccaaggaagatacagtgtgtttttgtaatattgcagcgactccatgtgaagtttgtttgtttgtttagtggctttctgacaagagtcccagccagccaaactgaaggaaagcagttactgaggggcatgggagttctggaacctacaagagcagatttacacagtggatcttaatcaggaggagtgcgcatttacagtcaaggagaaaagccaaaattccatgcatagaagtataactttttacaattagtctcctctttcataaattgtcacagtgaagctctgcaaattacttgatcccatttcaaaaaattgtacttttctccaaagcacataactgttaccccaaaagacaaaaaccatattactaaaaatgttttcatctagaaacagaagacacgtgcttgtggaaatgtttcaccaacctttttcaagcattagttaaaactgttacaaggcataattataaatggccatacatttaacactgttacttaattaaatatttgactgttttgtaaggattacttgttatattaaatttcaaatttccataattgtgtgatgatatagaaatatatgtatacacccacatttgtgtgagctgctcaactgtaattaatgatgcacttttattctctattattgtgtggaaaacattctgacacaaaataaatgaagcataatcattcagagtaatgattcaaatgtactgattaatgataccaaataacttctctgttcctgagttaaattaaaacatttatagcctgggaattataggggtatccctaaatgagtgttttgtagacaatcattttccctcacaggaaccacctacccccgtcactggaaatgagttcctagagattgtaaaatgtaccgtattattttaagtgcaaataagagacaaaaactctatccattaaactattagacaatgccaaatcgccttcagagacgtttaaaagcaggtcaggagagagtgggagagaatatgcctgcatcccagacttgatatacggtattctcttcccacagtaggcactcagtaaatgtctatcaaagagacatttttcaaatgttgcacaaggtattttcaaacttctttaaaatttgaaataagccagtcaccagaagaaatcacttatatgaggtacctaaagcagtcaaattcgtagagacacaaaatagaacgggtaccaggggctgaggggaatgagaagttactgtccaatgggtaaagagattccattttgcaagatgaaaaaagttctggacatgtatggtgctgatggttgcaaaacaatgtgaatatacttgatgctagtgaattgtacgctggaaaatggttgtgctggtaaatttatgttacgcatattttatgacaattaaaaataacaaaaagatttccataggaaaagaacagtatgtaagatggactcgcaaaactataaaactctcgatctggaaaggacctaaattcaacccaacttaacaagataacttgataaggtaactttccattgaaaactacttttgcagaaatactgagtcctttttcaatggactggtgagaaacttgcagtttccaaacaaaaagtcttgctgagatagcgcttcacacaactagcttaccatcagaatcaccatgggcttttaaaagacttccagacaactcacacctattaggatggctactatcaaaagaaagaaataagtgttagcaagaaagtgaaaaatcgaaactcttgtgtactgttggtaggattataaaatggtacaactgctaagaaaaacagtatggcggttcctcaaaaagttaaaaacagaattaccatatgatccaacaattccacttctggatatatatctgaaaggattaaaagcagggtcccttgctacccacattcacatcagcattattcccattagccaagaggtggaagcaaacccaaaagtccatcaaaagatgaatggatacacaaaatgtggtagacacatactatgtactattattcagccttataaaggaagaaaattgtcacatgctacaacatggaggaaccttgaagacattatgctaagtgaaataagccactcacaaaaagtcaaatactgactgattccacttaaagttccaagccaggtgtggtggctcatgccttatcccaattctttgagaggccaaggctggaggatcacttgggcctaggagttcaagaccagcctgggcaacatagtgggactccatttctacaaaaaaaagttgttttttttttaagttagctggacatggtggtgcacacctgtagctacagctacaatggaggctgaggtgggaggatctcttgagcctgaaagttcgaggctgcagtgagctgtgatcacaccaccacactcaagtctgggtgacaaagtgagttctggatgcctattgcacaacactgtgaatatataatacttaacacaatttaactgtacgtttaaaaatggttaagatggtccaaaagaaaaaaaaaagcaacgtatatgttagataagtaaataaaagatttcctgcctcccatcccaagcctactggcttagaatttccagagattagggtaaaataactggtatttctaaaaagcttcccaggaaatggctccacaatcaacagagatctatcaattccattagtttccaacttgtaagtaactaaaacacaatggcagccatgtttaacatttcattttgtgtttaagactgtttataggtacacataaagtatttctataagcaatggaaattgatcagtttgacaacatcactaaaaaaggtagggtgtggattttaatactggtactgatgaggaaagagacaaaggaagccctttaagtctctctctctacaacatgccatcttcctatcactgaactgataacagtgggaggagccctagtccactgacagcagctctacctgcatcatgcctgtggtttacacagagccccaagtcttcctccattgggtgtgcaaacattcagaaagcctctggtacgaaatgaccaaccagtaccaaccctggtccagagagttctagaaaactagtcaaccaattaaacagcagtgtagtaaaagaggcaaataaaataggtctcataatctagccctgccacataactgccaggtgatcttaagcaagatactgactttgattacattacagaaaaataacagggatggtactcgcagatttgtcatgaaacttccactgagataatacacatgtaaaacatttagcacaataaatggtgtaaaataggtattcagtaatcaaaagatgacattttcactgctgatgcttctttcatctcgtcttttataaaaattaccttaagtactatagatttcaggactaatcattccctaaatatgtactgatttttgtttctactcctaatttacctcaaggaccatgcttaatagtattacatttttttctatgtcctttgaagctcatcacatggtactaagcaatcagtagacatgttatttatcaacttaaccattcactcaacagacaatggatctgccatgagcaacgcatcatcctaggcactagaatacactgatccctacccctgagtttatgatccatgctcaataaaatctattctgttttattgaattatttattgcaacagcagaaacacatatatatctttgcatacaggcatggaacgcctccttccatagatttacaataacctattctcctatattactcgtgccagagaatgtcagaaaataagtcaccttatttaattattaaaactatcaatttcaactacgtagacaactatagtgtctcatgttccagccccctcaaacaatgggttggtctaaaaatgaaaaatgtctgtacatgcccattagcttgtaaaagagccaatgtaaaaccaaagaattgttacctaattaaaagtaatttgctgcaaaattattgattcaagaacaaaagaaattcacataaagaaaaatattttcggccaggcaagctggctcacacctgtaatcccagcactttgggaggctgaggcaggaggactgctcgagcccaggaattcaagacaaaactgggcaacatagcaagaccctgtctcttaaaaaaaaaaaaaaacaaagttagccaggtgtggtggtgcgtacctgtaatcccagctacttgggaggctgaggcaagaggatcacctgaccccaggagttccaactgccatccagccttcacaatttctctccaatccacacatatccttttcacatgtaaaatttctcccagttaggaaaaaatataagtgagctaaaaaacatagcttgagctttcatagctactccactatactatactacttatactataggtagctaagagattatgtgatattaaactaaagattctatcaatagtctatcaattttctccattcatttagcaccacacttggttctccccaacccttttttttccaacccctctgacaccctcacctccactattccccagattttacactgtgtgctgacttaaacatctgctctgctaagaaagaccaaatacaagttgtttttagtgaagatgaacatgtacatatttttgtataagatgagtatctagtttgctatttctggcaaaagggcagggaacatccaaggttgtcagtataacttttatctcttgtgatttaactggacctttagcaagcacagaatataacttcaaaagaaagaaaggattttttccatgattaaacaaacaaagccagggagcattttcccggggcagggaaggggaggcacactgacagaccttccggcaagagttaggttagttaaaaattctgagggaggaaaagaagaaaatacaagaattactgttgctacattaagcaaagcaaaacaagtacaggcaaaataaagaaaaatgtttcaacaaaggtgacaatatgaaatttaaaaataaggaagagtgacttgacaaagtttaccttgggttatctgacaacattgaaatgggttggacaaagtacacagtgagctcaaacatcctggctttaaaagcgtggggcccacagtcaggcatcatctctagatcatccattattatctgtcttataaggagtaatggtaatttagacaaatccaatccaatttattccatcaaagatgtattgaggccgggcgcagtggctcacgcctgcaatcccaacactttaggacaccaaggcaggcggatcacttgagcccagagaccagactgggtaacatggcaaaacactgtgtctaaaaagtgcagaaaaattagcccaggtatggtgacgcgtgcctgtagtccccgctactcaacaggctgaggtgggaggatcacctgagccccagaagtcaaggctgcactgaaccgtgattgtgccattgcactccagcctgggcgataggagacacacacacacacacacacacacacacacacacacacacacacacaaacatttaatacattctcatgtacaaaaactctaagtactctaggagagatacataaatccaagtctaagatgtgtttaagtaactcataccacagctaattttcaaaagtttgtccagttaatattgaattgagaatttggctcaacaatatgagcttgacatgttttatagctcaaacataattgagtaatggcaatttcataggttcaacggtttgtataatactgatattaaaaggtaatgaagtaactgtgaaatagaagtctaggcaaaaagtctcttagggtacagaaattaaaatgcaaaataaaaagtaattcattttgtctttggaaagcaggttggcttcttggagcaggtggcatatgaactaggcagaagtttttgagatttggaattattagaagagagaatacagtgagatagggaatggcagatggggatttcagactggaaaagcaagatttcttatagcatagaatcataaagtgtaacagaataatttaaataataaaatcatctattttaatgttaccgaacaagtacgtgaggttcactattaaaaataatttagaccaaattcacttggagacttggatattacgtctcataaccgaatgaacagggtgatgtaacaaatataaaggttttctgatcaatgataaaagaaaaattaaataagagaattgaatcaaccattccctatgaaagggctaccaactttctccatttcagaaaagtgtcaacataaaacactaaaagctcctcactctattacaaatgcagcagaatcccacagatcatcctattctgttccgtgatggtcaacagacttccccttgaccattgttctcatggttgtctctgccccaaacaccagggtttttataaagtccccattagattttaaaggtcaagttcttcctaccactctgcttacagatcactagaagtcaccacgaaacatttaccatgatagcggcaaattttaataatcactagaatgtattgagtagtttgtgggaacactggcttctgcatgattttgaggatggtaatgaagtctaatctactgctccattacacatattattcttagccacaataacagtgttccgtttgagctttagggctgtatttaaatagatggtttaggaaacaataaagcctaaaagaatactgtaggtgtattccaaatttagtgtgagtaggaaacatcaggggaattttatctactccatcaaacaataaaacactctgagccagcaacacaaaggagccaaaaaaaaaagggatgggaacattttttccgcttatttgaaagccagtgtgctaataaaaatatccattaaaaagcatatcaagtcttttcattatagtttgcaggaggttttgttggtttttttaaaagagaaatgctatatattatgctagttatattacataaacagtagagcttattaataccctacaggtctatatcatgatccattaaacaagcaagccaagggaaagaatggagttagatgaccacgtgaaagaagaatgagacagtcctgcagagaaagacacaaacatccaagaacacatgaaaagtaccagcaatcaaacccacgtgaccaaaaaaaagcattctagttgctcaatctttcaaaacatctttactgaagacctttagatattggctgtgttttcatgaacatatgcaaaaacggggatacctcatcacctgccccaagggtcatataaaataatgttaatggctgaatataaaatccacagttcggaggttctttcccaggtaaagtccatgacaatgtcaaagcctaacacaagaaagacgtagctcatattacaacaagcaccaccataaatgccctgctaccaatcatatgccttgagcacttgttatgtatgagacactacactaatgagcttacacataattcactgaattctcacgcttccttgaggtagctgctgttattgtcctcatttccagatacaaatgtcaaattttagagagacctaaaaatttttctaaagtttagcagccttaaataatggagcagggactcaaccagacatttgtaatactggtcctgaactgtgatccactagccagcgggtttctaactttaaagctcgccacaatcaacggacaacttgattgtgcaccaattcctgggcaccaccttcaaaggttctgatttagccatctggggttaagcccaggactctgcatttcaaccaacacttgtggtaattctggtacaactgtctgtggagcaaataccaacttctgagcagaatggctattatctgcactggaatagagattgctggtacctgctaaaatgctaattaaagcaaaggattacctgcaatgatgaaaaactgcagtaaattttaaaataaattttacttttaacctgctttatatttttgatatatattatatataaaattatgaaagatatattgagtttttaatatttcatatattttaaaagtggtttaaactttaaaatcaatttttgttttaacaattaactaaaggaatcactaatttttattattattattattattacactttaagttttagggtacacgtgcacaatgtgcaggttagttacatatgtatacatgtgccatgctggtgtgctgcacccattaactcgtcatttagcattaggtatatctcctaatgctatccctccccctccccccaccccacaacagtccccagagtgtgatgttccccttcctgtgtccatgtgttctcattgttcagttcccatctatgagtgagaacatgcggtgtttggttttttgtccttgcgatagtttgctgagaatgatgatttccaatttcatccatgtccctacaaaggacatgaactcatcatttttatggctgcatagtattccacggtgtatatgtgccacattttcttaatccagtctatcattgttggacatttgggttggaggaatcactaatattttaagcatgggtaggagttgatgatcacttgctagcatttttgtttaaaggcttaaaactattatattgctctttgtatattccaaaatacatactgttgacccctgaacatcatggaggttaggggtactgacccctacctcgggcacagtgaaaaatctttgtgtaatgtttgactccccaaaaacttaactactaatagcatgctgttggccagaagcctcacagataacacaaacagtagattaaaacatattttatatatgtagtatgtcctctgttcttacattaaagtaagctagagaaaataaaatgttattaagaaaatcataaggaaaagaaaatatatgtactcttcaagtggaagcacatcatcataaagacctccatccttgtcgtcttcaagctgagtagggtgaggaagaggaggagttggtcttgctgtcttggggtggcagaggtggaaatatatccacatataagtggacccatgcagttcacacctgtgttgttcaagggtcaactgtgctgtctggaacattttgtttatgtgcccttgaggatgatgacaagctgtgacattatttagcagtaatgtgatttggggttaattctgacaataatgtgaacaggaaatagaaagcatggcccaagaagtgagtctcagatagaaacacaagggacaagaagctcaggcaccagcaaaagtatgtgaccgaacgtcgacacaggtcctctgtcagaagttatataggtcagagacaagacagaagggtttaaaaaaaattttttttttttttgagagaattttctcacccattaaagtagctgatgcccctgggctctaagaggagaggctcagtttcactgcaagagtccagaatcttctgccaaagcaatctcacaatagctcagagtcaaggacagctgcacgatatggaggaggggctcaacgtctgctgaatacctctctgggcttcaactatgtgccaagatgtgtgtcagtcaagtgcttggctaaatcagtgatgaagatgcactccctgctctcgaagagttaataatctgattgagatcaggtttctagccccagcttgtgtcagcttctagccatatgattccaagcatgtcacttaaaagttcctgagccccaggttttgttatttggaaaccagagataacatttcttcagtgtgttggcatcaaatgagaatatctgttaagtataatatactattatctgtaatgtataatatactattaattggtgtttctcggtgtattgtgtaaaagaagccagaactgggctatcaaagaagcccaactgatgtacacacagttaataagcagaaaagaaggaactgcccatttcctgcactcaagtgcattcttaacaaagagaacactgatgaggggcatgacccaggttagttctaccaatatactcttattccttgaaacttcacagggacgagtgattggaggagggagtggtatcctacagactggaaaacaaaagcatggtcttgctctctttcagcatcatggggcacaaagagatacaaactccacaaaccatggtgagcttggcccaaagacaaagcaattcttactatttatcaaacttgctcagaaattccagcaagcataaatactctatttcagaggaatttaacccaccatagaaactattacactgataaaaagtgtggctatagctttttttttttgagacagtcttgcgctgttgcccaggctggaatctcctgagttcacgcaattctcccaccacagcctcccaagtctctgagattacagacatatgccactatgcctggctagtttttatatttttagtaaagacggcatttcaccatgttggccaggctagtctcaaactactgatcttaagcgatccgcccaccacagcttcccaaagtgctgggattgcaggcataagccaccgtgccgagccctagatctttcaactctagcatagcaaaggacaaaaagagaaagatgaggactattcagaaatcaatatatggtcatcacatggtactctgatgtgcataatctgacctacaagaaagagcacagtgctggggttctgaacatttgggttactatctgccctctgccattatacagatctgcagccttaaggtcattcaatgcctaaacttgtacttctgaaaagtgagaatggtcatattaactctacaccttttttacagggctttcatgatgaccagatagggtcttgaatgtgaaagcactttgaactgttaaaaatcactcacaaagaatcatgactaaagatataaacttcacttgtatgcataacaggatgtttcaagacaataagatttaattttctggattgtactgtaaaccactttatatgcaagctcttaaaaaataaaacgcctgtgtagtaaattagtacctctagacaattctgctatctctgtgacaattatttctagaattctgatgcgtaattatcaaaaaaagtagtaaaaccctaaatacaaatccaagcttaacctccatgaagtttattttactttattaacactatatgatattcattgcttttcaagtaaatgatggggtaaatgagtcctataaacacatgcacacagagtcaaggaaaacttccacccgccccctacaaaaaaaggtggagaatcaaagacacacaggctcaggttcatgaatatagtagattcattccatttttaaaacaggtattactgtgttctctttttaaccctaaaaggaccaaatatcttcaaaataatgatggtggtgactcttcattcctaggccattttatcaaatataagtgtatatttagatagacccatgaaaaaataacaagttgaaaattccacagataacctaattatctaggtatttaaaaattgtgacaaagatactactataaaaccacaaacagatatttcttattatatggatgcagaaatcctcaaaatagcaaaccaaacctagcaacatgaaaaaattaaattatataccatggccaactgggattcatcccaggtacgcaaggttggtttaacatctgaaaatcaattaatgtaatgcaccatagcaaaaccacaggatcatatggaaagatgcaataaaagcaattgacaaaacaccatttattgaaaaaaaaaaacataaatcaaactaggaatagaaaggaatttccttgacacgacgtaacatgcagggggaaaaaaaaaaaaaaaaaaacaaccatggctagtatcatacttaaaggtgaaagatagatgctttacccctaagatgaggaataaaatactcatgtctgctctcaccactccaatttaacattgtgctagaagttctagccaggatagtaaggcaagaaaaagaaataaaaggcatccagattggaaaggaagaataaaactctatttgtagatgtcttgatcttgtatatagaaaattctaaggaatacactgaaaatacattacaactaataaatgagttcagcaaagttgcagaatactaactcaatatacaaaaatcaatacaccttttatatacttgtattgaacgatccaaaaacaaaattaaaacaattatatttataatagtataaaaagtaatgagatacttaataataaatttaacaaaagaagtataaaacctatactctggaaactacaaaaaaattattcaaagaaattaaagatctgaatgaaagaaaaaacatcctgtattcccagattggaagactcaagattgttaaaatgtcacacatatcctctgcctccacacatgcataacctctttcattatcaacatcccatatcagagtggtacatatgttacaattgaggaatctactcccaaattaatctacagattcaatgtaatccctaccagaatcataactgacttctctatcaaaatcgacaagctgattctaaaatgcatgtagagtctaataaatgtatactggtgggtcgctgtggttttaatttgcatttccctgatgactaatgatgatgaacaattttccatgtgcttagttgccatccatgtatcctctttgataaagtatctcttgaggtctgtcgcctgttttttgattgggcttttctgctactgttgagttttgagagttccttgtatattctggatagagccctttgttagatacctcatttgtgtattcttctcattctgtaggttctcctttattctcttaacaatgtcattcacaggacaaaactttcaattttgatatagcccaattcattaaaaaacataaaaataaaaataaaatttgtatagaaattgcaagagatccagaatagccaaaactaccttgaaaaaaaaaaaaagaaagtaagaaagctcatactcttccatttcgaaacttactacaaagcatcaagaaacaagaccagtgtggttttagcataaggatgtaggtcaatggagcagaattcagagttcaaaaatgagctcatgtgtctatggccaatagatttttgacgggagtaccaagatcactgtatgaaaaatcaagagtctttttaacaaatggagctcagataactggaaatccacatgcaaaagaatgactttggacccttgcctcataacatattcaaaaattaaaaatggatcaaagaacaaacattcgaactaaaacaataaatttcttagaagaaaatacaagggtaaattttaaagacctatgacttggcaatgatttttagatatgacaccaaaaccacaagtaacaaaaagttaaactgatctttttataatacctccgtagttttgactctcctagaatgttatacagttggaatcatagagtatgaagacatttcagatgggcttctttcactcagtgatatgcatgtaagtttcctctatgtcttgtcatggcttaatatttcatttctttttagtggtaataacattccattgtctcaaggcaccacagtttcttcatccatttacctactgaagaacatcttggttgtttctaaacttttagcaattatgactataaatgtaaaaggagtagtggttgccaggattagggagagggagagatcaacaggaagagcacaggggattttaaggcagtaaaaaaaaacctctgtatgatagtgtattagtggttatgtatcattgtgaatttgtctaaaagctatgaaaagccaacaccaagagtgaatcctaatgtacactatttattttgggtgataatacatcaatgtagattacttaattgtaacatatgtaccactctgataggggatgttgataatgaaggaggttatgcatgtgtggaggcagagggtacgtgtgacacttttttgccttcctcttaattttgctgtgggcataaaactgctctaaaacaaagcaacctttaaaaaaaaaaaaacccagacgtggtggctcacacctgtaatcccagcactttgggaggctgaggcgggcagatcacgaggtcaagagatcgagaccatcctggctaacacggtgaaaccccgtctctactaaaaataccaaaaaagaaaaaattagctgggtgtggtggcgggtgcctgtagtcccagctatctgggaggctgaggcaggagaatcacttgaacccgggaggtggagcttgcagtgagccaagatcacaccactgcactctagcctgggatacagagtgagactccgtctcaaaaaaaaaaaagaagagttggacttcatcaaaatcaaaaacttctgtgcaaaggatactatcaagaaaatgaaagtcacattttgggaggccaaggcgggcagatcacttggggtcaggagtttataaccagccgggccaacatggtgaaaccccgtctctactaaaaaaaaaaaaattagccgggtgtggtggcacttgcctgcaatcccaactacttgggaggctgaggcaggagaaatgcttgaatcctggaggcagaggttgcagtgagctgagattgcgccactgcaccccagcctcggcaacagagactccaactcaaaaaacaaaaaaacaaaaaacaaaaaaaagaaaaaagaaaaagaaaaagacagcctataaaatcggaaagaatatttgcaaattatacaagatcctagtattcagaatatgaaaagaactaaaactcatcaagaagacaaacccaatgaaaaaatgggcaaataacttagacatttttcctaaggagacatgcaaatagccaacaaggacataaaagatgctcaacatcgttagttatcagggaaatgcaaattgtcaaaagtggcacctgagaaagaagcttcctcgctcactctcctgaaagaggtttcagaagcccacttccttttcactgtacaaacaaaaaatccagacaacttccttctcacaactacgcacttgaggggaaccaggtggaatttaatgtggatcagagagacagaaagaaactggatccatccttgatggcactgttgagaagttaaaccaaactaatcctggagacctacctacatctgaactttctatcattagacaaccaaagtcccttttattacttaagcctgcctgagttcattttctttactcaaaatcaaaaatcttaactgactaaatcacatagttaagaaatgctacagcgggcggataactggagcagaaatataatcttggaggcaacagtgttgaaatggctatttttgaagaaaggcaaattatgttttcctctactgtactgaatcatgtttcaaagcttcacccagaactttatgttagacagatctttttccagctcaaatgtgttacctgatctccgttccatatttccaacattgtgagcacatccactcaaaataatatagcataaagaataagaaaattaaaatacagagctcatagaattgggcaaagctggaattccttttaatgaaaaagaacattgtaaactataaataaccataagatggtcattatcatttgcctgtgaataacttgaaggaatcagactaaaagaatttttaaggaacattccagctctaaatgtctgattctgaagctttccaaaatatataatcacatttaaaaagaaaatagttaagaattgactccaaaaagaaaaaaatatatatataaatatatatagtgagagagcctgtattcaacacattaaacctcagatcatttctctaggtaagtaaaataaacaaaaatataaactaatgtaaatgagcattactttggtttaaatagcaatcaaccactctgacttcaacatgttactcaccacaaacatttgaaagtcattccttcttaggaaagggctatttttcccaactatttcagagttcattaggagtatcagtaaaatgcaaaaaaaaaaatacaatagctagttcatatttacacaacacaaacatgtattcaacactttaaattagtatatttgatacatgctaagtatataattttaaagccatttcagatgggcaaaagtagctaggactacaggtgcccacctctaccttatatatagactaagctcataaatatctgtcatatacatgcacaaatatatacagacacagtagaaaaggtttaaaatctcatttatctacttgaattagctatactttcgtcccttggtggccgagaaagcaaagaacgatggtttttattaataataactataacatttacattctgcaggaatttagaaaatagttcttggctttaaaaagtatatgaatatgcatttgtggaggggaagaaatgatccatggtataatggacttccatagcactgtgcattttcctttacatatcatcattttcttgatatgtaacctgccatggattactacttggcttatcaactctcactagatcatgagtttcaaatgcaaaagaactgggccaggaatctctaggatcaatcacaatgcctggcacataggaggtagtaaatgcctttccaccccacaaccagaaaagcttttctatcttttcttttttttttttttgagatggagtatcactctgttgcccagactggagggcagcggccccacctcggctcactgcaacctccgccttccaggtccaagtgattctcctgcctcaacctcccaggtagctagaactacaggtgcccaccaccacgcccagctaatttttgtatttttagtagaaacagggtttcgccacgttggccaggctggttatgaactcctgacctcaagtgatccacccacctcagcctcccaaagtgctgagattacaggcgtgagccaccacgcctggcctcttttatatccatctttcatttgtaaagcatttttgaaactacatatttccagtataaaatgcctcatgtaagtaatatattttacagttatcctacacattgtatgtagtattatttcctttcacttgttttatagttaatgtgtttcaattttcatgggaaaactcagttctaataaagatttctgagttttgatacaataaagtctgcattttatggactctgatcatatatcctccagactgaaaagttcacatttttcaagtctccagacaaaacaaagatcagtcatctttttttcagatcatgtctttttcaagatatgattaaaacccccacatgggattttggatataaaatttcaaaagtttatagcaatataattatattcagtgaaacctcatcttttttagaatcctcgaggaataaaacctctgagacagtacagtttttgttacagtgaatacttgtagtgccttttttatcgtatttttttttccttttggagacaggatctcactctgtcatccaggctggagtgcagtggtgtgataatagctcactgcagcctcaaactcctgggctcaagcgatcctcccacctcagcctcccaaatagctgggactacaggcatgcaccaccatgcccagcttattttgtgtgtgtacatagagataaggtcttgctgcatagctgaggctggtctcaaactcctggactcaagtgatcctcccacctcagcctcccaaattgttggaattataggcatgagctactgtgctccacctttcattgtaacttttaagagaaatgtttatgtgtggcattacatatttcaattccttacaaagactagactgaattaaaacaatttaaacccttcttagtgatttgggttactattttgaatactgaggagctacctctccctagccccaaatttgttgagcccagaattgttggggtgtgtagggttgtcttcactgaggtatttcaataacatcaaggacccaacagttccacatagaaacacacatcctatatctctcacccctttgtagaatcgtctgacagaagtagtggtctctccacctagatccccaccattttccatcatttcataagttagctggtttggtctgaaaagcctcaacttaagtacacctagaacagttgttctccatcacattatttgctggtgagtgcacataggctctttctgaagattctcctctttcccttttagttagaaagctcagaaaacttccatttgaattgctgatactgaaaagtaccaagttcaagcaattccaaaagctttccacaaaatggactacaagagttcatcattctaactaaactctaagcttcatcgtaaattatctttaccttcttttgtacccactgcccctttcactgatattcagcatggtgcccagaaaatctaaaagtgaactagaccacatataactacaggaagaaatcccctctctctccagcacagaaaacaaagacagggaccaaagattacaatcacaatgaacttcaattcaaacctcacagaatcatctactatgcaagatgtacactaaataaaatgtggtcgagattcaattacgtaagttgatctcttcagagaaactattttaatggcagaaacaataacctagggtttcttttaagcttttgaaaatcaatattcataaatcatgtttctgtttcctaggaaactaggtaatacctatgacgagaaaactctaccagtgtcattttccttttatccttggttcacaacgtggttactgcttactagaagaaaaaaattaccttctagtatcattgaatatcacaatgaaatgagaagggagatacatagaatgccaatttctcagactgcatctccttctcaggtgtgacagagaattaacagaataaatgcctgcacagagagctccaaaaaggtggaaaacagtttataatctagtttattatgtgctcaacacagagcatgacattttgaaacaaaggagttaaaagcctggatttgttagaaacatcaggtcagacacttccaagttcaaattccaaatttttttccccttgggtaaattaaaattacttcacctctctgaactacagtttccaagtcttaataaggagaaaagacctagctcacgttgcagtatatgaatacaatttaaaaagaaatacaaaataccaagttcaggattaattttgtctctaaagaatctccaagaactacgtttaaagataacaaaacaggtagtttctcaaggactttatgaccagtgtataaggtttcttttttgagttcccatcttagaggggttacaaagggacatggcatccttagaaagtttaatgagtgtcatttctacaaacatctgtgcatgacctttcaactctgaaaatgtgatcattttatactgtacatctgtgctgggaccacattacctaagcttgctctgactttcatatcaacaatcaaatacagaaagaaaactgatgcacaaatcacaacatggttgaattacacacttgactacagagtttattaaaacagtcttgaatttctaaaatccattattaaatcacagtaaattgtagggtatacaaccctggcccaaagatccaaagacttcatatgctgctgagattcactgttttaccaaattcagacactggagaccatcatctcaatattttaaacacacgtttaggtatcctcccaaacatttaactgcacagaatacttgaaaatacaattttatatacatatatatatatgtatttgtgtgtgtgtgtgtgtgtgtgtatgttcatgtgcttttattagttaaatgtctgcaacggcatagcaactttttcctaaagcagcaacacataatttccccacacttcagaccccaactccacaaactgctcctccaaatatatatatttttaaatattccttttgacttataggtacatctgctgacccaccatgcagatattcagaattcaattttctactctgtgaaagaatatttatgtatcaaacaagagagactaaaaaatggcaacaaccaactggctaatcttatttttacaggctactactagcctcgactatcaaatagatatttagaaactgcagctttaatttccatatgctgacccttctgtatcattaaccttctcacaaaatcccagaaatcctgaccccaggaatgtaaccatttcggccataataataaagtcaattcagattttctgtttatcatacacagctgatgctgaactcactgcttagaatcttgaattacacattgaggtgagaacattgcatgcacttttattaagtgctaaaaatggtccaggtaattattaactatcaatactgcttacctcctgacaaaagcctggtactgcaaaatgttaggctaggctaatcaaatacaataatgaagataattttaaccaccaccaccacattcagaagcactaagacttttggtacagattttgacttagagccttgtggagagctaaattctcattcaggttcctacctctacagaattcaagctctatgatctaatgaaggtcactttacctttatctgtagaagatgatttctaaagttctttcaattctctatgactctgtaggcctaataccctagagccctagagatatgtatattgaatattgaatggctatatcaaacctcatagatgggttttccaacaaagcaggaatgcatacttcccaaatatttagccaatacgacaagaaagaaccattatacaaatcagactttggtaagctttgttttcaactttttgtacaaagagttcataataggcttaacattttttagaaaatattttgctaactagtttatgtagcatttaaccattattaagcaattacattcaaaatataaacaggtttatattttggcaaacaaattcacatggaacacagtattttcaaatgcttcccacgctagtatgttacatgtcatgggtcttattttataacacaaactccgcttacttttgtaaggttagaaggagctattttatgactcatttttgctactggacatatatacatcattatcattgtataaatggggttagaaaaatcactttggaccaggtggggtggctcacatctgcaacttcaacactttgggaggccaaggcaggaggatcgcttgaggccagtagttcaagaccagtctgggcaacatagtgagacctcaaagaataaaaaatttaaaaattatctgggcatggtagtgcactcctgtgatcccatctactagggaggctgaggtgggaagatcacctgagcccagcaattgaggctgcagtgagctaagatcaaggccactgcactctagcctgggcaacagagtgagaccctgtctctaaaaagaagaaaagaaaaatcactttgcactttgccctacatcaaccttcacaagcatatgaaccctttacaatataaatctcattttgctcagaaacatgagctatcaccctccaaccacgagaagaacactatgtaaaatcatcaaatcaaagtgcttctcttagattctgcaactctcagggccattcctttagctaggcttgtccctagacacatacatataatcaaactgaaataccaattaattcatgcagtaaatcctaagagcaaagatgctcctaggcatgggaagaaaacctacatgcagggtaccaaggaagcacttccacagcaccctgctatttccatttcataaaattcctcacacataattcagctatttcacccactagtcatggctctgtagaggtgaagaccatgtctatctccacttctgtagtatacctagcatgatgcttcaacacaggataaacattctttttatttaaaaaaaaagtgttgatttaaactgaaaatagaaatacatactaaacagtactgaagtataaaatggtataagtttttcaaattgaaccataaaacattcctgtattttgtgcccagcagcacccagagccatggagtgctgatgggaaagaagggcacacacacagggaagcaggtccactgacaccaagtacacagagtgtggaggggagagagagcacgcagcatggaggcacgctggcagctggcagctggagaccacggacagaggggttgtgggggtgaaggaagaggagatggtaacaggcagatgagatagggaaaataagtaaaatgattaagcaaataaatatgttgaggataacaagagccaggcttcttactacagtagcaggtatttaccaacagaataggtggaggctacagagaaccctgaactgctacactggaattggaaaaataagtatgaacttccagttttaaaaaatataatcacagaagctgggtgcggtgtttcatgcctgtaatcctagcacactgggaggccaaggtgggtggatcacttgaggtcaagcattcaaggcaagcctggccaacatggcaaaaccccatttccactaaaaatacaaaaatcagctaggtgtggtggcaggcgcctgtaatcccagctacttgggaggctgagacaagagaatcagttgaacccaggagacagagttgcagtgagccaagatcatgccactgcactccagccagggtgacagagcaagagtccatctcaaatatatatatatatatgtataaacatagatataaacacctcaaatatatgtatataaacatagacataaacactgctataagtgtatgtatttatggagtgtgtacataaaaatgtatgtgtacatgccattgaatcattaaatgatactccaaagtatagcacttgcacatgctaagcactgtgaattaagggaaattgggagaccttagaaactgcctcagaatcaaagtccgaccttcccttgtttttcaacctagcccatggaggggatctctctgaagtttcctcatctgagaaaagttctttcaaaagaaaaaaaattgccttcagctccctgtcagaaatctcatcaaccagggaaaattaatcaccaaagaagaatctgaaggccatcaccacacccacccagagagaattttcatctattctgagtgctattactgacaggcttcatctgcatataagacaacttttgttcccagaatatgtcttccccttaccttcctatagtctgttgccacctccctgcaagccacgaggagctctgtaccagactactgtccattttctggacctattcacctcccctaaagatgatttactcttcctccaaaattgcctacatccctcactttctcctctcccctgtgaagagggtattcaagcacttctttgagtttcctactttgtgtaattcccatgcgcttgcacatgaataacttgtatgccttttctcctgttaatctgtcttctgtcatcttattccagcagactcaagatcaactcttcagagggaaagtttaaacttccccacatagacatacacatatttcccagctgtccaccaagaggactcaggatcaatgagcactcagaaagctaagattatagtttctaaataccactctccactgaaggaaccagggttaactggagaaatggcttatcaggaggacagggcagagaaaatacaagatgagcctggaactgcttattgtgccataaaataaggaagtgctgaaagactaatcaggatgtgtctaagagacacaagagccaccgtggcttgcattcaccaaatataggacaatatgagcatcaaaatagagacagtaatgggttataacccaccaagtaaactaggaatctgtgacataatatatgaaaaacatcagtaaatggggaaaaagggagaactcttccataaagcagattaccagtagaaagaatagcagaaaatgaaaatcaccatttggcaacgatcactgtggtggctggtttaggcagggtaactcaataaagaatatgcctgatggaggccaggcacagtggctcacacctgtaatcccagcactttgggaggccgagacgggcggatcacaaggtcaggagttcgggaccagcctggccaagatggtgaaaccctgtctctactaaaaatacaaacagtagccaggcatggtggcagatgcctgtaattccagctactcgggaagctgaggcaggagaatcgcttgaacccaggaggcagaggtagcagtgagccaagattgcaccactgcactctaacctgggtgacagagcaagactccatctcaaaaaaaagaaaaaaaaaaaaagaatatgcctgatggatggagctttgatgagggaaagatggatattggtgtaatcttaacactaagtgcttaactcctgatagcactaaacaattacaaaggggaaaatggtgcctttgtggaagggaaagctatcagacactaacagaaacagatgatcaaaaattaacatcattggctgggcgcagtggctcatacctgtaatcccagcactttgggaggctgaggcgagcggatcacctgagggtaggagtttgtgaccagcctggccaacctggagaaaccctgtctctactaaaaatacaaaattagccaggcattttggcaggtgcctgtaatcccagctactcaggaggctgaggcaggagaatcgcttgcacctgggaggtggggggttgcagtgagctgagatcgcaccactgcactccagcctgggcaacatagtgaaactctgtctcaaaaaaaaaaaactccaacatcatcactggctgagggtcatcctacagcaggatctcagacctgcacacttaaaaactgtggaggacatgacagggaatgactgaggaaatgttccagattggtgagtatgaaaagacgtcaccactgactgtgatataattattgcatgagttcaccaccataagagcaaagagacagctttaggacagttgttgaaatctaagtaggttttatggattggatggttgtgtcatatcaacatggacttcctcccttggaactctattcacctgtttttttgaggggggcagtaacacactctaaagtatttatggatgacaggcatcatggctaaagcctgttctcaaatgtttcattaaaagaccaatgataatgggagagaggggtatgtgatggagcaaacatgatgaaatgcgaaacgtgtgctgctcacacaacttgctatacatttaaaattatttataagtaattttaaacattattatttctaaaatttgtatcccgaaactaactgtaggacactttacaatttcatcccagctgttgaaaaatttccataattaaaacatttcttaaaataggagtatccttgtagctgatcatttgaagctgtctcatggtggcaaattaaaacaatgatttgatcttcaaaaatgtgtgtgttcaaagatgttagtccagctgccaagaaatatcatcagcagtgcagcacggaaaatgccctcaaaggtactctaaatctaacacagcagagcgggtcacaggagcagggatatgttgcccactggcagtcactaatattctcctaaaagtagcctaagcacaccccccagcgaattctgaagcgcaaactccatatcttcggttggagctgtttggctatacaacaatgtgctatttgtatttaactatactgatctttttgagggaaaaacataaacaaccaaaattaaggaaatgtttcattttctttgagatgatcccaaactaaaaagacaacttccaggtcactatgaatatgtactgatgagacgtaattcaactatgcctaatttcaaatggcttgatctattacaatactatcaaatgaagtacaaagattatacataaaaacttgtcatgacaacatgggacctactttattatagcatcagtttacaaagtaattgagaaacaaatgataagttttgttagaagtctatggggttaagtaaagcctgatattgtaatagatcctgaaaagcaaatgtaatactagaaagataagaataatttttcccatggaaataattacccttaatttttccactgggaataatgggttataaaattttatcctgtattaaaatacacacacaaacacacatcccatgcaacaatagagaagcatgtacagattaggaagtatcccagataaggtgttttggggacttgtgagtcatcacatttgaacatgtttttagtatattgtttcaatgatttgtatattttatttctagacagttttgagtagtgcaccgttattcctctgtggaaacagagatatttagtgaatgattaaactcatgcactgtgttatctgacatttattcaaccgtaactgtacagctcgacatttctgcacattcacataaactgagattcataaagatgcataaggcagtaaaacttaacttgcatgttctatgaatcattaaagactgtccttcaaaacacagagtttcagtcaaaaaccaaagttttgaataacctggacccactttcttgatcaattcagatgtgactgttcactgtatttttctcctgctccctcacatttctctcagctttcttattttctgttaatggtactcccattgcccaatgtaacagactgaaaatataatatcgcttgagatagtatacaatttcctgagtcaataatgttctatcaagaaaactttttcctagtttagtatatgacttcataaatatacatatagtgctccaaattaaatctgacaacttctaaattcattatatttattttaagaagcaacagaacagcaggggaaaagagaatcacaatagcaaaccaataaagagtggtgaccaggagataaaatatggagggcataggctctcatacttgaaacttaaactagtaatcattaccaaaattgggttaggttcccccctcccccgcgatgtataagtgggcctgtacacttctcctctacagctttttacccacctatattaacttcaaaaattatttgttggcatctctttttttaagatcataagctgcagagtccacagggagttgggtcaccattacattcagtacatccccagggccaagtacagcagaagtcaatgactgtttcacagctggtaagaaagatctgttcttttagtaaataaaacagggtttattggatgactatttataaacctcttaagttggaaacaattatgcagacatgacggtctataagaaagatctggagacacactgtcaaaggaaatattgacttagcaatttcagaattcttaaaatagcagtattttctagcaatacaaatatatgagttttatatcttcaaaacagactgggttttgtccctaaatatccctaacttgattgtagactatttctttaaataaatttttaaaaaatattaatctgtatagtgaaggaaaatggaaaatcaaagaaaaataaccattatcatattttaaatagtataattaaaagcatcatacacagaataatttgacattattgtaggtttttccaaaaagcaaacaacaacaataataataataatcctgaaaaggtaagcaagggcatagacgggtagagaagaggggaaaagatctttgttaaaagtgtaaattcataggtaatgggatgcacaggctgaattcttggattcactgaacaagtaggagaaatggcattatttggcttccaacctggatgtgttaacctaagcagaacatctgatggaggacctttcccatgaaaggataaagtgcttgttcaaataattcaacactcaagcactgaaaataaaagaaaaaattaatatgtactatgcctaattctctccaaaggagaagaagaaaatggcttttgtaaagtgagtggaaaaagatgtctttcacaccatgatagtatcaggaggagacttcagcatggccactgatattcttagtgtcacctcttattgtaatgaaattaaggtagcaatgacatggcaatttcttgtcagctttaaaaagaaatggtgtaattgaacttcaccaacttaattgagcccttcccctatatagcttataccacattaagtgggaattcaaggctatttataaagcactgtgactgtcctcaagacactctcagtcaattatatttcataatcacatttgatgcctactgtctattaaaggctccatgtatattttacctgtaaacaggaaatgcttggagagccttaaacaggtacccatccaaattggtatttgagatcattttgataacacaggtaattcaacagctgtctgtaccaattttttaactggatatcttagacactaaaagtggtgtcaaatatttaaaatttaattatctaaaaacatcatttattactttaaatactggtgaaattgtgattaatatacttcactacaagaggaaattaatagtttctaccataataaaattcagaccaatctggggaactttgtaactgaattcccacttcttttactcaacactatacttcaaggtataaattttcttggaatgttttcaaaatattcatcttattgctaagcaataatgctattttctggagataaaaatcagtgcatacttaaaacaactgtgttcacaggaattctgcattttcactggattatcaagaccatgaattaataatattcaacaaaacgtaactgcctagaaaacagatgactgcactgggctaaacagatgatcattagacacctgctccaacacaactattgttaggtattttactctatttgcaaagacagtaaggtgtgtagtaactcaaatctatctgcccacagccaagccaaacaattcattaaagactttcttatgcttcctctatattatgatggtaaaatcttggtaagaaagtcaggtccaattcaaaagagctcaaaggaaaaaaaaaaaattaaagatgctgtcttacattttttgggctgctatgacaaaacaccttagactggttaatctataaacaacagaagtttatttatcacagttctggaagctcagaagtccaagatcaaggcaccagcagatctggggtctgaggaaggcccattccccacagatggcgcttgtcttcacatggtggaagggatgtggggggctagggtgctcccttgaattattttataagggcactaatcccattcacaagggtggagcaccataacccaataagctcccaaatgccccactttttaatactattgcattggagattaagtttcaacataatgaattttggtgggacatcaacagaccatagtagatgcctttaggaggcacacatgtattcccagttcggtttctaactattctagggtagggtccctatgcaatcaattctactccaaactctccaaccaaaatttgaaacagcaatgtcactaagttaaaataaagaaataggttgaatttcaaggtaacaatatctctacagaaataaaagtaaaaaggaaagttaactcttcactttcttagatcattgtatgttggacttacttaaatgtgaggtctctctcaccgtgtgtgtatttgtgcgcatgcgcacacatgtgaaccaatataaagactaaaaggcagagaaataaactacatattagaaactagaaatcagggaaagccaagacaaaccattaagggtggctctatccttgaaataaaaggcagagaaataaaccacatagcagaaagtaaaaatcaggggaagccaagacaaatcattaagggttgccctatcctggaaaaaatgtgcacctcaactgggtcagagcaggaatcgatgaagagcaaagagaagaaacacaaagtggaaaatgacctttagattctagtgccaacaactgatcgagacaattgatctttacaaagttttaagcaactgtgaaagcaaaaatatttagtcttgaggtacgacattagacaatttgtcttagtaacaaagattaggcttatatactgtacatatggtcctttaatttccattccatgcaaatgctggctaagttttcaatgtactattaagtcacattatttttactactttacttcttcactgtggcattattcatcttccacacaaggaagtgaatgtattataactcacaatagagatcattaaaaggctctttcaaatttattttaacatatgtccctcatctctttgagtatatgactatgttctctgcaatagcaataataataataataatttgtctaaataaaccatatatcattcttgtttacttagagtctctttggataaactttttcaatactattagcaattcagatgaccacttcattctcactccaatttctgtataactctttcaaaaactctaaatatgttcatttacatattatttttcttcaagaatctaaatggaactctttaagagcaagaaataaaagttaacatatttatatcaaattttatatgaagagcaaataccctgtattttcaaacatacagttgacctttgaatgtggggggtgagggtcataggagttggggcgctgacctcccatggagtcaaaaatccacgtatatcttttgactcaccaaaaccttaaatactagtagctgactattgacctaagccttactgatgacataaacacttgactaacaccactgctatatgtatgttacgtgtattaaacactatattcttataataaagtaaactagagaaaagttatttaaaaaatcgtaagaaaaaacatatttactattgattaagtggaagtgaatcatcataaagatcttcatcttcattgccttcaaactgagtaggctaaggaggagggggaggaggaagaagaggaaaaggaagaatttgtcttgtcccaaggtagcataggtggaagaaaatccatgtataagtagacctctacagttcaaatccatattgttcaagggtcaagtatatgtgaaaatttatgtaaattaatcattcattttatgagaaagaattttccataaaatccaaaacacagaaatggcatgttagattttctaactagaaattaatgtgtaaaatccaatcacttcaaaaaaagaaacagaaaatgcaatcgaaaacaaaaatgtaataaacacaaatatttgaaaaaaagttgataaaacagataaatcatcaactagtttttgaagatataaaaatacaaatatgaaattaagaatcacttttaactaccacatggaaatttttaacatatattatctttaaatttctgctactaaatttaaaagtagctagaaaattattgaaggtaagtgttaatgtcaatttttttttttttaaataagagacctaactggatcaatcactgcaaaacagctttgctggagtgcagggagcactggggggagtaagtaattgattatttttaaaagctaacagatatataaggtttcccaacatttgaagaatagataatatattttgtaataatttttaaaagaacagattatttgaatgctgtaagaagtactctagaacacaggaaaagatgggaaacttcctcatgtattagttaaaagcaacataccatgatgtcaaatcatcaatatttcaaagaagaaaattgtaagatgtccaaaagcatttgataaaattgtaaatctatacttgattgtaattcttagtaaaataaaaataaaaagacagttctttaacatgataaaatgttagttcaagccaatggaaatttcctacaagaacacaccaacaatgaccacttaagaaatataaagagcaaggggaacattcacaacagcaactactatcaagtatctatagaactgaaattatgaaaaccgatccgtttttactaaaaagcaacatagaagcttttaataaactggcagtatatatcacatttctagagaaacaaaataattaggaaagtcaaatggaagaatgaagtgagaatcatagctaagacttttggggaaaaaaacaggaaaaagtataatattgaaatgatgtgggactaagagaggatagtaaactttagccaatgcttacaagattttcaaatttttcaagaaaatttggaaatctagattttcttaagtgaaatgtcacatgtttctctgtaggcttaagtctttgaaagcactatttccaaagaaagcatttctgtacgctaaattggccagagtggacctctgccctatacacacccaacacttcctgcctcgcccagagctcaagttgcttcctatgttggacagccccgtcctctttctccacccagtcaaatgcaacccacccatcaacgtgtggcttacaggccagtcctcaacagatcattcttagaacctctggtatggctttatcattactctccctctgctacaagaattacagttctaacaatagattgtaataacaaatagtaacccaatgtattctgtctcttcctctagaattgagagtaggaacagtgtctaataacaataccatctactatcttactggcctttctttataccaaacactgaaatgatgctttctacagagtttttctgtaaccctcccaacaaatgcaaaacaggtatttttcctactttacaggtagtacagtgctcagaggggtaagcaactaaacaggtcctggaaataaatggattctaaattcttttttgccaacttcaccaatcatatcacagctggttggtctcggttgagttaaatttacttgggaccctgttctcaaatgagggcactgaggtgagagatacagcaaagataagaacaacattaaacataagaactcaagggtttgtaatctgcaaataggatatgagtactacatgaagcccaagaagacgtgatgtattctagttgtgtatttgaaattgacttcaataatataagttacattggaaggctgaggtgggcggatcacctgaggtcaggagtacgagaccagcctgaccaacatggtgaaaccccgtctccactaaaaatacaaaaattagccaggcatggtggtgggcgcctgtaatcctaactactcaggaggctgaggcaggagaactgcttgaacccaggaggcaggggttgcagtgagccaagatcccaccattgcactccagcctgggcgacagagcaagactatgtctcaaaaaaaaaaaaaaagtaagaataataagaataatataagttatatcaaaaattaaccttttgcattagcaaattttattgattcacttgaacttgatgtactcagtgaaggaaaaacagaacagatggtactgtactgtagcctgaaagaaaatttgaatcataagacaacttttgaaatattcttaatattcttgtcatttaaggtaccaataaagttcttataatacctaatttgtatgttttgttgacatcaaaaatgaatcaccttataagaggcttcttttaaaaaattaaataaatctttaaaatatctataatcaatttaccttcagagaatttaaagtaattctaatgtaacctgctgaaaaattctaaagctacaagcatttggggatgtttcatgagctgtgactgaaaaaggagaacacaacctagtaacaaaactctttcacaagataatctgaaaagtccaattaatcattcaccctaaagaacacatttttgtttaagtgtctttaaaaattcaatagaacatctcacattgaaaaacatttgtgccaatggggaaaaaaggtcttttaaaagtactatgagttactaaaccagaaatgtattattttaaagaagttaaagaaatcctcaagatgatgttttcctctttatttttagacctgtgaaagatatgtttttaaaagttccacttataaaaaaggcaaatatattacagaaaactagatcattttttggctatttctaaatttgttcagtatttgtttaaggctagaaagtcataagcttcaaccaatcatattttggctcagattttaagttattcatatttaatatctgttctttatagcaaaaatacatgactcttctgcaaaaagaaaaaaggaacacccaacttattaccatagaacaggggtcagtggacaatgacctatggaccaaacagagccatggcctgtttttgaaaggcatgctcccaaagaatagtttttacatttttaaagggctgttaaataaacgtttatgtgtgtgtgtgcatctgtgtgtgtgtgtgtgtgtatgatatgtatgcatgacagtgaccttatgtggctagaaaagcctaaaatattactgtctggcccttacgcaagtttactgaccctgtcagaatataaaaagttctttatacaggcatgccttattttgttacattccattttactgcactttgcagatattgtctgtgtgtgtgtgtgtgtgtgtgtgtgtgtgttttgttttgatttgtttttttacaaattaaaagtttttggcaatgttgagtcgagcatgtctgttagtgccatttttccaacagcatgtgtcacattttggtaattcttgcaatgtttcagacttttctattattgcatctgtattggtgacctgtgatctttgatgttactattgggactggcttcggggcaacacaaaccctgaccttctaagacagtgaacttgataaatagatgttgtgtgtgttcttactgctccaccaactggcaattccttcatctctctcccggagacttaacaacactaaaattgggccaattaataaacctcaaaggcctctaagtgttcaagtaaaagaaagcatcacctgtctcttactttaaatcaacactagaaatgagtaagtttaatgagggaggcaggatgaaagcagacagaccgaaagccaggcctcttgtgccaaagagccaagttgtgaatgccaagcaaaagttccagaagaaaattgaaagtgttactccatcaaaaacatgaataagaaaacgaaacagctttaatgctaatgacggagaaaatctgagtggtctggatagaagctcaaaccagccacaacattcccttaaaccaaagcctaatccaggtcaagctcctaactctctttaattttgcaaagaccaagggaggtgagaaagttgcgttggaagccggaagagtttggttcatgaggtttaagaaaagaagccatctgcataacataaaggtagaaggtgaggcagcaaatgctgatggggaagctgcaacaagttatccggaagatctagctaaaatcactgatgaaggtgaatatactaaaaaacaaaaacaaacaaacagattttcaatgtagacaaaacagcaacctatcgcaagaagacgccatggaggactttcatatagttagagaggagaagtcaatgactggctttacaatctcaaagcacaggctgactgttagggaataatgtatctggtgactttaaattgaagccaatgctcactcactattctgaaaaattatgctaaatctaccctgcctgtgctttataaatggaacaacaaagcctggataatggcacatctacttacagcatggtttattaaatacttcaaacttactattgagatgtactgctcagaaaagattcctttcaaaatattactgctcgttgacaatgcacctagtcacccaagagctctgacacagacgtatgtagaactagattaaagctgttttcatgcctaacacaacatcctttctgcagcccaaggatcaaggagttacctcaactttccttattatttaagaaacacgttatgtaaagatatacttgccatagatagtggctcctctgatggatctgggcaaagtaaattgaaaaccttctggaactgattcatcattctagatgtcctaagaatatttgtgatttatgcaaggaggtcaaaatatcaacattagaaggagtttagaagaagctgattccaaccctcacggatgacttggagaagttcaagagttcagtggaataagtaactgaagatgtggtagaaacagcaagagaaatagaattagaagtagagcctgaaaatgtgacttaattgctgcaatctcacaataaaactttcatggatgaggagttgcttcttacaaacaaagtaagtggtttcttgagttggaatctactcctggtgaagatgctgtgaacactgatgaactgccatggccaccccaaccttcagaaccaccaccccgatcagtcagcagccatcaacatccaagcaagaccctccaccagcaaaaagattatgactcatttaaagttcaaaagaatgttagcattttttagcaatgaagtattattaatttaaggcatgtaggttttttttcatcacaatgctattttgtgcttaataggtcattataatgtaaacataactattatgctttggggaaataaacaaaattctagtgacttgctttattgagatatttgctttattgtagtggtctagaaccaaacctacagtatctctgaggtatgcctataattaaggtcttatatgtgggtcactgacatcatactacactctaagctgccaaagagattgagtcagaagattaatggatgaagtatgaatgaaaggcaatttttaaaatatctttaataatatttacagcagagacacactattaaaatctgagatatggcagcatcaagttgtcaacgtgggttccagaaattgatctaccctcaatacttgaaaatactgaagttttagatgggtgttcatctcacagatggggtttaaaggagcataacgtgctatttcatacacatgtccccctccctctaatcctccactccctttttgccagaaatagtcttacacgtcattcaaacacagaagaaatgcttctttctcaatgaatactctaaatcatggggccccaacccccggggccatggaccagtacctgtgaactgtgcatgagaaggatctaggttgcatgttccttatgagaatctaatgcctgacgatctaaggtagaaaccattcccactctttcccagtctgtgggaaaattgccttccatgaaaccagccctggtgccaaaagggtttggggaccactgttctaaatcctccaaattaacaaagttagttatccccttcaaagctttcagaactttctgtacaattattttttatagaacttgtaatactgtattatatttttgtttacttttcaaagatttttgaattcctggtagcaaagaccttataaccactaacatttcacataatacattgcccatagtgagctgattaatttcctgtggctgccctaacaattttccacaaacctgatgactaacaacagaaattattctctcacagttgtagagaaggggaaaagcaaggccataactccttcaaaggctctagaaaagaatcttttccaccgggcatggtggttcactcctgtaatcccagcactttgggaggctgaagcaggtggatcacctgaagtcaggagttcgagaccagcctggtcaacagggtgaaaccctgtctctactaaaaatacaaaaattagccaggcgtgatggcaggtacctataatcccagctattcgggaggctgaggaaggagaatcacttgaacctgggggacagaggttgcagtgagtcaagatcatgccactgtactccagcctgggcgacagagtaaaactctgacaaaaaaaaaaaaaaaaaatcttttccttgcctcttgcaacctctggtggctgctggcactagttggtattccttggcttgtagccacatccttacaacccctgcctctgtattcttattgccttctcctcctctgacgcttgtaaggacacttgtcactgaatttagagcttacctgagaaatccaggatgttctcatctcacatctttaacataattacacgtgcaaaaaccaccttccaaacaaggcaatattcacatattcccaggattcacacgtgggtatatcttactgagatttaccattccacactctatcgctgccatacagtaaacatgtgctcagttttcttaccttacacccacatgaaataaacttatagataaacccaaaaatgaggaaaagtggaaacaggaaaacttaatttcttcccttctctgctaatatcctctttgaaaaggaaccactgaggcatagccagaaagcttcaccagcattttttttactaagaaattactaaggattacttaacacaatgcccaatgacagatcactggagaccatttctttgctcctagggaaaaaaggccagagatatattttcttcctcacaaagaaacactcttattcacatcgagtgggaacctgctttaagtgaagtttcaatttctttaaattctttatacgtggccatgaacattttacagcacgtgtagttttacatgaatggtagaaagccaaactactaagaatttatccttacaggaaatttaagtgtttaaagccttacctctcaagattttaggctttcatttgaaacacaatcccttgcacatcatgaacattcactgagaataagttgattcccatggctatgattgtttcctagacacagtttaagatgtcatagcagaacttttcagaaagtattttaatcttacaaagatcaaagactgctatgatcttcaaattagggttggaaactaggatagaaatttcaaaacttctataaactataattaggcctgaaataattgttctattcaaggtttacattattaactgaagggaccaattaactattaatatagtactatctagcagattataaaataatgctggcaatataatgtatccatagactcaaactcttcaaataaaacatccctaatatcccaccataccagggaaccaagataatgaaaagttagccaagagcaaacgtaagaaaaatgtcaatcaacttgctgcaagatttggtaaaaaatctattttctctactcttatcgcaacataagttatgaaaattccagtcaattagccaaaataatgtaataatttcaaacagaattattggtatttcctctatttatcagtttattaaaaaaataaggtttaaagaaagactgattctgatcaacttgattcacaattagaacagcatctaccctggtagcaaaaagaacactcagcacccagtccatggtttctagatatcattctacaatgaaatgagagacccttgaaggattggctgatttggtagctgtggcagggaaaatatgagatgagcctggagtatcctgtaataccagaaagttaacaaagtattcaaaaacaaaaggacaaggggatgtcactgggccacaagagcaaatctgaaagtggtctttggtcaaaaccagaaaaatctaaataagagactaacacagtattagcttatgactccacatgtaagatatatacgcatgtacccatgccaatataaatttaaaaataaatgggggagaacaaaataatctatagaattctaaacatgatatgtagttattccttaagagtaggcaagacttagtgactcacttccacagaacagagtaaggaaatggaaaaaaattacagtagagaagcttggcaaataccactttaaccaagtaattaaggttaagatcatcagtggtatcttgtggatatcatgatatgatacaatgataccccgatgtgatacactgagaagggttcgtcacctatgtgatattgttttccaataccccctaagccagtctaaccatgagaaaagcatcagatgaaccaaaactgaaggacgtcctataaaatacctgaccagtactccttaaaattcttaaggtcatgaaataaaaagagagactaagaaactgccacaaaacagaaaacttaacaggtgtaacaactcaaagcaatatggtacttgtttgtatcctaaaagagaaagtagacattaatggaaaagccagtgagatccaaacaacaataacctaccaatgttggtttcctggtcttgataaacaacgccatggtaattctactaagtgtcattacacattgttagtttttgtatgtgtgtgtatgtgctttttgaagtccttatctgctagacaaatatattaaagtatttatgggtaaaattatatgtctgaaattagttgttcagggtgagtgaggccagagatttatgaaacaagatggcaaaatgttgagaattgttaaggttaagtctgggtgcatgagggtttcttatactattctcactacttttgtatatgtttaaaatttctcataataaaagagatatttcaaaatcttttaaatgtctatgatttagtcaaccttctttaaataaaagccacacgtctcacaatgcttaatgaactttgcaaagtttgttacattgttaaataaaattcttacgcatcaaaaacacaaaaaactttttaagtgctttattagttatgttgtaaaggaaatctggtttcctctgaatggtgtgactttccatacattatgttaatctatttcctggtagataagagaatgaaggacaaagtggctgactcagttgcaaaggctggtaggtggaggcaatgaaagagaaatgcactctcacattacatttattaaattatggtcaaaaagtttcaaaactgatacgaaaatggaattaaaccagtccctgtgatatattatcacccccgccaaaacccaatttacaaatcaacctttccaacatcttaattgtaagagggtgcaagtctgttaagataggaagctgcacatgctcatgtgcacacacaaacacagacctcttcccaagaacaaagactacaaagagaaaaaataatgaaagaaaagatgtagtacttgaaagatccaggagaccaaacacgtgaagagaaaactaaaggagaaaaagaaacaaataaaaggaagacaataataatacatcaacttcttaccataataattatttatctcagtatctactgttctcttatatataatggcaggaagtcaatcaaaaattacaagggcagggcacaatggctcatgtctgtaaacccagtaacttgggaggccaaggcaggcagatcacctgaggccaagtgttcaagacccacctggccaacatggcaaaaccccatttttactaaaaatacaaaaattatccaggtgtggtggcacgtgcctgtaatcccagatacttgggaggctgaggcagagaatcacttgaacttgggaggcggaggctgcagtgagccaagatcacaccactgcactccagcctgggtgacacagcgagactcttatcgcaaaaaaaaaaaaagacaagacagaaaaacaaagcaagaaactacccactgtcaacagataaacctgtcaacacaagcagaccctgagatagcagagatactgaaactaacaaattgagagttgcaaaataaatataagatgtaaaagaatctagaggaaagggtagaacatgcatgaacagagaaattaagcaaaggggtcataaaaaatgctaggcaaataacttctatgaaaaattaagaattctttcactgagctaacaacagacctgacacagcaggaagaattaggaaacttgaggacagatcaatacaaattattcagactaaaacttgaatagatgggggagaggtgcagaagattcaagacttgtggggcaataccaagtagtctaatgcgcttgtcaacatagtccaaagggaaaagagaagagaagggagggagagcaatagaaacactgaaaaggtaatgggtagaaatttctgaaaaactaagaaaaacaataaagcagcttagagaatccaacacatgataattataaatgataacacacctatatgcatcatagtaaaactgctgaaaaccaaagttaaagaaaaaactcctgaaggcagccaaagaaaagaaaaaaaagaaacattacatatagacaaaaaaaaaaagaatttcaaaagatatcttttcagaagtatataaatgagaggatactggagcaatatctttaacgtaatggtggaaaactgtcaacccagaattgaatacccacctaaaacacttcagaaaccaaagcatatagatacctttacacaagcaagagctgagaaatgtcattcccagcagattgcactgcaagaaattatttaagtaggccaggcacagtggctcatgcctgtaatcccagcactttgggaggccaaggtgggcggatcacctgaggtccggagttcaagaccagccaggccaacatggcgaaaccctgtctctactaaaaatacaaaaattagctaggcgtggtggcaggcgcctatcaggagctactcaggagcgtgagccatgagaattgtttgaactcaggagacagaggttgcagtgagctgaggctgcgtcactgcactccagcctgggtggcagagcgagactgtctcaaaaaaataaaaaataaaaaattattatttaggtaaagaaagaatttatttaggtaaaattaatatgatactatataaaaacatatctacataaagaaataaaaaaaaccctggaactagcaaaaatatgagcaagaattttaaaacatatttttgtctgatattgaatctgtattaaaggtaacttattatttaaagcaaacacagtagccaggatggataggctataacatgtataagtaaaatatatgaagaaaatagcacaaacaatgaaagagaaaaaaatggcaatatactaagattctgctatcatacagtaaggtaaagtattacctgaaggtaggctgtgagaagttaatgatgtatattagagtcactactaaaaatacaaaacaaacagattaactaataagccaataaagaagattatataaaatactaaaaaataatcaagcccaaatagagcaagatacaggtgactatgagggaacaaaagagaaaaatagaaaacaaatagcaagttccagaaacccaattatacaaaaagtattttacattaaattgccaaaacactccaaataaaagttagagatggtaagaacagaggtcaattcactaagaaaacacaacaatcctgatgtgcacacacctaataacagagtttcaaaatacataaagcaaaaactgacagcactgaaaagagaattacagaaattcacaactgtacttcaatactttcccaataactgacagaataaggagtcaaaaaatcagtaacaatatagaacaatatagaattctccagtaaattctcccatacttttatggaagaaatagtaccaattctacacaaagtattccaaaaaatagaagagaatgaaaaacttcccaactcattatacgacgttatgaataccctgaaaccagtatcagatgaatacattaaaagaaaagaaaaaagctaatgaccattatcccattaaacaaaacaaaacaaacaagcaaacaaaaacactcttaaaaatcaaatccagctatgcataagatcaaagcttatgtaagcaatgcatatttttgaaatataaaaaataaaacacgagcaaatgaaaaacatctacattcttgaattgagataatataatgcattgcaaataacattaaaatgttaattatcccaagaatatatataatttaatgcaatcccaattaaaatcacaacagggtttttgaatttttttatcccaggagaggtgtgatgatggataaaatattcctcacatatgaatgctagttgcaagtattagaatacctaagaaaatttataaagaaatccaggtactactggatatatgaaaacattacatgacaaatgtgaaatttatattctctggaaaaagaaaaagactacctcaaaattgctgctgatacaatggtatgtctatgctctgaaattaaaaagtagactccctctcttataccatatacaacaataaattccaaatagattaaagacaaaaatgggggggaaaattaaatctagtgaggagattacatgcctactttatcaatggagaaaaccttaaaacaggacaccagagagaaagagaaggaattgcttatatattttaaaggttgtattcaaaagatacttcttgaacaggcaagagataaaagatcagcttatgaaaaaaattacttgcaatggagatgtcaggcagatggttagtggctttaatataaaatgaattcccacaaaaggacaataaccaatttttttaaatgggcaaagaatatgaaaggacaattcttagaataattctaattttcctacaaacatcacaaaagatgttcaaagtcactaacaatcagaaaatactaattccagtaacagtaagatattaccacacaattatcagactgggaaacatgaactattactgatggtgattggggagagcgtatttgcctgcattgctggtaataatatgaattactatatccttgtcaaagcaatgtggcaacatttatgaaaattgatacatcttgaatggatggtcctatccctgggaatctattctttaggtctctcagaagatacccataaagttatttattacatcattagtttaaaagcgacaaaaactggaaacacagtatttccctctaataaatgagtgagtagactatgaaataaccactccttggaatacaatataacaaatttttaattgattagaacagtagcagctgagaaggatttctcttaggcagcactgaacaaaaaaagataaaagagtttcaaaaaaactccttccatttttgtaagcagtgactaaaaactgtgtatgtgttcctaacgcttaagaacatggataaaaatataaaaggacacataatcgtgctaaaaacataagttatggactaatggaatgctagttttggctagaagaaaaagaactaagtaaaagacaaaacaggtcactaaaaaaaaaaaaaaaaaaagaatgaatttaaaagtttccatacaagtatacccacttttatcagaataatatatttgtaaacaatgcccattaaagcgagcttttgcaaaacaatgcttattttctaacgatcttcagttgtgtttctttgaaaacttaaagagtcacagaaataaaaagataaaaataaatcacacgtcaatatcataaatacctatctgtgtgttggttggaaacataaaatgaaatgcgtttaaaatgtattatacacatttaagattaaaaaaatgtgcaaaaagtttttgaaagaaaaaacttacgaaactacatacctaaataggaaaagtttttctagtaagattaaaagtactccaaagagactacggcataaatctaaaaatatccagggtaccttctaggcacattaaagatctaaaagaaataaactaatccagaatctatcagcttgggcttgcctttcggcttagctatcctgcttctttcttgatctgcctacattgtaggacaaagcccatgttttatctacgtatgtatttacagcacctagcacaagccttggcacatggtaaatgccctaactttcttcaaagagtatggatgtctctaactgcacactctctattccagggtcaacgggttgatctctctgggctgttacatatggattctttctacctttttaaagtgcattttggaagaaggtaaaaattcatctgatattcactgggcatttcatatgagctagacactagtgacacttcttttatgtaatgtggacttgcaaagtttttacttatcgagactaaatgaaagtcagaaagacagtagtaattatgcaatgggaaaaaactattttactggtgttggcaattagggttctagttctgccaatttctagacttttaccttctcctgattttagtgttctcatcagttacatgggtaacatgtgttcaatccaccatacagaactatcaagatgaaactaaatccactctaaaccaccaggcacaaagcaatttttgttgttgttgttgttagcccatacttatcaagtattctaaactgtcttaattactgttatttataaacaaaacacaaggtaacggcctcagcctaaagccttggtataattccaccacactcaatatagtgctaaaaaaaaattccattaatgcttttaatcgactcattgagttcatttctttcttcaatgaaatattttgtgtttgctaaagttacttgtattcatatctaaagcagaagagctaatgcatattccaaagtctgttagccttgaaatatccacctacttcaagcttctaaatatcccttcaagcaacacttctgataaactgcaactatgatcttctgcaaaatttatgttttcaagtttttccttccattgttctcacgttttacaaaattgtattcctcttaatatttaaataatattttaatacaaactaaatattcccattatttaaaagatttttttgtcaaagttaaaattccgatcatttaaaagtaaaatactacacattttttcaaaaatatggaagaccttcattagacagcatcacataaagtgcatttaaagttgtattcatcagtcaactttctttgcttttgtagcccaaataaaccatctgtaaactcattataacaccatataccctattggccaagcatatcctagaatctatttttggaaaagaaaacttcctggtgatacggcaaatgataaaaatttgccaaaacaccataaaaccatcagctctaaaagataacagaaaaaaataagagggaaatcaccacagctgccaaaatatgtttttaatttgcattcatccattagcaggtttgctttttctattaaaaaatataaactgggccgcgtatgttggcccacacctgtaaccccagcagcaaggcgggtggatcacttgaggtcaggagttggagaccagcctggccaccatggtgaaacccgtctctactaaaagcacaaaaaatcagctggtcatggtggcacacacctgagtcccacctactcggaaggctgaagcaggagaattgcttgaacccaagaggcagaggttgcagtgagctgagatggtgtcactgcactccggcctgagcaacagagcaagactccgtttcaaaaaaaaaaatatatatatatacacacacacacacacacacacagtttatatttaaaaaacacactgtttatataaaaagatacacatacacactgtttatataacgaatcttttccatatatctactaaaaccctgaaacctcaatttcccagatagaaacaatttttccccaggtgctttaaacaacttacagcacttggtccatttatcacaaattaccttacattataatgtgccacataattcttaccccaccctccttgattttcagctcactaacgatactggatattgtgctacccattttcatataagggtctatagatgtagtaggagctaaatacgtgtaagtcaaacggataactgaggcatgttctaataaaaataacgttattattatttgtattatgtccctaactttgatagctttatccaatagcagaatgcatattagccagaatttattggtctactattaccactgctgcagaacatcctatagcagtttacttctaaaataattttttggataaggtatcataatttgttttactacatatatcagcaaacaattgacttctttattgaagtatatcttgtagtaaacgtattctagtaaacacagtatgtcaatatgatctacaacaaatataataatacagcctctaaaccatatttatttgtataatccttccacttttgctttattctacagtaaggctaactctggaatattacgtttaatgatagagggaggtaggagtaacacaaggggaaagtccagggggctttctagcgttcagctctctacagctaactggctattcactataatttcattactttactttgctgaaaatcaatttccacatctatgaaataaaaatcataatacagttcataagagtccaacaataaaacagaaagcataacatagtgcatatagcacatatgtgctgtattacatgtcatataacatatactatacatgacatataagttgtacgattcaaatatatattaaatgatacaaatacatatgatacataggctatgaggattactatacctatattatacaaatatcattgaatatttatttaataaaggatggaatctaataattgtatgagattttgtacgttttctcctgaaagcatacaaaactcaaatatgcagaagtgaagggaccagacatgttttaaaggagactcattctcacagacaaaaggaaaatcacaaaatctgccattatatacaatctattagtcattaaaagtatttgtattttttgtgttctatttcatttttttcacaatttttttcacaattcatcagcttaactccatgcagcacttccaataaagattcatcactttcagcacatctaatgattattgtctcaattttatatcaagataataaactttctcataactagatgctttcatttcccctttttccacttgttttgttaaaataaggtaaaaagcaataaaattttccaaataatttttgaaatttttgccaaaagtggcaaagtcacagttctgtagcaggtgggggttacttggcaagacagcaacacaaacagcccaaaaaaggcattcatcaaatgatgttcgtaagtcaaaatccagtatataaatggcatttcagaggtgacacgtatagtattccatgtgccagttatttgaaaagtcaatgatataaaagccaagggctaccagtacctgtttactaaagagtacatattaaacacactaacatatgaaaaaccaagttcttaacttctgtattatactaggtatacaataaggagtattttattttgtacctactatttactctgaatggctgtttgttgttactgttgttttagagacagggttttcaaggctggagtgcattggctcaattgatcatagctcgttgtagccctgaactctgggatcaagggatcctcctgcctcagcctcccaagtaactgggaatacaggcacacgccaccaaacccggcctgaatggcagcttttaagagagccatcaatacactagagcaaatatttataaatgcagcatggtttaattctactatactacaagatttctttttgcaagaagacataaaaaattttttcagggaaataaagtgaatcgaggaatggttgacagcgttgaatatatttagctacttagggtggaaaagaccatgataggggcatttagaacaaggcaaatcaacaagcaattaacaccagaaggaatactatgagttgtggggcccgagaataccaaccggaacacagtgtattcttaaagcaggggatgataaataagagagtcccacaaaaagtgatgctgatgtttgcagtgataattgtaacatgaattggagtcaggcaagatacctgtaacatggaaagagtctaaatcagttatattgaagagatagtttgagtttgtttctttgctcttgcaagggtttaaaaaaattgtttttgtttcttttttaactggagaaaatgcagttgcggagaaatcatgcgtgattataaataggtattcaataaatgtacaaataacgtgtaagatcctcattatctacctttattgtgcattttgtataatgttagttaagaataacatatagcatgttgcaacaatgtttgagtctaaccaagtgacttttaagccataaatcagacatagcttaatcaacacaatcttgatttaactggggatttgcagttcaatgtactgcttgaaattatagtatatcacaaatttaataattctatttttaaaattaagggcattctttttaatgaccagttgatagaagcttcaggtgactcattaaagaagtagcctgcagattttcaatctctaatcattgttcatctttattttcaattttctgtaaatgatcatgtgaactgtaatttcatgtgtttttcttttgacaagcttggatacttcacctgtattatataaatgttaataatcagtaacttttataccagctacgttgaaactttttaagagtgactttctcaaggtcacagagcaaatctctggtgagacaggaatggaattcatgacctttgactgccagagttttctacccacactcggaaattccttccccataagtgtaatttatatgctcactttgagaaacaggaaagtttatccctttcaggggagggcagtgtgggggcggtggaggtatggctggagtgcttttcctatcaaatcagttgccacacaagaactttgtagttttacaaagtgacttttggccacattaccccatttaaccctcaccacagccctgtaaactacatattattttttccattgtataaactcagagaggttaagaaatttgaccaaggtcatccatagttagcaagcaagagagtaagaatcgaactgagatatttctgccactgaaattagttgtgattcaaggatgtatcatcttagaggttaccattcattgtgaaatgaaggaaggttttctttacattgttttcgaataatttaacttggttgccatttaggtttgttttctttaaggcagggttgtttttcttttgttacaagttagctcgataatttcaaagtgagcacagtattactaaagatagaattttttttaaagactgtttttcccccttttttatacacacgtgtggctttttactgtatttctcggtcatgaaattttactgtaattcttgctcttgtgtatggtgtgtgtgggtgggttatgtactaatatagatatagactacaaaaacacatgtaaaaacatataaagataaatactaaatatacacatacacatatagatatataagatgatgaatatatatgtatatacagtatgtagtcattcttcagtacccttggagggttgactccaggatcccatcccacagcagataccaaaatccatggatgctcaagtccgttataaaaaataatgcagtatttgcatataacctgtgcacatcctcctacatactttaaatcatctctagattacttacaatcacttatacaatgtaaatgctatataaagttatgattttatttgtatcatttttattgttgtatttttttcttgaacgttttcaatctacaattgattgactcccttaatgcagaacccacgaataaagagggccaactgtatacatatacatcatgccaggaattactgtgaaaggccatatatactgagaagcatggcaaatgtcacacttgggacacaattcatggctgtcaaagccagcaggtagttatcgtggtagcttctacagtcactgatagtggtggggaaactatcccaaaggtctcctaatttattccactctcaccttccatgcagcagtacagcagtaagggcttcctgctacttctgcaccagacagcaaatgtgtttggagcagtctaattattacactaataaatattcaaaaatgtagaccatgagagtagcaacaaaagaaacacatgactttaagttgaaaaaaaaaaaaagacaggaagaaagaccataccagagcagaattctttgggtgaatatcctgtaatctactgccgaccaaaacaaatttttatggagcaataagactactcaagtagccactttatgacaataaacacccaaaacggaaaaatccttttgtaacataattactgacaatatagagagaaagtaaccatttaatccacagcatgtgttctctaccacaagaactcaatagctgacatcagatggggtgtggccgacctaggccctaaaaatgaattctggcgggtggaagtcaggcagctctctgggctgggcttgggatccagaaacttagcaggtctaacagagcctaagactgttgaccttctgggcatagggcaaggcccatctgtttacttgcttgcttttgggaggagtggttgtggtagatgagttaaggctgtggttatagggcgttgccagtgatttaattttaatatttttacccttacattctgtacacagttaaaagttcaaagctgtgcataaattgcaggccgaaaaacaagtaagtgtgagtttgaaaggaaaaataaacactgggcaaaaatataagccatttccagtctatgatcatacagtattttcaaatagaaaatgacagataagcaactacaacctatttcagacttattttaaaaattaaacttgtagccagcgcagtcgctgatgcctataatcccagcactttggcaggaggtttgcttgaggccaggaattcaggatctagcctggacaacacagttaagaccccgtgtctacaaaaaaatttttagctgggtgtggcagtgtgcacctgtagtcctgcctacttgggaggctaaggtgggaggatcccttgagcccgggaatttgagctatgatgatgccactgcagtcccgcctgggtgacagagtgagacctcaactcaaaaaaaaaaaaaaagctgttttctaagcagaaaaggtaataatggtgttgattttgaataaaactgtcttgggattttagctcatgttcattaatcagcatgcaagtggcaagcagaaaaacttataaacaaaaacttttcaaatgagtttgtgccattactagttttatagtttaatacacaatctacagctagatttatgaacttgactgcttctctcacaatataaagaaaacaaaccatttgacactccaatttaatgtgatcattgtaatattattaatttgcaaaaacataaagtcccatgctttccatgttgtacaatggaaaaaatgtccaggacctctatatgttcatctacttaacaatatgccttcactgggtaaggttaccccaaactctagattaaccaacactggcttgaattcaaaatgctctcagcataggcctagaggcctaagcacttacgttgtctctgcagagataaaacacacctatatttaaggccaaattatttcagtaagttgataacagcctgtttcatgatatactgtaacatctaaaactcactggagcctgttaaagtgcatactttccctgaacaggagtcagggaaaatatccctgagcaacatgtatattttcacatgaccagaacacgatggatattacaggccagatgcatgttcttcagaatgaacgtcaagcatcccgatttgttctccctttggcctggggagagtgagtacactagtgtttgcagaccttccctttcagcacacacataggctgcagctgtagtaaacaaccaccagccaagagttgctaaggtcaaggtctcaaatgctataccaggaccatttactcccaaatgatagtcattgctgtaaaaagaacttctggggagtgggaggtggagaatattaaggactcattagcacaacaatttttttcaataaacagtaataaaaagcattccacaataaagttcagctgactgcattgctaagtagtagataaataactgaaggttttcaaaaataaacagaaaccctcaagaatgttttgtttaacctgacatagccatgttggttacatggtcttagttcaaaattatgaaaattttatgtgaaaacatttcaaatttcaaattttcccagtacatttcataatagttattaaattggcagaataataaactgctttcctaatttttatatgctcaaattgctctttccccaactcaaaggagcttaatatattcaatctagtatcaagacccgtctgcaacaataaagatataacttacccaactgaaacgtctgtccttcaacatcctatttccactatgcttctacagtttgaaattttctaacctaaaagtatactcctttatcggaaccaatttctatgtggtcttaaaaaatgcacacaacatgtgaatgaggtctgagaatagcacaagcaagcttttttccttgagggagggggggtccactgttttaaataaatgtcagttctaaaagcgtttcttagaagacggtatacacccactcctcaaagtgaccactcctattcccatcacaagctgcttcttgctaaaagccaccaaatttatttcaaagcatttacttatctaaacaactctatcgtccagtaagaaaagggcatggaggcgtctaggtggttttgcagaatgacgtgtatttgattggcagatgtctaccgaagtcactagatgcacacgcactaaatgtaaatagagttgctcgtctctccgatgttacagggaaacagagaatcttaacgctggtgtaaaataaaatatcagagtgctcgccgagaattccattagccagtggaattatctaaaacaatccatacagaacgacactttagccatctatacagttaaattagagtgctgacaatactaactacgcaaactgtttatccagattacacattccgttgtattaatactctttaactcaacacagtcagcttttatcagctgaaataagactattactattaaagtatgcaaaactcgaagcgcagggtgaagggggttgggaagctgcagggcatataacaaaggaattggtactttttccaagcatttgcctcaaatgcactgcgaaacaaaactgttgagtgcaccccacccttttccccaaagataaaagttttcaaagttcttgcagacagctcgctacccaacaaaagcaggactgattctccccgtaggggagcatctaacgtgaacaccaactaatgtcgcggaggtcaagtctgaaccctcagagtgagcttctgaggcaagaagtggctcccaggccggctctgcgggttcccggcccgggtggacgtacaaagttgccccttgtcaactccggccaggtcccccgtaattgaaaataacagccaccggccagcccctggctacttgcatggaccaggcactgtagcaagtgacagttacacatcattacgaccagagacaataatgaatgtagcaccaggagcactattcatgccagcagtgtcatctccgccttaaccccttcccctccactctctccagcgcgcacacacagcccacacggtcccggtgcggagctattcatccaccccgctcgaggccggggggccaactacttccacgagccccccctcccccccaagttcagccctggggttttatttcacatccttggcaactgtcaggcaaacactgcaaccaacaattccactaggggtagaaaaacacttgcttaattcacgttacttgataacttcttctggaaaaaaaaaattaggggaggtggggaagaaacctccttctttcttctccacgaatccgaccgacgctacttgctttgcaacagcatcgcccttccccggccccctcccgcttcccagcactttccccctttaagaacacagaccaaccaaaatgatttaacttgagcagatgacagaaggaaaataaaacacgttaagagaatacggtctgatttgggatggcaaaaaaaaaaaaaaaagaggagggggttgtttattttgataagaaacggaatcggcacagacctgaacagaagctgcagagcaggagaaattgttttctttccctcacacagagtccccctctctctctccctttctctctctcacacgcgcgcgcgcacacacacacacacactcgcacacacacggcgtcacccgcgcacacgcacacgcagagcctctcagcggctctctgcagttctcaggaaatgaatggggggcaacccggggaactgttgtacttgcaaatgacttacccggatcacatgatgcgctaaatgtagggtgggccggtgggtggaggctgccgagttgcgagccccggtctagtgtggggagcctcgccaggcccgcatcgaattaccccggggcccagccgagggggttgcaggacgccgcttctcctccctcgcagcccgcagctcaggaaaccggagaggcgcttggggtggggtggggtggggtgctgtgagggggggggccgaaaacaagaaacccccaaacaaaagagctccgggtcctcctccccagaaacaaagccccgccgctgccggcgagccccggggtggggccgagggcgggggcggcggcggggaggggctcgctcagcaggcgctaagtcgctttattgccataaaatggggcccccgagccgctccgcccgaggattaggaggcgggctctgagtgtgatggttgaaatcccctgtgggaaactaacccctccccgctcgcagaggtagaaggcaacacccactgcccggccctcgcctccccgcccggaccgccgggctgggtccgcggcgcctccaccccgccccaccccgccccacccctgcccccgccctccggccccgggcctcggcagcgcttccctttcacctgcaccactttgctgcggcaccccaaataacccacacatggccctgggagctcggggagtcgtcggccgagggggcccgcgggggcttgcggcgggagggacccctggagagcaactcgctgggcaaggactcgcgccgagccgcgagaaagtctcctcttttgtgtcagagcgcgccagacaggcttaggagaattcggggacccaaaaagcgtgcagcccgcttgggcccccacccctcgccgcacccgcccgggtgggggcgcgcagtggagggagggggctgtcgcccgggtcgtccccgcggctcgcccgccagcgaacttggaaaggtgtgggcggagccggccgggactgtggggcagctcgcggggaccgcccctgggcgccgggcatcgcccgcgccgggcaacaatggggtcaggcaggggcagccccgcgggcggtgccccccgcgcgccggtggggcgggcggagggccgggcgcggcaggcaggggagtcattgtttgggttccggagcgacgcacgttgcgggcgaagcgggggcgccccttttccctgcgcttcaccttggcgggatgaatgggggcgaggcggagatgcgcgcctggcctcgccaccccagcgaaggggcccctgcctgcgccagttctgtgggaaagcacgcaaacttggaggactggggcagaggaagcgggatctgcagacccccgcggggcccgggggcggcggggaagggagtccagctccactgccccacgcccagagcggagccccaagaagcggacggcccggagccgagtccttgacgctctccccggcagcccctccctccccgcctccgcgccccggggagcggatccgcgggattgtggggcgggagagggaggaggcggccgggcggccctgcagttcccgcggcggctcggagggcgcggggtcagcgccgagccggagggtcggcgggggcggggagcagacggggcggaagcggccgggcgggcggggcgcgcggcggacggaggcgggaggctgtgggcccgcctcctcaccatcctaggtgagcgcggcgctccgggcacgacagtattcccctgccccgcgcccccggcccggcccgccccgcgtgggaaatcgccagggctgtgggaaggccgggaaggggaagtttgtgtgcagagagaaagctttgctgtactgtggcgtggagtggggtgggaagagaaacaagggagaggccgagaaacaggaaatgagaacgaaggcacgaatgtgagccagggccagctgggctccccatcggtgtggcggtttccagccacttcaggcgcggtgtgcgttcctaatgacaacaaaggcggcgtctgcctggtgcgttctctgcctcttgccactcctaggttctggggaaaatgggatgggtggtccaacctagaggaggggtcccacagcctaagatgcgtcttaggaaggcagcaggattcagaggaggggtctgtcctggtcttgaggtttcgaagaggaagaaatgtctgaaatttgtggagcactgctcgagtgaagtagcctcagcggcgggagcgggaaggcgcgggcgcagcgagggcgtcgggaacccagtgggactcgggggtgaggggttggtggttgctgcggtgcggtctctgttccggggaatgcagccgcaactcccactccctgatccgatcctgggcctagggtaaacagccccttacactccactacacccggatggaaacgacgtgaaaacacaagtttgaaaagcagcagaatatcaacaactgcgcaggatttcaacgagaaacttgcctctactagaatcactgtgaagtttccctctaggtggggcagggagtgaaggaagggagtttcactgtaagggtggaaggatgctgtaagaaattatgtcatcgtggcagttcttgtactaacagctctttctcgagtgagctgagtggcggatagaccataaatatattctatagcgagtgcttctgcacgtggaaaagcaaactgcactgccttcctatggcataagccacgggcttgttaggagagtgatgaaagatagaaaacaaactacaagaatccattccagagggataaggaaactaggggtaggtcaaggttagtatctagagtctggataccctgtgtggttaaaaaaaaaaaaaagtacatcaagcattggggggaaaagatgcagattttaaaaattgttgacagatatggagtagaaatcttaaggcaacttcctagctatgaaaaggaaaaggagaaaagagaaaaacaggtttagaagagagaatcacttcattgtgtggacttggggtgcgtgtaaaagagcaaaaacatttgaaataatacaaagcatggatgataacggagatcactagaggagtgtgtgtgtgtacacacgcatgcgtttccaaactagttcatgtaattctatctccatatagaatttagatttaaagaaaagtaaggtgtggacggaagggaagaagatagggaaaagtacactaccttggcaaaggtgcggatttttaatgtttagacctttttcctctctacctctgtgtttgcagagatgtgaaaagtcagaaaatgtaaagatggcaaatttatttcatccttaattcaagaggaccatgtaaaagaatgtgtagcgagaaagtacggtcatagaatttgggggttgaaagtatctgtcgaatccaatactatgtggcttcaatcctgtttaaaaccaagatgattttgataaagaatgataacccatttccctaactatatataaaaacttcatttacttagtcttagataaccaaaagaaggatgaattatgaacaaagaagataaagttgggtattcttaatttcttacacataacgcatgcattgagtttcttttacctaacacattgtccagaaaagaaaaccacacccaaacaccctcaaagcagataaaatatctaattcaaacaacaggaaaatttacaattagaaataatgttaatgtaaaagtaagtgttacctgcccacaaactttttgccagctcttcttatactcaaccagtggtgatactgtctttgtaaaattagtggttagaaaaatctttttttattttttattttatttatttatttatttattttgagacgaagtttcgctcttgttgcccaggctggagtgcaacggcgcgatttcggctcactgcaacctccgcctcccgcgttcaagcgattctcctgcctcagactcacaagtagctaggattacgggcatgcgccaccacgcctggctaatttttgtatttttagtagagatggggtttctccatgttggtcaggctggtcttgaactcccgacctcaggtgaccgcctgggcctcccaaagtgccgggattacaggcgggagccaccgcgcccggccagaaaaatcttttacagtattaagagcattacttatacctcacccagatttatctaaggtaaaaactctgttcaatatctgtgtacatttagagattgtaaggctttggattagtgaaaccatagatgatttagcactaatacgatttcaaggaatagggtaggaatgaagtcccttttagaggtaaaagctatgttgaaagattagaattaactagaaaggaaaataaagctgatttccagaactctgaacaaattttaaaatacaatcttgatttttttcctaaggccgaaagtgaacatgtactgttaggttttcaagcctctatttttcatatgtcatatcttggcaataatgtgcagcaaaggggaattttcctgttcaagtatgagaaagtgagaaagacatgtaaaagccttcctataactgcaaacagctggtgatattatgtgattacttggtaaacaacatgttttgatttgggggatgagctgtctgcaaattagggggaaaatgccatttcgtaactttgttttattgcaatcaatacagttttcggtccttctagtttaaatatcttcatcacatcttcagatgtgtcttcttttccaccttcctccagtcactttcatgcaggccttttccagactcacctccactatcatgtctgcttcccagctctgagctctgcatctagccccctttccctcacatgcactaattataacatatctgtctttacaaagccaagttggcacaaattagttacaacaaaatactgtgacacataaaggccccacttccatattcatacctcatactttcccctccagcctgggcacacaccttgcgatgatcttcctctgtcttctctggaatcctctaaaaacgattcctgcataccccacatacatgtatacatatccatcctctcaccaaaaagttatctttcccttcttggagcttcttgtggtataatggaaagagtgcttcagctgctgactagctgggctttcatcttctttctgattctctatttttccacctacttaaataacattttccccacattgaaagattaagatttattagatgcttacctgcgccaatgggagatatactggcccaagtaagcatccaataaatgttgattccctcatttattcttcaggttctcacacctttctacttccatgaagtattgttggctcacctattacatgtaacccctctcagaacaagagctgtactttaatcacctatttagcctttcttttaccctcacactgttttgcacatagtaggtgattaatgaatgcttcttgaatcaatgaaacaactataatatataaacatagaatgatatacgttaaaacacaatttagcagaaaacttgagtttccatttgggtgcacatattgaaaataacaaaattctgcaatgtgtcggtaaataccttttgaacattaattctggcagtgttcctcaagcaaccttcttctaagtagaagtttttatataaatataatacatttggagcattccattttctctttcatatggaattgtttaaaaattattcaattatattcctcttcattttttattaaaattagatagcattctactgtgttagattaaaaacattcaattttttaataccagaaggaaaattcacagcaaatttgttttaaaaaaaatgacatttgcaaattttgaggttataaacattagagctgtaaagtaataaataatctgcattttaaaatataataaattgaggcatatgagatctgaactataggtatccttgcttttttaactttacaaatgaaaatagtactctccatggaaataatttaattccactaaagtttatctagtttgcaaaataccactttaatttcatgctatatacaatacattaacctaggtattatattaagatgagcttagataaaactgataaataactatatagcacgtaacattagaattttcccaaatttttgcaattgtatttacataatagtgaatatcttagcttcttcttgtaaaaaaaatacaattttattttagatagtttcctctaagttgtgttactgaaacagagaatatgagtttatttttactgttatagaaacctactgtcaaattatttttcaaaagtattttatcagtttatggccagctgcaatggctcacacttacaggctcaatactttgggaagcggaagtgacaggattgcttgaggccataagttcgaaaccagcctgagaaatgtagagagactctgtctctaccaaaaataaaaaaaaataagctggaagtggtggcatgtgcctgtaatcccagatactcaggaggctgaggtgggaggattgcctggtgagctaagatcagcttaggcaattaagaacctgtctctaagggaaaaaaagcattttaccagtttacaattacactatcatatttgagagtgccattttccctgtgttcttgctagtattgggtggtgctttgaagtaaaacatcttaaattggtaaacaagaatggcttgagttttaattccttggtgaataaagattgaactctaggaatataaatgggacattggtggatgggatgggctgaatacaactcctgttgcatagcctcgctaagaaatcatgagaaactgatatcaaattgctgtgataagaaatgaaggttggagcagggtgcggtggctcatgcctgtaatcccagcactttgggaggccaaggcgggcagatcacgagatcaggagatcgagaccatcctggctaacatggtgaaaccccatctctactaaaaatacaaaacaaaattagccaggcgtggtggcaggcgcctgtaatcccagctactcggggggtggggggtgctgaggcaggagaatggcatgaacctgggaggaggagcttgcagtgagccgagatggtgccaccgcactccagcctgggtgacagagggagactgtctcaaacaaaaaaaaaagaaacgaggattggaagagggagtatagctcaggggtatagaattggactgcagatcaagaaatgaaggttggaacagctatgaaagacattacaaattcagactcttagaattcagcaacttgctattttgaggaaggggtacaaagaaaagagaatgggaaacgatcttatatttcattccttaattcaggaggattcatttttagttttgatagatttgagagtcatcaaataggtaattagttctaccatagttgaagctaaaatgaattagatagctgatagagaagaatagggagaaagaaatgaaacctggtcagaaacatggaaataaaataaaatgaaaataagaggaaacaagggagggagggagattatgatactgatttccatagctttcatctacaaacaatggaaaaacctaactaatgccagttaaagatacatatttttgtccatcccttgcagtgaaacaagaaatcgaaaaataagcagccacagttcaagactgtgcagctccctggcacaccaaagccccaatctcattttattttcctgctccctttcttaaatacagctgcccctccctctccatagtaggaagaaaaaaaaggctaagagcaaaaccaagtctgttccatttagaaagctttccagaagcatcaactgtatctctgcttatatttcaatggctggaaatgggtcacatgagttcctggagaccaaacacaggaaagcagacaggaagaagggtctcttggatggaatttggaacaaccaactggcagttgcctttttactatgtaatgtttcataatgttttagtcctaatcagtcctaaattgcaaaccactctattagtgaggctctctattgaattcttgctggcaaacagaaaaaaaaagaaaaatataccattggcttacaagttattggccatcattttaaggacattaactcataaactacaaaatagattgatgtttcttaactatattttctgcacaatgtggtcaatatgttattaaagtacacaaaccataatgtagtccattttaaatgaatccatgtgtgatttacctaaggcaaaatgtgaatcacaatttagcttcactgagttacacagtctgcttatggcttatccttccactccatgaatttacgtgtctttgagcaatggacattaatttttaaaagttggataagcaagtcacaattaaaaaggcaaatctgtgtctcccaaaatataagctgcgtttgcatttcatattcaaatgagagtgaagcagcagcacatgagctgatgcctgagagccagaaagacaaactgattgctggttttgccacttgattctgtgacctttgacaggttgcttaatttttgttggggtcagttttcctcccagtacaactgggttggcaccttctttacaaggatgtgaacaactaatgaggtcttccataccctcccttacaagactgtaagctctacaaggcttgacaagaattgtgtctgaccacttctcagttatcaccagtcctaacttggcactcagcacatagcaagtcctcaaagcttttcggtgaaagaatgaaagtaacttccaaaaggcctaggatattctgggtaccctatgatacctgtaaatatagttgcctaccagaataatagagttatttgtcaagaaaaataatctaaaggaatatatacagtttctgtactttagttcaataaaacgtatgtactcagttaatttaatttgtaaagatgagtatttagctagatttggtatgcatctctcttaactgatgcagcttccaagttagaatacatatgaagttaaaatgaatcatctctgtgtcctaatacaactttaaacttaaaatcaattcttaataaagaccttccttccttccttctttccttccttccttccctccctccctccttccttccctccttccctccttctttccttccttccttcctctctttcctccttctcctcctcttcttcttgttctcctcctcctcctcttgctcctcctcctcgtcctattccgtcttcttctccttcctcttcttcttctttcttctttcttctctctttctccctctttcttactctctctctctctccattaagacagagacaaattgtggataatttatccatgaagcatgaagactttggtttcctggtttttacattttatccagttcacaaattagttttttgatctttttatacagaattcaaatacaatttcattctcaattccaaataaaaatggccatagcaaataaagaaatgttactgtagagcaaatgaaaacttttcttaaaatctccttaaatgacactcctattttttaaaccaacagctattaagcatttactatgtgccacacaccattggaagcatttttcatataataattaatttaatcttcgtggaatcctatgaagctatactattgctttcatatcctcaaggtgagccttgctaatttattgcaagttgcaaaactcacaagcactcctggttctccttccctttcatctttctctatgtagtgcttatcatcatctaatacagatgatgcccaatttacaatgttccaacctacaatttttttactttaagaagctgtgaaagggatatgcattcagtagaagccataccttgagtgcccatacaaccattctgtttttcacattcaataaactacatgagatattcaacactgtattttaaaacaggctttgtgttagatgatttttgccaactgtaggctaatgttaagtgttctgagcaagtttaag

SEQ ID NO: 192 - DNA, 20823 bp, Homo sapiens
tctccctctcattcttttggaaagtcataaaacacttgagcatattaacaaacttttaaaaaggataaaaacaaatctgattaatgtggttagcccaaattaatcatataaatataaactttgtatccaatctattaatatttcttaaaaccagtgtctcaagcaattaacatttgaggagaagggctttagtcatttgagattggaatggaatggtattactggtatagttcaggaaactaactggagattaaagggatacctactaaaataggtggcaaacattaaagaaaagaaaaaacttagggcaatttctaattctttgactttgctcactacttctatagctacccttactagattaagaacttcctatatcagtaactacatcttcttcaataacaatcaagctgagaaacgaatcatcaactcaattccatttacaatagctacaaaaataactaggaatacattgaaccaagaaggtaaaagagctctacaaggagaactataaaacactaatgaaagaaatcatagatgatacaaacaaatggaagagcatcctatactcatggattggcaaaatcagtatcattaaaatgaccttactgcccaaagcaacctacagattcagtgcaattcctatcaaataacaacatcattttaatagaattatgaaacctaaacttcatgtggaatcaaaaaagagccccaatatccaaagcaatcctaagtaaaaagaacaaagctgggtcatcacatttcttgattttaaattatactacaaggctataataaacacaacagcatagtactgtataaaactagacaaatagatcaatggatcagaatagagaacacagaaataaagccaaatacctaaaatcaactgatctttgacaaagtcaacaaaaatatacacaagggaaaggacaccctgttcaataaatggtgctagggaaactggattgtcatatgcagaagaatgaaattgaatccatatctttcactgtatacaaaaattaactcaaaatggattaaaaacttaaatgtaatatctgaaactataaaaaccccagaagaaaatgtaggaaatctcttctagacattgacctaggcaaagaatttatgactaagaccgcaaaagcaaatgcaacaaaaacaaaaatagaccaatgggacttaattaaactgaaaagcttctgcactcctaaagaaactgtcaacagagtaaacagacaacttacagaatgggagaaaatatttgaaaactatgtgtccacaaaaagactaatatctagaatctacaagaagctcaaacaactcaacaagaaaaaaaaaaaaaccactatcaaaaagtgggcaaaggacatgaacagacatttttccaaagaagacatacaagcagccaacaaacgtggaaaaattctcaacatcattaatcattagagaaatgcaaattagaaccacattaagataccatcttacagtaataagaatggttattaaaaagtcaaaaaacaacagatgttggcaaggatgcagagaaaagggaacactgttggtaggaatgtaaattagtacaaactttatggaaaacagtatgaagattcctcaaagagctgagaatagaacaccatttgatctagcaatcccattattgggtgtctacacaaagaaaaagaaattgttatatatattaaaatcccctgcactggtatggttatcataacactattcaccattgcaaagtcatggaatcagccaaagtgtccatcaatgaatgactgaattttaaaaagtgatatataaatgcaatgtgatactactcagccataaaaaagaataaaattgtgtcttttgcagcaaaatagatggaaatggaagccattatcctaagtgaaatgactaagaaacagagtcaaataccacatgctctcacttattattgcgagctaaacaatgtgtatacctggatatacagagtggaataattgactttggagactccaaaagttgggagattgggagaggggtgagggatgaaaaattacctacaatataaactatctgagtgatggatatactaaaagcctggagttcacactacgtaatatattcatgtaacaaaactgcatgtttacccttaaatctataaaaataaaataaaatagaactttagaacagaagagtttccatacatcaataactgcatcttctcactttagttaacagactttagtattcttatactaatcttccagaaatgccaactaaaaaccttataacacatcttactaatgaataatctacttatgttctccacacgtgactaacttttgttaaacttaaaaaaaaaatcataggctcacatgaagttgtacaaatagtacctagagtcccttcacacagcctcctgcaatattgccaacttatttaaccatactacaaaatcaaacctaggaaattgacactggtgccatgttgttcgctagactacagaccttattgagttttgctggtttatacatgtactcatttgtgtttgtatctgtatggttcaatgtaatttatctaatgtatagattagtgtaaccactaccacagtccagaagaaaaattcttccatttatgattaacattttttcttttttttttagagacagggtcttgctttgctgcctaggctggattgcaatggtgcaatcaatagctcattgcagcctggaactcctggcttcaatactcccgcctcagcttcccaaggagctgggactacaggcatgcaccatgtgtatgaattacaatgttcatgtaatgaggcagaaatatgagccacatattttgtccttttatatttataaaatgtttaatttagttatatatgaaattaaaaatggaagcttgtgttttctagacaacaacactagacagtaatgcagcatttgaggtgagtggtgcaagtggtggtatagagcagaaagaaagatcaagtcaaaatacgacacatttatgtaattatgtcattttttccccaagtcacaagtagaagcagtgccattagaaatgtcaaaattttggatgaacctggaggacatcatgctaagagaaataagccagacacagaaaggaaaatactacatgatgtcatgtatgtagaaatcgaaactagttaaactcacaaaagcagagactagactggtagctgtcagggcctgggcggagggtaaattgggagggtgttggtcaaagggtaaaaagtttcagttatgcaggacaattaagttctggatatctaatgtatagcaatgtgactgtagttaacaatattgtatcgtatacttaaaatttgcagaaagggtagacctcagtgttcttgccatagtcaaatgatcaatcaaatggaaactgaaattataactatattaattaccttgactgtgacaatttcacaatatgtgtatatattatatacagtgtgtgtatctcaaaacatcaatttttactccttaaatttatataatttttgtagactatacctcagtaaagatgagaaaaagaaaaaaggcataaattgataaggtaaagtaattctttccaggaaatgatatgcataatttcttttcctcctcagtttccatattaaaggaaaaatgatattcagacttttgtagcacatctgttactaagttttacaattaacattactgatttcacatactgttgtcagaaaaaattgtgggattttgaaatgggggaaatgtattactatgtggcctgtctagttcatttttcaaggtattgtcacgtattattgctttttaactcctatataattctgtaagttgaataaaattgttaataatgcaaatgattctagtccatagaaatgaaatagtttctgtcaagtggaatgatactgatttttactctgcgtacagcactactttgcatctatctgtggattcatttcaaacttcctaacaacctgtctaagtgttctctgaattatgctttgaaccagttgtagcatcttagtggtccccacatttattaatgagttaaataaaaatttttatatgtgttgattttttcatttgtgtaagaattgtgactttacctttttaaaaatttatcttaatactattatgttttatattgtatcacattttaaacgtttgccttccctttctttaagttccagggaagcagcatgcaagacatagtgagaaaaaaaaagaaaataaaaatagttggagatcaacagagatgagatattaggattggattaaccatgaatgatttcttttgaacagctggatagagaattctggacttgaacagtagatacctgatgttttcttaattcatactgtggtgcctctcaagtaatagtctgcaaccctgagcttctgcttgttaatactttattagactgctaattgtaactaagtctccagttacataaactttgatatctaagaataacatgagccccccaaaaccactcccacatatgaaatgtgaagtttatttttttaattgtttatcgttgacatcttgccaccccagacacaaagctgaggccctctatggcatccgtgttgtttccgtctctatttctggatttgtagaattggacaatcacacttacttattattatgtagtcttctacctcttgctgaccacatttcccagtttaataaaaaaggaacttgtagttttgtccccgaaacccacactgtattcttccaagcaattatgccaccgcttacgcagtttcctcttgctggcgctctcttctcacgcatccttcacaccaaaatcataggaggaaatttgtctctctcactagtgagagacatgagtctagtgacattggtcttttctaagctctcagcacttttcacagaagagctctagtgcaaagttaaagctcaaacacatctagtgagctgaattagaacaaagagctgatgtcacttggtatattaaggtcattaggagtggaataattataagtgagcttgaaagcaacttatcttttccactctgctttttcttagccagtgatgggagtcagccttccattacactctctgttaccctcatacaacttaggcgttgacccacagttaccaggtgcctaacttgacagcaccctaaagggtgagtgtggagaggagcagagtgtacataaaaactgaaaaatcacagagagaaggagagaaagaagaaaagcaaagagaaaaggtgagagaggaaaataaaaaatagttggagattagcagagatgagatattaagggaagattattcatgcagaaaatggaggaggcaaagaatatttattttgtctgatccctgaaatctgaatcttcacattatactttgaaaggtttaaatattgaaagtattccaatgtgttaattttctcctttactctctgcctccctgtctcaattgtttgcattccacttaaagattgcattagaatggtggagattcttcaagtcactacagaactagattctctatgtcactggacaccccttccttctatcttgggattgctgcattttaaacatttctctgtgctcagatgtctccttgcaaggcctggtgccttccacacttgaagttatgagcctctagctcccaggactttcttactgtccatgctactgtgacccctttagtttgttttctcaaatgattttttttaatccacattttactcattccgcattatttaaagatgaattagtagtccaccttcaatgctaatggcataattcagactcataggacctttatgtctaataaaaatttttaattacctatttacaccaaagtcaatgagtagctctgcacttgatgacatatttttttttttttttttgagtcagagtctcacactgtcacctaggctggagtgcaatggtgcaatcttggctcactacaacctccgcctcccaggttcaagtgattctcctgcctcagcctcccaagtagctgggattacaggcaccagccaccatgcctggctaattttttgtatttttagtagagccggggtttcgctatgttggccaagctggtctcaaactcctgaccttgtgatccacccacgttggcctcccaaagtgctgggattacaggcatgagccaccatgccctgcccaacgatacattttgtttgtttgtttgtttgtttgtttgtttttaattatactttaagttctagggtacatgtgcacaacgtgcaggtttgttacatatgtatacatgtgccatgttggtgtgctgcacccattaacttgtcatttatattaggtatatctcctaatgttatcccttccccctccccccaccccacaacaggccccggtgtgtgatgttccccttcctgtgtccaagtgttctcattgttcagttcccacctatgagtgagaatatgtggtgtttggttttttgtccttgcgatagtttgctgagaatgatggtttccagcttcctccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaatatatgtgtgcatgtgtctttatagcagcatgatttataatcctgcgggtatatacccagtaatgggatggctgggtcaaatggtatttctagttctagatccctgaggaatcaccacactgtcttccacaatggttgaactagtttactgtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtctgttggctgcataaatgtcttcttttgagaagtgtctgttcatatccttcgcccactttttgatggggttgtttgttttttttctcataaatttgttggagttctttgtagattctggatattagccctttgtcagatgagtagattgcaaaaattttctcccattctgtaggttgcctgttcactctgatggtagtttcttttgctgtgcagaagctcttttgtttaattagatcccatttgtcaattttggcttttgttgccattgcttttggtgttttagacatgaagtccttgcccatgcctatgtcctgaatggtattgactaggttttcttctagggtttttatgattttaggtctaacatttaagtctttaatccatcttgaattaatttttgtgtaaggtgtaaggaagggatccagtttcagctttctacatatggctagccagttttcccagcaacatttactaaatagggaatcctttccccgttgcttgtttttctcaggtttgtcaaagatcagatagttgtagatatgtgacattatttctgagggctctgttccattccactgatctatatctctgttttggtactggtaccatgctgttttggttactgtagccttgtggtatagtttgaagtcaggtagcatgatgcttccagctttgttcttttggcttaggattgacttggcaatgcaggctcttttttggttccatatgaactttaaagtagtgttttccaattctgtgaagaaagtcattggtagcttgattgggatggcattgaatctataaattaccttgggcagtatggccattttcacgatattgattcttcctacccatgagcatggaatgttcttccatttgtttgtatcctcttttatttcatttagcagtggtttgtagttctccttgaagaggtccttcacattccttgtcagttttattcctaggtattttattcctttgtagcaattgtgaaggggagttcactcatgatttggctccctgttagtctgttattggtgtataggaatgcttgtgatttttgcacattgattttgtatcctgagactttgctgaagttgcttatcagcttaaggagattttgggctgagacgatggggttttctagacatacagtcatgtcatctgcaaacagggacaatttgacttcctcttttcctaattgaatacgctttatttccttctcctgcgtgattgccctggccagaacttccaacactatgttgaataggagtggtgagagaggttatccctgtcttgtgccagttttcaaagggaatgcttccagtttttgcccattcagtatgacattggctgtgggtttgccataaatagctcttattattttgagataagtcccatcaatacctaatttactgagaatttttagcatgaagggttgttgaattttgtcaaaggccttttctgcatctattgaaataatcatgtggtttttgtctttgcttctgtttatatgctggattacgtttattgatttgtgtgtgttgaaccagccttgcatcccagggatgaagcccacttgatcatggtggataagctttttgatgtgttgcttgatttggtttgccagtattgtaaatctttgtatgagagtgccagaagtcttattttatttcaattattttatttagtttaaacctaaagaagactttattgacccatatgatcaaagcacttaaaggatgaataaagctggcttaaggtacatgggaatcagaggcttctgtgttgccaggagtttcttcccgtgtttcccttctctattcttctagtttctgtggcggcaggtttctatgatcagaggatgtggttcccacacttccatgcttagcccgtattgtctccattataagagaaaagataccctcttttttcaggtttaattataaaaagcttaagggaaaggtgtcagggaaaaaaatcaattaaagctcgtgacatattattggaggaaatgataatctttcaaagttgttttcccattcatggagagttgttattgaatattttatgaaaaagttttagctgaacttttacactacctttagcctctgaaagaaatcacttgcttaaattaaaataaatagagaaggtcttatatctcagatgtgaatagcatcctacaaatatttatttttattcacactgtcacagctgagcagtggattccaaggatactgagggaggttataaaatctagaacattgaaagtaatctaattttaactgccactcaatgcagaaatcactgaaaagtaatatctttttccttgttgataaactcaataatccaaagaaaacacaaaggtcataatagttctataaatttatgatttataaatatacatttaaaacaagccaaagtatttctccctataactgtttccattactcacagttgtaaaccttaagtctttctgtcttctgtgctctctctctctttctcacacacacacaacacaaacacacacacacactgaataattaattttctcctatatttaaacacaaccgtaatgtcctccagtacctaacatttcatattttcccttttccatcataacatttcagatttattcaaatatttcataattttatatttaatcacctagttgacatcttctgagaaaactctaaatactcttttaaaaatgtaaacaaaaagcaaatatgattgtcagcaaaatgtgtcttccttgaaaacacaccaccattatgagtgtactctcaataattctgttaagaatccaaccagttttcatggcagaagacatgcacttgctcagtcttttaggcactggcatgcccggagaatctccccacacactaggcctgatgacattaccgatggaaatggatgtccaaggaaaagacgtctgggggcctggagcccccaaaacagatcacaaatcaaactttggaaaccaataaaagacaaagagaacatattggaatcaacagtaaatgaatttattacgtgaaacaaaactgaacttccatatactttataagatgaacttacgtgataacgaatcacttgtttcaaaattatagacatttgactctatattttgctcattcattaatttcacagtctgaaagaactagcctgtccagccagtacttgatgccagagaaaggatgaagagctagtagtaagaggggttagctcacattgctggaaatgcctatgataacagctctacgtagagactgagacactttgcttaaaaggtctggaaattcagcaagttgatctgcagaaggttgatccataggctggtctgtaacaaggagactggcagctcctagaagccaagtaggttgggcggcagaatccagatccatagccgagggaagggaagccacagcttccataacccagggatctgacaccactggacccacagcccactgagtagcagctcctcgatccatagcccagggagcggcagctgctggatccaaagcctagagacccagagtaagtcgtcttgcaaggactgcagagcaaggaggttctggggcggtagcaggaggtctggcaggggctggactccacataggacgtctggcagctggtgggctcccagcagatctcctgacagcccctatagagagaggaacccagctggcaggtgctgggagagcagaggtcagtgctgtagaccagattgctggggtaggaaaagccacgtgaggatgctgggtagcgcaggtagtcaccacaggagcgggaggagaagtttccagagcagcagttgtaggacatgttgacgggagatgtgagttcagctgagttatagtggaaagattctctgagtttgaatgtcatagtctggactccaagttatatatgctcttagacctgggtgtgtccactgtctcgacactcccttctccttgctcactttttattataagaatgcttccctaggttattgtttaatttatcacatcttcatatacttacttgtactttagtcactctggaacacttagaaggaagccactcagtttttttttttcctggaattcactgtggtttgaccttcaatgttatatgtcatcacatttatgagtatcttgcctcttattatttgagtacagtgagtccttattgtaccaaatggaattacacaaaattctttctttacttcccttaagttatcaggagcatcagtggttactactcaaaatagattgtccttctttttaacacaagcatattatttgttaccagaaacggaggatttctccaaatactaactgtattcagtagcctcagcaatctgtcagttaaaccttttactagtaccttaagagctcaggatcagaactgaggagtgcagcattatgttgggtgtccatatcaggcatcttccttaacaagaggctactttagacaatgctcacttaggaaacaataaacacaaactttttagtaagactttaaattgaagtttttcagatattttctgatgaacctatcttgtagcaagcactattctatggttatgctctaaatcaactcataaattttattttgttttatgtttcaatttttttttctggataaaaggacagattcttagctgcaattattaatttatacttaaactttgaggaattgttaacatttttctgaagcttttaacttgaagtattagagttatatgggtctttaaacatcccctgttcaacccatacatggaaaaattacctctcagagagctttaactttcccctaatttctcagtaagatagaagcaaaattgaagctttaattatggttttcttattcagagtcaagttgcaaataccttgcaaatataaaagtaaattcaactttaacttgtctcagaaaagaaactattaagcttatttatactaagatataaaagcctaacaaagccttatttacttttcctaacaatattcacactgaatagtgttcaactggggaattctatgccttactgatcttcatacatttgaagtatatttcacttcctagcccaagaaagagaaagaatattggtaatccatgtttagattaatggggggaagaggcttcttatctgtgtctattcttcttcttttgaatttgacattttatttggtttaactaagggaaatggcattcacaatggttatcgaaaagagagcctcttaactacctgaaaattaacttccttcattccaaagcacactgtttcagagcacttagttactttgttttatgattatctctcccatgcagaatccaaagtgtggcatgcatcacatgaagtgcccttgtgcaatacttaaaccatcactctgattcactgaagtaaaataagctgtgctttatgaatggacacctattaaattcaccaaaaagtatgcaccacccccaacacatgggattccttataatggcagcttttaacacctttaaaatgagaaatatttttcttttcttactacaggttgattctgctcaaaaaaaagaaaacaaaaaacttactaatatccaaaagttcttgcctttctagaccagctccctatgtctgggaataaacactaaaataacttgggagtaagtcagttccaattaacagtccctccacccattcctaattgggttaacactttttattaggagttatttgtgcactttgtacaaatgctaatgaacaactcccaaatgctaataaatgtgtccatctgaaaggcagaaaaagcagaacaaaactagagtagccttaacagttcaaaagtggattctggaactaataaaatactctacgtactctacatacacaggcaaagtattagtatagaaagaaaaattcactatcttgatatgtcagggaaaacgtgatattgaaatcttttctctctctctccttccttccttccctccctccctctttctttttctttttctttcttttctttctctgcctctctttccttttctttttctttcttttctttccctccctccctctctctctgcctccttccctccctttctccctctctctctttctctgtttctctttctttctatttctttctttcttttctctttctttctttcttctttctcttttctctttagaaatttaggcataacaacactacagagaataaaactatcattacagtacacagtagccacaagtagcctatgatctgaattacttgaaaagtgattgtttttccaagttaacatagtaatgtagcagaagctttaaactgacaatcttctattgcaatgtttccagagattcttcaaaagctttcaaattaaccaaatattaggcagtagtagaaatagtaaaaatccatatatactgccctataccttttttactttcttttttttttttttttttccgagacggagtctggctctgtcacccaggctggagtacagtggtgcaatcttggctcactgcaagctctgcctcccgggttcacaccattctcttgcctcagcctcccgagtagctgggactacaggtgcccgccaccacgcctggctaattttttgtatttttagtagagacggggtttccccatgttagccaggatggtcttgatctcctgacctcatgatccacccgcctcggcctcccaaagtgctgggattacaggcgtgagccaccgcgtccggccacctttttactttctgttcactttttaattttctgccttctctagacctaggagaggcttttattgtctggtcactaaagagtcttcataacagctgctttacactagattttatttttaaaattctcacccaaggggaaatgtatctattaaacattaatgctaactatgaagaacccactactgagtaaaggcttgatgagaactccctggactaacctgttcatggtctcttcccagtcccccatgcaagcctacccaggcctgtggctttctcggaggtcatccggcctcattgtttgagacttttccaggccctggcacctcctctaacttcactacagctcttcctgcttcaaattcatccattttatgtcttcatcatccatgactttcgtttgaaataaaaaggccaggctgggcgcagtggctcacgcctgtaatcccagcactttgggaggccgaggcaggtggatcacgaggtcaggagtttgagaccagcctttcaaacatggcgaaatcccgtctctactaaaaatacaaaaattagccaggcgtggtggcagacatctgtaatcccagctactggagaggctgaggcaggagaatcgcttgaaactggaaggcagaggttgcagtgagccaaggtcatgccactgcactccagcctgggcgacagagtgagattccgtctcaaacaaacaaacaaacaaaaagatttataaacagcctgcttacacacctctcggttcttcttatctcttctgagaccttacccttgcatttactgaaaacaaatagaaaattaaagtaaattctagagtcattttctggatgcctaaactcacaattgttaccacgttgtcagatttgcgttcatctttctcttttttattttaaatgtttatggatacataatgttgcgcatattaatggggtacatgtgatattttgatacaggcacacgatgtgtaatgatcaaatctgggtaactggcatatccatcaccttaaacatttatcattttttttgtgttgagaacattccaaatctacttttctagttattttgaaatatgcaatacattattgttaaccacagttgctgtactgtgttactgaacactagatcttattcctcctatctaactatatttttgcacccattaaccaacacctctctgtcctttctttccactacccttgcaagcctatggtaaccaccattctattcgctatcttacagagagagaccccttgtgggccagtctctcagtctgattctttttcatatctttccaaaggcatcacaataatgcattcgtttttgcatagcattccaggaaattgtctatacatatatttatcggtttataccatttattgttgttttaagttacaaaaatgccatcttattggatacatatatgtatctgtagctttctttttatattaaatttatttaaataaaaatatctaaaacatatccaagttgatatttatatatttgtgcatttattatcactacagtagaacttttaaatgtcaggcactgttctcagcactgtattacaaatattaactcaatcctcataataattctacatggtacacaccacttttattcttgttttatagctgaggaagctgagacacaaacagattgagttacttgccaaagctacccatgtagttagtagcagagatgagatttgaactgcaatactgacaccattgtcagactttatgcaaataaccatgttgctatgatacacacatctagtttattccttgttacaaatttatagaattctactgtataaaaatattttattgatatatcgctctaccattcttgattttttactatcacaaaccatgtggcaagaaatatacttctatataggcccttgcatctactgtctagggcttctggaacatgtatatttagatgcaattgctggacatacataatttcaattctagcatggtagttacgatcaaggcttttggattcaggctggcagagtttgaatcccagctccatcacttagctgtgtaactcagacctgttttagtttctcatattttgttatcttttagccattattctatggagtcatttgttcttttaaatgtatttttagagaatttgtgcattctttttgtatgcctttgtctttcatatgttgctaatatattcctctggtcagttgtttgactcttttgtaaagtcagatctgtggatacacagttcccataaaatgaaatgcaccatttttaggagtacagttcaatgggttttttcctttctgttctttttttggtggagggggcaagggcttgctctgttgcccaggctggagtgcagtagtgtgatcatagctcactgtagcctccaactgctgagctcaagtcattctcctgcctcagcctcctgagtggttaggactataagtgcataccacaacccctagctatttttttttcttttttttttgtagaggcagattctcactgtgttgtccagtttagtcttgaattcctggcctcatgcaatcttcctgccttggcttcccagttcaatgagttttgacaaacatatatagttatgtaatcatcaattgattgagatagagtatttccattatttctagaaattctcctgtgctcctttggatcaatctgcttccccaatatctaaatttctgttcctatagtcttattttttgaactgcatgataaaaggaattacacattacgttgccttctgtgtttaacttccttcacagagcataatgcttttgaaattcatccatgttgttgcatattccagtagtttattcccttttattgccaagtggtatttcattgtatgtacgctatacactagaaaatggacatttagatgattttgagtctggagttactgtggataaaactgctataaacattcacatacagataattttgtggacatatgtaatatggtttggctctgtgtgcccattcaaatctcatctctaattataatccccacatgtcaaggaagggacctggtgggaggtgattggatcatgaggacggtttccgccatgctgttctgatgatagtgagggatttctcatgagatctgatggttttaaaagtcccagtttctgcctgtgtatactctctttctctcctgccaccatgtaacatgtgccttgcttccccttcaccttccaccatgatgtaaatttcctggtgcctctccaaccatgaggaactatgagtcaattaaaccatttttctttataaattacccagtcctaggtagtatcttcatagcagtgtgataacagactaatacagagaattggtaccagcagagttgggtactgctataaagataaactgaaaatgtggaagcgacattggaactggtaacaggaggaggttggaacagtttggagggcttagaagaagacgggaagatgtgggaaagtttggaacttcctagagacttgttgaatggttttgaccaaaatgctgatagtgatatgaacaacgaagtccatgctgaggtggtctcagatggagatgaggaacttatagggaactggagcaaagtcactcttgctatgctttagcaaagaaactagtggcatttttcccctgctttagagacctgtgaaactttgaacttgagagagatgatttaaggtatccggtggaagaaattgctaagcagcagaacattcaacatgtgacctggcttattctgaaagcattcagttatgtgtgttcacaaagagatgctttgaaattggaacttattttaaaaaggaagcagagcataaaagtttggaaaatttgcagcctgaccatgtgatagaaaaggaatacccattttctgcagaggaattcaagctggctgcagaaatttgcataagcaacgaggagctgaatgtcaatagccaagacaatggggaaaatgtctcaggggcatgtcagagacatttacaggagccattgtcatcaccggcctggaggcctgggagggaaaaatggcttcatacattaggatcagggcttggctgctctgtgcagcttcaggacttgatgccttgtgtcccagaagctccagctccagccatggctgataggggccagggtatagctacagctgttgcttcagagggtgcaagtcccaagcattggtggcttgcaagtggtattgggcctgcagatgtgcagaaaacaagagttgaggtttgggaacctctgtctaaatttcagaggatatatgtaaatgcttggaagtccagacaatagtctgctgcaggggcagagccctcatggagaacctctgctagggcagtgcagaagggaactgtggggtgtgagctcccacacagagtccccactggggcactgtctggtggagccatgagaaggccaccatcctccagaccccagaaatgtagatccaccaacagcttgcattgtgtgtgtggaaaagccacagacactcaatgccagcctgtgaaagtagccatgaggactataacctgcagagccacaggagagaagctgcccaaggcattaggagcccaccccttgcatcagcgtgtcctggatgtgggacatgaattcaaaggaaattattttggagctttaatatttaatggctgtgctacatggggcctgtatcctttttgttctggccaatttctccctcttggaatgtgaacatttacccaatgcctgtacccccattgtatcttggaagtaactaacttgtttttgatttacaggctcataggcagaaaaggacttgccttatctcagatgagactttgaacttggactttggggttaattctggaataagttaagactttgtgtgactgttaggaaggcatgattggttttgaaatgtgagaaggacatgagatttgggaggtgccaagggcagaatgatatggtttggccctgtggccccacctaaatctcatcttgaattataatccccacatgttgaggaaggggcctggtggggggtgattggatcatggggggtggtttctaccatgctgatcttgtgatagtgaggaacttctcatgagatctgatggttttgcaagtagtaggttcccttgtgtgctctctctctctcctgccgccatgtaagatgtgccttgcttcccttttaccttctgctatgattgtaagtttcctgaggcctcttcagccatgcaaaactgagtcaattaaatcttttttctttataaattacccaatctcaggtagtatctttaaggcagtatgaaaacagactaatacaatatgttttcaattttcttaggtaaatacctatgcatgggattactggtttatatggtaaccacatgtttaacattataaaaaactgacaaactatattccacagtggctataccattttgcattccaatagcaatgtatgaaaatctcacttgtttcacagtctcaaccgcactgtatgtattatccttattattttgtctattctagttggcatgtaatggtgtcccattgtggtttcaatttgcatttctctaatgaataataatattgaacatttcctcatgtgctttttgcctcccatacttctcctttagaggtgtctgttcaaatcttttgaacattttctatgtgtgttatctcattataattatattcttactgtttttttacacagaagactaagattcaaatcctctatcaaagtatatgtttttacaatattttcttccagtctgtgacttttaatttcattttcttattaaagtctttgaaaacagatgtttctagtttgatgaagactaatttagctaaaaatctcttggtatatcgtgcatcagggtgacctggatgtgagacatggaatcaaaggagatcattttggagctttaagatttgactgcccagctggatttcagacttgcatagggcctatagcttctttgttttggacaatttctaccatttggaaaagttgtatttactcaatgtttgtacccccattgtatctaggaagtaactaacttgcttttgattttacaggctcataggcataagggacttgcattgtctcagatgagacttcggactgtggacttttgagttgatgctgaaatgagttaagactttggggaactgttgggaaggcatgattggttttgaaatgtgaggacatgagatttgggaggggccggggtgaaataatacggtttggctgtgttttcaccaaaatatcatctggaattgtagctcccatagttcctatgtattgtgaaagggacccagtgagagataattgaatcatcggggtggtttcccccatactgttctcacagtagtgagtaagtgtcaggagatctgatggttttataaggggttttcctttttacttgtctctcattctgtcttgcctgcctccatttaaaacatgcctttcgccctccatcgtgattgtgaggacccccacccacttggaactgggagtccattaaacctctttttctttataaatgacccaatcttgggtatgtcattatcagaagcatgaaaacagtctaatacaccatcttatcttggaattttcattgttagaatttttttactcttaatttaatttattttgtagatccagggctagtcaggctgtctaggtatttttgagtgagctctcttagtttgtgcctgttaagaaattttttcatttaatctgtggtattgctgtaagtgatctcagggtccagcaacaatggttatatcaatctgcttgatctgcagacatatcagaaatagtgacaacctgtctttcaaccataggaataacataagccattgctaggggcaccctggccagaaagtaaggcaagttcatttatattgtcttggacataaactgaaccaagaagagatgaaagcaacaatgtcatatttattatttcaccctattttgttttgtttctatgttaataacttctgccacagcactatacttgtccttttgtacagttcatgtgaataaaatattatcatgtatctttattaaaaatatgttaaaga

SEQ ID NO: 193 - DNA, 98357 bp, Homo sapiens
aaatgacctttcaaactatggagtctctaaagagagtttaaaaaaaaccatgtgatacaagccatactgtgtaatattggcttaataactagaaatcgatttgcattgctttccctctgttatggctcacgtttgaaagccaaagtaatagagaaaaataaagctatggtcaattctaaatataatccacaatgatgagttgttccaaaggtctatgtcctaccatttatcatgttttgatataaacctttcatcttctctatttacaaggatgatccatgcttgtttcttctgcacaaagtagactagagcaccccctggtgtttggatgatatcactaccctcttcagtatactagggtttctatgtttgcatgaagtgttaatatgagagaagtttgttgttgtaatgtctggcacttaatactgaattctagatccattagttgtgttataaccatcttgattttagggcatcattgatctattaattctcatctgagctcagaattccgaaaggttttccctaaatgttaccatcttcacccaaaatatctaaacatttatgcatagtctttaagtgatatacagttatccccttacatttcaagaaggactctttgtaattcaatattattgagaacacctacactgttctgagctgtggtaagtgttttgcaggcatcattatattgaatcttcacaaactaacttatgaggttctgttattatttcaaataataaatatatttcgaattttatttcaaataataaaactgacactctcagaggcttcataactcctaggttttcacaactagtggtttgcaaaggtgggatttgcagccagttctatataactttatgaactagagagcttacctagtctactatatagtctcattcttacatgttttattttgagttgttcacactcttgttttcaaaaataaaccagtcctccccaccacaacaacatctgtatggatcccttactttctaaaaatgaccatggggtccttttaattagaaccaaagttctaatactaacagacacttctgatcctaaacacaatcatgagacagatgaagtatttaagtccaaagaacccggcaatttcagtctaactcccttcgtcacctattgtcttattttagcttttctcatatgcttcctgccagatgcttttttgaacattatagaatacagcaagtatccatctgaaaatttaaaaaatataaagtattttaagtgtaaaattccttcaaggtaatccagggcttcttaaaagtcaagatctagaatgttgtagacagtaggtgttcattaattattttttgaatgaatgaattatacgtaaatgaagaatatacccataaattcagagtgatctgtaaaactcaagaaattgtgtgtgtgtgtgtgtgtgagagagagatgagatttcatgactaaaagctaaaaatcatctctatttgtctgagctctggataactcaggttagattccttaatccatttcatccagaacagagattttattatttactagttttttgactttgcatgtaagggtctaacatttaaatttgtgaatttcctcatgaagagacaactgaagaggtttttgcagaactgacctggggagtgatgctggagctctccagactggcccaggaagactggtgaatctctgactctgagctaagtgcagaccatccagaaatacttgctgaatgaaggactagatcttctaaattgccaagctgggtaatttttagagaaatgaaattttaggacattgatgctaaggttaggagggcctatcaatgccaagacttgagaaatagtagaggattggaaggacttctcagactgaactggattgtggatgcttgaagaaaaacttccaccgctgtttagggagtgtgttcttcataattctgtcctcttatgctatactttttttctccttttaagcagcaatatataggattcctctcccagttcaaatatagacagtctctaaagaccatctctctgatcccaaaaaacagaaaaaaaaactagttaaattacaaaatcaccatttattctttttaaaccccaaaagaagggagaattacaaaaccatcatttatctttttaaaccccaaagtaagagacactgggttttgcaaaatgcttttgcaaaaatatctttttgctggcaaatacccatcttggcttcatattttttaccacttgtaaatgaagtccaattctgctgaaattctgaaacgcattaatgcattgagtgatactgtttactgggaataagtaataattttcacatctcaagttaaaaccctttaatttgcctcctaagaagtggcctaggttggaaaacaataaaaacatctcaaagagaaagaagaaaacactgagagttagagaatattttactaaatttttaaagaatgttagctttgcatttgttcttggaagtgaatcagtaagtgaatttgtttctgaatatacacattcacaaaaaaaatcagttttttctgtttccattatataactattgaatgaatatttaaaagatattagtttaatatgccaaaattatcgacggcccagcatacaaaccagccttgtctgtttcagaaatagaagagacactggtgtttgagaggcacagggcactgaaagggctttagatttggatatatctgcatttgcgcactgcttctccacttactgtccatgtaatttgggatatgttccttagcctttctgaacataactttcctcaggtaaaagagcttcttttcatagtttatgtgaggattgtgggctatttttgtaaagtccaatcacagagtgtatgccttatgaaaagattggctaccacggctgcaatgattaataatatgttcatattttcctttctgattattgactatgtttgggaagagtgatcatttaaaatcaaatattgacatgttaatattgcttatctctttgaggcaggggttttagatgacttttacttttgtatgtaattttatttttaagtgaaaagtattccacaagattttgtatattatacaaacatataattggaaacagagctaatgaacaaatcaattttgattatgaaagaattaaaataaagttgggttgatatcagtctgtagatcaaagatgcctcaatgaaaaattttgttctgggttaatccaaggcacaaccctcctttattaagcagtttgttatgtcatgcaccagaattatccacatttgagttgatgaacaagtttcattccctcttggtgcttcatagtgcttcagagagaattcatagtactctgggtatttggggggtgttttgaagacatgatagtcacatattgatgcttctggatagttgctcagttcattaggttctccaaaggcttactgttaaaagactatttcttaatcccactactggatatgtaacaaaaggaaaggatatctgtaggttgaagagatatctgccctcccatgtcaattgcaggactatacataatactaaaatatggaatcaaccaaagtggtcgtcaacagatgaatggatttttaaaatgtggtgtttatgattcagccataaaaaaggaacaaaatcctattattcgtggcaacatagatgagcccagaggacattatgttaagtgaattaaactaaatacagcatgttctcacttatgtggaagctaaaaacattgatctcatagaagtagagagtagaataatggttactagaaactgggggtagggtggaggtgggtagccagaagtagggtttgagcttttttcccacataaatgtcttttgagaagtgtctgttcatatccttaatagcttaccaaccaaaaaacatccaggaccaggcggattcacagctgaattctaccagaggtacaaagaggagctgataccattccttatgaaactactccaaacaacagaaaaagagggaaacctctctaactcattttatgagaccagcatcatcctaataccaaaacctggcagagacacaacaaaaaaagaaaatttgaggccaatatccctgatgaacatcgatgcaaaaatcctcaataaaatactggcaaaccaaatccagcagcacatcaaaaagcttatccaccatgatgaagtcaggttcatctctgggatgcaaggctggttcaacatatgcaaatcaataaatgcaatccatcacataaacagaaccaatgacaaaaaaccacatgattatctcaatagatgcagaaaaggccttcgacaaaattcaacagccctttatgctaaaaactctcaattaactaggtattgatggaacgtgtctcaaaataattagagctatttatgacaaacccacagccaatatcatactgaatgggcaaaaactgaaaacattccctttgaaaactggcacaaacattgatgccctctctcaccactctattcaacatagtattagaagttctggccagggcaatcagtcaggagaaagaaataaagggtattcaaattggaaaagaggaagtcaaattgtttgcagatgacatgattgtacatttagaaaaccccatcgtctcagcccaaaatctccttcagctgataagcaacttcagcaaagtgtcaggatacaaaatcaatgtgcaaaaatcacaagcattcctatacaccaataacagacaacagggagccaaatcatgagtgaactccccttcacaattgctacaaagagaataaaatacctaggaatgcaactgacaaggaatgtgaaggacctcttcaaggagaactacaaaccattgctcaatgaaataaaagaggacacaaacaaatggaagaacattccatgctcatggataggaagaatcaatatcgtgaaaatggccatactgcccaaagtaattgatagattcaatactatccccatcaagctaccattgattttcttcacagaattggaaaaaaactactttaaatttcatacggaaccaaaaaagagccgtatagccaagacaatcctaagcaaaaatacaaagctggaggcatcacgctacctgacttcaaactatactacaaggctacagtaaccaaacacggcatgttctcactcataagtgggagttgaacaatgagaactcatggacacagggaggggaacatcacatacgggggtgcctgtcgtgggctcagggggctagggactcaggatagcattaggagaaatacctaatgtagatgacaggttgatgggtgcagcaaaccatcatggctcgtgtatacctatataacaaacctgcacgtcctgcacatgtatccccagaacttaaagtataatagataaataattaattaaaataaaataaaataaaaaataaacaccttctgaaggcaaaaaaaaataataagaatttcattttattttgccaacagctttaaaccaaaggacattaatgctgttttagaactagaaattttctatgcagtttgttctcacgtatgccttcccacaatgataatctggagacttaagaagtttactctagattccccaaggctacagacaggccaaactaaatacttgagaacacacgtacctctggcaaccaataataaacttttctgattgtttttctttctcaagtacctagagaatattttcaagtctgtggagaatatttacataagagtcaagttcataaataatagtaaaaattgctggattttgttcatacaggtcaaggagtgaagcagtaaaccctagaagcaacaaacaagtgtttattgaaaacatattacataagcaatagtctcttttttgctttttacttttaatttacatatcattgtatatatttatggtatacattgtgattatttttactatattttaagttctgggatacacgtgcagaacatgcagttttgttacataggtatacacgtgccttggtggtttgctgcacccatcaacccatgatctacattaggtatttctcctaatgctatccctccactatccccccaccccctgacaggccccagtgtgtgatgttcccctccctgtgtccatctgttctcattgttcaactcccacttatgagtgagaacatgaggtgtttcgttttctgttcttgtgttagtttgctgagaatgatggtttctagcttcacctgtgtccctgcaaaggacatcaactcattcttttttatggctgcatagtattccatggtgtatatgtgccacattttctttattcagtctatcattggtgggcatttgggttggttccaagtctttgctattgtgaacagtgccatgataaacatatgtgtgcatgtgtctttatagtagaatgatttataatcctttgtgtatatacccagtaactggattggtaggtcaaatggtatttctggttctagatccttgaggaattgccacgctgtcttccacaatgattgaactaatttacactcccatcaacagtgtaaaagcattcctgtttctccacatcctctccagcatctgttgtttcctgactttttaatgattgccattttaactggcatgagatggtatctcattgtggtttgatttgagaagcgtctgttcatgtccattgcccactttttgatggatttgtttgttttcttgtaaatttgtttaaggtctttgtagattctgggtattagccctttgtcagatggatagatggcaaaaattgtctcccattctgtagtttgcgtgttcactctgatgatagtttcttttgctgtgcagaagctctttagtttaattagatcccacttgtcaattttggcttttgttgccattgcttttggtgttttagtcattaattctttgcccatgcctatgtcgtcaatggtattacctaagttttcttctagggtttttatggttttagatcttatgtttaagtctttaatccactttgagttaatttttaataagttgtaaggaaggggttcagtttcagttttctgcatatggctagccagttttctcaacaccttttattaaatagggaatcatttccccattgcttgtttttgtcaggtttgtcaaagatgagatggttgtagacgtgcggtgttatttctgaggcctctgttctgttccattggtctatatatctgttttggtatcagtatcatgctgtttttgttactgtagccttgtagtatagtttgaagtcaggtagtgtgatgcctccagctttgttctttttgtttagaattgtcttggctatacaggctctttattggtgccatatgaaatttaaagtagttttttccagttctgtgatgaaagtcaatggtagcttgatggggatagcattgaatctatcaattattttgggcagtatgaccattttcacaatattgattcttcctatccatgggaatggaacgtttttccatttatttgtgtcctcccttatttccttgagcagtggtttgtagttctccttgaagaggtgcttcacatcccttgtcagttgtattcctgggtattttattctctttgtagcaattgtgaaggggagttcactcatgatttggctctctgtttatctgttgttgatgtataggaatgcttgtgatttttgcacattgattttgtatcctgagactttgctgaagttgcttatcagctgaaggagattttgggctgagacaatggggttttctaaatatacaatcatgtcatctgcaaacagagacaatttgacttcctcttttccaatttgaataccctttatttctttctcctgcctgattgccctggccagaacttccaatactatgttgaataggagatccttattttttacatttatacattctcccccaaaattcataattttgggaaatacattgggttttaatgtgctacctagtccccctcaaaagtctgtgatttagcaatgaggaaactgactcaggaattagttacatacattgctcaaggatatgcagttaattaaggaaaattgaaatactggcttcctgagtgaggttctagtcttcttcaatcaacactaggcttgatagatttgggaggagagctttctgattaaatcttgatttataaaagcattctccaacgtaataatgccagctgtgttctaaatgctaaaagactgcctttatgtcacagcttattttgaaatttataagaatagatgggacagagatactactggagtatgcctgccacatttgctataaaagaagaaagaaaagatttgatctgagcctcctcactattaatgcaatattttctcctcagctcacgttctacagtgagttgggcaagcactctgtgaaattatttccactacaaagtcagtagagtaagaatgtaaagtatattcaagacagatatcccaaaacttgatgaaaccagtagcctttagatcaattagtgacgatctacttttaaaaaaatccagagatcaatgaagcagaataaatagctcagaaacagacagtgagatatgtatgcatttttacttgataaataaggcatcagtaaactacagggaatggattatttaacaaatggagctgaaaattttactacttaggaaattaaaagtttatattcaccttttaccatgttaaaaaagtaaattctctctgtgaaataagatggcttgctggttgaaatgtaaaaatcaaagagtgaaatgaaagcagaaactgaatgtattgtgttgtggtttaaggatagaaatcaaagtgaaactgatatttgtttatatgaattgtcaacttatttttttcccacttggatatttccaaaaccctttagttaaatttaaaatatgaagcctttatcaaactagctctcagtcttcacttaagatgagtaatttttcttgaagcatggtaaaacagctgtctttcaatcataaatatttccacagatctagaaaatattgctggctgtgtgcaggggctcatgcctgtaatcccaacactttgggaggctgaggtggcaagatcacttgtagccaggagtttgagatcagcctgggcaacatagtgagacctcttctctacaaaaataaaaataaaaattagctgagtgtggtggtgcatgcctgtagtcccaactacttgggaggctgagtcttgaactcaggagttggaggatatggtggcaagctatgatcaagttgctgcactccagcctggcgcaacagaacaagacccctcaagactctcaaaaaaaaggaaaagatacaaaaatattttttgattcttccttttttctcttgctcacctgtcattttttatccccctttataacttctcatcaatttctcatcagcttttctcattgtttgattactttcctcagagtttaatggtctttcctcatccttttcctccgcagtcctgttttgattttctgccaagttaaatatctactgttttttgttgctgttgttgtttgtagagataggatctcactatgtggcccaggttggtcttgaattcgtggccttaaaggattcttctatctctacctctcaacttatcgcccaaaatgctgggattataggcatgagccaccatgcccagcttgtttttcatatatttatatccttaaaatatactcatttagccaggcatggcggcatgcctctgtaatcccagctgctcgagaggctgaaacaggaggatcacttgagcccagaagtccagccagagcaacatgggaaggctcatctgttaataattaaaaataaaaaacactgtatacatttattgattttcctcactattaaaatattcagtcactaaaaaatgagagtaaaaaaattattaacaaaatagtaatcacacttacttttacattttcatctttttcttttcagccattcttttcatgtatacatatgcaagtgcattgtttgtgtatgtgtgagagagacagaaggagagagagagagaggagagagggagtttaaatcatgataatggtaattatgcactttagaactgtttttgtcctattttgataacattatagcataacattatatactgactcctcagtagcagggaaatatgcattgaatggatggatgcaccatcgttaattgaacctttctccctgtggaacacatagactatttccaactttccatcattataaatagtgcttagattaataggcatttacaaaacatttgtgaacatctccgattattactaagcataaatttctaaattacaacattttatctcacatgccttttaaaaaaatttttgtcttcccttggggaaaatgtaactaaaaacaaaatctgccaactccaaacacctctccacaaaggtcacagagaaagaaaacaatcttatttatgttattttttttaattttatttttttttgaaacagagtctcactctgtctcgcctaggctggagtgcaatggtgcaatctcagctcatcgcaacctcagactcccaggctcatgcaattctcctgcctcagcctcccgagtagctgggattacaggcatccgccactgcacccggctaatttttgtatttttagtagagacagagtatcaccatgttggacagactggtcttgaactcctgacctcaagtgatcctcccgccttgttctcccaaagtgctgggattacaggcgtgagccaccgcgcccggccttatttttgaataagcattaaactagaatgtggtgcacaccacaagcaatctgctcagagattgaaaagacagaaacaaaccttacctttttgcatagccatgcagaagcaaccgttatatacatgtgttcaagataaacaatacctagttctcaagtaagagaacttggcaccatttgtcacacaaagtccatcctaaattcacctggtaattggagtgaccatctgtgtcagctaattagcttcatccagaggagaaacaaattttctatgtctttatgacatgagttattttgcaaattggagcagatgtccactgaagttaggctcctagccttccccagaaaccgggagatagggttagggatgctgtctcccttcacatttacattaggaagagatggcccaggtccttgagaaagatattcctgggtcataaaactgacgaaaggtctgactttttcttttttttttttttttataaggagtctctctctgtcaccacgctggaatgcagtggcatgatctcagctcactgcaacctctgcctcccgggttcaaatgattctcctccttcagcctcccgagtagctgggactacaggcacctgccaccacatccagctaatttttgtatttttagtagagatggggtttcaccatcttggccaggctggtctcgaactcctgacctcaggtgatccacccatctcggcctcccaaagtgctgggattacaggtgtaagccaccatgcctggcccaaaacacaccttttatatcatgtctatgtttcaaggaataagtgtatgtgaaagaaaaatttccctttaagttgtttttgttgttgttgttgttgttttttaatactttaagttttagggtacatgtgcacaacgtgcaggtttgttacatatgtatacatgtgccatgttggtgtgcggcacccattaacttgtcatttaacattaggtatatctcctaatgctatccctcccccctcccccctccccccaccccaccacaggccccggtgtgtgatgttccccttccttgtgttccctttaagttcttaacaactgtactgtaagcctggaatggaccaaagatggttccaaaatcgttggtggtctttccattgagaagaggggcctgtttttcttctccttgacctgggactgtctttgaccaattgcatatggtgaaagtgactcgtatttttccccctttggattcttaaagctctcagctattctgctgacaaactcccttggtgaaaagataaggtggagaggccataagaccacatataggggaatcattgccaaggcaccaggcagtgaggaaaactgttgacactttatacactagctactaactgaagaggatgctacaggccagctgagccctgcctaaattcctatcccatgaaataatatctaaaaacagtccgtgttttgagtcaccaagttttgagattttgtgttatacagcaagtaaagatttcagccattgtgggttcattggctcaatgcacagcaagttaatatactgagtgagataccagagattgcggcagacagagtctaataatcatatgagaagggaggaaacctcaaatcctcctctccaaggagtatggggctggaggttttaaggagctaggagtgggcagaaatgtgggatccgtgattggtggcagagtgcagaatgaagtcttggggcggggagaggaagaaactgcattatcatcctgatttcattcttctctggggctcttcaaactggtagcgtcaggcttctgctggcatccaggatctgaagaacatcttgaacaattcttaaacaaaagccttatgattctaactttggaaatcctatctatggaaacagtgggcatgcaaatcgtccgtatctggtgctatgtggcttttagttacaaggaaatgggccaaagggcagactgatgaatgcttaattataactgtatttctgttcagaacctgacatgtagttcttgttaaccctgtgaatacagtatcatagtcagagcagggcacaatgctgagtcatgtttttttttcttttttcttcctttaataaaagtaaaagagcactgtattaagattcagggcgggctgcagttgaaccaggaggataggcttccttttcctctgagggtttctcagctttaaagctggagagcagtttgatttccaaagtatttttttaactttaatatctaataaaatacagtttctttttcaaagaggatctccatgtagccacgaaaaaatatctactttcatatcaaaaattaaaaaagcaacataaaaaagtagcccaattcagaaaaaaaataggggaaaagattcatttgtgatgctcacacaaatgtatttctaccaggttgcagattaaaaacaaaggaaaaagatcttcaatcacagacctccttccgtctcaggagggtttcaacaactcaagtgcaaaatagagagatcagtaaagagagaggcaaccgtagacaaccaatttaataaccatagagactggtggggaggagggggatgggtatcagaaaaaccaagcaagagggaaaaagctgagtatggagatggattggggttgtttgctcaatgcctgtgttaataaaatttattctatcttttaaaaaaagttaaataacaaatgccaattattattttattttagcccactgggtaagaaaggttatataaattcttccctgaatcaggaaaatgctcaactctgatattttttatttttctaaaaggttcttttagttttcagcattttcatatgcactttattggcatttgaaaaggaatcagccaggcactgtggctcatactggtaatcccagcagattgggaggccgaggcaggacgattgcttttgagattagcctgggcagcatagggagacctcatctctaaaaaaaaattaaaaatagctgggcgtggtggctccagcctatagtcccagacacttgggaggctgaggtggaagggttgcttgagcccgagaggttggggatgcagtgagctatgattgcaccaactgccctccaacctgggggaaagaaagagaaaggagggaaggaaggaaggaatgaaggaagggagggagggagggaaagaaagaaagaaggaaggaaagagagagagaaaggaaagaaagaaagaacgaaagaaagaaaaagaaagaaagaacgaaagaaagaaagaaagaaagaaagaaagaaagaaagaaagaaagaaagaaagaaaagaaggaggcaggcagttaggaaaggggcagggagtgggtttagcaatgtgcaatgagcatctaataaattagagttgctcttcaaagaggatccccatatagctatgaagagttagctacccataggcgtatataagtaggtgtgggggagatatacaatacatggtgatttgaaggacacgaaggaagctcagagagcaatagtgtagggtaaatctctttcccagaaggagcgtggggtggttgacacacttctgtctcacagcaggactgagctaacacagcgtggtgtggcacaggggaagatgcgtgggtgcagccaggaagaaagaggtcaagcagaggccgggattcaaccaccccgacaataaaggatgacaagggcattgccggtgatcaaatgcctgaaggacagaatttctgaatggcaaagaagtaacatggagtctgaccagaccagaatatgggcaccacagggcccatgacagaagaccagaaggaaaaagaaggctaggccattcgatgttttgtggttttgtttatctggtttgttttcccatgcttaagatgttgaacttgtctgcagggctgggaaagaatagttctgaatttgaggatcaactttgccatattggaagtagtttccttcacttttttacttgctgggtcctatttggtgttcccttacataatttcaggatcttttcccctgtggaagtcaagttgctaccatcagcaatagccaatcctggagtggcaggaattcttgctgtacgtggtgacctagtgaccttaaagttgctatctgactactgggaacctggtaagcagcctccgcactcccagctgtccagtgtcctcactctctggtcttacagtctccaaggccccaggctaagtaggaacccagcctatgaataagtctcccaagggttttctggccccgaggttatccccctgagacaggtgaacaaagccttccctccttccagggttacttgtgaagcaaggagggcctgagtttctctcccaccctctcactccgagcagacattcaggcctggccttgagcctctacaccaggaatcccctccttcttcttagactcaccattgaacacaatgcttctctttcttcccggaaggtggcagcgcctgaaacgtctcagaaagcttccagcctctgcctgctgggcctcggcagcaatttggctttgtttcagcagttggatcacagttgagaggagggggttgcagggatactgacagggaagtccttctcaggacaaggaaggaggcctggtgaatggaaatacaaggcctacaattggagtccaaaaaaatagaatgttatcccacaggagaaggtaatagatgtcaggcactaaaagcagtaaatcatctagaggttaagaggggaatgagaagggagtcaaaatgtagcaaagatggatgaggaggtcactttagtgttcagggagaaaaaatgctgtgaccagtgaatcacagggaagacttgagacatatattatacacatattaatcacagagaatatatatatatatagtctccctaattctaattcaaggtacatatatatatatatatatatatatatagtctccctaattgtaattcaaggtacgtatgtgtatatatatatatatatatatatatatatatatatatatatatatatatagtctccctaattctaattcaaggtacatatatatatatatatatatatatatatatagtctccctaattctaattcaaggtacatatatatatatatatatatatatatatagtctccctaattctaattcaaggtacatatatatatatatatatatatatatagtctccctaattctaattcaaggtacatatatatatatatatatagtctccctaattctaattcaaggtatatatatatatatatatatatatatatatagtctccctaattctaattcaaggtacttaatgtcaatgagataatataagatatgtgtgtgtatttatatatgcatgttacttcattgagactctgtgttcttataatttaatatctaattcacagaatttttaaaggatcaatgaggtaaagaaagaaaaacaccaaaaacatgggtgggcatgcagttcagctacattcctcgctcttgtctcttcttgttagttgtaaatgccttgaaagcaaaaactgtcttgtccatcctggattctctagcacttacagtactgtagcttaataactgtttcacgatgcatgagactgccattttggatacagaattagcagaaggggggtcatggtgagagcaacaagtggtacagtatgaaaaagaagaaaatattattattctatttggtttgaaaagtagctagaataggcaagattgatatctaattcattatttgcccagtattgtgctaaggacttgatgtatatcaactcagtgaatcttgacagcaaccctagaactcaggcacaattttgactcccattttacagatgaggaccacgagacattaggaggttaagtaatttgcctaagaccacacaggaataagtgacacagctgggatttgaacacagctgccttccttcattcctgggctccaaatctctacaacatactatttctggatgaaatggtattatgcttatccaagacataaatgttttggcaaggttaaaacattttggaaaatgtaatgggtacttaactaatgttcctatatgagaggaaacaattatcaaaagctaatagcttaaggaatcatcacattttttattttttattttttaaatggaatcttctacacactaaggcatactgttatttttgagcagtcaacgagataagtatttagaagccctctagaacacaacattttcaaaacatctggaaattttgtgtgctgtaaataacattagtgattaaagtttggaccaatggattagaaaaataaatggaaaatattttaaatgcatatcctaaaacagttatctaaatcttactacgaaaaaaagatataagcatactaatgtttttgctttctgtattaatggtaaaattatgaaattacctcttttccttaattcagttgaagatccatttcccagggctatataattaatcataaaataacctgttggtaagattcacaatgaatacctgatgtggaaaaattattattttaatattttattctctatttttgcttattttattgatgtgcatattttacacacaactccaaggaattttaaggaggaatattatacaaagagaagtgatccactatttcttcactctagcattgggctagttactttatatacttctttcctgcagtaatcctaccttcattatatgaatgagaagagattgagtctgaggggctaatgaacttttctaaattcgctgcttgggggtgtgtatggaatgattctctcatttgactctttcaaaagttggtcctctttttactatatatattgcctttcattgttgcaacacatttaatgttccaaattcactaacacaatgaatattataccctattataatcccatcggaccttatggcctattattctatctgacaattggaaaataatagataattacagtgagatacattggattctaaaatttgcttcaagtcataaaaccaactagctacaatgtgaatacttaacatcacttcctgtgcctcccctgtcctttccatcacatgatttttttccatgcaaatacattataaaactttctattgcatgcaatttgccaccaattgaatcattttgtagttgtcaatgtatctctttcagaatattaaagaggcctgtgccatgttaattacgctaatttggggacattaactttataattgttattatactggttatacactgatgttaaactgtctgataaaatttaccttgaaaattgtaagataatttttccttcccgtcagttagcgtatgcgaaggcatttggactttccttataggcaatgggatgtccttaccgagcttatgggcaggccgtgatgggacttgacttgcgttttagaaacaactaagataaaagtatagatgacagctgttgggaaaagactctgcagacaatgacacaagtctagaagtcttttccaattatgtagataagagatgagcagatagtaaaggtggaaagttgtagaaagatttcagatactcgaagtgatgccataataaaaactagatgtgttattctgttttagagaaaagaggagagaaataataaattgagtttgggacatttaaagggctttctaggtaaaagaaaaaatagttgattagagactggtatttagaagatggggcctatggatttcttctccaaggtgctcagttatttttgctgtatttttccttttacgaatgttttgacctgaaaaagcaaaattgcctaggatgaatgagcacttgggtataagagaatcaccaatatggaaaaaaggaattgctgggggtggtggcacatgcctgtaatcccagctacacaggaggctgaggcaggagaatcgcttgaacccaggcagtggaggttgcagtgagccaagattgcaccactgcattctggcctgggtgacagagtgagactctgtctcaactaaaaaaatttacaaaaaaaaaagacaactaaaagttttcccaactcatggtagttaagtgtgtcattttaacatataaaaattcgtgtttaaactagacattgctgaaaaaataattcactttccttgagagaaagagtgttgagctatgagtccaggcagcctttttataaatctcctgattctattgagtaatcaatgaattgttctgagatagcctcatctttgaattgaactaataacattatcagtctcataaaagatttaataacaattcatataagcagtagaggtcctagcatgtaatacatgcccccagaacattagacaatattatttattatttctcagaagtagaaatatatatttagctacagaaaatttttcaaacctggctgttatatacataatatttataacatatagatttgcttgaatttatagtactatcttaaattataaatatattatctgcattgaatattggtatagggatccaatgattataaggtatattgttgttaaataacataaataacatagagtactttatattttcaaaaattaatgcactgtttgtctttacaaggcaaatcttgacattctttctcaatttggagaataaaaaattatcaggcttttcaacattcttctacaagttaataaaacagaaacaaaaggagacttgtgaaagaatgtcaaataattagaaaaatgtacaatttattaatataaatgtataaagcaaatagaacacattcatttaagctagacagacgtcgacacaaactttcaaattggattgtcagtttcatcaaatttggaataaacagaaaaatacagtatttacagattttagtaaaactaaacagaaatggtacaagaaggaaatttatttttcacagaacaaaaatgacaattttgactcaggtacccacataggagcaggtgaagttctcaaaggacaactttttttgttgttgtttttttggtaagcaaatgaaaaccaagacatatttttctgctcttttatttatattgatgaaacctcaaagtctgtactcaaatacttattaaaatatatccatacatatatgatttcttgtcaaaatgcatcattcttcttcaaatacaaaaacaaaaatattttcactttcctaaaaccatcactttttcttagatcacacttttatctttcttctgagtatagccctggaaaagcagtttgaatgcaaagccccttgacaaaatatctgctttttaaaaatgttaatttaatacacaagaaaaaaaaagcctctgggagaagaggataaagaagttaggatttctaactcctaggctaaaaaacagcatatcagaaagccattcaatttcctttacaatgctgattaaagccttcattttaatcttcattataaatggaggacattaatccctaagctgtttttaaacaattaatagtaaccttcttcaaccctatccatgatttccctgaaaagcaatagttgagttctatttattcagtgtaatggactggcatttcattttaaataaaaccatataagcatgtctctatgtgagatataaatgttacactcatctatgtacataatgctatgtcgtggagaaattacagtagtaaaataatgcagtctttagcaatgtcattttgaagtaaatgataaaaagagtagatgcttgaaccaccttagaaaacaaattactatactttctagaacaatcaaagcattgggtttaatatctcattctgctgaaatagcttatagaatcataaatagctgatgcacagttcctgtaattaagattaggcagttaagaacagtaaatcaaagtttctttggggtccattttgagaaagtaatatagatttttgtcatttgcatggctttatagtaaagttaaaaaaacatacacaactacacatactgacttctggagtagacgctcggtgacttctttccggtgtgataacttttttgggttgtgcgatgggaaggtatcgagtatctgtagctactgctcttttcgttgcaacaaaaaacgcagcagaacagagctcctccaacaatcagcaccagtgccgtggtccatcctaagtagagagcttctccaagctcacgtttttgggcaacattcactattgagttatagaaatctctgatgatggcattggcaacccagctcacagggatgagcaccaccatgcccgtgatgatgaagatgattccagccgtcagcagaatgtgagccttcaccttctcattgtcccccgtgcacctggtgcatttcatgccaaggatggccatcatgaaagccaagaaggacatcacggaagcagcacacatcagtcctctggctgcctgtaggtccggagaaagagccagcagggaatcatagattttgcactgcatcctgatgttagcctgcctcacgcaattcatccacagtccttcccagaagttttcaaaaaccacgatgttgttttcaatgaaggccgacactctccactgaggcatgacagtgacagccactgtgcccaccattccaacaccaccaagaaacagcccagcgatttctaaggcatgggttgccattatcctctgggatgagttttagccagctggactccggaactgctacttctgctttgaagcagggttctctgtgccacagaagagaacagtttttcctgtagtaatgaactcggaacccagtggtttttcaaataagagctgctttgctacttctggccagatagtatccagtgctggctggctgagatggccctgctattggctgcaacaggtaaacttacaaatcaggtgtggcaactttctcagccaataaaaggtggatggtaatccaggtgtgtctaaaccaacacttgggtacttggaacagctagacctgcacataaacattctttatacttctcggtcttccaagaagacagcagtatgtttacctgtaggcatagttataagtggttgcataagcatcaagaaatgagccgatcccttgtaatgtgaaaggtgcaccttgtacaggcaattctgaaactcttaataagagctgctgggaccaagggataaaataaattatctgccgaagaattctgcaacgctgttgaaatgccaaagtgaaacgagagtaggggattgaaagattgcttttacctgggaagccacattctttgggacacatgtgatccaagtgattgatttaatttttctacaacttcaaagcaagctctactgtggtgaaatcagggaacagatcatgccagaggacaaaataagctaaagtaattaaatacacaaggctgtccttctccttggcactgaaaacatattggagttctttaagccagaaaaaatactcattgacacttttctgataatcttcacttataaaaacattttttgccaaaataaaaatcaccagatgattatcttatgtatccagcactatagcattaaaataagcttatgagcttattttgtggtgttattcttgctgctttgaattcctgggctgaaggaactagaattctgaagatgacacaagacccttgggcctatacaaatggctgatatttcaaaataagatatttacaagacaagggaactatatttaccaaactgtattatattaggtattaaccaaatatgttttcctaccttttaatattatgtctgcagtaggacatagaaacccctaaacgcaagacaatttgaactttcttctcaaaataatgatgctctaacagtagtgctatactaagcataaatgtttatctgagaaaattcgactagcaattttcttctggagatcaccttaagctctctgtctgatctttccaaagtttaagctgccacttcattttcttttcttcttaacatcataaaaaatgattttctctttacagttttactttctctctgtttcattggactaccttaaatccaaatatgggagaaaatcgtttctgctcactgattaaactttgagagtttcatggttcaaaaaatctgagtcatttgtggatattattaaaacaaaaactatatggtagaaagggcaaaaggaggatcaagtagactgtcttctaaaaaagaggcaggacagacgcacagtagtatgagttgttataattttgttaaacagacgttataaaccttataaaaagttaaaacttaatatttacagaaatattctcatttgttgacctgtgaggtgccaaacttcagggtgtcccttaggctgatgcagaaaatatgcagcatttggccggggcggtggctcacgcctgtaatcccagcactttgggaggccgagacgggcagatcaagaggtcaagagatcgagaccatcctggctaacacggtgaaaccccgtctctactaaaaatacaaaaaattagcctggcatggtggcgggcgcctgcagtcccagctactcgggaggctgaggcaggagaatggcatgaacccaggaggcagatcttgcagtgagccgagatcgcgccactgcactccagcctgggtgacagagcaagactctgtctcaaaaaaaaaaaaaaaaaagaaaagaaaatatatgacattttcttcatcaagtttctatcagttacagatttgtggtggagggagacttagattaatcttgggaaaataagattttaaaagttgagattttaaactttcaaagtttaagaagtgagcagaaaacattttctcccatatttggatttaaggtagcccgatgaagcagagagaaagtaaaatttcaaagaaaggatcatttttatgatgtgaagaagaaaagaaaatgaagtaaagcttaaagattttccttttgtgcaatccacaaaaggaaaaatgacatataaacagaagatatttttcatctttaattgtcaaactgggaaaaaggagtgattgacagaactgaaaaatgaaaaagaaataatataactggttgagataatgactacgtgaagctacattttaagggatgtcaaggcatatattgcttcattgaaatttcttttcgaattcccgtgtggcatgtttcttaggagctctgtttaaatattgctgactatccacatcaacacaggaacgcatgagacagaagcagaaagctctgcctctgagtgcctcagccgttgtgggagctgcttcccaggtacgcattcatatttcttggctttgtgtattaccaaacctctcttcccttgaggcttgaattttaccaggaacttattttacataaaaatattttccttatttcaaaaatattaggtactttactattgaaattgttctagccaaaagatgaggatctgagtgggaaattaacactaggttcacattagaattattgtacagttaattccctactaggaagtggcccagggtttccaaataggttccttatcagacaatgatacagttaactccatagtatttataaataaccatgtcctaaaagacactggaataaaaagacagaaaaaaatggtaatattgagtttgctaaagacaaaaggggcctaaattcaaagataaaaggaaactgttatctacttttctgtcctgctgaattgattaacttggctacaaaattcagatagcagtaatagagatataacagattgataacatttttactctaatttagaactacagagcaaaatacatcgattattcaatagtttgtacttccatttccatgaagaaccacagtactaccaagaacccaggagagaaatgagagctcatgtcaaccccctctccaccctccctcgggcttttctgtctgtcaacatcatcataaggcatgatttaagtttagcaattaaatttgctaaactgcattcagccctgataatagcataacacaggcaaatgctttttcttcctaaatgataacatacaaatcactatcagattgtcttatgcccattaatccttaacctaattcaactccacagtcttggatttctattaattcttatcactgtttgaaataatttttgcttctgcctatcaagcaaaggtcaatttcttttgttttctggatttgctttgtagttttctgttgtgatgacagtttttcaagggtgtttatttttaactatgttccactgttaattaaccatacttggccaaccatcttgtcctgagagaataagtgaacatatcaataggtctctgtgttgttccgaaaatactgttgtgcattgctgtatgttctcttgaaccatcatcttgtttgtttttcatgatggccagctatgcttccagttctctatccattagcagccctctctttttaccatgtctctcttttttctttttctttttttttttttttttgagatggagtctcactctgtcatccaggctagagtccagtggcttgatctcagctcactgaaacctctgccttccaggttcaggcgactgtcctgcctcagcctcccgagtagctgggattacaggtgcacaccaccacagctggttaatttttgtatttttagtagaggcgtggtttcaccatgttggccaggctggtctcgaacccctgacctaaagtgatctgcccacctcagcctcccaaagtgttgggattacaggtgtgagtcaccatgcccaaccgctcttttcaccacctctgtgtgatctattttcagttgctctgcttaaaaatgaactccttactgcatagaaattgcctagtatcttagccaattcaagctgctttaacaaaataccacagaccaagtggcttgaacaatggaaatttatttctcattcttctgaagtcccagatcagggtgccagtgtcactgggttccggtgaggacccacttctcagtttatagaaagctgtctttatgagatgacttcacatagcagggagaaagtgtgagctccagtctcattctcttcttataaagacactaataccgtcatgaagatttcactttcatgacctcctctacaactctcaaagtttcactctcaaagacctcacttccaaatcccatcacattgggggttaacatttcaacatatgaatttagtgggtacacaaatatccggtctgtaacatctagctactaacaaattcaagcaataaaatttgcataattctgaagggtctactggtgcttaagaacttcacccatattatatcacccatatcaatatttcatttttccaagatgaaaaaagaatggtgaacatgaattaaaaaatcaataatagaaatagtgtcatggacatgtttttacctttctttcgcttttcattgcattaaaaaaattaaaacctaagtataggatgaattctgatatattttgaaagacaggtctgtgtatttcatgtgatatatttgatgtctctactaaagtactggaaatccagggagataactgaaaaaagcaaaactgtatactgtggaaattttcctataaattaatgagtaatttatatatggagaattgatgatgtgaaataccctaattctaatgatttcaggaaaaattttaaaaaagaaagaatttgctggtaatagcagctactgagtattaaatgttctctatacaatacattctttttatcactctactttatacttaaaacatttttagaaagcaggggtcattactctccttttataattgaataaattaaaactcaagagagactgccttttttaaggccacacagactttgctggttgaatctacagaaatggaattcagaagcagacctaaagcccacattcttttctgtattgcctaccatctccttaaagagaactagggaaacagaatttcttacattggcatatatggtcagagttaattaagatataaaatatgttcaaaacatttttcgtccttgcttagcacattgttgtaaaaattttgcatggccaaccttcgcaatttttaaaacatacctgcttcactgaaatttgaaatctacctctttagatactctattcaaaggagtttctactggggaaatattggcaatttcaataaaattattccttgtttagaatttgagagagttccctgtgctgaaggtaccagtggcacccctttttccttcacttcccatgcttgtccccatcttcgtgattccttaattacagactaggtcgtgatactgaatgacctaaccaccactgaacaagtatttggctaaagtaagcattaaactatttcaatgcaatgaaagtgaacagttacatgtgtctgtgccctcagctaattataatacagagaaactttcctttgtattttatagggacttcttagtgaccaacagaggaatgattctatggttaccttcattagtccattaaaattgctttttcaggtgactcactaacaacttttctttttaccttttccaaacgctaaaattaaaaaaaaaaaaacatttttaagttgtataaaactgttttccacatggttatttttggaattgcttgaaaaacaaattttttaaaaaaatcccttaatctcccataataatcctttctactgaaatgtaaagcatatgaagcattgaatgaggagaacaaacggtccatgacaaaagtttctggccaggcagagactgtaattagtactaaaaatgataacatcagataatgaacaggaccaaaacagagcacttttcataattttattttgaatccacagcaattcacaagtttaagtcatgttaattataaaaaggaagagaagagaaaaggcacataggataatagataatatatttaatatgactatgcttaaaataatatattttaataaatattacttaatcctagtcataagaactacttaataattactaagttatatgaacaattaagattaagtgatatcatattagttaaccatatgatttcagcctcccaacgcccttattagaaaagccctttattatgtcagttttactaggaaactggaatttacaaagtttaaataactgacccaaatcctcacaacaaactggtaaaaaaagccaatatgggaactctattctgtcaaacacctgaggctacactcttgacccactatgtgctacaagtcattatagacctacctgtaaacctaattgaaagcttgtgtcaatgtgtagttttatctcttataaagcatataagttttggtagatcagaaggagttctctgaaacaatgtccttcacattgtgaattttcaataggattttgagcattataaggagaaatgaagtgtttccattttctgcagcaacatgcattgtttaatatgagaaatcataagatatgagggaaatcataagatataagggaaaagtccacacaaatggaaaacacatacaagggtgcacacacacacacatacacacacacacaaaatgtccttataagcaaacaatgaatataggagcacaagaaacaatttcccttgtaaagttgaagttaacaggacagggaacaggacagggaaaagtaattaactgggcaaatagagctaagccacattactgattaatttgcaaaacaattaactttccacttaaaattcaaattaagattctgtctgccttaggcaaccagtgtttgcaaattttaatagggctagacattaagtgccttacttaaaaccaactttacatggcactgggtgagaatattattggaacaagcagctcatggcattcttgggtttcagttatttttttaagagaaaatattacaatctataataatatgctggatgcactaaaattttttcaatgagaatatgagtaaaactaaaagttattcaactcctcatctcaaatatttatagagattttgtactttctgtaaaattttcaagacgatgtctcataaaacatcttctgaacacttattttccaaccgttcaacaagtatactatgtaccaggccctgtgatagactctggaaaccaagaaatatgaggcatagtttcttttctttgtaattttacatccacaaaactgaggggctagtggaagaaagaactgctgagtcaattaactctgtcattggttaaacttgttaaccaactattcttttcaacttgaaaaagcatacaagtagccacacagacaggtgagaacagccacccttcactccattgaaaaaaaagcagcttccagggttttgatgttttctaaacaagatcaaacaatcaatgaaaagcaatgccaggagtctataaacattcagcagaggtaagctggctgtctcacattttcacacacctttctggttcatgcagctcctatttcttgttcttatctttctttttctctgacctacgttccagatatctttagagttgctgctatggggagctgtatgtgattatctgactggcttctgggcatctttttcatagttttaactggacttttgatgtctcacactggacaacaacattctatttcattcttatgtcaccaaactggttggtcccagcccacatggcctccttcctggtcacgagcttggaacagggaaacacaagttacttttgtacatggcaacaggagagaatattagactcaaaacagatctaaaagaacatctgatgtgcacttcattctgtacatgaggggctcaaaagctccaggaagtcaggaaccacctctgttctattcatcttcgtgtcaaagtaaagtacttgtgtagtgcctggcacatagagagcactcagtatttatctaataccacgcaaatcacgctgaaatctctgtgcccagttcttgatatttgcttggtaactcggaaactatgacaccgtagacaagtaaactgcctattgcttatttatgtatttgtctttttaaaaatctcctaaaatagaatataaatatcatgagccacatgattttgtcttgctcataaatgtatttccaactactaaaacatcacctggttcatagtaagagctcaggaaatattccataaataaaagaagaatgttagttaagaaaaataacctatgtacccagtattgtaaaaaaaaaaaaaaaaactctcctatatataagttatataatattttcagtttattttttcaggtcgatgcttaagcagagaagagcctaaaataaaactcacctttggctgtatcagcccatcactatgcctctgaatatgccttcttaagaggtaaacttatgtcccagtgggttcatgaattttacttcagctttctttaagtttcctaagtatgccctgtgaactgaccttcattttctcatttattctatctcatttctctcttctcagtatgcaaatcccatttttccaatgcttgctattattaatccaatatccttccaattaccatggcaaatattgatggactaagagcctaggctaccatttttgtttaatatataattttactataccaaggaatcattaattataattatttttctctaagtatattaacacaaatacagacaaatacaatatagaataatacataactaataaaaattaatacacatatacttttaaattttagaaagaacttacatgtatattttatgcaaataacttatatgtatgttttatgcactttctcattgaagtaagatttattttgctgttactttttaggagatgtttgatatcctagggaattttagtgtttttttgaccatcgctaaattggaattcttattagttaatgatgttgctaggaatggaatttcatttggaagaagcattaagctacttaaatagcaatctcaactgtatcagcctacctttctcaatttgccttgtgatttaatgtaaactcggaaaagggagagaacttcgactacaagtaagtgaatggtaagttcatcagctagccattattggtggcttctttggcttccaaagaagaagttaacttaagtataaaccttgaatctgtgacttaatgtggaaataattagaaatttgcatggattaccattgttcctgtgtttcccttacttttcaatcaaatattgtttcaaatttcatgctagcttgaataactatttttataataagcaaaacagaaaaagctaacttaaatatatgtttattatatcaaatttttgataatagctatcccctggatagtaacccagatgtgtctatgtgtttgtgaaaagaagcctatggggtatgatgtcatgaaaaatcgctttcagattttgctgcgtattctgctatgttggtagaattcagtacatgagactatgttcacatagtacaaaaataaataacatatagtacaattttgcatataacatctatctaaattcaaatatagttcttatcattcacacttgagatccagattccatttaaataatatttattaatcttctatcacatgcaggaaatgttacatatattactgtaactaaattaggttactcttcaacttggcaatgaaaaatcccctttggcatagactttgctattaaaaaagaagttggtgcaagttttacaaaagaagggaaatttttcctggggccattcatagttgacactcagaaattatagtggaggaacacctagaatagaacagattagaagaacaagcagctgcatttccatacctccaagctctattctcacagtctgtaatctaactacattgaacttcactcatctacatgtttgttatttctacagccacactttaccatcttgactctagggttgaaatcccaactactatgagccttttctttcagacactggtcattttagaaaatgtaaaatcaattaaccaagttcaattctgaaaatctctcgagtgcattttccatgtagagagagagttctctggcataaataggttcagtaattaacagcttgactcaaatgtcattttgaaggattcattaattcacctcttctttaattcatcatatgttgattacttagtaactacagggcaggctctgttcaaagtactggagaccagggccgggcgctggctcacacctgtagtcccagcactttaggaggccgaggtgggcggatcactgaggtcaggagttcaagttgagaccagcctggccaacatggtgaaacactgtctctactaaaaaaaaaaaaaaaaaaaaaaaaaaaaaaaaaaaattagccgggtgtggaggtgtgtgcctgtagtcccagctactcaggatgctgaggcagaagaatctcttgaacctgggagatggaggttgcagtgagtccagattgcactactgcactccagcctgggcgacagagtgagactccatctcaaaaaataaaaaaaatgtactggagaccaaaccacgaagaaggcacagttcctccctcaaggagcttgcaggctaatcaggggagaacagttgcttcaggcctgactgccatttagaaccagcctttcagttgagcataaaaatcacaagatttgtgacaagctgttccaaacacaaatgcctgcagggactagggaggaaagagaaaaacgtaaagcaggacaggtaaaaattgtgtttgttcctctaaatgaagcaaaagctacacaaatgcagttgattttggcctcatgggagtggactctagtgttactggatctttccattcttaacaagtcagaaatctgtatttttttaaacccttctttgtttaatgttgccactagtatggggtttgaacaaaacatgtgggacaaatttggctcaaggttggccagtttccatgtgtcaaaaaccagtgacctctagatatcaattgccatcaggaaagctccttatttgaatgggcactgaacccagccatgtttcagatcctcagtcaacaacaggagagcagaacctgctgcttccatggaatgttataagaattaatggccctgtgaaggacttagatctccttggataaaggaactgtgcaagtaaacattgtaatcagtaatattatgttgtactggttgacccaaaccatggcaggtcagttctgcatgttacatacagtggtggagaaatcagttagagctattcactatcaacttctagaactttcctaaacacctgtaatttatctgtaaattacctagaagagtttgtaagtctcttcagaaaaatgcaaatctgatttctaaaaccgtcttaattttaaaaggtaatcttaattatttaccaactactcataaaatttttgtgcggacttgaagtgcagttaagtatgagaaaaggagattagctggtacatgcacacgttctgtaacagaacacagcctgtctgctggagagatgacagtgaatgagtcccccatcctgattttcccacagcttaataacctccaaaacaaggaagtggacatagcgaaactggtctccatagattcacttttcccataacagagattctattttaataaggctgttagtcagacaaaacccctattgacctgtggcagcacattgcatgctttctcttgtttccccggttttaccagtgcttaggaagcaagccaatatcaagtgtgggtcaggctagtagctggagatatgccctgtgactcatctttatcttcagtgtgcttctttgaatattgcacaactgcccatgacagagacacattttaaagggatccagactactcaggcttgaacagaaaagaaaacctagcatatgttgaatgaataatacaatccaaaccagtgattttttaaaagtctcctctcaaatattatgtatcagggatgtaaattaatcaagactgcctttcccccattaaaggtctgtgaacaagttggggataaatctgaataactacatatgtagttacaacagatttctgggatctctgccctgattggaaacagttttgtctatgtcccatgttataatataaatgtaaatagaagatgttggcccttgagtcaaacataggattcttgagcatttcaattacaagcactttgcagcattgctcccttgtatataccaacttgagaaataatggctctgccccaagtttaaaaaatatcaagccctgggaagaaatttgccctataagaacatatatatggctactttcaccttatgataacaggatgatgtcaatcacctattaaaaataagtagggtggacgcaacggctcccacccataatcccagcactttgggaggccaaagcaggagaattgcttgggcccaagagtctgagaccagcctgggcaacatggcgcaaccctgtctccacaaaagatagaaaacttagtggggcatggggatgtgcacctatagtcccagctactcaggaggctgaaatgggtggatcgcatgagcctgggaagtcaatgctgtagtgagctatggttgcaccactgcactccagcctggatgacaaagcaagaccctgtctctaaaaaaaataaaaaagtaaataagtaaataaactcagctagatagcaaaaaaaaaaaaaaaaaaaaaaaaaaaacccaaacctcataagctcttttgctggaatttgtcacgtagctggagatacaaagtacccagtcttggaaaagatttaagaactatgtttaagcttgccatcaatgtacaaacattaaaataattagaaattcacatggcaaatttgaaactaaactaataaaaagaaatttctggtattttctgccacaattaaattttaaaatatggtaagattgatatacataatactctcgcttaggatctggtctattccaaatagaattgttctcacaatagcaatgtattttatagtgaccatacagtcatgatgatcatcaaagggacaataagaatacacagataaaaagagtacaatgggattaaacagattgtgtttcatagattcatttctgactttcttgctagtaatggaaaagtaatgcagacttacttcatttccaaaacagagacttagttatttggttacaagctcattaaaataccagatttattatcatgattaatatatatatatatgtatatatatagtatatatataattatatataatatgtatcaaatatgtaattatatatacatatagaggatattattaaagtgattgacagttaatatttgaattatgtctctatgtaaaattgaggtttgaataacaccttgatttgtatccagtaatttgagttgtagaatttattcatctaagctctagagaaaaggctgccatctactgaaaaattagggtgtcttcttggagtccaaggatagtcccgagaaaactctactaccattgtggccattactttttctaaaagctacaaaatgaaaaatgaggtaccatgattattcccccggcatttaaacaaataaggagagggatgtatgtgagacggaggggcaaacacgtttggtgtatggagggttcaccgtaaagtgaaggggtgagggttggggaatcactcaataacagtacttagaattaccaagacctgaaatctgggaaaaaattggttggtggactaaaatataaacaagatgaaaacattgagataaatggggggaaaattagaagctctgaaaacagaaaccacagaaatatagatgggagagagaaagtgagatagaaatagaggctaaaaatagggaggcattagtagttctgaagaatggaggtatacagtttatctgacaccttccagccctgtctagcatgtccttctgtactgcagagactcatgagtgacatatttcacacaatgcctttcaggttattctggatactattttgacttcaaatattagttacatttgcaagaaatttgttttgaccctgagttacatagaaagagaggatggtttcagcacgttcatttcgttgacctggatggtgacagaggagccatgttcctggagccagcagctttgttaatggttctctgacatggaaagaagcttccagatacttcaacgtttacatcatggtagaagcagtaccttctgggttgtccagtattgcttgtggttttggggattattcctgaaggctgaggctagtctatttgttcactttccccaataattctatgaactgtatatttgtttggaaatacttttctgtggacactaactagaatggattcataggtctcagtaaaaaaagttgactggtacagaaggaaatacactatgaactgtatatttgtttggaaatacttttctgtggacactaactagagtggattcataggtctcagtaaaaaatgttgactagtacagaaggaaattgttgagttggttgggacaaaaagagatctttccatttttcatatagtattattgaatagggctgtgagcttgtttctcactcagttgtggaatgttaactgattaatctcacagggattcttcagccttaaactcttattagtgggtttactttgaacataaaaatattcatatcctattagcagacaaattcattaggattcatcaagatccaaaacctagtcacataggaaacttgatgaagtcaaaccagcatgacaaaacttcctgcttccaggttgacccttaacattgataacagcttttgctttattttgtttctaaagatgatttcaaaagcaatttatggtttttactgggactagagtttcataaaagaacatggctgatagtgggtcaccaatctgaatgcacagtcagctaaagtagtagggaaaagctaagtgcagtcagaagcagaaacaatgatttagagctatatgggtcatatgaggcggaggaggtaagaaaaatgacttttcacaatatgacaaggaatacaaatatgcagaaggaaacagattctctaatagatgattaaataaaatgaatgcagtatgtgctataaaatttaaggtaaacaataattattataggtctattgaaagaaaaataaacggaaagctgagaaatgcattgagctgaaggactgagcagagccagtcccagcagagccagtaagcccagcagagcccagcagagccagtaagatacaaaaggccaggcatggtggctcatgcctgtcattccagcactttgagaggcagaggtgggcagatcaccagaggtcaggacttcgagatctgcctgaccaacatggtgaaaccttgtctctactaaaaatacaaaaattagatgggcacagtggtacgtgccagctactcaagagcctgaggcaagaaaattgcttgaactcaggaggcggaggttacagtgagccaagagtgcaccgctgcactccagcctgagtgacagagtgagactccatctccaaaagaaaaaaaaaaagttacaaaagaaagattctaagcaaatgcccataaaatgcacaagtgctttaagttgaaatcagtatgttgttttctaaggcactgtgcttttaggaaaaggaagtgaaaaaaaggtatctccttgttaaaatccacaagtttcttagaagtggcaatttcatggaggcatcacagtactccccttcaaactatactataaggctacagtaaccaaaacagcatggtactggtacaaaaacagacacattgaccaacaaaacagaatggagaacccagaaatgaagtcacatgcctaccaccatttgatctttgacaatgttgacaaaaataagcaacacagaaagaacttcctattcaataaatggtgttgagataactggctttgccatatgcggaagaatgaaactagacccctaccttttaccatatacaatcatgaactcaagatggattaaagatttaaatgtaagatgtcaaactgtaagaatcctggaagcaaacttaggaaacaccagtctagacatcagccttgggaaagaatttatgactaagtacctaaaagcaattgcaataaaaacaaaaatcaacaagtggacttaaccaaaatagagagattctgcacagcaaaagaaactgtcaacagagtaaacaaacattctacagaataggagaaaaatattcacaaactatgcatctgacaaaagtttaatattcagaatctataagaaacttaattcatcaagcaaaaaacaaataactccattaaaaagtagggaaaagccatgaacagacacttcttaaaagaagacacgcaagcagccaataaacatgaaaaagtgctcaacatcactaatcaccagatgaatgcaaattaaaaccataatgggataccatctcacaacaattagaatggctactattaaaaagtcagaagacaacagatgctggcgaggctgtgtagaaaagggaacggttatacactgttggtgggaatgtacattagttcagccactgtgaagagttcactgaagcactgcctacaatagcaaagacatggaatcaacctaggtgcccattaatggtggattggataaataaaatgtggtacatatacaccatggaatatgatgcacccattaaaaaaatgaaatcatgttctttgcagcaacgtggatgcagctagagaccattatcctcagcaggaacagaaaactaaatgctgcattttctcactcataaaagggggctaaacactgtgtactcattgacataaagatggcaatcatagacactgaggactactagaggagagagggaggggtgcaaggactgaaaaaccattgggtactatgctcactatctagatggcaggatcaatcataccccaaacctcaggatcaaacaatatactcatgtaacaaatctgcacaggtaccccctgaatctaaaatataagttaaattacaaagaaaaaagaagtagtatcaggttctcagtcactgcatggaagataaaatagatctcacatgggaaatccagatcttgctgaagacatccaagtccctttatgttctataatttcaataacagcttccaatgtgggagctcttttacctctgggaacgttaacccataaaaaaatagagcagaagtgagactccaatctttaacctgacacagaaacttcttgtaaaagtcagtaggccttgaaagaaagttaatatgccacagaatttggctttatggctttgatggtgtgtgaatacatttaaatgaaaagagagactgtcagtggcggagaagctgaggactaggaaaaggacaccatgttgccacattagtatgtgatgtaattttttccatcactattttcttagacacaatattaaattgtaatgttacttttatttaagccaatcagtattacatattgtatgatttaatgctgtaattcaactcacctttcccaagaagatagttattaatgtaatgtttaaattgttatcactctgtgtacaattataaagatgatgttattcttattttctaacaggaggaagactttttccagccaagttactttagccatttcaacccctttctccttaatgggaagcagatggctattgattgattcctgcagagaatgttgaaacattagatccagtagagaatgccaaagagctgcagcaattcatgggtaaaagggagagtttttcagagatattacagggaagtgttattttttatcttccatctctcaattaataaagatttgagcaaatacataagccatgaccaaaatttaacaaggaggagcctgaggatagcagcagaaaccccaaagtgattaagtgaaatgagaacagcatgagatttagcagggaaaaagtttgcttaattctaccaggtttaaattcttgccagttccttgagaaggaggaaatgaagaaggattcaatgttcctctaggtatcctttacagggctgtattcgatataaacatgttttattgcaggcaatagagcaaatcaccatttgattagggtagagagcagattctatgccatcagtgccttgaactttgttcagtgccttggacgttgttacaagtacagatgtgttgggttacctctacttgctttatagaaacaaaattttctctaacataccatagatgtaggttgaaaatgtacggttatatagccccatcactctgaactctatgtttctatacctcatccaatacaatggctcagttctctccctgggtccctgctcttgattatgagaatagtatgtaattaattacctttaggagaaacataatgttttaattcactctacaaaaaggattctttgttaataaaaacatagatgcactttactattactactgttaccactagtcaatgtcaatggctactgtttattaagaacttactttgtgacagtcattataatccatgagtgtacattaccataattggttaacacacctccaggtggtaagtatttttattattagctccacttacatataaggaaactgcagcttagtgaatttaagaaacttgctcgaggctacacagtttgtaagtggtgcacatggtttgaacccactgaatcatccctttcattgactactttgttcttccagaggaagcagtaacttacaagtaattcaaagtattattgcttaatcaatgactaatctcctgaaccaactttcagatattaaacacagacagatatacagatgtcttttcacatagctatgttttaatcttggaaagaaatataaatatcccatttcgtcctcataatagctattgaggaggatatgataggttttatcatgtaaaatttatcatggggtaattgaagctcaaagatatataatctgtctaaaattacacagctaatatttggcaaagcttgagtcttccaaatttagacatttttttttttttttgccaatccacaaggtttacccaagatagtcttccaataaaactatgcccatctgtctcaatccctgattgctgacctcctgagatatttttaaatcatgaaatgctttcaaactgattagctagtatttataaactagtgagcactaaccacctcagaaaggaatttgagacttgtcttaaacacggaaatgatcaggtcattgccatcagtgtggtccctatgatgacagcagtatttagaaaagtatatttcaaatgtttattaaagtcatagagaagaatgatgtactttacattgcatctcatttgtcaagagtgattatgatctgagctttgcaaatcaagatcattgatgaaatggaggaagtaatcgatgtgaaaaatattctgcatgtttatgtgatcaaacaccaaaggttcatggttttacttttcaaaatgagcttctgcatatgggcagaagtatacagtacagtggtgtgctgacagtaaggatgaggggaggtgccagggacatatcagggacatatgtgtctgcggagtgacaggaaatacctttctgaattaccaactttctcaaaaattgaggagaaataaaactaaattactgaactggtgctataagatactcattagagtattgaaacaaatacacaacatgttagaatgaaaaaatattgcatcaattacaacaaaataagacatgggatttctaggagatttcatgactgcaaatgaaggtgtggctaaggattcacctgccatctctcagggacatgtctctcttggcttttgggagctatcactctggaacccgagaactaatttagggaaaatctggaaaagattttagtagaggaggaagctttgtttttctttcaataaagtcagtgaaccaggacatggaaatttctgggaagacttaatgtgtcaatctaaaggaaaaactgaggccaaattaatataagtagagagtttatttgggccacgtttgaggactgcaacctgagaggatagatgcaaattgcctggaatatagactctgattagaaacagttaaaagtgagtttaaaaaatttttgtatttatgtattttcttgagacagggtcttgctctgtcactcaggctggggcacagtggtgcaatcttggctcactgcaacctcccaggttcaagcaattctcttgcctcaaccaggcaagtagctgtgattacaggcatggaccacctcacctggctaatgtctgtacttttagtagagacagagtttcaccatgctggccaggcatgtcttgaactcctggcctcaagtgatccgccaacctcagcctcccaaagtgcagggattacaggcgtgagccaccacacctggcccaagtacatttttaaaagaaaagaagaggcagttcctaaatgtttttttatttttatttttattttttttgagacgtagtctcgcactgttgcccaggctgaagtgcagtggtgtgagcttggctcactgcaaactctgcctcccaggttcaagcaattctcctgcctcagcctcctgagtagctgggactacaggtgcgtgccaccatgcccggctaatttttgtatttttagtagagacggggtttcatcacattggccaggatggtctcgatctcctgacctcgtgatctgcccgactcggcctcccaaagtgccgggattacagatgtgagccaccatgcccagcccctaaattgtttaccaagaatttacatgaaaataacataagctattgattgactatatattgttctttatctcacaaattccaggaacatgacaataatggacagggcagccagtcaggaacaaaatgactttaaaccattgtccctgagcatgggtgacgagggagaaaaacctgactgaggtcccatcctcatgtctctctgggcttaataaatttcacatacttcacagcccagactgctctcagtggttttgcttttcttgtaagcatctctctcagatgagggactttttgatgttacggtgttctctgagactcccaatgactccaaagtatttaacctttccagctaatattaaaagaatctgaagagacagcattaaaaactcaaaggtaaaaaaaagaacacttaccattggtttattcattaagttcagatttttaggacccaactggatagagcagatggcaaatggaggtttcactcatttaccactgctgaactaccagaagctgaatggagttatggcttatgaaaaactgcttaactattttgtgaacccaaaccttcaactttagaaaaattcagtctttaatgcatacatacctaagagcatgtctaaattgtgaagcatctgtatgacgatatttctttttcttttcttttcttttcttttcttttcttttcttttcttttcttttcttttttttttttctgagacagagtctcgctctgtcggccaggctgaagatcagtggcttgacctcagctcactgcaagctccgttctgcctcctgggttcatgccattctcctgcctcagcctcctgagtagctgggactacaggcacccgccaccacgcccagctaatttttttttttttttttttttttttttgtatttttagtagagacggggtttcaccacgttagccaggatggtctcaatctcctgacctcgtgatctgcccaccttggcctcccaaagtgctgggattacaggcgtgagccaccgcacccggccctgtgtgactatatttctaaagaaaccgagcagagagaaaattttgaccaagacaaaacatccacacaaagtagagatatgtaaattgaatacaaacttatctgaaacttcagtaaatgctttcactctagtttgcttcatgagaatacattggcttttctgaaactacaggtatgaaaaatgacaatctctgtcagcactgtgcttctcgattgaactgacaggcctaagctgaatgcactcaagtttctctagaatgactccagtaaataaaagttacagctctgacttgattagtaataaacactgactagaaggctccctgtttttatataagtgatggtgacaatggccatatttgttttggagcagataatgtttttaattttttaaagaaagcgctactcaaccaaataatagtcacatgacctacacaaatagttttctgatcatgtgaccattgctgatcttagatacatgttgttcttagatacagtttgttcatgaccttgtctctgccaagaatggaattaaattatgaagcccctactgtataataacaacttttccaaatacttgttcaactaactatcacacctataccaagatctaaagagtataataatcatcaaaaaggtaagaaaaattaactaaggttaagtagcctacgcaagttaaaacatctagaaagacgtgatttaaaatggggtttttaactcctagtacagagtcatcttttgggggcatcttcaactgaaacagacttcaaatctatgatataatatgagttctggacaaacctctgtttatcacttgcagtcacttagcatcactttgtttaatcaaaactgcatctaatagttttatttaacatatgattttctattacactcagtatatgagtgcttaataagtgtacctggctatgaaagtttattataagaaagtatgaaatgcatagttaatgcatatctttaagtaaattgtaaaggttgaatatcctgttatgcaaatatttagcagcctcttggtgcttaaattctgtttcaaatggggaaagtgcagatgatgctatgaaggaattctgatagatgattacacactctttgagaacactagtttttaaatttgctgtgctcctaatcaggatcaatttatcaaaactcccttaactgcgaagataaatagtgaaactaactgccttaataatagctagttccttctaaacttcttgaggctacatgcatatttccatgtctttatttaatatatacaaaatttatgtgaaggacacctttattatcttgttgtacttaatataataataataatgtatacagacaaaaaggaggtgccttagttctgaaagtgcatttttcaagatcacatactaaacatgtgttcagaaaatagcttcagagaaattatgatgatggttaaatatttatattattctcttcctgtttactataataccttccacttttcctgtaattaagtactgatgtttgccctgcataattattaaaaagttttttcttaatgaaggtgtttaattttaagccacattaagaattatctccatacatgctttattatgtgttacatgacaaatcttcaaaaatatattctattcctcatcctgttttttttcagaacagcaattcatttttcaaaccaaaacatataaagatgacttacagaaaaaaataccctaaaaaaacagaagcgaagactgttagaaaaatgactgtgtatttggtttaactaagtaggataatcaagtttgttacaaaaataatgtcaataggagacactctcagagttccaatgcctgataggtatcctactaagagtttattcatttgcttattctcttatctgctacctgcaaagaagacaaattgatattttcacttaagtgattccagatgagtaaacccattaaaaagaaaaaaagtcaatgattggcatacgtctgcaaatttagaaattttcacacatgcaactgttacactgcacttcccacgttcttccaaactggaaacaataatatgtattattttatgtaaataattaaaaactggaacaagtaggccacaataattaattacttaactattttcactttgctaaagctgtccttaacaagtggtctattaccttcattaaaattgtaatgaattttatctcccttggaccttttagtggaaatgaaaaataacatataaataagtaaatattgaaattatgcttgggatatgtcatattcaaaaaattgcagtttgctggtatattaaaaaattctgtacttctttgagtgacaccaaatatttgtttgcaaataaccctatatatttggaatggaaaatattgtcagccatgctgtcactttcctgctccactggcacaatttattttcaattgatttttgtttactactcctagatttggccttagaattcctttcagaacaattctctagggatcagtggctttgtgttttaaaatctatttgccatcactgatctaaactgtaaacgctaagagagctgagaactaccattcatggtgaaatagtccagccatagggaaaaggtagaacaagtgccttatagctacagtccttgccggagaactcttatgggctgttgagaaggctaaagcaacttcatcttggatgctaatcgaccatgtggacttctccttaaccccaattctgggaatgcctctaagatttctactttcatttatttagcaaatcctgaccttaggtcaaaacaagctttttttttttttttccccttgagatgaggtcttgctcatttgctcaggctggagggcagtggtgcaatcatggctcattacagcctcaagcagtcctctcacctcagcttcccaaagtgttgggattataggcctgagccaccgcacccagcaagagctttgatgttatcataaacgcatactcaccataaatcttgcccctaggcaaattctggatggtatagaagccttgaatgtggagagtaacaatgcagggatcccctatcttgtctctcagccgcctgaaacatggcttctgttcctaagtgtctattaattgttctttctgagatactggatttgccagcctctttttttctgcctctcagcttccttggcctttagaggtagttttgcctagacctgctcaccaaggaacggctatgatttgggagtaggtagatatcaaatagggaatttattgaggtatgcacaatagttccagagcttagctctgaaaagaagattgagttatatttaatgaagaaaccaatctgtttgtttgtttgtttgtttgtttgtttttgtagagtcggcgtctcgctctgttccccaggctggagtgcagtggcgcaatcttggctcactgcaacctccgcctcccaggttcaagcaattctcctgcctcagcctcccgagtagctgggactacaggcacgcaccaccatgcccggctaatttttttaatattttagtagagacagggtttcaccgtgttgcccaggctggtctggtgagctcaggcaatccgcccgcctcggcctcccaaagtgctagaattacaggcgtgagccaccgcacctggccccaatctgttttttaatctttacactgtcctcaagattctgaacatgaccatgcctcaaggcattggtataagcattttcttgtcataactgttggtatttattcagttcccactgtgtggcaggtagtgtgtgccacacaactattatctctttaacatttgcaacaatgcctcaagacagctcatgtattatcctactttcataaatgaagaaaggtagttggcattccattctctttttactataccaatcactttgcattggtgaataataaaaaatattgatagaaaacacatatcagggaccactagttattcggatgattgttatctttaacctatgtatagtttgatccattttgtcaaatttacattttagaaaatattgagcttaatggtcagagagttacaattctcacctcctagggtaaaaggagccatctgtttataggtcctcatgtcctcaaccacagggcaggggactgacccaccaaggcaaaactgatcattctaaggaacagagagctcataaggttagcacacctaccctgcttaatgtgccacatttaagcatattaaaaccaaataaagaagccatgagcattaacccatttttaattaatagtgttaaaacttaagttagccaagttacacttctatcagcttgtttctagagcatattatgttaaatcatatttttaaaatgataaattacactctgaagttgtataagaaatagaggaaagtagggcagatgaattctaaatatggtcttaatttataatctatgattattttacttagtttctcatgttcttacccacttgaaaaaaaattggttttgcccacagcaaaaacatttcatgttgaaggaacaaggactgtatctacagaagtttatgagcaggaatatgttgttttcctacttgtcaacacgagtctcccataggagtctctcctttttcctttttaagccaagtacttaattatggccttgtaattacttattcttgtcaattcacatcaaaacaacatagctacaagggatttgtttcttgattttagaactcgattaaacagagtccattcatgagctcccagtcctgctgagtggtctttcacttcctgacacataattaatatcaaacaattttttctaacctggaatgtgattttggtgcatctaatcaatcaacattgctcatgaaaatagatgaacaattaagaccactaaaaaatgactcagcctttagggtctttaaatggttgtgtttttctgaatacattcattttgcaggtaagcagccaaggttaataactgagtgatgtggaaagagcacaggtctacagtattagtctgagatcttgcattgattatttttagcatttaataggaagccattatgcactcagatctgtctggattgagtgctgatggtacaaggtaacctcaaacaaaataaaacacctgagcagccacttagtatgttgtgtgagatttgttttatttccttcatacttttattaaatctgtgatatatggggatgccgtggtttaggctggatgctgttatttatagacatttcaatggccagcagtgggaaaattgccttataaatttcctaggacaaaaaatgtgccttaaatatttaaactgttttcctaaaattggtgacttgagtcaactgttgagagtaaatagctcctttctttgtagagattgtggtggggtgaggatgcagtaaagcttgaatgggaatttagttagataaaagtaaaactcatgatccgcctgacttggcctcccaaagtgctgggattacaggcctaagccaccaagttcgagaccagcctggccaatatggggaaaccccatctctaaaaacacaaaaattagccgggcatggtggcgcgcccctgtaatcccagctactcggggggctgaggcaggagaattgcttgaacctgggaggcagaggttgcaataagccgagattgcgccactgcactccagcctaggcgacagagcaagactccatctaaaaaaaagtaaagactctattgtgaaattgagattccataaacaggagcaaaattgcttctaaaaataatgtaaaaaattatcaattttgaaatgaatgaggttgtgttccaatattgtgtttatttcctcttagaaaagtgttagggacaagctgccccaggaaccccccactccctcaatgtagctgacccttaccctgaatactctgcagctgcattcctgaacccttatctaggtgccacagcaaggtaaccagatttgctatgctgaagccctccaggcagcatgggggaggtcatgagaaatgtgggtaaacctatgttacacccttttgtaaattcctgttttcataatatattgtaagccagccacaagatgatatgtggtaaagttaaccaacaaacaactccagggcctctctccctggtataaacccctcactttgtaagctcagggctgcctcctctgactgtggtggagcaacccggcaggttaataaacttactcgcctgaccttgggtctctctctcatcttttctctcggctaaccttgcaaaaagctgttttgttcaggtctaaggtttaaggggagttgaggctttacattgtatagaaaaggcatgctcagggtcagctcattatgggaaagagctggctattacaaaagagcttagattggagcggaaagaagaaggctgagaggacctcttgaggctgggcatagtaactctaggacttgctgtattgtttgttggttttactgttttgcaatttctatctgatatcccaatacacacaaacacattctgttcttagttgtgtagaggtggtattaaaatactgcttgtgcttataaggagggtgtgtcaagttctatgggtttgcttctgtttgaagaaagttgatccaagatgatgaagctgtatttaagaaaatctgaattctcttctgaagctagacagtgggcagtgggatttggtatagactggaacttctagagtcgagcaggactccaagaccattgaaatttaggtttgaaagaagtgtctgattattcaaaatttaatgtaggcttataaatatgaaaactaaggtttagaggcaagaaagctagtaagtgacacagaagtaatattcctatttcaaatcttaattgttaagtttgattcagattatgataaactagcttgcagcagaacaatcctcccatcaagaaaaattttatcatctctattagggaaaacaaaaacaaaaacccgtttgaaggcacaggagagcaaccaagatagctaggacttgagtggctaatatcctacagagaagagacactcactagagtgagcttaatcttctgcaacacatttctgctcaagtcgtttgatagtttataagacaggtggatggaaaggcagagaagtcaagctaaagctgacgctaaaaggcaaaaatactgagaagagattttggcagtcattgagattggagacttcattcatattcagcattaccaaagtggctaataattgagaatccaagatcctgaaaagaaaagtaacatagagaagtgagctcaatggttgagccactttcccctcaaggcattagttcattcagatgtggttcaaaccaagagctggagaagcttagtacaacagctgctcctaagagactggaaagctacacacaactgttggcagttttcagaactggataagcattggatttcagtgtggagggtctccagtaaacaagccaggctttcagctggtgctcctgaaaaactacattctaaaagttgagacagaacatatgagatcttacaaaggcttcaactcacccttaaatcagctcaaacacagaaagtattcatacaatattcatctacctgcctatcaaaaactaaaaggaatcatctagagaaaataacatcaatgaaaaccctctacaaaattttgtattaaatcacaagtgtcagtggattaaaaatgtgacaaagaaaaaaagaaaagaaaagataatggaaaccctcacaggtggtccattcagtaatatggaaactggacaatgccattgcaaaaatgtcattctcttatatgaatttagatgtacatttgttgttgctgttatttagagacaaggtctttagagacccagactggtcccaaaactcttgaggagttgaggatcaagtgatccttctgcctcagcctcctgagtagctgagagtgcaggaatgcaccattgtgctggcttagatgtaaatttttttatttttttgagacagagtcttgctgtattgcccaggctggagcaaagtgtcgtaatcatggctcactgcatcctcaacctcctgagcataaggaagatgtaaatttttaaaccaaatgttagaaaattaaaacttgcaatgtttgaaaaattaatgtatcacaaacaaattgtgtttatttgaggaatgcaaattttgtttaaatattttttaagataattatattttctacatgaaggaaaaaggaagtagcataagatattctgaataggtacagtaaacacattttgtaaaatttaaccctcattttcaaaaaaaagcaaacaaaaaaatagcaaactgaaaataacagagaattatcttaatctgatagaagatatttatgaaaaacagagcaaccctttttctcaatggtgatatacagaaatcctttgctttttagtctgagaaagaattaagaagtttaaaattagttctgctatttaattttgtactagcagctctatccagtgtaataactcaaggagaaaaaagagcataagaacttatcaggagtaaataacacaaacattattcaaagcagtctggctatatatgaaagtaatccaaaaaaaccatcctgttaacctatcagaactaataaataaactcaaagaagttactgaatacagggcaagcatggttgttcatgcctgtattcagtaactctcagcgctttgggaggccgagatgggaggattgcttgagaacagaagttgaccagcctgagcaatatagcaagaccctgtctctacagaaaaattaaaacattagctgggcatggtggtgtgtacctgtagtcccagctgcttgagaggctgaggtgggaggatcacttgagcccaagtgtttggggctgcactgagctctgaataagtctttgcattcttgcctgggccacagagagagactctctgttgaaaaaaaaaaaatagagaaaaaaggttactgaatacaattaatacaaaatcaatgtcttcctttgtatcagcaataaagtttaagaaaacgaaataaaaaaagtctttacaattatatttaagcaaatatataactatgaatttaattttaaaaaaactaaataaatgcagcatgcatttaccttgtatgttgattagaagatgcaatactgttaaaatgtcagttcttcccaactgatctatagattcagtaccatctcaatcgaaatcgcataaaaatattttttagagactgtcaagttgattctaaaatttgtatgcaaattcaaaagtcaaaaaatagctaagacaacatgaagaagaatcaagccagaatacttaaaatataggatatcaatactttttatagagctggagtaattagagtaatgaaggtattggtataatggtagataaactgaccaataaaaaatgagtccagaaggaactaacatgtatgaatatttgattcataacaaaggtttcactgcagagtagtcgggaaagaatggtttttcagtaaatgatgttggtacaaagtgcatattcatagggaaaaaattggaacttgtctccctatattacactatgcataaaagtaagttcaggtgtactccagatttaaggacactaaaacactaaaacttctagaatacaaaacagattaatttcatggctttagaggtaagcagcaatttttaaaagaccaaaataagaattaatataaagaaaattaaaatggaccatcttataattaagaacttaaaaatactaataaattagtgaaaaagcaaacctcagattacaaaagtatttgcaatgtataaattatatataaacatatatattatgataagagtaaaaaaaatcacacaaaaaatcagcaggaacttgaacaaacacttcacaaaagagaatatctaaaatagtcaaaatactaaagaaaaaggcagtcaacctcattggtgatcatagaaatgcaaagtaaaaccaggtagacctaccacagacacaccagaatgactgaaattaaagcaagaagaagccatgtctagtggcacacacctgtagtgccaaatactctggaagcggaggcagttcctcatctcaaaaaatatttaaaaattaaaaaaaattttaaaaatagtgaaaagagcaagtgctgctgagcatgtgatgtgaacaactagatctctcctatacttccaggagtgtatcaattgaccacagtctgcaaaagtatatgtcagtatttactaaagctgaatgttagcatgcccagtatttcagaaattctcctaagtatatactcaatagaaatgtaaacatatatgtacctaaagatatatacaataatgttcataacagcactatttgccatagttaaaaaaaaatggaaactgcctaaatgcccaccataccagggtacataaataaaatggttatattaggttggtgcagaagtaattgtggtttttacgattaacagtaatggcaaaaatgcaattacttttgtatcaacttaatacatacaataatatgtataattcagcaatgaaaatgatcaaactacatgcatgaatcttactaacataattttgaacgaaacataggcatcaatgagtacatacactatatgaagtacaaaaataggtacaattgatggtaaaaggcatggccatggttacctttggaaaggagagacctatagttactgagagggtgtttctggagggctgacaatgtcctgttgctgacaagatctgattacacaagtgtgttttccttttggtgattcgccaatctgtagtgtgcatattttcacctttctcttattctctaatactcgcataaagaaatttgcttaaaataattaaaaccacaatgtggtgagtgctataattccttccacaaagagcaatcagtatgttcttttccagtaaaaacctgcgccaaggaacatagagacactgaattgtggggttaactctgcatgaaggtgtctgggagagatacggttttgatctgtgtccccagcagcttttatgtcgaattctaacccccagtgttggaggtgatgcttggtgggaggtgattgaatcatggggtggagtgctcatgaatgggttcgcgccatccactggcgctactgaacgggttagctggtactcatgaatgggttagcgccatccactggtgctatctcccagtctcaggtatttcttcatagcagtgtgagaatgaattaataccgaaagacacttagataatgcgttaggtaggattgtggaaataaatagatattttcttggcacaaagagaggagtgtgtaaagaaacagcatgcattaagaaactttccaagactaaaaattctgggaatgcagcgtcttcctgcaactgctgaattaattgttaaagtttttgccacttgaagatctttcctccattttatcaatctacggaagagaaacgcagtaaaagataatctactgctcacggggcttattatccatggcctccctcctgctgaccatcgactagacatgtggctactcattatccccagaaagagtgctcagggaaggaaggggaaaaagtcaaattagttaattaagcatctctggccaaaggtttggtagtgggaagaggttgaaactaatgactaaaataaatctgttagatttaatgaaactcttagttttggcttcccctgactatatggagaaatgagaattaggctttaatttgctttttaatagtgtcccatctgacacaagctcttatgcacttaattcagcaattaaaagttttaatgtatagaagatgctaaggaaaagagtgcccatttaaacttgtcattgattccctgaacaaatgcaaactaagataacaaaaaccacacttagaagtcatttttttaacagcaaactttattattttactgaaatgcaatgaaataatgacatttgctttctgtagtcaatgacattacatttttttaaaactaaatgtcgctaatttttattttcaaattataaaacatttaccagtttaaaaaattataaacaatgtctgttttcattggaattgtcccttgagtcattcaactttaatggatgcattttacaatggagagcatttcattagatgggaatgtggttcaaagctacccaagaaagatatcttctgcgtttgaaagccagtccattgatacgtgacttactgaggattgaaaaggtttattgtaatacaagttttactgtaacaatcacataattaagatcacacattactcatatcaactggtccaccaattcatcatcagtgaacagatttttcattgactgctggagactctgatatgttgggatctacatatgagtaagcaaaacatggagaaatggtcaaacagcagcagtccatgaagcacaaattggaaatatttgcaatagcgattcacagtgaagagatgacagaggaaggatgataggatttatattgagataagaaaaagtaaccatggggaaaatagcactattaaatagaaggcatctatttctgaaatctgagaatatccattaaaaacccatagaaaaaaagagacagtactgcataccatgaacaaaaatagatagtatctgtgtggatctatgaagtagtaaattatcatagtaataggatgttaatatatgcttgatggagactttgtactttgaagacagaagtttgagcaaataatgacttagacttgaatctgaaatagccttctaatatgatttggctatgtccccatccaaatctcatcttgaattgttattcccacaattcccacgtgttgtgggaggaacccggtgggaggtaattgaattacgggggcaggtctttcctatgctattcttgtggttgtgaataagtctcacgagatctgataattttataaatgggagtttccctgcacaaactctcttctcttgtctgtcaccatgtgagaagtgcctttcacctacttccatgattgtgaggtctctccagtcacatggaactatgattccactaaaactgtttttccttgtaaattacccagtctcgggtatgtctttattggcagtgtgaaaatagactagtacaccttctatctctgaactgaggaagttactggtttgcatcagtttggtaccatcaagtttctgagtggcttatatggctaattaagggaagacctttaaaaaagtgagataataacccacctaattactatttttaagtgaatttccaggtatggcatatatggctaatgagcagtaccatgatcttgtcacaattttcaggtttgatattatctgatcatgggaataatcattacatggatttctaccttagtaataagaatagattggaattgggagcacagattattttcatctctgctatcaaccactccagtgaccctacgctttcaagattgttcaattatatagaatcacagacaagaaggatacagcaataattaacctggtctcaggtgatccatcctagatgaattagtcaagatttattttaaggaatattaaagaattggcttacatgattgtgaggactggcaagtccaaaatccacacagaacaggttggcagctggagacccagggaagagttgatgttgcagcgctagtccaaaagcagtctagaggaagaattccctctttcttcaggggaccccagtctttttctctcaaggctttcaatgaattggatgagatccactcacattatggagaataatctgctttactccaagtctactgatataaatgtgaatctcatctaaaaaaattcttccacagagacatttagactgatattctgccaaataactggtactatggcttcggcaagttgacacgtaaaattagccatcacattaacattcgtacttcctaataaaaataatctgatttggtcagtttgctactctctaatataaaatactaaattgggaaatgtttttcaccaatgtgttagaggatgttggcttctttcatgtccactgtgtaatactctttatactttcactgatccctgggatctttgattgtgagtcaggaatcaggggagggtttggaagattcctatgaatcatggcaaatgatgcaaagagaactgttaggaatcatttccttagaaatgggcagagaataaggcaggcacttagaatttcaatactttctctcaaacctacatccaaaatgtgtatgtcaatttgcaattctatcagcaataaatgtgcactgaatagaaagttagaatgatattaatccctttaaaattttctcatttctctaacaggtataaaatgaaatgccaaattgttgtcattttcatttatttgaataccagtgaggacaaatttccccaagtgtttttttgttttccccttgagcaaatgtttattcatattatttatccattcatctgttaaaatgttacactattctttatacatttgagtgagctttttatgtactgaagatattaacctctttatacctttatcatgtcgaatataagcacttcacatttagaaacttgtctcatattttagttgtatttattttaattccagaagtataaaatcgtgtattttcaaatctttcaatttgttctttattactttttttttgtttcaaaatgtatcattcctcattcctttacacatctaaaaaatattctcttttattcttggcttatatacatatatatatacatatacatatgtatatatatatgtacacttatatatacatatacatatgtatatatatatgtacatatatatacacatacatatgtgtatatatatgtacacatatatatctatatctatatctatatatagatataaagtaagtttcaagactacctacagtctatttgagagaatggtatctactccattaaacactcaattttctttattcctatatacttgtgagattatatatttgattaaaaagtaagatatatgtgtacaaatatgtacgtaaacatgtatatgcaattgtatgcatatttatctactagtacatacatatgtatatatagaaatgtctatgtctatcatttatttaaaaagaaacctctttctcttgacaaggaattatccatctgacaaggtattaataaccagaatatataaggatctcaaaccactgaacagaaaaataatttaacaattcaattaacaaatgggcaaaatatctgaatagacatttctcaagaaaagacgtacaaatagcaaatgagtatataaaaagtttctcaacattattgataatcggtgaaatgcacatcaaaactacaaggaggtatcatctcaccccagttaaattggcttttatacaaaagacaggcaataacaaatgctggtgagaatgagaagagaagggaaccctcgtacactcttggtgtgaatgtaaattagtacagccaagatggagaacagtatggatgtccctcaaaaaacaaaaatatatttaccatgtgatccagcaatcccattgttaggtatatacccaaaagaaaggaaatcagtatatcaaagagatattgctttcaatggcaaaaattgtaattacttttataccaacctaatatatgcactcccatttttattgcagtagtattcataatagccaagatttggaagcaacctgagtgttcatcaacagatgaatggataaagaaaatgtggtacatataaacagtagaacactatttagccataaaaaagaatgagattttgtcatttacaacaacatggatggaattggagatgactagattaagtgaaatatgccaggtgtagaaagtcaaactttgaatgctcttgctaatttatgggaactaaaatttaaaacagttgaactcatggagatagacagtagaatgatggttaccagaagctgggaagagtagggtacaggggaagtgagaatagttaatgtatacaaaaatatagttagatagaatgaataagatctagtatttaataactcaacaatgactaccaccaacaataaattattatacatgtaaatataactaaaaaagtacaattggctgggcacggtggctcacgcctgtaatctcaccactttgggaggctgaggtgggcggatcacatgaggtcaggagttcaagaccagcctggccaacacggtgacaccccgtctctactaaaaatatagaaaattagctgggcgtggtggcgggcacctgtaatcccagctactcaggaggctgaggcaggagaatcccttgaacttgggaggcagaggttgcagtgagcagagatagtgccactgcactccagcctgagcaacaagaacgaaactccatctaaaaaaaaaaaaaaaagcataattgcactgtttgtaacagaaatagatgataaatgcttgaggggatgaataccccatttaccctgatgtgattatcatgcattgtatcaaaatatttcatgtaccccataaaaatttcaaaaaagaaaaaaaagagacagaaatttctcatcaatatccatttcaaggtgcatcataaggttggaagtacaccattttctaaacttacacaattcctattttgttcaggaaaacatatgcttagttataaatagtcatccctccttactttcctgcaataggaatagagatgcgaccacgccctggtcaattagatgtaaatagaaatcaatgaatggggcacctgaatagcaatttaaagggagccatatttaggtggtctatttctttagctgtttatctttctccttttctcctttgtcctatctagaataagcatctgatacctgaaggtaaaacagctctctgggggaagtgagaataaaagccacacactggggttggtgtaacagaaagctggaattatctgggtttttaatggcatcgtggagaagtcttaccagccttgacttacctatgtctcccccagttttggtatgcaagaagaaagacctttgtgttgtgaagccagggtaggcagttttctgttttctgcagctcaatgcaggcctaacaaatgcatttacttctatctaggacttgcaaggctttttatttatctataccactgaaaatggcaaataaatcatgtttcttgcttctaaaacaattaccagttttgtctttaaacattgcataagataatataatgtttatagagacaatttaattttaaagaaacagggaagttaaataaaacaatgcatatttcatctctgttatagaaaacacattgatctaagccatgggcccacatctataattaagccatagcccttgacacaaagtgttcgcattctagtgggtaagaaaaatgtatatggatagctgtgacactgtctgacaagtgcaataaatataatatttccaaagctcaatccaaacccttctcaaaatcattttttctttattttttctttatttctcaaaatcattttccttttatcacagggcagcattattaactcaagtcccatcactcacccaagactcaaatttcaggatcttgcttctccttcatgcttgcaatcaatccaatttcccttaaatgtgtaccacatctatctccatttatggtaccactgtttatattcagcaaccacctaagaattattgcactaaccagttgactggcttctgtatccttcatcttttttaactcctttatgtttttatacctgttaccacagtcataaaagtttttttctttaaaatctgtttttgtttcccaacatctaccagataaaacctaactccttaaggtgactgatgtgttagtgagagttcttcagggaaacagaatgaatggagtagttataaataaagagatttattatgagaggttaacttatgcctgtaaggaagctgagaagctccatgatctgctctctgcaagttggagggacaggaaaatcagtggtatagttccagcccaagtccaaaggcctgacacctggggaaaaaaagatgtaagtccatgtccaagtcgaaaggccagagaaccaagagctccagaggataaaagaagagagatggtccagctcagcaaaggaagtgaatttgcctttcctctgcctgtttgttctattcaggccctcaacagattggatcatgcccacccatgctggggcaaaccatcttctttactcagtctatggattcaaatactaacatgcttccaggcacaccttcatcgacacacccagaaagtaatgttttaccatctttatgggcatctcttagacctgtcaagttgacaaataaaattaaccatcacatctgataaggcctataacccaaactaggtgcccacagcataagtgccagccaccgtgggcaactgggagttcccggaatgtgtcatgctctttcagggcccctccggaatgtgtcatgctctttcagggcccctccctatgccatgggaacccttctattctcttctctacctgacttgtaagagtctttgtggaagcttttcttttcttccctggtaactttaattctctaccctctcctggctcataggactttcttcattttttccttccttgtccctctctctgccttcccttcttccgcctctttctcctattccctctttctttttctccatttttcccttccttgctttcttttttactttcttccttttctttctttcttcctcttctccctaatctttatactagaataatttgttgatatatttgtgcttcgtaaaagtccatgaggtccttgcaataggtcactttgtgttacaaagaacctggtttttattttttattttttgatcaagatgttaagatctaatttcaaaacatatggaaataattgcatacatttaacattactgttaaaaaaactctcttaaatcctttaggaaacaataatattatttttgagacagggtctcactctgtcacccaggctggagtgcagtggcacgatcatggctcactgcagccttgacctcctaggttcaagcaattctctcatgtcagcttccttagaagctgggactacaggtgcgccccgccatgcctggcttagttttatttttgtatttttgtagagacagggactcactatgttgcccagatgggtcttgaactcctgggctcaaaagatcctcctgccttggcctctcaaagtgctgagattacaggcatcagccactgcacctagccagtattattattaacaggagtaataactaatacatcaattacattactatgtgacaagctttgtgtttgagcaaatattcaacatgtttttgtttgtgtgtgcacaatctggacaattatatatgttgataaatatataatgtacatgattataggcattacatgaaaaaacatgagaaaatatataattcgttttttaaatgtgtataattttttgttgaattcagtgttaaatttgtgtaagttaaatacatatatattgtgactcacttatattctgtctggtttttcattgccccaaatttgattaaaatttattcttcaatctttctgaaatgggtttagtttatagaatgaggagtaaatctaataaagctattcaaggcctcatcatattttccccagccttaaaaaaaaaatccagagaataagatctaatttcataacatatggaaataattgcatacctttaacattactgttaaaaatctcttaaatccattagaaaataataatattgtttttgacacagggtctcactccgtcacccaggctggagtacagtagtgagatcacggctcactgcagcctccaacttctcttcaccagcaaacaacccaggcctagatctccaaattctgaaatacaaaaatgctgccctttctcatctcagtattcagaaggtggcaaaaagcactctccttttcaatcttcaactccctaccccaatacagattttcatactggccttgactcaacagcagatcttctctgcgctcagcatccagggctgcccaacttacactcagagggctaattaattcctgccccctggtggtaaaatgtgttgtctttaggaacgtgaaagcttggctgccctaagagaggtgagagacaccttttattccgtcctgaagagataatggccacaaaacaaggtctgatgtagtttctccataggccaccctgctagtataacctctcagttactctctctgatttatgtttcctctttaaattctgattcgggtattttgatgatctgctcaaacggctcttggctcaagtcattcagctgggcccaggtttgatagcaaatatgcttgcagaaaacccaagctaaagacatgtcaaacaaactgggcataaaacacaacatcgaatcctatttttttttttctgaatctccaactcccaagtaatgtgtagttaaggagcacagacaacaagttaattcggtgctccccataattcccaagccatgttcagggccctgccttctaaaactttcaggggttaccaaagtatctctctcaatggacctgtgcttcccatttcgcttgctgaatttgcagggaagcaatacagtgtcaaactgtggttctcaacccaggtgatgtgcctgcctcccaaccccacctaggacacatttggcaattttcacattgtgtgcgtgtgtgtgtgcgcgcgcatgcgtgtatatgtgtgtgtgtgttttgagggtaccagtgctactggcatctagtgggtagaaaccagggatgctgttaagcatcttatgatacacagtaaagtccccatcttcaactaataattcagtccaaatatcaattgtgctgaggttgttaggccctggtggagaggtttaaagattctggagttaatcagacttgctttgtatcctaaatctgtctattaggttctctgaaacctaagtatcgtcatatatacaacaggaaaaataagtttcaccttagggtggtgtaatggctaaatgaactcatccatacaaaacacttatccacttatcacagtgtccacagaataagcacttaccatatatgttgttattatcactaattttattaacacttctcagttcaaaatgaataaagaacttttcaaattaaaatgaaagacatatattagaattctaataaaaatgtatttgatacaaaaaaatttacatacaatttttaccatcctgcagtagaagtgaaatgtttcttgcattgctactcattggcacaattgttggcttttggtaacttttttcataactgaaaattgttgctcaaatatttctgctataccaaaggagtaactcagtatatgtgcaaataagtcatttaaaatagttaccaaataccatcaaacatattatttctctcctgattcagttcccttgggtcaaaagtccttattcttggagctggtagaaagactttctccactgacactataaacgttgtctctcttgagatatcttatgtttgtgtcaagcttgctatctttaggtactcataaagtcatcagtgtttaaaggagcagaccatgacagggtcctttccacagcactgggccatctcttgtcacgggcacccaggtatctcataaaagtctatcatgcaagtagtgtcttcaatgtcttctctctggttctcatttcttacaagcgatttcttgaattcttggaaaaagtttttcatagtaaaaagaaataattcaaacacagctctgtgtctaccctacttttcaaaaattaactcctctgcaacttcattttaacaaaaacctgcaaaccaaacaacaactttaaaggtaaactttgattaaacacaagaatttacattcccaaaaaacaaagaacttaatctcttcactgtgagctactaataagataatggaaaattgctttatatttttatatcttaaggtgtaccctggatgatttgtatcatgtaaagacacagactgccctgaaaacacattgaagtttctctgaggatagaaattgatttcaatttttctcttctttctctatctctcccgaacaccccctcccccaccaccccaccacaatttaagtgtctaattagctagagcattttgttacgtatagcattatttcagaatgtactcatataaaatttgagcattgtctacacttttgaatgggttgcagtaaatccaaccctatgttgatttacaactcttgcagtaaaatcatgggattagagcattctgcattggaatgaatcttgtagatcaaaaaacactgaattggaatgtattttgtaggctattgggttctaaatttggatataaggaaagcgaaggaaagaaatgagatgatacaagtaggccccacagtgagaggggactgtgcttcctaaactgagatgggagatatgtgagttacacatgagttaataaactaaatacacatataattggcttacttaaggaagaggtctaagatacagaccctgtgcatagtattataaagattgtatcatagacacatgccatctgggttatttgtctaagtacctacaaccaaagtattctccaacagagataattaggggaaaagacaggacattctatatgatttttaagaaaggagaatgaagtggaacagagtactcgtgaaaggttcatacttcagaaatagacggttagctatggtttccatagaagaataaaataaatgataatctgtcagcttagattgctcttagaaagcaaagaaagcagtgtggtgattccgcaagagctaaaaacagaactactatttgacccagcaatcccattactggatatatacccagaggaatataaatcattctaccataaagacacatgcatgcaaattctcattgtggcacttttcacaatagcaaagacatggaatcaacctaaatggccattaaggacagattgaataaagaaaatgtggtacatatacaccatggaatactgtgtagccataaaaatgatatcatatcttttgggggaacatggatggagctggaggcctttatccttagcaaactaacacaggaaactacaatcaaataccacatgttcttacttataagtgggagctaaatgatgacaactcatggtcacaaagggaacaatagacactggagcctacttgagggtggagagtgggaggaggaagagaagcagaaaaaataactgttgggtactaggcttagtaagtgggagatgaaataatctgtacaacaaactcccaatacatgagttcacctgtataacaaacctgtgcacatactcctgaaccaaaaataaagcttttctaaataaagaaagcaaagagcagacccaaataacatttgtagtacctgaagacttacgtgcaaaatagatcaatcaacagagatatgctgaatgaattaacaaacccaaagaaaagttttctgtgttttttgtttttcacaaaagaccctgtgtctgtctgataatatatttgagggaagattcgcattttggaggccttcatattacagaaagtcaacgcttacatgtattatttttatgtctataaaaatagcgactgagccaacatgagaatcataatagtgtttccttattatcttctgtgaccagtttctgtgtccttaaggaggggcgatatgaaaatatattatcagttattatgtgcctttgtcttgtttacctctcaaccttcttgcaaacttctgataaaatatatgtgtgcaataaatatttgttcattgagaaagaaaggctatggaaaaaaagagcagggagagataaaagtaaggctttgagttatcaaaatgaagttttctaaagcaaatttttttgtttctgaattctggaaatacaaaagaaaacagacaaatgaacaagcaaacaatgaataatttctaaagttttccagtcttgggttctacctgagtattatttgtcccatacagaaaatctcactttcccttctttccctctaatgcccacctacttcttccaaatcaaattagtcttttttaatcatgctaagacaccaccatgaataacttatggttgttttatagaattatttattgactttcaagaagatgattctaccttaactgctaagttctgcaccgaaaaattgagagtctgtagtctctttaaaaggcaactaatttaacaaggaaagattcaccaatctctttcctgtcattttccagaaaaaaaaagttttgaataatttattaccagtttcctattagtaaatcaacacacggcataaataaataattccttgtagctggggttttccttgtcattagaaatagataaccagggccttttatgcttgatgataaatgtttttccaaatattttgattaaatttttttttttttttgagatgaagtttcgctcttgttgtccaggctggagtgcaatggtgtgatctccactcactgcaacctccgcctcctgggttcaagtgattctcctgcctcagcctcccaagtagctgggattacaggcatgtgccactataccctgctaatttcgtatttttggtagagatggggtttcaccatgatggccaggctggtctcaaactcctgacctcacatgatccacccgcctctgcttcccaaagtgctggaattacaggtatgagccaccacgcccagccttgattaacttcttaaataaaatcaagtgtttactcactttactctcccatggattcagaacactggcaggtggttaaaagtattgttagaaattaattgatcccaggccaggaggggtggctctcgcctgtacttccagaactttgggaggccaaggcaggcaggatcacttgaagtcaggagttcaagaccagcctggccaacatggtgaaacctcgtatctaccaaaaatacaaaaattagctgggtgtggtgccaggtgcctgtaatcccacctactctggagcttgaagcaggagaattgcttgaacccaggaggtggagactgcagtcagctgagatggcaccactgcactccaacctggatgacagtgagactccatctcaaaaaacaaaaagaaattaattgatcccagaaatctcatctaatatccacaatgaaagtttagggtagtcaagatataggccacacttttagatgtcagatattgaatcagctatgtcaatgtagacatgatctgctctatggtaagatatgttgtatgctgcttgctatgcctactgtaggcgcttagtaaagatagggggatggaaatgtaaatacatgtataaattcaatcttggattgcaggtttctcctcagaaaaaaagtagaaaagtgacagtttttcatgatttagcactgattaacatgattcacagcttctttcttctctctctctctttttcttggtggcataaggacaaactttattgagaacagcactagttctctttctcctgcccggtcttggttccctagactatcccgtctggcgggcagcaatgagacccactttggccagcagaggcatctctgcagatggtggagggcttgccgatgtgctggtggctgccacctccctccgaaatgatgctccacagggttcatgttcacaccccaccccgtacttgtggccagcagttcctctttgccttatatctgtggtatgcccagccagccttcaggatgggtttgtcaatttggccacctccagccaccacaccaaccacagctctgttggctgaggaggtaaccttcttggagccagagggtagctttacacggctcttcttggtctcaggattgtgggagataactgtggcatagttccctgatgcctgggtcagcttgccatggtctctaggcttctcctccaagcagcacatgattgtacctctcaggcatggtatccacagagagaacattgccaatgttgagctgggcaacattttactatttcatattaaaatgaggtttaatattttataataatggtgctagaatttcaattcataatttgaaaatgtaacaagcatttttttaaagactctgtctctcaagccctccacaaaatgtgacctcttcccacaatcaattgagacttgcagtggcaaacccctctcttgctgaatttgattgatccaccttccatcctgatttccacagagaccctgggctggtgctgatggagcattttttgtcatgggggaggaaatgatcctttcagaacatttagcaataaaagcagtgcaaaaataaatcaacgtccctgacctttctctctccctatttttggcaacaaaccttttactccaagttgtcatttttctacccatgctcagaatcaccttcttattctccaggtgttcctaaaacttctccataaatttctcagtggcgtctccatttctttctatttccagttatgtccccatggctggctttgagaccgttagtatcacgtattaattattcatcttctgtcatcttcctaccttacattccactactggtagtaatttagctgattattttctgtattttcagtaaaagccttgttaaatgaaaatccttaaacatgtattctgtgaacaggttctcaccattatctataataataatatagattgagtatccttaatctgaaaatccaaaattcaaaatgtttcaaaatccaaaacttttttaaaaaattgtattttattttaggtcctgggatacttgggcagaatgtgcaggtttcttacataggtaaacgtgtgccatggtggtttgctgcacttatcccaaaactttctcagcagtgacataatattagaaggaaatgctccttggaacatttcagatttgggattttcaaatttgggatgctgaaccattgtaatgcaaatattccatgatccgaacaaatctgaaatccagaatgcctttggtcccaagcactttggatgagggatgctcaatccgtaataacagtagctgtggtaatagctatctttcactaagtagctacattattcctggtacatttctaagctctttaaaatatacgtattgtctcatttagcccttaccatcacttgatggagttttattgcaatccctattttacagacgaggaaactgacatgtagagtctgaaagtagcatctcaggccccatgcttgtaggcctacaattcaaactcaggctcttctgcctggagactttatgctttactattctataccgctcctagatgtgggagagctaacccacaaggtttacatattctaaattttagcaactgatgtcaaattgaccttaaaatggacgctataaatttaactcccattatagttagtaatagttataattagtaagcatgaataagacctgctatttgatagcaaaacaggtgacagtagtcaataataatttaattgtatattttaaaataactaaaagagtataataagattacatgtaaagggatggatatcctattctccatgatgtggttattatgaattgcatgcctgtatcaaaacatttcatgtactccataaatatatacaccatgtagctacaaaaatttaaaattaaaattaaaaaaaataataaatttaactcccagaaatattgaacaatagtggtgctttcagtcttttatttatatctacctaccagatcaggaaaaccaaaatctcaggtcttaaaatgtgtattcctgggtgttgaaggccgaacgaatgagggtcatgatcaactcagtataccactgaaggccatatgagtaaacagcaaactgtttctcatgaaagcaggatgttggcaaactgacaaactgggtctgccacccagaaggaatgctaagggctgccacgacccaggcacaagtgtttcttgtgattaggcacatctgaagcctgttagcaataaagtgaacctgtgatcaatgaagcagctgaccaattgttacctcctcctccctgctctttctactcaataaatacgaagggctgtagaagctcagcacggctgcctttgctcattaggagaagggagcccttttcttcttcccctggccccttcctttaaaatagtttcttttgtctgaagctttcatttctatgttcttcctccttcgttcagtctcctaatgacagtctcaggtagtaacagtagtaactgccgtagtgatagtctcaagtagtaactgtggaagtctgccatacctgggggcaaattttagccataaaaatatactgtattcttcagtgcattagtctgaattgttgaatgttggaagtgaaagaatacagagtggtactatagcctcctattttatgatggtaaaacctgagtatctgagggttaatatgacttccataagtttccacatagaaatacaaggtttggggagagctcagatgttttctatcttttaaaatgctatttctgctcatcagcactgcctcctataaccacttctttagaaattacacttaagtaaaggatttcatgttgattatttgatagatgtgccaaaatactgtgctggacattgaatgctcatgctagaggtcaaagaaggcacctaggaaggcaggatgtaggataataagtcctcttttctaacctcttgtactattctcatgaaaaataaaatactaagagaatagaaaatgaaggaaaaccctatgcgtagaatcagcccgtacgtttctggctacccaccaagcatacttattttagcatttgtttatgatacagactttgtgattacaaaagcagccatagattatccaaaccactaatgtgaagacgagtaacagaattgtgaaattggaatgcatcccagaattaattgtagataaaggcctatcatgccatatgacagacaagtgattgaggactagagacgttaaattacttgcccaaagtaacactgctagttagtatcgaaaccagaatttgaatttaagttttctaaatgtatacatttccataaaagtaagaatcgatctactcaacttgttcaacaaatgactattaagggattattaattgccagacaataatctagccattgacaatttgatggcaagacagatatctttactatttccctggcattaatcaccagtggggttagagaatgtggagaatgacacccccacctccaagtctcagctctcagtgttgacgtccatgtggcgggaacaccactaggaaaaagtttctgacctccctctgtccattaggcaggtagagggaggttttcttgtctgatcaatgggcttggatatggaattaggcatgcttaatcagcacctcctttccttcccatcaggtagcttctattctgctctacttctctcctaagcgtgattaggactccagtggtctagcaccgtctgtctctaggtgaatgtcttagcccatttgggctgctgtaacagaagtaccataaattgagtgggttatcaataacagaagtgtatttattatagttctggagtctggaaaacaaccaaggcactggcagacccagtatctgatgagggccagcttcctggttgaagactgccaacttctttgtatcttcacacggtggaaggggcaaggcagttctctctgattgttttataagagcattaatcccattcatagacggcttctccctcatgacctaattatcatctcctaaatgctctatctcctaataccatcaagttgggggttaggatttcaacatatgaattttggagggaacataaatatccaggccatagcaacagctcaatctatttaattctggaattaatatcaggaacacctcttacctttatatagagtcacctatctctgtgagaagtaatttcagtagtaaaaacagcagtttactcttatttgctgactcttttattctatttttcatttggttcaaaaattgctgagggaaaggagtgttacatttgggatcgccatcaaacctaacacaaaaattcagatcaatttttatgtagcaaaagtcgaaggccctatagaaacatgcaagggtagtttagaagatatgaaggctgtactacctaattttaggtcatgtaattctgatttgctatctatattttatttgtgtattagtttgctttttttttttttttttttgaggtggagttttgttcttgtttcccaggctggagtgcagtggcatgatcttggctcactgcaacctttgcctcccaggttcaagcgattcttctgcctcagcctcccgagtagctgagattacaggcacccgccaccaggcccggctaattttttgtattttcagtagagtcagggtttcatcatgttggccaggctggtctcgaaatccttacctcaggtgatccacccacctcagcttcccaaagtgctgggattacaggcgtgagccactgtgccgggcctagtttgcttttaataatgggcccgtcttgcttttgaaataggcatcttttatactgaaatgatattataattcactagagagagattcattacaatgtgtgcctattctaaacctcacccaagagtttctttgctcacataggtataggatagtgactcataccacggacctttgaggcataattaaagcaaaaacctaaaatattttcttctttaagaaaaaaaacagtcttctggtcaactacgtattaaatgcacttatgatttttatagatgtagcctaaaatgacaagtatatagcataaactctaagagttagctcagaagaacaaatgcggtctgtgatggttatgaaggtatggtctgttttaaacgttacttgttatgttctgtcaacagggggcactagagagtaacaggcaggaggagaaaggaactgttccttctttgcctttctgtttctgtaatgtcactgtggcaatggcagttggttccagttcccccctcccaccttctgatttgaagaactagtctcattgaattcccaccagagaccagcacaccccaacagcagtgccccctccatagaggtctggctcaccattccacagggtccccctgttccaccgtctgaactgtgcctctcttcagagatcagtctcactcccctagcacttattggattctagcaaccctgacttcttccctttgtcccagatctcacgggtgaggctgcttcctgcaattactatccccatcatcttggcatttccagtcctctaatacatgcctaaccaattctctatattatattgccctggtttctgttttcctgcgtggactctgagcagttgcccaatgctaggcataccatatacatttaggaaaagttaaactcccaaatgggctttctccaaccactctggatccacagctaacattcaatatccaagtcagttctagaacatgtcagcatcatccactcatcaaatcagtagtcatgtgaacagatggtgctcagtagcacttctagaagtaaaatgttaaagaagaaagttctcaaacaaaaacccttgaccatcatacttattgcacagtatctttgcaattagggcaagggtcaaaagccggcaatatgaactggtttctgagaaataagcttaaattatttatgcattctttaaaattgtttctaagttacattattttacaactaaagttgcctccagacaagaataacgagagagaatgagacaaagaaaaaggatgtttgggggtacggggcaaaggaaacagaactgcttgttcttgccttatgttgaaattccattcttcagactgatttagcaactataataaaactcactcagcagtttgaaaaactaaataaaaattatcctcattgctttttctgagcctgtaaaagattgtagtttttaatgataatccatttgtggagtcttccattgcccactatctctccctgtgatcaggttatattctggtgcccggctaaaatcaacttttgatcttcagcattccttgagtttctaattatgatgatctcacctatcagtgtgcctctcctttctttgtttgcattttccttttattttatggctgtagaaataaacacatgttatctctggatcttcatatcaggaggggatatatgacttgataagctttctcatcagctgttgaaaatagtcagattccagcccaaccaaactggagttaatatgttgcttgcaaaaatatgtcagactttttattgtgttactcttttaaaaggttaataattgtagagtttaaatggtcaaggttaaggtgaaccttattattacctgattatgatatttaatgtctttagttgtgaaatcagttccatcagacatggggcctggtgtctactgaaagctttaatgatctggcccggggtccaggcagattttactagtacacttaggtacatgtgttttacaagaagggtggagtctctcagttaaaatgactgcagtttgcagcttctcttccgaaaattaactcatggaggaaattctggtctcctatggcacttcctctgtttttcttcttttgaaacataaattagcattagcccaaacacagggtcttgaggaaatatgtaagttaggtataaagcttccattggtagctcttggcaattcagtaattaaggtgtaacaaaactaaatgcatctctactgatttaatggcttatttgtgacatgtaataaaaatatgcctgtatctttaaaagtcattgcctgggcttggatggattcgataaacactttgggaagggaacatgcggaaggaaggcatagttaaacaccataaaaaattttaacagaggttggggccaggagtgttggctcatgtctgtaatcccaacactttgggagactgaggcaggtggatcacctgaggtcaggagttcgagaccagcctgaccaacatggagaaaccccatctctattaaaaatacaaaattagctgggcatggtggcgcatgcctgtaatcccagctactcgggaggctgaggcaggagaatcgcttgaacccaggaagctgaggttgcggtgacccgagatcgcaccgttgcactccagcctaggcaacaagagtgaaactctatctagaaacaaaacaaaaacaacaacaacaacaaaaaaaaagcacagtttatatctagaatgatagaatcatcatattttagaggtgtaagtgttcattaaattcaacctcttctttttttctggtagggaatctgaggcccagagacaaaatgtgacaataccagcactagagaataacctcctattcccaagcccagtctccttttacgactctgtgccctgtctcttgtctccagtcatctgcctgacttggctgcagtgacaggcatcatctctacttcccacaaatatgtatgtggtcccacaggccaccaggcaactatccaaatggcctttagattttatgtagaaaagttgaaggactgttcacttgcaagaattcattggttttatattttaaagacttaaatgatccgggaaattgctttctcggtcccatgttctgtctcaggatagcaaaatatatagggcatccctgcgattggacacagacttctaaaatcaacacgatgtttctaacagccttgttcactgataccctcaaccctatttggtagtgatcatgaaaaccctctgcctttaacagtttattttagaatatgttgcatagctatttctgaagctgtttacatggagataatgataaatatgcaccaagtttcatgtatggaataaagtttcataacttggtaaacagatgttgacggcatggaatgatgttttgcaatcactgaaaacagcagaacttctgggcttgggactctggggttgaggtccccttatgcttttgattaccacagaatgtgagcctacactggaatcagaagaataaaattgtgccctaaatttagattagagaaggatttggggctggttttgtgtctggttaaaccatcatcacctaaaattattgtttcagtgtgtgcttcctggaaatatgtatcccagaatattttttgaatttttatttttagagacagtcttgttctgttgcccgggctggagtgcagaggggtgcaattatagctcactgcagcctcaaactcctgggctcaagtgatcctctcatctcagctttccaaacagctgggactatagacataatcatgcccagctaatttttatattcttttcttttttatttttagaggtgaagtgaagtcttactactttgcccaggctggtcttcagctcctggcctgaagccatcctcccatctcagcctccctattagctgagattacaggctcaagccaacatgaccagctcttccaggaattgtgtataataatttttctgccacggtatggctgtggttgagaaaaccttcactgtgccttcacattcaggttggttaggtactttttagactaatgagttcatgcattctctggaatgagtagagaaatgttccttgaaaaccaccacaactatcttgatcagatagagctgtcatacctggtccctggaatacttgtgcttttatattatgtttctattaatattttataacactactatggtttttttttatctaaaagcagagagaactgtagatgttctatgcctctggctggattgcactgttacacttaaaatctctattacctatctttcaagagaggcaaggaaaaaaaaggaaaaaaaaatacgctggctaagttctctcttctttatcaacagttttctaagttatggagataacattctttattatgataattatgcccatgtcttaaaccaataattaaaatagaaaaaaagcagtaaatatgtattttcaaaaatagtagaactatgacttctggatatatacataacaagtttaagaatcatgatgaaaagacatatatgtgtattcatacacatctataagctcacatacctattcacaattattcataaagttagcatagttattgcctttatctgattccaagataatcttcaaagaacccattagctttagtagaaattcaaacattagtcatcatccacattaagagtttgtaagagatggaattcagagagtcagatgtgacttaccgtggtggggaggcctggggcaggatgagattaattcatctccagtttgagggtctttctagtttattgggatgccaaggttatgtgttttcaagtcaatgattctcatatgaggccaggaaggggagttgctggaaaatgtttaaacaatcctcttccctgccctttcctttccttttacatgctttcccttaccttccttttcccattcctctttatctccaccccatttccttctctcttcttgttgatggcggtggcccatgctacgtgttccaagccggaaattaagagcactcttgactaaagttatacctttttctttgaaaatttacttgtttattcctattctagactatttccctcgaattcaggcaagatcaggagtacaagttctaaattttataaggttcttcccccaaattttagttctgtttggaaccagttcttaaatattttaatttgtagatattgcctccatgtgagacattctcatgtgccttcttgctctatgtgttgtggaatgaaaatgtatgtaattcagtacttcaggaaaatgttctttcccagagggaaatgctacctatggccaggcacagtggctcacacctgtaataccagtgctttagggggccaatatgggaggattgattgaggccagaagttccagaccagctcttcaaaatagaccccttctctgcataataataacaataataataataacaaaaattagccaattgtggtggcgcacacctgtggtcacagctactcagggggtgaggctgcaggattgttgaagccgaagattttgaagctaccgtgagctatgattgtgacactgcactccggcctgggagacaaaacaaggtcctgtctctaaaaaaataaaaaataaagattatgtatgctgggcacaaattgttcctggcatctttcctttagtttcctaacttaaggcatcaaatggagtgtagatggcacaatctgatcttggagtaccaatgttgagaggtaggaagattgtaatatttttcttgggcccgaaatatttatactccccttatatacttcttgtttcatcatctattgtttctcctcataacattacactaaaaaaataaggaaaataagggtatgtctgcattctgtcaaataaatatcttccatttcaagttcaatttgcatcctaagtgtgataacaatagaaaaaagccataatggagtggagtgatgtcgtctgatttactttacaccatgaactccttttcagataaatgtagactggtcgtgcccctacaatacaagtcttcattaattagttatttaccagttacttattgttaaaccaccttcccttaaatgataggtagtgtgacctattttaggaggcactgttttgggtccggagaaaccactctttgttactaactgggttctgaacactctgaaatggcaaaaagttgcaggcagggaacacatatgtcacctttatttttgacagtagaactaggtgtgttaaaacaaatggctttgccaacactaaaccctagaatcagactgagttacccatgtcagggtagcatgggtccaggagaagttccctaagatggggaaagtagtgggagtggacagcccgtgggcaatttgtacatgaataaagaagggttcccaagaaggggagggtcagggatgaaaggcacattcttctcggatatatcaatcataaagatgtcttcatctctccagaggctgagtgaataaagggttagagagaggtcagaaggacatttaggggaaagtcattcctcataggaaacagtagtgagaaaaaagctcttttaataccctagactactaaaacaaaaataatttagattctggctctagcttcctaactaactagctctaaaaccttggattgtggttctcaatcacatcctctacagaaaaaaaggctgtagagttggcgaattttagggcctcttcctttttataatacaacaaaattactgtcatttgtcatttgttgagcactagtcctaggcactgtgtcagagcatcttacactctcctttatttaattctcagaaagtccatcactctataaaaatccagagggttaaatgatggtttatgtcatacaagttaagtagaatagtcgggattgcaactcaaggtcaatgagtcactctgctctgctcatgatatgtgaattaaggtgccatacacaatacatgaagaaagaagcacttggtatcttggtatttttctttgagtctatcagccgccaaatatttctcaaaattactcaagatttatattacaaccagctattgtagcacaaaatagaaattgaatatcttccccaatctgggagaaaagagctcagaaacgactcctacttattagagattactgagtaaagttgcaaattgatgaaaaagactagactctgtagtaatacatcctcagtgccttcactccaggtaaaaaatggttcaccgtaagaagtcacaactgtgacaataataatcgtcattatcatagttgttgcctgaaagatagaattctggacttaaaatctttattttttctattttgaatgaaaccattccagattgagaatatttattctttagataaagaaactttaacataattctttgcattaaatagcagaatctgaatttaaatttggggattgtatatttttgatttaaaaaataagaaaattactttccacttttgaataatttttcctttaaatatgtgagaccctggaatttgaggcagtaaacaattgcatcgcccagagttttctggactccagactgtaagacactgaaaacaaaggtgagagctgagcttcaaatgctattctgatttttcagtcacctgactgtagatagatagcttggggactcgctgagtcctgtcaatcagattaaactcacagacagaaagaacaagaaccatgggcataatgagtagttgaagacaggaaacattttattagatcagctctgagacaacacctatgcacatctgatcaagaattcagtttgcttctgattctaattctgcagtaatctagaaaccatgattccagccagcactgatataagtggaaattttagcatggacagtacagtattgggggttatggatagagttccatgatcttggaatattctctcataatgttgggagtggcagtatggttaattgaactgtcatgtgaaacctctgctcattaagggcctcctggtaagtggaaacccttttcctttagtgaatcgcatgtagcacactaactgtatgatgagaaatttgataggcagcttgtggtgaactcaaagaaaaaaaaattaagaaactcaatggaggcagggcacggtgactcgggcctgtaatccaagcaccttaggaggctgaggaaggcggatcacttcaggtcaggagttcgacagcctggccaacatgcaaaaccccatctctactaaaactataaaaattagccaggcgtggtggtgtgtgcctgtaatcccagctactcaggaggctgaggcaggagaattgcttgaacctgggaggcagaggttgcagtgagccaagatcatgccgctgcactccagcctgggcaacagagcaagagtctgtctaaaaaacaaacaaacaaactaatgaacaaacagaaaaaccaaatgtaatggaacaaaaatgtttcactggacttagaaaatatgtaggcttaatacacccatcagaaaatacattctatgaaagaagggttcagaaagatagtggtcagtaatacagtttcaagatagcaggcagaaataaatatgaaaattatgctatatattaatgcttttcatagcacgccaaatgtagtagctttgtcaactctttaaactatattataaattgttagtcatcgaaacataaactgtcttgtatatacattaaaacagattttcatggttaagtagattgtgcattaaataaattctagggtagagttttgcttgattcatacatttgggacagaaggtgcatatgtattgtgttttcttgtacttctttctctgttgtctataaaagtgagggggtatgcctaagaaacacctggatgctcatagctccttatagctcatatttggatttgtaaaatgtttacagctgtgaaaagtgatacttcagtttataatcagcgtttatttcttgcaaaacaaatgaaaattaggttgttatcttttatttaggaggcagaaaaatttgatctactatgcagtgaaatttatgggaaaagaagtttaaattgtgtatttttaaacacacatttaaaggatctcggctgatttcttgtcactggagcaatggacatagtatgttgtttactagcgatattctttgcctaaataaaatttaactaaaattgaatcagacaaaacatatgaatcctcacatcctatggctttctagaaggcaatgtgctatacaggactgatgcctatttcattttgctattcaatgtttttattaatagtagtttggagaatgtcgttgactctagcaattcttaggatggggccatctttatttctcagtacttctatttttctaaattttaaaaattacttgctcatcaaagcataattgttaagtctaaaaatcactttaagaatctagaactagaaataccatttgacccagtaatccgattactgggtatgcaccccaaggattataaatcattctactataaagacacatgcacacgtatgtttattgtggcactattcacaataggaaagacttggaaccaagccaaatgtctatcaatgatagactggataaagaaaacgtagcacatatacaccatggaacactctgcagccataaaaaagatgaattcatgccttttgcagggacatggatgaagctggaaaccatcattctcagcaaactaacacaagaacagaaaatcaaacacctcatgttctcactcataaataggactagaacaatgagaacacatggacacagggaggggaacatcacacacctgggcctgtcggtgggtgggagtcttggggagggatagcattaggagaaatacctaatgtaggtgacgggttgatgggtgcagcaaaccaccatggcacgtgtatggttatgtaacaaacctgcacgttctgcacatgcaccccagaacttaaagtatattaaaaaagaaaaacagaatatccaatcctcatttccaagacttctccaaagctaacaatttttgtgtaggctgtgtttttgtaaagctttttattctctctctctgtatatgtacacacgcacatacacactataatatacaaatgtatattacataaagaaatgtttgtttatttgcaagtggttatacataaaatatgccagtctacataattttatagatcgtatttattaattttataactttttgtcatattaattcatatggatctattccatcctttttatctgttgtaaaatatttattcatatgactatattataatttatagtctccaactgatgaactttttcattgttctcaatttttcagcgtccaggtggtgctgaggtgaatattgtagaacgtgaaaggatgtttaggtagaagggactttgagaagtgaatttaccttgtcataaagtgtgggtattttaaatattcacatatatagtggctgttaaattccatttccatctgcagtatgtgagaatatatttttaagttgccacatgattaactttaaaaaagtttgccaaatggatgattacaaataatattttgtaggttataattacctattactaaggttgaacactttttaatatttttattaaatcgtattttctttgttagtaattgcttatatactttgcttattttctattgagtcatttgttctttctttttttatttttatttttttgagacggagtcttactctgtcaccaggctggagtgcagtggcacgatctcagctcactgcaacctctgcctcccaggttcaagcaattctcctgcctcagcctcctgagtagctgggactacaggcgtgcaccaccacacccagctaatttttgtatttttagtagagacagggtttcaccatgttggtcaggatagtcttttaatttgtaggagttcttaaatattttggatagtatttatggtacatgttgtatatattttctctaaatctggttttttttttttctatgttttgttgctaggttgattttttcgttaatagactatttccgtagggttaatatttacagaaacattgagcggaaagtacatggcgttctggtaggcattatcatccccccatccttacacatgctcttgctttatttttaatttctttgtgatatctcatattaccaggagcttttcattttgatgtagccatatttgctaatcttttattttacaagtattgtttatttgtttgtttgtacttacttgaaaaaaatctttcctatctaaggtctttaaggtaatgtcttatattttcccttttttattttaggcgttcttttttctacttaaatttaactacacctcttttcaaatttgcctgtcacctcacacatttttttccattgagtactcataccctagttacctcaccattcagatgtcacttccatgccatttcttcccctgagtgttcttttgttcttcaggttaggagcaatcttcttgcctgccagagagtcttgcaaaaaaaaaaaaaaaaaaggtgattttcttttcttctccggaagtttttatattgtacttaaactagtcaagacagtattatgcttgtttcagtatattattcttccaaatagttcttgagaacaagatctataaatcttgatatccccaaagagtcctactcagtgtctcaaagaataagtttaccattaacttttgtaaagagaaaaaaaaatgtatgtttagtttggacaactgaatgctcatctgggacacacagtaattatttccaaatacttgaacacctatcctaggttaaaggaattgaagtggtcctatatggtcaatagatcattgctaagggcaactatacagtatttttctcaatacgaagaagaaattttcagcaaatagaattctctgaaaattgaacgaactcacacaggagtgacttgattattcccagcctcattcaagcagaagcagtgcattaatatttcttctaaagccctttgtacacacagtagtcctactgaaggaatgaatgacatattagctctatttatatgcttcgtgagttttaattttaaacattgactcttgatattggggtttcttccccatctttccagacttcagttacacccatctctggggatcattttatttttctttaaatatgatttgctttttatttacaaaaatgcttagggtatttatcatgttgttttcaccactcaaatagatgattttattttcattttttgggtaataacttacagaggttaaatgacttctaggaggttcaatattaaatttatttaactgctgaaaccttatctacaaaaccaataaatacacatactgtgctgagaaataaacgtatgtttaatactctatgtactctttattaaattgatttatgtttccaaatttctgtatatcaatattaatgtagacattctaggtgagataaacataacatgttaaaaacagaaaaaaacaagtcagaagcttgtgattccatattctactttttttttttttttttgagactgagtttcactcttgtaacccaggctgcggtgcagtggcacaatctcgactcattgcaacctccgcctcccgggttcaagagattctacctcctcagcttcccaagtagctgggattacaggcatataccaccacgcccggctaatttttttttgtatttagtagagacggggtttcaccatgttggtcaggctggtctcgaactcctgaccttaggtcatacacctgccttggcctcccaaagtgcttggattacaggcatgagccaccgcatctggccccttctttgtatctttaatttagactctaaactaaatggcaggaaagcagcattttgacaatgctatgtatattgcccagaatatggatgaaattttagtaaatgtgaaataaagcataaggaaagccattacttccagacagaaatttgtttattaactaagaactaggacattttccagagtcagaatgcaataaattggcaaggcaagatgataggagaatcctaaacgcagattacacataattgtaaagggtctctaacagtatttgttcttctttcaacaaataattttcatgctttagctaattctgaggctttttcttaggcatggagaacaaaagctgagtaccagtgaatcttgttttatggcttctctggaagagaagatttgctgaagtcttctatttttgagctctagtcaccattgctatttgcctgttcttacaatcaatcagtaagaaaaggatgaaatagttcaacttattatgctcaagatagtgttttctatcggcttattagcaaggtgctagttaggtagttgacaaaaatattaatgacaatcaaagccatccgaatgaatttgcatgctggaatctgcagtcaaaccatggaggccccatttcatcaggaaaggtaggtgataatcacactgtcagacaagtgacagtgacagccaaagtaagaaagccggtgatggttgtatttcaaatggagtctcttcggtaagtccattgtaataaatctcagaaataatgatgttaccttcagggtcagcttttagtacaaagagcaataacagaacaacagaaaaaagaaaacctagcaggtgatactggctgtggttaataaacctgggagttgtatttgaacttaatgtaacaagattcttaggctgaataaagagattcagcagaaaattagacgttctagtacttagtagaatcttccccattgggcaatttccagctgctataaattctggaagttggtcaatagcatttcagaggtctgctaccactgcacaaatacctcagaggtggaaaggtactgggtatatagctcagagatctgaagcttctagataaatagctcagtggtcggcagctcgtaggcctgtagcttgaatagtgataatttctcactaaatagctttggggttggcagctgttggaaatataacataatggtgagacgtagctgggtatgaagcaaggattttggtagcttttataccccaaagtactcaatctgcagtggtttagagtttggaaactcttggataagcagttaagttgtccaaagcagttggaaccgttgcggagggtttggcaggctttggatgcatttcgagtgggtatgtggcaattgcatacatacccattggtctgggtgcttgggctgcagctggggctggggctgacgttggtagtttcacagacactgaagacttggcctgctgatggggagttgcagggcacagaggagtttgacgggtcacaaccagtggtactgcaggtcttgggctcacagctgggagatttgcaggttggtgcttcaccgtaggattcttggcagtaatccaggagccagagatttccttggtagctactgggtaagcagtgtccaaaggtagggcttaaatcactggagctaagagtaacagaagaggtcactgggatataacagtgagttctgtatgatgtggtactgcagacaccaggatagcctgtagtagacatggagcctgcaggcatgctcagtggtcgctgtgcagtgtgtctgtggcctaaggacgttttataccttccctggtgattgtcaaaagcctctccagactctttcttctgtctgcttggggcaataacacagcaacatctcattagtgtgttggttagccacagaggctaatgttttcacacgtgtaaaaataagtttattttaattcttcaaagtatccataatcaccactttgaccatcacccatcactcatcatctgtagaccataccttcagcaaatagtgattttcatgttaataggcaaactctcatctgtcaatcagaggttaacaagagttcatgggtctatgggcttctgcaacatggttatttaaaggttcacaaggactcaagtaaagcaagtaacctgtatttttccacgctgttaactactggaaaacactgaaggacttaatcatatactctgaaataagtcaagtagtttgtctgtctcaacatggttactcaaaagcaggcattgacctttcaagaatcagttttccaaatatgtgctatactcttacctgtgcagggccatatactggtaacggcttctcatgtaatgtattaggagaagttcataggtaagactcacagcaatacttgggaaacttggtgaccaacacctggctaaaaatgaacttgttcccagggggcatttgttgctaagcaaccaagacttctgttaaatcccttcttaaagagtgtcggcaatatgcactatcaaataaacccagctttgcaagatgataccttcctaattgactaagattacatatcacatgttccattgcctgctgtaaaccccaattgctgtcagatgtaaatattttccccgtttttccccaaataagttctcttattctttatttgctttcttttgcacctacactttattttactcctgtgttgaaaaatgcagttatttttagtttatgtcaatgaaaggaaataactctttaaaagttttatctgaataaactgtatagttcttacaagcactgtatatatgaaatagcactttttactactcagggtgaaggctaaagaatttttttaaagattttaatttatactgaagaactgaaattttgttcttcaaatataaaattataatttataattccagcctctattgaattggaaacagcaatgcatttattaactgtgaagagttcagacagagaatagaacagtcttcttcaggtataatcagctatagggatagttttttaaattaactctctttatagcaaactatgagatttctctcactgttttcggttacttttcagtcagatttttcaaatgcacagcaatttaaacctacagatattctcttttttttaaaaaagatctccattttctcagtgcttttctcagtatttgttctgtaagttgacaataagcaattctgtattaaacatgttttgctgccttctgcagtatctctcaggtgacaaaggccacaatcatgaaactgtatttccagtaaattgtttggctatagagagccttgggattttgtgcggaaaatgttagtcctgaggcaggcaaaataggaaagaagatacatgggcagttagttgacggccaactttccgctaagttactgagccccagtgatacacagaaaagccacaggttgatgaagctttatttctacagttctctattgtatcattgttgcctctagtctttttttcttaggcatccttgaagcaggtttgagggctaacaccattaacaaacacagaatgagttaagtcagttactgtaaagctcacattcttcccttccatcttaaaattaaatagtgaggtattttgaattaatttgattcacacaggtgtaagtctaaaaaataatgtggaacatcatatggcatgaccaatattcaaagcatgagccattagaacatatttaaattgattttgctatgataatattctaaacaaataaacaatgagatttgagaaaggaaccctagctcatttcctctcatttgcttttgtgtttcctctccttccttactcagaacatcacacacctgtagaaacaacatcccatcccattcacaccatcattttctgtacatgattcctctgcacaattgtgtcctactctaatctcaacctttgaaagagatggagcacaccgcatcagaaatatagcaaatatcaggttcatagcgatggcaggcttgagtagaaaataaagaccattgtcgtttgagtggcatcgtggtctgaaggctttggagagtcatatgcatttctctgttttcacttaactcctaaaataatgttttcttccattaattcccctgttattagtatttgttgtgtgcggaagtccgaataatgcacccacccaagagggtcacattccagtactgggaaatctgtgaatgctacgtgacacggcaaaaagggactgtgcaggtgtgattaaattaaggatcttgaagtggattatctgggtgggcctgatgtaatttccagacaatatgaggatggaaacagagtttggaatgatgtggccacaagctaaggaatgtcagcaatcgttataatccaaaaaaggtagggaatgtatttctccctggggattccaggaggaatcagcactgttgataacttcactttgggtcagcgaagcagcttttgaactgtagcctctagaactgtaagaaaatacacttttgttgttttatgcctttccattgagtttgtggtaagttgttacagctgtcacaggaaataaatacactatgccagaaaagtgtaggaaaatataatagatagtccttatgtagtttgagaagtttgcactctgtattcagggaaagtttaagatgtaaggaatgagcttcctagctatcagataattcagagagataccaatactgtctgtggaatacgcaacaaacttcctgtatctaatgagccagcagactcctttcctcattaaaaaagagttgtggaattctttcccagttttatccaaaggttaaaaatcctttagggtaaacagaagatcaaataaagctaaattttccagtaaatggcccttaaaaaaagtaatagaggacacttttctagtcttttaggtcaaacaaaattttatattcccttttgctactatatatgcagtaatgtatttttccacttgccaagatggtgttaaattaggcaaaactgatcttatgactgaaaaagcaaaatgtttgtgaatccatacttaaataacaattgaattgcaaatattgagtcaaaatgattcttacatttagcattggtaacctaaaatattggttacttgctgtttacaagtagcatttatattgctgtaaatgtaatgcagcatttacattgttggcttaatagatcgttagtggtttaagaagctgaagaacagatgagaaatataaaaaattttaagaaacagaaataaatgaaggtaaagcctttaaaaaatgatagcacaaatgggtggaaagaggaattttcatgcttaaattcagggaaacatggtatacatgtaatgaaatacaactgtagtaaaagttaaacatttttaaatggaactgtcaggactgtgccctactgagttatgcattactgtcttgctgactaccatttaaatgtatttattagcatgtaccttggaaaattgttctctctcagtacatcagtatcttaaataaaactggagctaatagcatgtactttgcaggactttcctgcagatgcaatgagataataaatatgaaaatacctagaaaagtgcaatggacatagtagatgcaaattaaatcttttctttctaattttctaatgctccactttagggaattccggtcaccaattagactaaaaaatattatttgcaatttactttgatgttgtaaacacatagtcctacaataatcattgtgtcctttaaaagtaaatgctaaaaatgaacaattctaccttgtgtagttaagaaaaatgacttgcttgacaacaggctactaatgactcctcttgtataactcaaatccttcagtgtcatatatcattagctagttcctggaagccgtatatgtattgctagcaataaaggctcaatgctcaaattccctggactctaatcctgtttctgatgctcagtttgactaccacgtgtttctgtaacttaatttccacctcttcaaaataaagctaatagtagtatttgctccacaggtggctatgagaattaaataggtagctgtgagaattaatagtagtatttgctccataggtggctgtatttattaaattaaataaatactactaatagtagtatttgctcaataggtgggtgtgagagttggtcaagcacagcataggaaatatagttttgtgtagctgatgttttgatgttaacctttatcattatcatcagcctataatatttgttagtattattattttttattgtcattggatctcatctaaaacttactgcattttgtatgtgtacatcaaaagcaagaagaaagaaaaaataaagaaggaaggaagcaagaaaggaagggatggagggagggaagaaggaagggagaggaagaaggaaggagggagggaggaaaaatggaaggaaagagagaggaaagaaggaagaaaggaaggaaggaaggaaaaaggaaggaaagaacatgccagaataggctgttttaggctaggtaacttgctatgatgtgtataaattatatgttgatcttagaaattaaatttggaggaattgaataagttgaaggcatttaccaccatttatatgggaaataaggatcccagagagggcatactccataaaggtacacaccattaaagttagtccagctagagagaaaggctgggtggggctgtggcagagaggaaatacttttatttgaagtttagatttgtcattctagaattgaagattatggtcaccaagtaattgataacttccaagtggcttctagattagccaaaacctgaataaataaaaatagagataatatgaaagacaatgaaaagtctttgaactataacttatgtgggtcttctggcaagtttcttgacctatttgaattttcttatctgtaacaatggggatgatagtatcttttcatacgtgcattgggagattattgatcatgtagtggtatgcccggtacattgaagatgatcaatatggtggaatagttattggaatatgagcagttgcttgtaagaagaacaagttcccagtgagtaggtggaataactgaattaattagttacatacatataagagagaaacaagttcaaagtaataacaattttctctatgcaaggatccacgggagggaaggggggaggacttaagtttcattcaagaggaaaaaatattgtgctgtccgttgtacagaactaaaatttatgtaacccctttgtgcttaatcttgtggggcaggctgggcattgtaacttgttctgttcaatggtaatttagaagacatatgcagggctgatgagcaattaattttccttgctattttctctctgcctctactggcattattcctgatagtgaagatcctctatgcctgggtcccagaatgagaatgatttgggagctgaaacaatgaatgtgtagtaggggtgataagtagaccattccaattttaagcatctggaattttgaagttgttggttgctaaggcaaaatgtagtctatttgggctaaataattctctttttaactgttagaaaatacaggtgcatatttaatgtttaagtagtaggacacatgcaatcagattcttgaaaggatctatcttgcctgcgtttttcagatactctttattttctttcttttcattatatttgtttagtgaaactaacagtccttaacttcattgaagataatgaagaaccaaaagatactcttttctatataatttgaagacagtttacttataaataaccatgaaaacttgtcttcctattcaaggacatattattggcatagaaatcaagaatcgctggcagtgaaaattttctagtgaagaaacaattacaatctcttagaatttgatcaagtaaaatggtacaggttaaaacagcacctgaactataaacacaatggtccatcagcctaagaacaattcttcaacctaaagataaaatttctgtaaaacgctgtcagggcaagacactgaaaagacaattcagcatgttcttctaagaaatggagattgccaacccacaaaatcagaacaagctggttggaaactgctgtgcatgaaggaaataggttggaaactatgagacacataattcagggatctgaagctgttggatatagaacctatagtttgattaccataggagaaatagctcaagggatagcaggtcctggacacaaaattcagtgattgacagcgacaaaaaataaagctcggtgattgacagccataagagacatggttttgggggtggcaactactgaaaaaaaagccttgagatctgttatgcattgaggattggcaggaacttgagaaataaggattgatataaaaacagctagttgagtggcaaggtctggagacacagtaagtagtagaaagcagcaagaaattttacaaattgcatgcacacaactggatgaatggtagctggaaggtttaccacatgtctctggggagttttctagaagtcaaattcagcgttggttggacaagcacagagcatggtcccagtttacacaagtaggccagagtgcagtggatgaggtgacaagaacatggcagtaactcccaagacaacagaagttgtagtttccataatagcagatgctggctgacatgacagagtctgaagtaaggctttcattcagataagtaacaaagaatagcttatctaagtctacatcaaactagaccaggttgcttctacaccttgatagctatatactcagactctctgcctccccatattttagattaatttgcatcataatatctcatgaacttagtgttgtgttgcctatgaagataactttcttcccattcataaaataattttggttttaatcttctatatatctacagttgtaatctttctcctgtttatcaggtttcagaatgtgtgtgatgtaatcacttgtgtattttatctgctttgcttctgcttccactcctaaataatgcttaattaaaaggagtccatttgaatggatgtttatcctattcattatctacaaggaaccccacagttaggaaggcatagtcctcatcctggaagaagagatacaatgttgcaatgcttagaggaggtgttgatgtcctaaaatagtttccatatatcaaagtttcttggattttccagacaaaatatctcatgctattcgctgtttttcatacttagctgagaatctaattatgtgatgttgctatctgtatattgtcttgagagtcaattttatataagcatgttagggtacattttaaagagctcagctttgacaacttaatatttttcatacttaaaagttgtgtttgatttccaaacacttgagaaaagacatataatagttttacatggtaacattgatgacatatgtgcttttatactagtgcaaatgtcttacatgtacctgtggtcttcaaataagaggataaacatgatatcaatagtcatcagcttgtgtactagctttccagaattaatggatgtcttcatctgaagcaatttttcaggaggaccaatttggtcttcatgcaatgagctaaacaaggattatgcaaaactataatatcacataaaaaagatgtccgaagcctgcttacttgaatactatggaaggaacaacaatattttggattcttccctaaagatgcaagttaatgtttacaggcatctattttctggagtctcttgtcttcccaaaccaacacattccattctcaatcatcttctcacttatcagcagtgacggagttgttcatgagcagaggacactaaagattccaagtagccacttggcatcttagagtatcattgatgatccttctgttgaatactttcctattgtacaatagtcctgttgttcctgcattgttcattgaagattctggaagactgattattattttaattttgcggaaaagatattgaaatatctttttaattggaagcttttacggagcattcagaaaactgcagatatctcatcacccatgcaaacatgcacaaaggaagaaaagaaaacagagagagacagagaaaacacacttatgatatattttgacatttatttacataaacatgacatttggtacagatgtagtataaggttcttcctctgaatttcacattttttgtttcagacagtgaaaggaaaaatgtttgacatttcacatggggaattttcacagtcgattgctacattcttgttaaagaaagcctcagatcacatcaatgtaaaagaggactgttagggataaaaaggaacagaagagattggaatcatcaaggattgagataagtttgagaatctgtctgacatttttccatcttctctgagaaccttaagcactccagataagtgaaatctttcaaatccttatatgcttccaaagaagagtcctccaaagtgaaatattttagttgaggtgtgtgcacctcccctaaatgcctcataatttagttgaagtttatgttcacttcttatattctttgtaaaatttgaaaacaagtggtaaccaactagtctataaaatattttcctcagcatattggcatgttacatgagcgttccaaaaccaaaattaaggtttttctttttaaaccatagtgaaaacagatttgatctcaatagaacggctattgaaatatatctggtaactggaaagtcattagggccacagttatcaaactaaatataatcccatcatttatcatcagtaattaaaatttaagttagatgtggggcatgtaaatgagagaaacctggtatcatcaaacaatgtattgcatcttgatgacaaatgccagagaagccctatacatataccaacctgatgcgtgtcctgatttattatttctaattccatttataatttcttcaaatgcctgtagagactaatggttctttaagtttaaaacatctccatgtagctacctggtttaatagcctgagatcaaaaaagctactgagaagttatatattttgtttgaaatgactggtggaggatatgatgaaattaacataaagtaataaaaatagcatttaagagttcacattttcaccttgggaggctgaggagggccgatcacctgaggtcaggagtttgagaccagcctgaccaacatggagaaacctcttctctactaaaaatataaaattagccgggtgtggtggcacatgcctgtaatcccagctcctcaggaggctgaggcaggagaattgtttgaacccgggagatggaggttgcggtgagccgagattgcgccattgcactccagccagggcaacaagagcaaaattctgtctcaaaaaaataaaaaaaaaagagtttacattttcattctcacatactaattaacatgctaaatcttatttagagtttataagtctaatacatactccgtattttcattggagttctttgtgaaatacagattttaatgactcctaattgcctatataataaagtacacactcctgaacgaggttcagaaaatcttcaatatctgggatcaacatgtattttcaacttctcttcgtgatcctattccaaaacccccatatttccatttcaatttaatgttcaaatttcataaaaccctgctttttagtcacagaaactctgcataagctacacccttctggaatatccttctctattgtgcctctgcaaattactttacatttttaaaagcaggttacaaatggctctcagagacattttctgcatc

SEQ ID NO: 194 - DNA, 21159 bp, Homo sapiens
acatttgatagatagattagattatagagtgacacattggattaaaggtttagtagtgtgtggcttccatgtgccaaagcattaacatagtaatatttctaaattgcttgtttatagatgtagaagattcagtaaaatgagtgtccattttactgtccagtaaactgtggaccattcacagtccacagctaaaaatgaactgtggtcagcacttagaataatgcttagtatataacagcaactcaaaagtatttgttgattaaattatgccgaatgatgtgtttgaagatgtaattttaaataatggtattcagctgtgtttcagcaaacatagtatgagactaaccccgaggaaattttttttctttcaagatttctctctccctgtcttgctttttcttcttcatttttgccatctcttcacactactgggaaggaaatagaaagcattttgttctcctcacagtttcaccctaataataaatagagtaatgaagtataggtctcttcatgggaaacaaggcaacaagtatgctttaaaatacagcagtctctttaccctgtggttgagaaagttctgtaatcaattcataaatttgtgttacagatatttcttataggccatcatcacctccagagattcagctcatgctgacttaacaataccagatatttatcgaccaataagaatttcataaagaaaatggaaagtgctcttctgttttaatggagaatgaaggctcatccatacaactgtccctagagcaaacaggaacagacagcgtgttacgtgcgggccgcataacatttccttgtgtggtctttttttttccactgtattgttacatctgataattgtctatattgggagccagaggtagatagcacttgtatatggaattaaaaggaacagaaaaagtgaaaaggcagcaaaatattgtgtttttttgtgtgtatcctctgaatttgcctctgaagtcattggccttgactgcctaggtaaggctaaattactccttggaaggttctataaaaaatttcttattaagtacactacatttttttaggtcatggaaataaaatgattttgacatttgcaataatgctctgatttgagtttagaagaaaacatagcctgcaattgatttcactaactggagtgtgacctatattgcaaaccctatatccttcctttaatttttaaataattaattgctaagacatacaaatactaaaaaaatttgattgtttcttcagagaatagtaatgtcttttgtctttttctttggatgaaaaaataagataatagcagaggaaatacaaagctaaaacacctgtgatccagcacaactgtcagttagaaaagtacaagtcaatgtccatagtcagctgattaaagttaagcaggtgcatcaaaaatgatgacaggtacttgtgcataagaaagtacgagcttccataattgaacttgattgctcgatatcttcatgtgggcctatttcatagaatcattttaatgtgaatgtttctgttataaaagggatatgttatgttttgctaaataattgtatctacatgttgtaatagaactggtcaatatagatataattaagaaggccaaccataatttattcaatattgtattagttcacaggaataattttaaaaacttgacactttattgactgttctgcaatgaggcattaagtaataatatggtgtttattattaacttcatatttagataaacttaacatgggctttaaagaatttactgaagaggattaaatacatttttgaggggccacactcaattatttgattagattagattactacagaaagtagctttgtattcattttctaatactgaaaagttctggcatttagttgaaagatccgtatatcaaatgtccaatctgcagtccccttcctttggattcaagtaaagaacctgtatctgaatgacatggtcaatactatactgtctatacagaatggctgttcctcagttcacccttgttgggatatgaactttgaagatttccttttagtttatcctatagcctctcactagtagcactttttgtatatggcacatgatataggtgcctcgtgtgcagtaaattgcccgctcatgttgtcccggaggcctagatgtcacgtaaagggcattcacctacttgaaaaagttattgctttccatagtataaaattactggagtatgcataggacatgaaaactttcagtaatctgtgggatttttcctaattaatgctatctatcaagataattgttacacacctcagagtataaatagccacatattgtattttaaaagtagatctctagtttcattgccagatatctctcagcacaaactagattagtatgagaacaacctgcttttgttttaatgcacaaaccaaactttgaacatctgcattccaagtacaaaaaaagtccattgtaaatatgtcagcaagaattaatatcattaatgacatgcttatttgatcaagggaatacattaaaatataaagagtaatttcctatgaaaaaaaagtaataagaccagtaaaaaggaacagaaatgtccaaaaaatttgagagaagaaaagtgcttggaacttgaataaggtcacaaacatttaactactgtcattgtgatatatgtcagaaaagttatagaactaagaaagttttatgttatgtatttcctttaaagcttgcaatcaggtttactctgatatcttaatatctgttttggtaatttgttaaggtttaaaaggtgagtaaaatgtttacaaggtattggctgaggaactttgtgttggaagttaataaacatcagtgtcaaattggaaagattttgcatatttatattgcaaggaaaaagtcactaggctttcttacttgattaggaagggcacttccatatgtcatctctatgatttgaagtggactatacttctcccttctattggtttaagaattacacacactgtatattcttctaccacgtaataacttagaaggatttattgaaaagttcaaaatatgctgtttttgtttttattccattgatgaaataaatgcatgaatgggagtaacagaatatattaacacatctagagaaaaatattgttgcttatccctgcatagctgctggtacatcacagatagcaacaacaaaaatccataaccagtactatgatttggatgtcttctccataactcatgttgaaatttaactgccattgtgatgatcttggcaagtggaacctctaagtggtgattaagtggcagagtcttcataaatcctgttatttcatgagtggtttagactcctgggaatgagttccccaggataccctttctctgtctcacaggctcctttgttctctctcatcatgtgatatcttccaccatgttttcacacagcaaggggatccttatcagatgcaaaccctctatctggaatttccagactccatagctaagaactgataaaaatttctattgtctataatttgcccagtgtgtagtattctgttacagcaatagaaaatggactaggactaccagccaaaatcttaggtcagaaactaaagtgactccagtgagacattagatgaataactaattaacaactcctaaaaattataattgcaagctttaaaaaaataatcttatgaaagaataagtcttgttatgtaacatggaccacttggatcttactgtctcagcaagatgctataattcttagtaagcaaaaattaaatactcatctttaattagaagtctatcttgttgaacttactctacttttggaaaacaaccaatgattgctaaatacctttcagacataactatttgaggtgaccctgttggtggcaaagggtctaatgtattgaacatattggcaaactctctgatactgctctttcttcactcaataccatctagctgcactgggttccttttattctgcattctccccaagttcctgcctttgatcttgttctccatgtctaaaaccgttgactgcagggcactctccttttaatatttctagatatgattcaaatgaaatttttgttaaagccaaaatatcccaaccttgttaaaattaaccagctcccctctttttataatataatttgtatcccctttatactgttttatatactctaatattatcatatttctttatcaatatttatgatttattttttgtcattcccccagattgagttgtttattattgtatttccagaacatagaagagggcttggcatacgatagaaattccttattattgactgagcgcttatgtatgctgaaattacttcgaaggataaaaatgcgtttatcaaatgatacgatgaatcactgactgaattatcaatctgaaatgtttaagtagattctcccaaccgtttcagggaacataatccaaaaaaaaaaaaaaaaagcaaagaaaatgactggtttaatgatttaaatgataagtggaacaatgagtaagtaatcatgtcactgcatatgttttaaatatttcactccatgcttttcttgcatgcatggcttctgacaaggagtctattgtaattcttgtcccagtttctctatagataaggtatttttcccctggctttttcttttctaaagatttcacatcatttttgtttatctgaagtatgaatatgatatgcctaggtataataatctttttgttttattctaaaatgctgcttggtgttctctgagcttcctgagtatgtggtttggtgtttatcattaaaatttgaaagttctccatcattactgcctcaaaaccttatttcttctccttttgacattcaagttaagagtatattatatgttttgaattgttccatagttttggatgtcctcttctgtgtttttgtgtttgttgttgttgtttttctgtttttttaatctttgcatttcagtttggggcgtttctattggcttagcttcaagttcactgattctgcgcttcaccatgactagtctactaatgagaccattaaaataattattcgtttatgttgcagtaatttttatttctagtttaattcattctttaaatttctatctccctgcttccattgtccatctgtctttatatgttattatatctacttttcccattagaactctaaatgtattaatcagagttattttaagttgtgtctgatgattccaatgtctgtgtcatatttgagtctgatgtggatgcttgcttttactttggaggctgtgctttcattgccttttggtgtgtctcttaacttttttgttgaaagtcacttgtgctatattcagtagtaggaactgaggcaaattggcatttaatgttagatttgaaatgattctggctagaagttgggctgtgtttaatacctgctgtagttgtaggtgtcagaggcttcagatttctctattatccttaatttttgtctaccctcttggctttcagctgacctaagtactcctccttagagacgatctgtttcatggagccctttcaactataatccactgttattaaactggagccttgccggtgtggggcgaaagatggaggagaggcgaagcatttcataatcttataattaaacctcagtcttttattggacctgtgtccctgagctgtgagcttcactggtatttctttgtcctccctacttaggtgagccagaaaaggtagtgcaggcatcgtgtggaatgggaaaataccctttccttgagttgaataaggtcctggtaaagtcttttcttcctgaagagtaaggatttatgatggaggaggttctgagcatgcttttctaggattattcctctctttctcttgacagagccattttggcatcatccttggatttcttccatgagaaacctgtgggatccctagaggcaaaaaccatggagtatatgaggtatgaggcatccttaagactgtagcagctaggagggttggatacacatgctggtacacactcagcctccagaaattcctcaaatttatgatttaagtgttcctaccagatgatggcttcagcagcttttgctctaggaaagcatactccagatgtgactctagactcacctgcctccccagattttggagtggaatttggccctccagacttagctctttgatgggttcaggaaaagtcattgattttcaagttgcccattgttttcttgttgtaagacaatattggtgactcttaagctccttacgggttggaattgaaaccagaaatccatacattccttgagtcatcatccccaatggcatcactttcattaatttctggaaaaattctctaagcaaaaatatagtttcagtggagaatgaaattaatgtttatactggcaagtgactattcagagttaagtttagaaagaagactcagaatccaaattctaccctcaaaatatctgaataatctgttagactaactctgttttcatttttcttatgtatgactgatttaaagactctaataattattaaggtatatgtttacttttacctcaacccatttcaatcaagataaagaagaagatgattctgtgtgtctttcttatgtatttggtatgtggagtctcatgttgaaattaaggaaaagtagtgatgcttcacaattgcttttgatggagacttacgctttcttgattaaagttcagttgaaaagggcaatgtattatttgtccttatggtttgacaaaatgacgtcagcttttataaaatccagtttgaaaatgactacatccagaaggttaatcacaaggaacacaatggtacctgaatattaataaagaaatatttaaattttgtgaaaagaggagcctaaagacctaccctccacttaccttactcatgggaataaaacctatacaactagaagtcaaaacttatcagatagtacattgccctgtaatttgcttaaataaataaatcttcatattacacttgtaatgtagtttactgtggagaaacacagactttgagaaaacttaaaaataaatctcagacaagtaatttacaatctctatgactgtggctaaattatgaacaattagagctactgcgctggatattaaagaaattaaattaataaaatactaaatcagacatagatggcaatagacaagtatcaaaggtggactaaggtatagctattagcaggtcctgtctagtcacgggataattgatacagaactttccttaattcctagcgcttggacttgtaagctgtggggaaatgagaagcaaacatttgtttcccccagactcaggaaagatagcgtaaaacaaaactccaaaggaaaaaatgtgaatttctcatcaccatccaatcaaaatgcaatctactgtcattcaaatcaataaacatttacagagagcctagtcatggtactgccacaaaagcagcatttgaagggctcaaagtgtagaggagagtttataaatgcaaataatgaaaaataaaacatgttagtgaggtaacgctagacaattagtcaacagaacagaacagagtcaagaaatagacccatccatttaaagataatgtatttacgaaaaaaggggcacggaactgcagagtagtagaaaaaggagagagttttaggtgatggtgctgattcaacagaattttgacccctaactcacatcacacacaggcacacagacacacacacataaacacacaaacagcttttcattgatggcatatttaaatgtggaaaatcaaataagaaagtttctaaagttaatatttttattaatttggggtaaacaaagttttatttaaaaggatgagaaaattactaactataaacagaagatcaataaattagattcatttctgttaatctaaatacaccattaagggcataaaaagacaaggaatgatatggaagaagttaagctaaatatgtatactcaacaaagagttaatatctagaccatgtgaagaactatccaatcctgaagacagacaaacctactaaaaatagggacaaatgacatggatgttacttcaagcaaaaaatttaaatggccaagaaacaagaaacattttatttaaaaagtgctcaattcaatggaccatcaagaaaattaaaaacaaaacaaacattttttagaattacattctcactagaagtgctaaatgtaaataggctgacaacttcaagtgttggtgagggtgtagaacaactggaattctcatactctgatagtagaagtcaatattagcataactgcaaggataactttgtaatggtgtaaaatagagctgaacaagcacatcctacataacttaattccacccttacacatattgcagaatagaaatagatacagatgtgtattaaaatatagccgaagaatacaagaatattctgtacactaattctaatagatccaaactagaaacaacccaaaggctcatcaacaaaagaatgtataaatatattttggtgttttaaccttgaatattatgtacacaaaaaattaaaagactactggtacatataacaatatggaaaaatcacacataatatttagtacaagaagacagacaccaatgggtaaatactttataatttcattttacagttcaagaacatgcaaaaattagttatgtatgttatatgttaactaaaatctcatttaaaatgatgttaaaaataacagttcaacaagattaacagtagacatatggctgagataaaattcaggctgagccaatgtgtgattagggtaagaggcacagagagggccggggaaaggcttcaaaaaataggggatacagatgtcacaaaatcaaaatatccaggagagcaagcaaataaggcaaataatgaaccagaatgaaattaacaacagtggcatgatcatgatagtaagtggaactggcattctgcttcattgtcaggaagtctctagggcaagattgaactgagaaccagaagtgtgtgccctgtctaaagggaacagctgggagttactgcgagctgcctgccaatcactttcttgcacagtgatacagtttctagcttttctagctattccagttcctcaaaaaggtaaatattcaggcttttaaaactttatttccttttaattaatgaaatatatgcccccacacattttaggttgagtgagagaaaaaatgtatctttaattgttacatgtcccatagcttataacttctggcaaattctgtgatagttcaggactgttttgttcacctcagtatcttttgtgcctggcatatagtatgcaagcagtacctttgtttctgaataaatcaaaagattaattaatgaactcaagactgtgtttttgtaaaagcaagtatgagttttcaaaacagagctgaagaacataccgctctcgatgatgacctatgcaaaaggatggatgactgtaaaaagcatatgtttggggacccatgtgtaagtcaggatcgcaggagcttagttttattatttgcaatattgagcaaaagagcatgaagccagagaggtatgggggagaaagacagtgagggaactaggtgtcatgctaagaggtttgaatatttatcttatgggaatagattataggaagccatcaaaggcgtaagcagaaacttggttaggtttgcaattagaaagaacattctggtggaagtgtgttcatggggtagagagataagagacatcactcctaatttttccttttcaaaacagctttcccaaggactttttgggtctctcaagtacatagggtcagaagtctaaaaagcagcttaaggaataaaccatcaaacaatccctctactgtcaggtaagaatatatggttgagtatcacttgtccagctcagtcatcttgcaagcaattgacgttggttatttctgtgttgaaattaagtcatgaaacacaaagcgctgaaccagattcttaatttggacttaatcgcatttattatagtgcaaaacaaatacattcttcccagaccagagcaacattgaatagcattgtaaactaatttttttgatgtcaaggaaagatgaaaacaagataaaacatgcgagagaagcagcttgcattagatcaggcacagtaaaactaagaaacatcagttgctactagcaaagaagcaaaagtccatggagtttgaatttttgttgtggatgctcagagtgattattcactggaacaaagaagctgctggtttcacagtccagagcaagatggacgacacgtgctgaacacatgggtcagaggttggcaaccactgaacagaggccccagaggtctgaggctgctggacacaacgtgaagactttgaggacgataggccaagcaactcgagggttggcatccagaagtgaggaggttttggggctggcaactcttggacaagcagaattgggggcgataggcattgggcacacagtctcctatgggctggtaactattgagcagcggcctcagtggacgacagccgctggacacatacctctgtggtctacaggatactggaaggcaggaactggagaagaaagaagcaggaagaaaactgcttccttggcaaggcctgggcacgtagtaagcagtggaagaaccgcaagaggtttcaagattgccggtctcacagtggaccggctggcagctggttggttcaccgcaggtctcttggcagttgtctgtgacccaggtatggtcttgagagctagtgggtaagtagaggacatctccacagctcacgctggtagggcagaggtcgatggaggtgagaggaatatggcgggaggttctgagagatcctgagttggagtttcccgagcagtagttggggcaagacatagtgaggttgtgagagcaggctgaagttgaggcaaagaagtgagtgtctgaagtttgttctgcccttccttagcttgaccctttatttatccctagaaggtggtgcttctgcgtgcagactcttcctcttgttgtatgaagatgcatcagaactctttattatagccaaggaagtgaggcttccaccctccataaaactggatgctccttgcaatgccatccattgattacgtctatctataaaccaatgcgactgagttttaataggatctatccttcttaaattatccaaacaaaacagacacattttaaagcctatgtgcttattccaattataaccaccattgcacaaacattcttaagattcctctcttagaattgtctttgaaagttgtagcaacttctttgaaacagtgagaacttacatctttttgaagaaaaattctattcttcttggaaattgccagaagtgagtaacttggaacaagtataagagaaaatgaaaatccttgcaaactatatgacagaaatatggacaatttcaatatgttttgcttggttagaatttatttttctaagttgtgatttgctttatttcagaattctattcagacttgactttctaccaaaatatctttattcaaaaatatgtgctcattttagtcatttcaataaataaataagctgagtgaagctgaaaccttggcttatgtttaagatattcttgaatatagataatgaagttgggccaagttaaaattatgtatcctactgtgaacaaaagcagagaagtagacctcttaaagaaagtcaggcatcttgacatttttcatgattatttcaaggttatgtattgcatggtttctcatattccaactgaaaaaatattgttcttggttaaaaaatacactgattatgacatgaatttattttgctttctacattggccttgatgtcaatttccaaaaaggagcttctaaactgctttacatagggaaaagcatcaggataaattattgttttcctaagttttagtactttaaaggtcatttgagaatatgtatttctggtaaaattgttttaaaaaatgtatgattttagttagtttcaactatccctctatatttttctcatactgacatacccagtggctccagtagctattttaatgggattttaaattatctgctggctctaagttccaattccttttggctagtcaatttaaatcataacactttcttctattttggtgtttgagggacatacttgtgcttatccagtctccctctgtcctggaggagtgaaatctctgaaacagaaagttggtttctcaatgagacaacactagactattttactactgggggagaaatataaaaataaaatggtataatcccggaggtcctgtactaacatgttgaatttatctcagtattttaggtcagacgatttgtacctgatgtatttgagaaagccccactcactccaacccccaaccccaggccctcatcacctaatactgtttgtataaccggatactttgtatacttcggacatcacctaatactctgtgtatacagctgctagagtcttcttgtaaaatcctggttgcatcagctgaatggcgttagtaataggtacagtcatatttagctgaatgcttatgaaattgtatgttgatcctttttatgtctgctcttctctaatataaacaagagcccaacatctgtatcattagtacatcaatacgcttgtgtgtatgtgtggatagatgtatatactacatgttctatgtatacatggatggttttccatgaagagaaggggtgtggaataagaggaaactggcattcatggaatgcctactctgaagaaccttgtgctgtgggtgcccacatgtgccattcactttgtcctcacaattctatacagtagatcttactatttcaagtactcatacgagaaaacttgagctttagaaagttgcagtaataggtattacgaaaaacatctgaaaaaaggctccttgactccccaaacagtttttctctatccaatatggcattacatagagatgcattgatactatcatttaataaccaataaccgtgtgaattgggtaatttgcataattgctctgctccccagtcactatcagtataattttatggaaatattaatagtatctacttttcagtgacatttcaggaatatattgagatgtcattaaaagttaaaataaactgtaaaacgttatacaagagtaatctattttcttgctttggcgttcttaacccattctggagagtacgaccttgggtttaatttctttagagcaccaccatgagtttctcgtgtgtgtgtgggggggggggggcggtgggggggtaaaattgcaaaaatatcaacagatcttcagaaagtgaagtaccctgaatataagttgtccttcatgtaatataggttgaactaaaattatttcatagtggctgtgtcactaatagagaattgcttatttgggcataataccaggtacctcattagcaggatcctataaactacatgtttcagacttctcttctgagttaagagcccagggataatcggaggaactgggcatcctgtgtgatttcccagatttacccatggcgttgctttttttttttttttttttttttttttaataaaccatggatctttgtctctcctactgtagaaggagaattctgagtttctctgtcttggagacaaaaaatccccagaacatttcaacaataaagttgtgccaataaacaaggtacttttaactcatccattcagcaaatattattgagcatgtagtatgtgcaaaacattatgatagatgctggcaatggaaccaacataaaattggtttctgctctcagatgtacactatctggtaagcgtgataagacaggtacataacccatgtcagtgtttactaagttccgtaagtaatgtacagagaagagcaaacatagttcattcaccttaccaaaaatttaacatttgatattaattttgaaagatggaaggggctttggagaagaggaaaacactttaggctatggaagaagatgtcaaggtagagaaaatgacaacatagagcttcccagtgaaggattctaagaagcaaactcatattcacatgttgaaattactgggggaagtagttaagatattgttctaaaggtgtggtgatccagtaatgtgtttcaagaagagagtgctgaggttaatttgcagcatagattggaaagtgggaaaacctgttatgcttttctccctttatcttctaaaattatatatttctttccatttttttctttctgttatcatggcaatgatttaagttgggcttttttgttctccttcagtgaatttcctactgccacctttgacttctgtccctatggtcttctattttgcctaaataatgcatttgaaataatactcatgaaattaatttcatcatatgattctctttctcaaaaaagtggatgatttctctttgtcaacagagaattgttctgacacttgtctggcccttctctacttcccagtaaagattctctcctacttttttgggttgcctgttaatatttactagttctaatagttttttggtggagtctttagggtttctaatgtatagaatcgtgtcacatgcaaacagagacaattttacttcgttatgatttgggtgattttctttttttttttttttctgactaattgctctggctaggacttctagtactatattgaatagaagtagaaagagtgggcatccttgtcttgttcctgatctagggagaaaagcttttaggttttcaccattgtgtgtttcacctgtgagtctgtcatatatggactttgttatgttgaagtatattccttctgtgcctaatttgttaaagtctttatcgtgaaagtttgttgaattctgtcaaatgctttttctacatccatagggatgataacttttatccttctttctgctaatttggtgtatcacattcattgatatgcatgtgttgaatcatcctagcctcccaggaataaaattcacttaatcatgttgtatcatcctttgaatgtgccattgaatcctgcttactagtattttgttgaggacttttgcatctatcttaatcaggcatattggcttccagtttatgttttcatttctgttttatcttttattatccttgaccaacactagtatcagggtaatgctggttttgtaaaataaatttggaaatgtttaaaaaacaacaagccttacttctacaaatcttcctaattttataaaaaattttctatttgacttttttctgctctatttttttttcttctgctgactttgggcttagtttgttattctttctctaacttcttgagaagttaagttgtttgaaatctttcttttttcaggtaggtattttttgctgtaaacatcttaaaatggttttcgatgcattccaaagttttggaatgttgtgcttccattttcattgtctcaatattttttaatttctcttttgattttttctttgatttattggttgttcagtagtgtgttgtttaattttcacatatttgtgaatttttcaattttcctcttgttactgatttctagtttggtggtttaatatcattatggttggatgtttaatatgattttaatttccctaagacttttttgggggctaacccataatctatcctggataatatttagtgtgtgctagaaaagaatgtgtattcttctcctgttggatgaaatgttttgtataaatctgttaggtaagtctgctgtttcctttttgatcttctgtctgggtgatgtatccactgttgaaaccggggtatcaaagtctcctgtgattatcatactactgtcaatttctcccctcagttctgttaatatttgtttttatatttaggtattccaatgttgggtgcatatgtatttgtgattgttatatcctctttatgaatggactcctttttcatgatataatgaccttctttgtccttatgatagtttttggtgtaaagactattttgcacagtagaagatctagccaccactgctctcatttggttaccattttcatggaataactttcactttcagcctatgtgagttctaaactctcaattgagtctcttgtagacagcattttagttggatcttttaaaaaaatatattcagccaccctgtattttttaagtggatatttaaatccatttacatttaaagtaattcttgattactttactgctgccaagaacttactactgccattttaattgttttctgtctgttttgtgattccttgttctttttgatttgacgattttttcttagtggtatgctttgattcttttaattttaatgtgtttacaacagcttattcttggtgatcaccataaggcttacataaaacatcttctaactgtttattttaagctgacaataatttcactttgatcacatacagaagttctacacttcttccccacacacacatattttgttattgatgtcataattacatctttttatattatgtatctattaacaaattattttagctgtattagggttcttcagaggatcaaaactaatagaatatatataaatatatgaggatatttattatgaaaattgactcacatgattatgaaagccgaaaagctccatccatgccatctgcaagatggagaaccagaaaagtcactggtgtaatttaatatgagtccaagggcctgagaaccatggagggttggggaagggagtgttggtgtaaatcctggagtccaaaggcccaaaaaccaagagctccagtattgaagagcaggagaagatggctctcccagctccagaagagagaggaaatttacctttcctgcaccattttcttccctcctgggctccattggattggatgaggtctgacagattgataagggcagatcttccttatttagtctactaattcaaatgctaatctcttttagaaacaccttcacagacacatctagaaatatgctttgcccactattttggtaaatccttaaccagccaaattgacacctgtaattaactatcacagtagttatagttgtttttaatacttttgtcttttaacttttacactaaagttaaaagtgatttatataccactattacaatattaaagtattctgaatttgagtagatacttacctttaacagtgagttttatactttctcaagttttcatgtttcttattagtgccttttcatttcaagttgaagacctccctttagcataccttataaggcagatctagtgttgaggaaattcttaggcttttgtatatctcagaaagtctttatttctttttcatttctgagagccagcttcactggggatattattcttagttggcaagtgtttgtttgtctgtttcagcactttgaatacatcattccactctactggcctgaaagggttttgctgagaaatttcctgatagtctcttgaaacttccctagtttgtgacaagtcatttttcttcataatgggggagtacatactcatgattaacaaacatgtctctcaagtctcatgtagccaaaaggtacaaactttgtgtctgcagcaggaaaacaacatggctgcaactgctggtccagttactccatggcttaattaaactgtgtcaataatgattatattactgcttaatatagaacattcggtggactaaaaaattacatgtttgtttgtttgagcccctagcagatgtcttgctgccaaaaactataagtaaaagcatcttgttttctggtgctaagctgctatctgtctctccacacctgctaatctgttcctccttctctatcctgacataagtcactttaaggagaaagacaattcagggtaggaacaatgtctatatctttccccaagagagactgaagctgtatacactcattcagatacattgaggaacttcaagaaaaagaggaactcaaacttttgtcgctctcttggatacaggtgtccaagttaccattttactcagtccagtggaggtgaaagggaaatacttgaatacagctaatgaggctttggaagagattacagatggaaaggaaaaataatgtgactttctaggtggagccctttgtgtcagtttaatgtacaattgacccttggcatctttgggggactggttccagaatccctgcagataccaaaatttatggatactcaagtacttgttataaaatgatatagtatttgcatttaattcacacacatgctgtcatctactttaaatcatttctagattactaataatagctgatacaatgcaagtgctatgtaaatagttattatgtgttttctagggacgaattataaggaaaaatgtctgtatatgttcaacacatatgcaatcatctttgtttcccttaatgttttcagtctgtgattagttgaatccacagatggtgaacccacagatacagagggcaaactatacttttgctgttgtgttatatgactatgttaccccgttccataaattacaaaagggattccactgattgtgaagatctgtattcatagaagtgctagtacttttggggtctctgtgagttacaagtcactgtgactgatgattttgttattggagcacttagcataggtagacgcctccattcactgaatgccacttggagtcttgttaatagtattctaacctgaatgatatatgagatatattaaatagatttggttgcagcctctattggtcagactaatcggagtggtcagtggaatgtcattctcatgggaaaattcaccaggagcagtgcagtgtagagataagagttgggtattgtttcagggaaaataatccccatgggtctcttgcatttctgcatgtcttcagtgcagtcactggctccctttgttctaaattaacttttcaagcatgtttttagagaaacagtcttggaaaatagatacagtgtttctctcagggtcaaatgtcaaacatgcttactcttcatgatgtctatgatccagggttcctaaactcaacattcctctcctgtgaaacaacctgctgcatatgcaggtgtcagctggccctatgggaattggagctcagggatctggtgtcaatgctaacactctggcttcggctattgccataaatgataaaggcctttgtctctaacctaggcttcttatgtcttctgcctgcattcccgaaactatgacgggttaacttgttagcatacaaataggataaaatttctgacttttcacagttctcaatgccccttccacaggtttcggttttctagttgaaattgtggcactgcaacgtcatcataatcaccaactctattgctttgacaatcttttaataagacacagacattttagtcaaagtataatatagtcataataatattgaaataattatgggcaatttatgcagtaataactagtagagattaatcgaagctattagaagataaagaaagcaacttgataccatattgaaaatacatcttaaaggcttataaggcattaaaagaaaaagctgacaaagaaaagggacacatgtgaaccacagtttagttaataaacagtctgctcatggaataggagagcaataaataggtctgtcacatattttttacagcaatccagccatataacatagccctccatgagactgcccattttccccaactatgctagatagaaatgtttggatagtttacttgggaattgacaattatgagggagtactcaaaatacccccgtgagctatataagcaacagcttttgcccctgacttccatattgtatataatatatataggtatacaatatgtatacaatatgtatagatatggcaatatgtatacaatatgatgcatttgtatacaataagcataagtatacaatatgtatacatacacagtatgcaagtcaggggcaaaagctgtttattatatagctcatcatttgttaacaagtgaaggtgctgcacgacggggcagcagctgctaaatcccaatcatgaatgagatgcaagagccagcccaggggttaatagctctaagaccagtgaatcctgggacagccactgctgtccatgtagtccaaaacattgatcacagattgcttggtggaaggaagtaaagacttaggacgaaaaagattgtatggcaggttctggacacatcacaagcagaggagtacagggagtggtttcacaagatctgggtccgcggcatgctgttggcagctggggatcccctcaggtttcttggcagtagttcaggagctggattctgccatagctgttcctggcttagcagaggacatctctgagggtcacatgaaaaaaggggctattagaggggatgacagccccatggcaataacccctgagggaatgacagctgtggttttcacctgagcaattattgaaagacaagatgaccttagtttagattataggtaaagtactcgcacttacttaatgctatttctccttctttgctgtggcttctagaattttttagtaatgactactagcattcagtgtaggttttattctgactcactatttcaaatgtggttatgaacatagctcaattattcagatgtcaggaaaatggctacttattactatgaaaaaagtactcagtgaatctctaaagcaagagaactgtggtcttgtttactttttaacaaaccatgcatctagaaaaacaatatttcaagttttattaaaatatatttaaaattctgtggctagatgaatatttattacacctggaatattaatttaaaataggttacatttatgacctaataaagacttgtatatgtgttaagtgtggcctttaaggtacataaagggctcactaaaattattgtgcttcatatgtttaaatattcttaataaacttctcatgagagatacttcaatgtacaatcagtaggacactaggttgagcatcacaaggcttgagttctagccctgatcggctggtaatgagccacgtgaaattgaataactcatttaacctcagcagatgtatttgctcaactgcagaataagtaaggttcactaaagatctcttacacatttagacatgattgtgattctatgaaaacataactgtgatagaaatga

SEQ ID NO: 195 - DNA, 38396 bp, Homo sapiens
ctgtcatcccagcactttgggaggctgagctgggtggatcacttgagcccaggagttcaagatcagcttggacaacacagtgaaactccatctgtacaaaaaatacaaaaatagactgggcacggtggctcacacctgtaatcccagcactttgggaggccgaggcaggtggatcacctgtggtcaggagtttgagaccagccagaccaacatggtgaaaccccatctctactaaaaatacaaaaattagccaggcatggtggcacgtgcctgtaatcccagctacttgggaggctgaggtgggagaattgcttgaacccaggaggcggaggctgcagtgagccgagattgtgccactgcactccagcctgggcgacaagagtgaaactccatctcaaaaaaaaccaaaaaacaaaaaatacaaaaattagctgggtgtggtgacatgcgcctgtagtccctgctactcgggaggctgaggtgggaggatcactggagcccgggaggtggaggttgcagtgagctgagatcatgccactgcaccccaacctgggtgacagagagagagagagaccttgactcgaaaaagaaaaaaacctgggcgcagtggctcacgcctgtaatttcaacattttgggaggctgaggaaggtggatcacttgagtctaggagtttgacactagcctggccaacatggcaaaacctgtctctactaaaaatacaaaaaattagcgaggtgtagtggtgcaagcctgtaatcccagctacttgggaggctgaggcacaagaatcgcttgaacctgggaggtggaggttgcagtgagctgagatcacaccactgcattccagcgtgggtgacagagcaagactccatctcagaaaaagaaaaaaaaaaatagaatatccctgtagctactactgagtgagcacctggtctgtgctaggtcacatgttatttcatttgctcatcactacatgtgtggtagggattaatatgtccctttctcagatggaaaaacaggctggcagaggggacacagctagcacgtggtaggattaggatcagaagccaggcctctttgtcctttgggcccttggtggagaacagtgcatccttcagaacagtgcatcttaagcagctcctatggctcatggtatcccccagagtctgccgaggaccctcaaactccctcctcatgcctggtgtgctgtgcctctcctcacagggggccgtctgccctgcccagagctgtgtcctgatgccgtgttcaggctcatggagcagtgctgggcctatgagcctgggcagcggcccagcttcagcaccatctaccaggagctgcagagcatccgaaagcggcatcggtgaggctgggacccccttctcaagctggtggcctctgcaggcctaggtgcagctcctcagcggctccagctcatatgctgacagctcttcacagtcctggactcctgccaccagcatccacactgccggcaggatgcagcgccgtgtcctctctgtgtccctgctgctgccagggcttcctcttccgggcagaaacaataaaaccacttgtgcccactgaacactcctggcatgtgcactcctctggaaggcaggtctcagaaggcacaagtgccggtatggtggccttggggaaggaggaggacaggcagtatgcatggggcagagctgacatgatttagtagcagctggatgtgagacatgcggaaggcgggggagagatcaggatgatatacaggctatggccagatggcggtgtcatcccctgaaataggattataggaagaggatcagagcttcgaggaggatgttgagtttagagatgttgcattttattggagataaaagtgtgggtgaagccaggtgtggtggtagacacctgtagtcccaggtacttgggaggccaaggcatgtggattgcttgagcctagtttgagaccagcctgggcaacatggcaaaactccatctttacaaaaacaaaaaacaaaaaacaaaaaaccaagaaaattagccaggcgtggtggcacacacctatagtcccagctactcagaaggctgaggtaggaggatcaattgagcctcggaggtcgaggctgcagtgagctgtgatcacaccactgcattccagcctgggcaacaaagcgaggccctgtctcaaaaataagtaaataaaaataataaataattaatttaaaatgtagatgaataggtctggaagcccagatggagatgaaggctggcaatagatgtgtgaatcattggcttatgaatattagagagtagctgacactatggatgcgtataacactcgcataaaattcaggaggagatgagaagagagttccactcaaagaagactgatgtggctgatgaggaagaaaatgcttttgagggagttgtttctcaagatgaatttattgaggaataagatggcagactggggagccttcacctcctcccctaagtcccagtgaaacctaaaaagtcatctgaaatattaacatcaccaaaagcgaagtttgagaagataaggaagtatgaacataactaaaaaacaaagtgggaaacatttgtaatacagaacagggcaatgaaaaccttgaagtaaaatggccatccctcaagaaagttcaggaaatagttaacatcagctgggtgcagtggctcacacctataatcccagcactttggaaggctgaggcaggtggatcacctgaggtcaggagctcgagaccagtctggccaacatagtgaaactccgtctctgctaaaaatacaaaaaaaattagccaggcgtggtggtgtgcacctgtaatcccagctactctggaggctgagaagggagaattccttgaaccggggagatgaaggttggagtgagcagagaccgcgccattgcactccagcctgggcaacaagagcgaagaacaaaactatgtctcaaaaaaacaaaacacagcaaacaaaaatctattttgaaagagatgagagtgagccatataacttgtttaaacaaaaggaagttgtgttgtcgtgtaattaaatgaaaatactaggaagtgaaataatacctccaatggaaatggtagaaagcagaactgaaaaacttctgctaggtaggatatggtaggtctctgcacgccaccactcccattgcaaccgctagggaaaaaacagctaagatgaaaatgtctttttttttcttttttttttttttttgagatggagtctcgcgctgttgcacaggctggagtgcagtggcgcgatctcagttcactgcaacctctgcctctcgggttcaagcgattctcctgcctcagcctcctgagtagctgggattacaggcacgcatcactacgagcggctaatttttgtaattttagtagagacggggtttcaacatgttggtcaggctggtctcaaactcctgacctcaagtgacccgcccacctcggcctcccaaagtgttgggattacagggatgagccaccacgcctggccgaaatgtcttatttttaaaaagaatgaagagtggtcacagaaataaagactgaatggactaaaatttcaaggagggaagagcccttccgagttgaactagtgataggcagctattttcttccctgaaacatttgcccatttgggacatgaggatcagacttggcccaagcagagagactctactggggaagagagaaaggaacagtttttggtagttgcaaggacttgctatggattaggacctagaggagcacaaaatgcagagtgttttccccatgggacatttgctgagttctgaggcagtgcaggagactgagaaggcaagtcccacagtcttgcagtgtttagagaggaggcctggagtgaacaaatagctggtctccccaacataaggtatttgccaggttttgcgcctgtgtgggttgggaagctaaagagctccctttaaatctctgaagagcagaactttaagatctgagagagacagagactgactaggctttcaatccaaaatccaagagggccattcctaaggaacaaggacaaccaggaggggattgaattttactgcaattccaacactgccccaacccagttcagtacgtaattgcatcgaagtgactagctcctgtagggaataacaagatttgaagcccctatccttcttttatacccaatatgtgacatacaattaaaaatcataaaccatgcaaaaaatggagaaatgtggggctaatacataaaagaaaaaataaataaaagcagacccacatgtgatccaggcattggaactggcaaagatttttaaataacttggttaatatgtcaaatagagaagaagatggacaaaaaagaagcaaatgtagagaatgtcaacagagttggaatctattaaaagaggatgaaaggaggctattgaactgaaaaatacccctgaaattacaaactcattggatggatttcataaacattgatagaagtaaaggataaaatcacaatcgaatttagaaattaagtcatatcagaaaacagaattagtgaacttaataggttaaaaggaggtacctaaactgaagtacagagaggaaaaaagagaatggaagctaagaaacatgggactatatgaataattcaagttacagaagaagtggagagagaaattaggtccagaacaactggaaaatgacccaaacgtatatacagcaataaaaacaaacaaacaaaacaccactaatatatgcaccgacattgatgaatgtcaaagacgtggttgggcacagtggctcatgcctgtaaccccagcactttgggaggccaaggtgggcaaatcacttgatgccaagagttgaccagcctggccaacatggtgaaaccccgtctctactaaaaatacaaaaattagatgggtgtggtggcacatgcctgtagtcccagctactcaggaggccaaggcatgagaatcacttgaacccaggaggcggaggttgcagtaaactgagatcgcaccactgcactccagcttgggtgacagcaagactgtctcaaaaaaaaaaaaaaaaagtcatactgagtaaagaagccagacatgaaaagagttcatacttatgattctattttatgaagttcaagaacaggcaaaactaagttacagagaagtcaaagcagtgcttatgtctggagggtcctgatggaaaggcgtgtgaagatggaggggaaaaggttcaccatggtgcccttacaaccatgtgtgtctctacatgggccacataggcaaggctggaccacagtctgacagccactatggtgtgcttagggactgcttggccacttaacacgggaacattttgggtagatgggaatgtcctgcattttgatctgggtggtgattatgcttgtgtatgtatttatcaaaacccatcaagctgtacacttaagatttgtgccacacagtgtaaactgtacctaaatttttaaaaaagaaccaccagacaacaaacaagaattcttgaaaattgagattatcaggctgggcgcggtggctcatgcctgtaatcccagcactttgggaggctgaggtgggcagatcacctgaggttgggagttcgagacgagtccaaccaacatggagaaaccctatccctactaaaaataccaaattagccaggcgtggtggcagatgcctgtaatcccagctactcaggaggctgaggcaagagaatcactcgaatccagaggcagaggttgtggtgagtggagatcacgccattgcactccagcctgggcaacaagagcagaactccctctcaaaacgaaggaaaaaagaagattatcaccaaaatgaggctgagcacggtggctcacgcctgtaatcccaacactttgggaggccgaggtgggcaaatcacctgaggtcaggagttcaagaccagcctggccaacatggtgaaaccccatctctactaaaaatacaaaaattagctgggcatggtggtgcgcgcttctaatcccagctactcgggaggctgaagcacaagaatcacttgaacctgggaagcagaggttgcagtgagctgagatcacgccaccactcttcagcctgagcgacagagtgagactttgtctcaaaaaaaaaaaaaaaaaaaaaaaaattaccaaaatggaaaattcaatagaagggctggaaaataaatctcccagaacacaaggcaaaatatgaaaagacaaagaggatgatgagcccagtctaggtctaacaccctaataacaggcattccagtgagtaaacaaacctggaaagctgttcctgatggtgataaaagaagtggcagtcgagtgcagtggcttatccctgtaatcacagcactttgggaagctgaggcaggaggatcaaggccaggagttcgaggctgcagtgaaccatgatcacaccactgcactccagcctgggtgacagacaagagcttgtcaaaaacaataaaaaaataaaaagagctgggcactatggctcatatctgtaatcctggaactttggaaggccaaagtggggggatcgcttgagcccaggagttggagaacagcctgggcaacacagtgagaccctcccacccaccacaaaaaataaaaaaattagggccgggcacagtgactcacgcctgtaatcccagcactttgggaggctgaggcaggtggatcacctgaggtcaggagttcgagaccagcctggacaacatggtaaaaccccatctctactaaaaacacaaaattagccaggtatggtggcacgtgcctgtagtcccagctatttgggaggctgaggcaggagaatcgcttgaacctgggaggcggaggttgcagtgagccaagatcgcgccattgcactccagcctgggcaacaagaacgaaactccgtctcaaaaaataaaaataaaaaaattaaaaaataaaaaaattagctgggtgtagtggcacatacctgtaaggctcagctactcaggaggctgaagtgggaggatggcttgagtctggaaggtcaaagatgcagtgagctgagatggtgccactgcactccagcctgggaaacagtgagatattgtctcaaaaaaaagaaatggtcgttaaataagagatagcattgatcattctcagcaaactaacacaggaacagaaaaccaaacaccgcatgttctcactaataagtgggagttaacaatgaaaacacatggacacagagaggggaacatcacacaccggggcctgtcgggggttgggggcaaggtgagggagagcacctaatgtatgtggggcttaaaacctagatgatgggttgatgggtgcagcaaaccaccatggcacatgtatacctatgtaacaaatctgcatgttctgcacatgtatcccagaacttaaaggaaaatttttaaaaatgagatggcattatatatctcattaatcagctaaaacattgtttaagcaatatccagcagtttgttattgatggtgtaaactggtacagtcttttgggggagcgatagtgtcatcagtcatctctgtccttatcttttgcccgggtaacttcactgttgcaaattcatcataaaataacgtcttaatctgttcgggctgttaggacaaaataccataaagtaggtagtttatcaacaacagaaatgtattttctcacagttctggaggctggaaagtccatgataaggcataagcggattcagtgtcgggtgagggcctgcctgtggtgcacagatagtgccttctagctgtgttctcacgtggttgaaggggccgactctcggggtcatttgataccggcactaatcccattcatgagagctctcccttcaaactctgttcacccccaaaggcccatctcctaataccatcatcaccttgagggattaggatttgaacatgaatttggggggtcacattcagataatgttatatataacttaaaaagaacaaaaatgtggaattcatggagatgttcattgcagtatggattacactgaaaaactgtaaacaacctagatgcccagtaaaagggaaacagccaagaaaagtctgtgtcttgttcactcgctggcaggaaacatagagcaggcacggaaaggaaagggactcgaggaatgcgctgtaccgacaggaggcagcacccctttgcccgaggggcgcaacgacagagacctaaggctacctgggccggagccgggtgaggccgcggagaacgcaccccgctacgcgtctgccgagacggaggcgggcgtttcgaccactgcccgatcatgcgcttactcaagtaggattccgaaaaaattcagtcgcgcgtccctcctgaggttccgcagctggccaggcccggcccgggctggtgcggctgcgcactgcagcccagcggagcgggcccgggaggagccgggcggggaccgcggcggccagagctcctgtcagctccgccgggcacacgcaggccggggcgggcggcgcggctgtccccgccccgcacgctgctgggcccggcagcttcagaggctggcggacccgcgcggggccggcgcagcggagcgcgccggcggcccggggcccagcgggagcgcggcagcggcgcgcggagcagggggctacgggtgggcgggcgcccgccttcgcctgcgtcgctgcctgcacgcgggccgccgtccccgggcgtgtgagagccggcagctcggccgactgggcccggagcggcgcggaggccgggcgctgacggtaacgggccgggtgcgcgcgcgggagggctccggctgccccgacagaggccgggctcgggcggcgggagtgcgagcgccactgcggcgtcagaggggccaggaagggacaggaggctgcctgaggcccgtacctggcgcctgtctctgcggtccccggggccgacgaagtcggagcgggtggggagggagccgggcgggcggccagagacctggcggcaggtgcctgccctctgtgatccaactctctccccagctccacccacattggcctagacccagtctctaagggctgaaaatattgcccggaagctcccgagcagaatcagatcgcgctaagtagggcacaacgcagaggcgacaaagctcctcggccccagggcccgcggagcagactccggagcgcggtcccgcccacgctcggctccgcagttagcgtcctccttcctcctgagcaggcaagcggagcccgagggcggtggcggcggggggcacgggtcccctgaagttgcctcgcagctgagcactgggccccgtctctcccttcccagggggccttcggcgtcactgcaggcttcctaggggtcccctaagtgctctgcaaaccgcggctggaagtttcccactgcagtgaacagtagagaaacagggagaacacacagggcttgctttatgctagaaacacaagcatctttcttctttattagaaagaaactcattctgtgtttctgagaaaggatcgtgccaggcactgtttctggtgagtgccagtttgacccgaaagggcactgagaaaggctttcctatcagtctctttgggttctggctaaacttttaaatcaaacaaaatagagactagcttattcacctgaaactagaagcacatggccgaggagcctgaacaggcacctcctatctaggcagggaagctgtgtaatcaggagcttgtgtggtgcgctccagtcggagctgggactcttatcctgggcccgtttttcatagcaccagccaaaggagagcgtcctctccaccctagcggcagagctgctaccaggaccaggtgggccagcctcagatgtgctgcttgtgctacttggagccaggcaaatgggtgttcctttggaacagccctcaggaactcactggggtatttggtggaaagactgccacgggcattttgcatgttggagctacagatggtgtccttcctgccaggtgtgtgtggaggccagtatgaagctgaaaaagcaggtgacagtgtgtggggctgccatcttctgtgtggcagtcttctcgctctacctcatgctggaccgagtgcaacacgatcccacccgacaccagaatggtgggaacttcccccgggtgagtcgtgcctggttgctaatttctttgtatacaagtcacctgggctcagggtatgcacctcccaccccgccgcctcccctcccaccccccgctggagggtaatgtcagtacaggacaggagccttccttcccaatagtcaggttttgtagaaaccctcagctaaaaacagtgatggcgaaaagaaggaaggaagaaaaaatgtcaatggcaatgagtattgtcactctgttctcctgaattcttttctttcttttttttttttttgagacagagtctcgctctgtcgcccagccttgagtgcagtggcgcgatcttggctcactgcaacctccgcctcccaggttcaagcaattctcctgcctcagcctcccaagtagctgggactacaggagcctgccaccatgcccgactaatttttgtatttttagtagagacgagacgaggtatcgccatgttggccaggctggtcttgaactcctgacctcaggtgatccacccaccttggcctcccaaagtgctgggattacaggtgtgggccaccgcgcccagcccctcctgaattcttggcagacattgctaattgattgcagcattctttgccattaagccccgctgaaatcctcagcacaggcaacaccgattgttgagaataggtaggtgaaaggaaatctttgccatccctgagctagagagtgatggttctcccaacccaagtggagtgtagtcctcagtggtgatctgcacagctccctttatctgaacggtgtcatctatccctctaggctcatggtctggctttgactgatgagggaagaattgtactcaggcctcagctggtagaccccaagcagagaccctccctgtggcataaggagctgtgtgtgattgctttctggttttttggcagagccaaatttctgtgctgcagaaccgcattgagcagctggagcagcttttggaggagaaccatgagattatcagccatatcaaggactccgtgctggagctgacagccaacgcagagggcccgcccgccatgctgccctactacacggtcaatggctcctgggtggtgccaccggagccccggcccagcttcttctccatctccccgcaggactgccagtttgctttggggggccggggtcagaagccagagctgcaggtaagagtcagagctggcagggacgtacagtggccacgactggggtactgagctgcagttcacctggcagatgctcactgtgtcggaggagctgccgtttgacaacgtggatggtggtgtgtggaggcaaggcttcgacatctcctacgacccgcacgactgggatgctgaagacctgcaggtgtttgtggtgccccactctcacaatgacccaggtgagggccctgcagactcctgggagctggagtgtggagtgggatttctgatggccaatacaagggagggacgtcgaagaagatggtggcatcctcaggggaccctacattggctccctaggctggatcaagacctttgacaagtactacacagagcagacccaacacatcctcaatagcatggtgtctaagctgcaggaggacccccggcggcgcttcctctgggcagaggtctccttcttcgccaagtggtgggacaacatcaatgtccaaaagagagcggcagtccgaaggccagtaccaggcggggaggcatgggagggcattgtctgagccccaggctgggtggacgggtcttaccttaagctatgggtgccaaggtggcagggagaggcccagagagctgtggaagagatgagtgatggtggagggagggaaggcaaaaacagataggttccgagataagcggggccaggatagcctggaggttggctgtaaggaaaggagggcaagtgtgtgttctcttggtcctgggattgggagaactggtccagtgaggccagtgcacacaggccctgacatttgctggttggcaggactgggcagagtgtcctgctccgtcctgagtgtgagtccttaactataggctggtgggaaacgggcagctggagattgcgacaggaggctgggtgatgccagatgaggccaattcccactactttgcattgattgaccagctcatcgaaggacaccagtggctggagagaaatcttggtaagtccaggcccaggcatgggggtctgccccctgggctgtaaggcacaggcaggggctgtaaggcacagggatcggcagggggtggttcctttctaggcagatcccaccatgtgggcctggtgtgatatcatctctccactcactaccaggacaagagctggggtcccagcacctggaaggccggggggccagcccctgaggtgtgttcagggcctctctggcttccatgccctgcccaggtgcaaccccccgctctggctgggcagtggacccctttggatacagctccaccatgccttacctgctgcgccgtgccaacctcaccagcatgctgattcagagagtgcactatgccatcaagaagcactttgctgccacccacagcctagagttcatgtggaggcagacatggggtaaggccgggtagggtagagggggttactgcagcatagtcttcactggggaacagcagggatatcagaactaagacccccactgttcttcagagcagacctgcaggcactggtgtggactgccagaaatggtcgcaccctctggttaggggagggccatattgacctctggcctctacagggcctgctgtcccaagggcttcagcgtgccctgtgtgcccgtcccctgagggagcccctcatgtctttctccctggcctacacactctctccagccctaggtccagttacagcctcgcggtctatcagggctgcctttagcctgaacagatccttgcccccctggcgtccagaggctgcctgctggtggtgaccacgtggtgtgtctcctgcagactcggactccagcacagacatcttctgtcacatgatgcccttctacagctatgacgtcccccatacctgtggcccagatcccaagatctgctgccaatttgatttcaaacgcctgcctggtgggcgcatcaactgcccttggaaggtgccaccccgggccatcacagaggccaacgtggcagagaggtatctgcttccagccctttcacttcacagaggaatcgggaggcctggctctggtctgggccgtgccacgtggagggtgggctcaggtggtgagttgaggctcctagcctctgcagcagcagctccttactaagtctcctgaaaaactggaatggctcttgcaaccacctttcacagaatgcttttaggttctcacatgagtacttcttgatgccctaacaaactgccagggccagctgacaacttagaggtgaaggattcccaggttagatgtatgttacaaacttcaggctcatgtgccttcacttagtgccagtgttctgacttggctttaagtcaaccacgagaatcctgttcagatccacattcagtcccacgagatagcctccagcctctgagaaaacagacctgtcccttttgagagaatttagggacccctaaagatagcactcttgctgaaatcaggccccgggggaaagtgttaggtaagagttgatccaaacagcaatttagtcagaaccttaagaatacgacaagttggattggtttttatgttgcaatgctctgatttctccctgatgtccaagagttgaaacgtgaccaaaagggaaataaagtggtcttttgtttccagaagtctaaatggcgattccaggcaagaatctagggctatgagggcgtgacttttcttaaagcagcagttgtgatcagtgaggctggcctaggtttacaagaacaggccctgaaaggtaaccattttctcctttgaaaggcttactagactgataagttaggggaaagtggtatttgaggaatcctctcatgagaacagagtagaaaagtacaagctgggccagcgccgctaagtagattagttgactctttggactgtgatatttataacatgccaattaaagtaggaaagggcttctgctgatgtgccacagggctgtttttctactgattttgccaataatttggatgaaaagaaaagaaatgtttatatatagttcccattatgtaccaggcactattctaagtgtttaacaaatattcattcattgattttattttatttatttaatttaatttttttttttttttgagatggagtctgtcacccaggctggagtgcggtggtgcaatttcggctcaccgcaacctccgcctcctgggttcaagtgattatcctgcctcagcctcctgagtagctgggattacagatgtgcaccaccacacccggctaatttttgtatttttagtagagacagggtttcaccatattggccaggctggtcttgaattcctgacctcaggtgatctgcctgccccggtctcccaaagtgctgggattacaggtgtgagccactgcgctcggcccattcaatccattttaattctcataacattatatgggtacctacggatgttatccttattttgctagaaatggaggctcagagaggttacttgcccacagtcactgagctagtacttgtggagctggtgtgatatggctccggggtccagacccttcactttggtgctgcatcgctaactggtgggcaaaatgaggcgggagtgtcagaaccaggatcccaaaagatctcaacagcctagcataaaaaataacatgtcagctgtcagaactgcccagagagcaccggactcccctggggctgggattcatgtgcaggaggtgtctgtttgcgctgaaccactccttggtggatgggatgtcttctaggggcttgctggcgggatggctgtgcgtggtgctcttttactgatgagacttcgtggtgggcccatgttttttttcctgccccagggcagccctgcttctggaccaataccggaagaagtcccagctgttccgaagcaacgtcctcctggtgcctcttggagatgacttccgatatgacaagccccaggagtgggatgcccagttcttcaactaccaacggctctttgacttcttcaacagcaggcctaacctccatgtgcaggtgtgaggggcacttgactggggaggggcctcacagtgctgcagcccatcccttcccgtgagaccgtgccctgggttcccaactcgggcagggtgccccccttttttttttttttttgagatggagtctcactctgttgcccaggctggagttcagtggcgcgatcttggctcactgccagctccgcctcccgggttcacgccagtctcctgcctcagctgcccaagtagctgggactacaggtgcctgccatcacacccagctaattttttgtagttttagtagagatggggtttcactgtgttagccagggtggtctcgatctcctgacttcgtgatccactcgcctcggcctcccaaagtgctgggattacaggcgtgagccaccgcgcccagccgaaggtgccccttttatgtcagaattaattcccaggctcccctacttctgttaagtctagaatggcaggatgtacagttcctgcttctgaggccagagcccctgcctcacccccaactgcagcactgtggccacaatttgcaggaggctctagaactgatgggagtgggtttttggggttcccacaggcccagtttggcactctttctgactattttgatgccctgtacaagaggacaggggtggagccaggggcccggcctccagggtttcctgtgctgagcggggatttcttctcctatgcggaccgggaggatcattactggacaggctattacacttcccggcccttctacaagagcttagaccgagtcctggaagcccacctgcggtgagaccctgtccccgcttccaggctggagggggagagtcagcctttggggtttaaggaggggctggattggctcagaagggaatagataggcccagaggccagggcaggtagaggaggggtgggaaggaaggaggctgcactggcagagtgtgggtgggccctggctagtggtgcaggctggcagctaacttctctctctgggcaggggggcagaggttctgtacagcctggctgcagctcacgctcgccgctctggtctggctggccggtacccactgtctgatttcaccctcctgacggaagctcggcgcacattggggctcttccagcatcacgatgccatcactggcacggccaaggaggctgtggtggtggactatggggtcaggtgggagccttctcttttcccttgtaagctcccctgctcactgtcccaaagaaaggacattgggtggtcagggggtaggccggcctagggcttgtcctgctgacaaggcagacagcttccctatggtcatcttctctccttccctctcctgcgccacccacaggcttctgcgctcccttgtcaacctgaagcaggtcatcattcatgcagcccactatctggtgctgggggacaaggagacctaccactttgaccctgaggcgcccttcctccaagtggtgagcccctcctgggtctgcatggggaccctctggtgtgtgcaggtcccatcccaagagctgctggatgggggtgccgcttctctttttccttccccatccggatgagttctgtgcccagtgcagccgctggtccacacctgggacaggtggggtgggaggaggctgagcccatgatggttcttcccttccggctcactgaattccaggatgacactcgcttaagtcacgacgccctcccagagcgcacggtgatccagctggattcctcgcccaggtaacctggactacgccatgtgcagagaggcagagccattccctggctctcaggcccctctgccccagcatgtgctgaaccagtgcagggcgcttgccctggtcggaagcagcagcctcctgggtcagcccaccttctacgcacaggtttgtggtcctattcaacccactggaacaggagcgattcagcatggtgtccctgctggtcaactctccccgcgtgcgtgtcctttcggaggagggtcagcccctggccgtgcagatcagcgcacactggagctctgccaccgaggcggtccctgacgtctaccaggtgaggtgtgggcttgtcaggtgggcctggccctctgcccgtcgtgggcccctccccgcccggcgacgccagcctcccaccctcctgcttgtggccctgctactctccaggctgaggacaagtgtcctggggagggggttgtccagaagacaggcactcttgggatttgagcgtgtccttgaaaagaaggggaaggttggtatggtaatagtaatggtaaaaatagcagttataatgccccatcattcagtcattcaatgtttatcgaaagcttaatgtgttgttaccgcttcatactttttcaaatatcacttgagaatcataaagtctgatgaggaagaaagggcaaatcagatcacctccactttggaggaggggcagaggcccagcgggtgcaggggcttgctcaagccctctgttagtaagcggatgcctcagcacccctgtggcgaaagccgtgcccccacttcctcacccctcctgtgcccacaggtgtctgtgcctgtccgcctgccagccctgggcctgggcgtgctgcagctacagctgggcctggatgggcaccgcacgctgccctcctctgtgcgcatctacctgcacggccggcagctgtccgtcagcaggcacgaagcgtttcctctccgtgtcattgactctggcaccagcgacttcgccctcagcaaccgctacatgcaggtctggttctcaggccttactgggctcctcaaggtaaaaggccagggtggtggggaagggccaggggccagagtagggcgtgtgtggtggtggcactgtgcagagcggcctcccggccctgtgagcattctgccacctgacccacagtggaccggggcctgggccatctcagctccagcctgacagcatggggaagcagggcacggctccttggggaagctattccgtgtcctcccaggaggcaggcctgacatgctggtgtggggccaggggtcagggctgtgttttttggcagagcatccgaagggtggatgaggagcacgagcagcaggtggacatgcaggtccttgtctatggcacccgtacgtccaaagacaagagtggagcctacctcttcctgcccgatggcgaggccaaggtatcctaaagatgccttgaacaacctggcagggagggcaggagggggcacaggccttcccacaggtttattgctgcctgccaggggccttgtctttcctgttcagcccaggggtgtctgggaataggtgctctcttgcccagccctgggctggcaccttcctgctttgccctctgtgctgtagtttcaacagcaatctgctctttctctagccctacgtccccaaggagccccccgtgctgcgtgtcactgaaggccctttcttctcagaggtggttgcgtactatgagcacattcaccaggcggtccggctttacaatctgccaggtgagccctgcatatgaggaagggtctggaaggaggtgtgggctccacaactgtggcgtattcttccttctgctgcttctctgttcatacctctgttccgtatcatttgagacagggatgctccattctcttggagaaaaagtcatccagaaatgccctggggatttcttgggaggttggacagagcctctccccagctcggctctgatcccccagcccagcctcttagctgtgcttcagcctcacacctgtccatgcccccactttgttcctgtacccaggggtggaggggctgtctctggacatatcatccctggtggacatccgggactacgtcaacaaggagctggccctgcacatccatacagacatcgacagccagggtatcttcttcacagacctcaatggctttcaggtgactcctgggcctgggtctcggagaccccacagagtagaacttggactctgcttttgcccctgtcacaggccctgggggatgatctgccctgatggagaaagatgaatgagaggcgaagagttatcggggactccttcagtctggggaccgcttgggcccacatggtgcccgggtgcccttgatctgctggccttgcccccacaggtgcagccccgacggtatctgaagaagctccccctccaggccaacttctaccccatgccagtcatggcctatatccaggacgcacagaagcgcctcacgctgcacactgcccaggccctgggtgtctctagcctcaaagatggtgagtagggcccaggagttctgcagagggtatcagacaaaaagaagcccgtccccaccctcaagggctccccgctctgttggcctcccttgcctctttctggactgcatcacctccatgcttggagagggggcaagccattcagagctcttggcacaggaggcaggcatctgctgtccccatcccctggtggaggcagcagtgtaggcaactgggtggagtgtcctactggatgccctgaagaaccgtcagggttacaactcttggggccaaagaaaggaaaaaaaatgtcaaaaagcaaagctaggcacagtggttcactcctgtaatcccagcactgttgggaggccaaggcagaaggccaggagtttgagaccagcctgggcaacaaagcgagacccaggctctacaaaaagatttaaaaattagctggatttggtggcacgtgcctatagtcccagctactcaggagactgagatgggaggattgcttgagcccaggagctggaggctgcagtaagccaagactgtgccactgcactacagcctggtgacagagcaagacccagtctgaaaaaaaaggcaagaagcatcagggtattgaacagtggttctcagctgaggtgtgcaaccctcttctgggcggggctgagagtagggacagcttgtaaagtgcactcagtgttatgaaatattaaggaaatgagaaaattacatactgttttccttccagtgatcattaaaagacagactgacgttctttttttttgtttttttgttttgagacggagtttcactctttcgcccaggctggagtgcagtggtgcaatctccgctcactgcaacctccgccttccgatttgaagcgattctcttgcttcagcctcctgagtagctgggattacaggcgcccgccaccatgcgcagctagtttttctatttttagtagagatggggtttcaccatgttggccaggctggtctggaactcctgaccttgtgatctgcctgcctcggtctcccaaagtgctgggattataggtgtgagccaacacgcccggccaagactgacgttcttaagaatcaagacgggcatggggagcactggcctggagtcagacccgggtagctggtcacgctggcagctctgtgtggcccccatatcctcagggcaaaacgaacagtttgcacttggtggcatctgaggcccttgagatctgtctctgggaagagcccttgtgaagggctgagccgagagcacccagtcaaggctaggcgtggcccaatggctggcaagttcgggggcctgactccctgctgggaggagtgtgcctttctctgccaggagcagcccctggtccatctgtgtcatgactcctaactgcagcccaatatccctcactggatcttctcctctccccctctgggatatggtatttgaaaaaatgactgtcttctatacaagggatccgttttagggttttcagacatctttctgtggttgttctgggttaaaagactgagcaactacacaagtcagtaaggactggagaggtgaaagggagaataaggccatctgtcccggtggaatgtaggggcagctggtgtggtttccctcgagatcttgtacaagaacagctgcacccacctccaacacctgcacacactggggcctctgtccccaacacatcagccatgcaccgagcccctgctccaagcatactctagaaaacagagcaaaggtggtcacttgccatatcttttttccagggcaacccagatgacacttaatatgagcctctgcctgacttgccatctggctgtcctttccagagccctacttttaacacacagacagtcagagcttgagtctgacctgctggggctgtctggctgtccagtgtagaacaagggcaggagagcctgtgttttagtcacaacctgcccaacctgagcaaacctgccccagattacggaggtgtgcagcaacactaccgatggctgttgatctaagtttttcatttctggtttattttgttgtatgtaacccgtcctgattcggtttcctgcctgggcccctaggcccgttccctactcctgagtcccagagcgtggggggtaaactgccagggccagccttcccctttctggacctcatgcttcctcatctgcaaaataacggcccaggacgagcccctcatcaggttccctcccagccgtgggaacccgtgacctctcctgagtgactcagcttctgtctctcgagctgcgcttttccgtcagggcctgtggcttgggattctcctttgaaaggtcagtgcctgcttgggggtgggggcgggccagcactcactgtttgcttccccaggccagctggaggtgatcttggaccggcggctgatgcaggatgacaaccggggcctaggccaagggctcaaggacaacaagagaacctgcaaccgtttccgcctcctgctagagcggcgaaccgtgggcagtgaggtaacatctggggctgacgcccagggagccaggtctggctagtccctgggggtggccggggggtccagcctagggctcgaggagcgtagttggaggtgggcaagagagagagagtagggctgaattcctggggtggggggaggcagtctggcgttttgtgtcccatctcacgcagcctggcaccttcctctcccagcagcgctctgtcacctgtgcccctcatgttcgtctcccactttcctctgtgctgccctcctctgccctgtcccagcattctctaagcctgtgctccaaccccgctcatctcatggctttctttgccccaccagcctgactttttctccaaactggcagccatgtttaggggcttgatctttcacagcagcaggagcggtaaccgagaggtaagggtcggctctgggagcggggaactagtacgagcaaggtgtagctgcgccagagcccaggtgacagagcccgccactcagtcactcgtgcatcagatagatattgagcacctgctttactgtgaggacccagagggacataagtgcagacagtgctgactctcccaggagtttactcgtgagtaggggtggcagagaagccatgtgtgtaaaaatgcaaggtagaaagggctttgtctcactgatcctgaggagcaaggtaataatgtgggctaaggagatcgaggtcaaggaggtgtcacccaggtgtggctttgatgaatggggtgtgatttgaagatatgaaccagggcacaggataggaggcaggaaagacaacaggctggggaatagcagtgagttccttagttatgctggagctatgctatccagtacggtggccagtagccctatatggctatttaaattacaactaaatcaagtaaaaaatttgctttcttattcctactgaccacacttcaagtactcaagtggctaagtggctgccgtattagaccatgtggtgtcggatatttccatccttgcagaatgccctcttggctggtgctgggctagagtgctagggggagatcagggcagacggcagagcaccttgagtgcctgctaagggatctggactttatcctggctaggaaaggtccaggctaaggaaagagctgagcaaggagggacaccgtcagaactctggtctcagcatgtcacgctgacagtacggagcaggttggatctgtgggaagggagactggaggagggtgacagcgggaggctgttcaggcaggacatgctggctgcttgaactaggccagaggctggagaagttgccggtggctatgaggacactgcccaggtgcgacggaagagggtttagcattacctgggaatgcagagggaagtgagagatgctgggcgcttggaagaagggggatgccagggacagaagtccagaatattcagcccaggcctgtgagtctgacgtccaggtgagctgctaaggagtagccctgctggcagagccccggccgcgctgggcctgagagccaggctggcactgtggatgtggcatcgctcgtgaagccgcagattacccagagcactctggattggaggtccgtgctccatggtgaggcctgcgtctgcctggctgccatcctccctgcactgtggatccatgtgtgaggggagacatggctgatgggagtgggttgctcatgatagtgttatgtgagcaaggaactaaaaagtagagaagaaacagcttagtgaagtagccctctgcgttaggggagacggcaaatgtccacacttgaagggttagcggaacctcgcctggagccaggcgtgcccttgagtccaggcacaccaggaaaggtctttccaaaacaactgacctgggtgtgcttttatcctgcctcgtcctctcccctcagcctggctttggtccctcaccaatatctcgggtcaattttgcaggtccaagatagccactctaccagctacccatccctcctcagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggtgagtgtccctcagcgtgacatgctgagagcagagttctgatggtgtccctccctgctcagctccttccttagcctccaggatgaggtccagaccccttagcaggtattcggctccaaacctccaggaccaggttttggcctttccttacccacacgcctccctgtgccagcactgcctctgggcagaggcgctgctgcatctccgatctctgaaagccctgcgcccacttccctgggcactgtctgtcatccaggaggacaccctaccctcggcggagaccgcactcatcttacaccgcaagggttttgactgcggcctggaggccaagaacttgggcttcaactgcaccacaagccaaggcaaggtgagtagggtggggaaacagagcacctaggaatggcaggcatgagcttggtaagactgggctgagattcggtgacaggctgggagaagaaagtgtcactccagggctttctggagagaaggggggaagctgtagacatgttttcagagctccggaggcctggcagggggagttccagacaaggtagatcgcttgagaacttttgttccctgagcagggacctctatcaagcaaagtggaaaacaccagaaatagaaaaccagaacccatcctgttgttactttgtaagctcatatcagccggcactgataaatgtccccgggtgccaggtcctctgctgggctccagtgtttcagaagtgaaccaagacatggtcactgttttcacagagctcacagctcagtggaacggttcttacccagagatctgtaggcaggctttagggttgagcaaatctcagcaagcccgtgagactggatgcacactcatgtgtaagaaggcatggtgttgctgagaggggccagccggaactggagtgcagtggcgtgatcgcagctcactgcaacccccgcctcctggttcaagtgatcctcctgcctcagcctcccgagtagctgggattacaggcgcctgcccccacgcccagctaatttttatattgttagtagagacggggtttcgccatgttggccaggctggtctcgaactcctgacctcaggtgatccacccgccttggcctcccaaagtgctgggattacaggtgtgagccactgcccctggctgagattcttaaagaggtaccaaattgtagatgaacagccacattctttagtgtctcggcacctagcacaaccctgccccttctctgctctccacaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacgggtatcccatcccgatctgcctcccagaactgtgacacactgggctctgccctcattttctgtttattgctgctgctgtgttttcggcgcaacccacaaacccagtgatgggtaaatagggcagacgccagtgagatcagggagagaaggcccttggtcagagtgggcagtgccaggctctgctttgggttgtgagtggacacccaactgggcacaggctcaggcacccatcctttttccaaacagggatatagaagtggtggaagcagacagaagaggtaagggaggctaagtgggtaacagcccagcatcagggtcactgtggcaacagcaggctctaggggaatcctgtggttatgtagagactccatgtcctggtgtgatgagcaggatcagagtgactctgggaggacaggggtggggacccagagttagcagtggggatggagcagtagaaggaatcactgtttctcctaggagtctgaaggcctcgctgctttctgtgatggctttgcagtaagtgccgcctggcctgcatgcattggctaacaggctgcagaatggcaggaaggactcgctagagattgtcatggccagagatcataggtcacttcaggtagcaagacccctggcaaactgggcacttggcctatgtactgatttgtgggatggtggcaggggtgtggggtccttcaccctgcctgaattctctttggcttctgtgctctgtatgctgctgtccccaagggctctttcttattatggcagggagtggggattggtcctactttctttctctggaaaggaaagcctccaagactccatgtgcttgggcagcttgagaaggcgttcagcaccacgcctagcaggcagaccttgaagcctcacctttagtctatctgcagaggtattcagttcctggcacaggggactaggggcatgtagagtatatgaggaggcagtatggctgtgcaggagccttcatttcagcttcaattaatagggaagaatttatgatagctctatagatgctgaaaaggtatttcgtaagatttaaaatccatcccttattaaaactcttagtaaattaagtctggaaagaaacaccctaatctagataaaggtctgtttcagaaaccaacagtgatggcattctaaagagtcagacgccacaggcattcccattaaagtcagaaactagccaagggcaagctattattcagcagtgtcccggcactactaacccctgcaacaagccagatgaggaacataaggaagaattataattgtcattatttgtagacaataaaactgcctacctgtaaaacctaagaatcaactgaagacctgttaagagtattctgtaagtcaacccaatgatacacatcatgttcctgtccacatactggttttccccaaatcagctgataaattcagtgtaattccaatgagattgaaactttggaattgacagttctaaagtgcatttgggagagtgaatgtgtgagaacactaagaccactctgaacgatgataatgagttggggggtggactgctcgggggtgatcctgccagattcccagaggattctcacgccaccattacctcactcagtgtgacctggagggggtcagacagacgggagagtccagaaacagacccagggctacaggaatttagtatatggtaagagggatgttttaagtggggaaaaaggtggattatttaataaacagcacttttagacaactagctatcaaagctagatctcagctgggtgcgatggctcacgcctgtaatcccggcactttgggaggccaaggtgggtggatcacttgaggtcaggagttcgagaccagcctggccaagatggcgaaaccctgtgtctactaaaaatacaaaaactagccaggaatggtggcgcgcgcctgtaatcccagttacttaggaggctgaggcaggagaatcacatcaacctgggaggcggaggttgcagtgagcttagatcatgccaccatgccactgcactccagcctgggtgacacagccaaaaaaaaaaccactaagttagatctctacctcacagtgtccatacaaattagttccagagggaagatataccacaaaattactcaaaaatttttatacctctggtgtgggacggtcttttctaaactttaacatgagacttaaaagatataataagggaaaagataagcagatttcgcaaccaaaaaatatcgaaagtctctgtgtgatggaaaacatcaaggttaaaacacaaatgacagatatggaagaaaatatttgcagcacataaaaaaatcaacgagtacaattactttaggagaaaagcttgcttcagggtccttagagaaagtcactggggcctgccaagctgccacctaaagacaagagtgagagggctgagttcttccaggtcatcagagttgttgctgcccgtattaggccacacagtggaaccccatttatatcatagcagaagaaataggattatcaatgtgaactgcttagcatggtgcctggtatatacgagagctccacaaatgtgagctataatcctactagtaaaggatgctaagcagttccactgtggcaggtgtcatttgctagtagaatttgtaatcaaacaataggaggggaatctgtgaacgcctagaaaatgagcagaataaaggatattatctttggaagtcttagatgtgcaatgaaattatttgtctgacagaaacgaatgctgaattctatttacttaagcctttaaaatgacttaaggcagtccgggcacggtggctcatgactgtaatcccagcaccttgggaggccaaggtgggtggaccacctgagctcaggagttggagaccagcctggacaacatggcgaaaccccatctctaccaaaaaaatacaaaaatgagccgggcgtggtggtgtgtgcctgtaatcccagctactcggtaggctgaggcaggagaatcacttgaacctaggaggcagaggttgctgtgagccaagattgcgccattgtactccagcctgggtgacagagcgagactctgtctcaaaaacaaaaaaacaaaaaaaaaaaacataaaatgacttaaggcagcatggctcaaggtgtgattcagaatcaccagaactgccattgaaagtacaggtttctgttctgactagggcttcttcagcctggaggctgcagtgcagatgcgtagggcagagccacagctgccctgagactgctgtgtcataggagataggagcaagaaacaaaagctgacttcagtgcacagggggataaaggcagattcctgggtacaacctttgaactggtttctgggagtagaggccaaataatttgcatttttaacaagctcccaggtgattcttgtgcatgcataatttggaaatggcccaacttttaaagcaagcagcaaccctttaccacagagctgtggtactgaggcctcacggtttgtttgtttgttttttttttttttgagacagagtcttgccttgttgcccaggatagagtgcagtggcacaatctcggctcactgcaacctccgcctcctgggttcaagcaattctcatgcctcagcctcccaagtagctgggactataggcgtgcaccaccatgcctggctaatttttgtatttttagtagagacaggttttcaccatgttggccagactggtcttgaactcctgacctcaagtgatccgcctgtctcggcctcccaaagtgctgggattacaggcgtgagccactgcgcccggccagcctcacagttctgagggttaccatcaaaatgaaccaggacatgacagaagccatttcaaccactggagacggatcggattctattcctacatttacttggaaccatccagctttcatgaagaaggaagggctgtatggccagttggaaccacagagagaaaggctccagttgaaccacttaagagctggtcctcccatgcagggcgagccagcccagacagtgtcctcatatggcttgcctcagggtaggtaaaacataaaacctcgaccacttgtgcagagagagcagcatctttaatttgacctgaacctgacttgcttaccttgctctgtcactggggcatctgtgcactcacggagggggaaaatcagtctaggatggtgggaatgaggcttaccatccacaatagagatctctgaacaaaatctttgttcttccctaacaaaaaagtgtgtgaaggacaaacacttcaagggctcattctcattctcattctcatagtgagaagagataagacagagaccagatccttcgcaacaaccctcaattttacttagggtcagtgagaaatcaattcagatggtaacagtacccaggaccagctgggtctgcagttggctcctgactcctgacattctggctcctgactttggacctccctagttgagaataaacctgaactaaaaatccatgtagttaggtagtctgggcacaggaaaccaaagtggggttggagatgcggactctgtcattctgaatgtgacagagttgaagatttgagacacagcattgagtgtggagacctagagaaggcccctcagtggagtaggaaggactggggtttcccagtcagcatgcctcccgcaagtttgaatatttgtgtccctctcaaattcatactgaaacttaacctccaatgcagcatattaagaggtggggcctttagaaggtgattaggtcatgagagcttctccctcgtgaataggattaaggccctaatgaaagaggcttcacacagcctgccttttttactgtgtgaggatgcagtgaccaccttggaagcaaaaagcagccctcgctagacaccgaacctgccagcaccttcatcttggacttcctgcttctagaactgtgagaaaacgaatttctgttctttataaattacccagtctcaggtatttttgtcataacagcacagactaacatacctagagacttgcattccaactagaggcgcaagcacacctataattctgccctctcaactcctaatgccagagattgctaaataaatactaaaaatgtaaaaacaggccgggcacagcccagcactttgggaggccgaggcaggcagatcacctgaggtcaggagttccagaccagccagaccaccatggcgaaaccccatctctactaaaaaatacaaaaattagccgggtgtggtggtgggcgcctgtaatcccagctacttgggaggctgaggcacgagaatcacttgaacccaggaggcagaggttgcagtgagctgagatcttgccattgcactccagcctgggcaacagagcaagactccatctcaaaaaaaaaaaaaaaaaaaaaaaaaagaaagcaaaaactgtcaaactcaaaataaaggaaatcttctttgacaaagaatggagagaataatacagccattagcagaggctgaggctatacagcttgagagaagtagagactagttcaggatggtaggtgctgggacttcaaagtccacgtgggacaggtaaccaagtgtaacctaggaacgtcaagggaccagaaccagactctgagaggtacacaggcaggaaaaatgtaagttgcaaacaaaaacaggatgacatgcaagcaatctaaaaaaatactttaaaaaatatatatgtgcaatcaccaaagagctaaagatattcagtcttgcaatgagaaactgactgaaaagaagcaaataagattttacaaattatacatgctggaaatgtaaaaatacaattattgaaatatactctatgtatggtataagccctagactggaggcagatgacataaaaatttagcaggtctggaaaacaactgaggaatcacccagaatgcaccacagtgataaaagaaatataaaaaagaagctaagacagatggaggatagactgagaagctttggcataatgtttcatagcagttttagaaaaaaagactagtgagaatacagggatgagaaaacaaagacggtgaatttttcagaactgaagaaagatgtgagatctcagaatcaaagagctcattaagttccaagaaaggtacatttaaaaaaaaaggccaggccgggtgcggtggctcatgcctgtaatcccagcactttgggaggccgaggcgggtggaacatgaggtcaggagatcgagaccatcctggctaacatggtgagatcccgtcactactaaaaaaatacaaaaaaattagctgggccaggtggcaggcgcctgtagtcccagctactcaggaggctgaggcaggagaatggcgagaacccaggaggcagaggttgcagtgagccgagatcgcaccactgcactccagcctgggtgacagagcaagactccatctcaaaaaaaatagatagctgggcgcggtggctcacccctgtaatcccagcactttgggaggccgaggcgggcggatcatggggtcaggagatcgagaccatcctggctaacatggtgaaaccttgtctctactaaaagtacaaaaaattagccgggcatggtggcgggcgcctgtagtctcagctacttgggaggctgaggcaggagaatggcatgaacccggaggcagaggttttagtgagccgagatcgcgccactgcactccagcctgggcgacagagtgagactccgtctcaaaacaacaacaacaacaacaaacaaacaaataaataaataaacaggccaggtgcagtggctcatgtctataatcccagtactttgggaggccaacgtgggcagatcacttgaggtcaggagtttgagactagcctggccaacgtggtgaaaccctgtctctactaaaaatacaaaaaaacccaaaaaccagaaaaatcaaaatgtagcggggcatgctggtgtgtgcctatagcctgtaatcccagctacttggaaggctgaggcagaagaatcgcttgaacctgggagatggaggttgcaaatagccaagatcatgccactgcacttcatcctgagcgacagagcacgactccgtctcaaaaaaattaaaacaatttaaaaaacctcgtgtagatatattgcaaattacgtaagataaaacctaaaggccaggcacggtggctcacgcctgtaattccagcactttgggaggccaaggtgggtggatcacctgaggtcaggagtttgagatcggcctggcccacatggcaaaaccctgtctgtactaaaaatacaaaaattagctgggctggtggcatgcgcctgtagtcaaagctactcaggaggctgaggcagaagaatagcttaaaccagggaggtggaggttgcagttagctgagatcatgccactgcactccagccttggcaatagagtgagtgggattcactctcaaaagagaaaggcaaatataagaacttattgagaaactgcaggaatgaatataacctgttgtacaaccatggtttaactgtagatttttagcctagcttttttttttttttttttttttttgagacggagtctagctctgtcgcccaagctggagtgcagtggcgtgatctcggctcactgcaacctctgcctcccaggttcaagtgattctcctgcctcagcctcccaagtagctgggactaaaggcgcccgccaccacgcctggctaattttttgtagttttagtagagacagggtttcaccgtgttagccaggatggtcttgatctcctgacctcatgatccacccgcctcggcctcccaaagtgttgggattacaggcgtgagccaccacactggcctttttttttttttttttttttgagacggagtcttgctctgtctcccaggctggagtgcagtggcatgaccttggctcactgcaacctccgcctcctgggttcaagtgattctcctgcctcagcctcccgagtagctgggactacaggtgcccgccaccatgcccggctaatttttttgtatttttagtagagacggggtttcaccatgttagccaggatggtctcgatctcctgacttcgtgatccacccgcctgggcctcccaaattgctgggattacaggcgtgagcctctgcacccagcctgcctagtgtgtttctttggaacttatcaaaatgtctctggaggccgggcacgatggcttcatgcctgtaatcccagcactttgggaggccaaggcaggcggataacttgaggtcaggagtttgagaccagcctggccagcatggtgaaaccctgtctctactagaaatacaaaaattagccgggcgtggtggcacacatctgtaatcccagctactagggaggctgtggcataagaatcgcttgaacccaggaggcagaggttgcagtgagccgagattgcgccactgtactccagcctgggtgacagagcgagaatccatcttaaaaaaaaaaaaaggctctggaacatttcatttcctgttttgttactgacctgtgactctgtaaaagtctactttcgcaatttggattaataattttatgaatgcaaattggagatgctgttcaaaaaaaaaaaaatagaaaagtcttacaaaggaaagacaatcacagtgatagcagacatctagttagctacagtagacacctggagtccattcaaacctagagaaaactcagccttgaatttgctatcagctacaccattcaagagcacgggggaaatgaagacattttcagacatgcaaagactcaacagtttgcaatgtacaaaactttagtggaagaaagtaggtgtacttaagcaaaaagagaatttgtctaggggcataaactaatgagagggagggtacacctaaatactggctataaatgtaatactagtttatagtttaaaaagaggcaggaactaaaattctagaaagcaatattgtgaagagttattcaaggctgggcacagtggctcacgcctgtaatcccagcactttgggaggctgaggtgggcagatcacctgaggtcaggagttcgagaccagtgtggccaacttagtggaacgccatctctactaaaaaataaaaaataaaaaaatccaaaaacaggtactaagaggacagaccttgcatcaaatggtgctaggaaaactggacatccacaagcaaaaccatacatcatatattttgtatatggtgtatatacaaaaaaattacaccatatacaaaaattaacccaaaatgttcttgccacaaaaacaacaaaaaattgggtaactacgtgaaatgatggatgtgttaatttgcttcactatagtaacctttttactacctgtatgtagcctcataacatcatgtataccttataccaaattaaattgatttaaaaagaaatttaacccaaaatggatcaaaaactttacttgtaagagctaaaacgataactttgggaggccaaggcgggtggatcacctgaagtcaggagttaaagaccagcctgggcagcaaggataaatcccgtcactactaaaaatacaacaattagccatgcgtggtggcgcacgcctgttatcccagctactcgggagactgaggcaggagaatagcttgaacccgggaagcggaggttatggtgagcagagatggcaccattgcactccagcctgggcaacaagagtgaaactccgtctcaaaaaaaaaagctaaaacgaaagctcctagaagaaaacaggaaaagcttcatggcattagatttggcaacgatttcttagatatgacactaaaaacacaggcaacaaaatatataaagtggactacaacaaagtcatcttttcttaaaaaaatctcgttatcttactcccgcaaaactatttaaaaaaattaagttcaaagttctccaaaatgtaccataccctggggattactctgaactttgttcatttgttttcttttaattcggcttttttggttgcctttcacctactttttcgcagagccctccgctggggccttcacttgggcaaacaactatcgtagtcgaacagctttgacctaacaatttcctcgtacccaagatgatcgcttttccagacaacttaataaactttggctttaatggatgactggatgcagaataaaatacataaaaataaacctcagctgctcagcaacgactgaaaaaccaccaccgggcaatccctccccatggccaccgagcaaagttccaccgcctcccctacgccgaccgccgggctcccggggtcggacagccccgggccacttccgggccttcccggaagtccctgtcacttaacaaccgaagtaacccgcaatgcggaagggcgaggggattgcgagtcaccgagtttcccgcgcggcttgaggtactggggaaccggaatcccccaccggcccaatcatgttgctgctggggtctctccggtgcccagcagtggttgtcagtaagcgggcggcactcccttccgatacgtcttttcttttttcatttttgagacggagtctcgctgtgtcacccaagctggagtgcagtggcgcgatctcggctcagtacaaactccgcctcccgggttcaagcgagtctcctgcctcagcctcctgagtagctgggattacaggcgcgagccactgcgcccggctaatttttttttgtatttttagtagagacggggcctcgccatgctggccaggctggtcttgaactcctgacctcaagtgatccgcccgcctcggtctcccagagtgctgggattacaggcgagagacaccgcgcctggcccccttccaactttcttaacgggaaaggctgctaccatttcttgagcacctatgtgtcaggctccatcaggcacgtcacagtctaacctgataattacacaacccatgtcactgacaaggaagccaggttcggaggggttgaggcccgcaacctgagggaggtgactccgggacacacaattagtcctgctttgctgaaggaaagatatgcagcccaccagtcggaggctggagaaggagcagcagcagcttaaaccttaacccagagttatttttattttccagaacgtgttaggaactagtacttaaataatctcaagtccctgaggggccagagatcccaccatgcaaaatagcaaacagacccaagacttggggagaggcggtgagtgcatcagaaatggatgggtacatctgattcccaccacgcggggctcagcttagttagcaggagaccttcagactgagaaaaaatgcaagtctttttttggcctctaatatctgggaaggatggagggagctcaggagacacagaaaagatggcgtatgaatcctgtccggcctgaacgaggctggagttgtgcctctggatagcttcaagcactgatcagattgtcagcccccgctgcttgaacagatgctttagagcctcttccagttgccggtttgttccctgaagccccttcaccacctgcgctgcccactcgaagtattcctggactcgatgttctgaccatcctgcataagagtcgacagaaacttgctagcgtgatgtcaaggaaagcactgccttttccccacttcctggcaagcttggttcaaggccatgagttcctgatggaatgagctgtcctgaaaacttccccttggcccagctattgtatttttactgtatgaaagaagatcaaagagtggtccagtaggattaatttgggaattaagaatgcccagggtttttcaggggaactgaccaacatgtgtcttcagaaggcggcatccccctcccttttcccttacagcccatacgaaagcgtaccctctggggtgcagcgattcaggtccctcagattgtacagcttgtctgccagcttcaccagtttggccccggggctactgtggggcgcttgctccacctgcagcctctttctctccagcttgggcagagtcttgtcatctgttacctcctccaccaggcgccgcacttgtgccccaaagtgtagctccacctcatccagggtggtgtctgtgtcctccaccgtgtcatggagcagggccgcctggggacaagttcccactcagccctgagatgtcagccaagggttgcccattgctgaatggggcccctaatccccatcccaggctcctggcagagaagggggaaagttacctgtaacaccacaatgtcagtgattcccgcctcgtgggtcaggatccgtgccacacctgacggggaggggcaaagcaggaagtcaggtcggaggtagtcccaaggcggtgtgttgtgggttttggagagccagatgtggccccttgtggactctgactagctgggtgaccttggtcaagtaccttaccctctgggagccaaccgacaaagggaacgatcatgcctaccgttccaattgttatgaggcttaaacggtatatcgcactaagcttgggacaaaacaggtgctcaatgaggtgcacgccccccacgtttccttcccagtccccaccacccaggtgccgcagccggcgctccgcggccgacgcgcccaccgatggggtggttgatgtagggggtcccctcggggtccttccgccgctgctgccggtgcttgcgagccgcgaagtcggcagcctccagcagctgcgccgcctcagagcccatcgcgcggatggggccgacgactgcggccgcaggggcagggacgga

SEQ ID NO: 196 - DNA, 223035 bp, Homo sapiens
ggtggaggttggagtaagcctagatcgagccactgcactccagcctgggtgaaagagtgactctgtctcaaaaaaagaaagaaagaaagaaagaaaaacacttttcttctgacatattcaaataatatcatcggcgttaacaaagatagacagctaaagtcataaatttgtgttctaagtgattcaaagctgtgcaagtattgatatgaacaactatatttgtgtagacagggaatgataatatcacccatgtagagatggcaggatgagtgatcttcactggaattacaccagcatgctcctgctcttcctttttcattttttttcaggtttttaaaataatctaccatatttttattggttgcaagaaatattttcccttctccagatttggagaacaggattttcttccctcctccctgcaacccattccagttgctcaccctgtgtttggcttgactagccaagtgattccctcctgcatgaaattcttacattgctcttgattcaaattcatactaggtgtttaaaaatgcataatctcagttaatcctctcaacagcccacaatatcagtataattattctcattacaattaaattcatgtcttggatctttgaggctgtttgtgagtagctgaaacaatgaatagtaattcacaaatgtcaagggtctattctaatttacctgtctgtctcccaaaatagactatgaagacttgaactttttttttgtttgatttgttttttgagatggagtctcactctgtcgtccaggctcgagtgcagtggtgcaatctctgctcactgcaacctctgcctaccaggttcaagcagttctcctgtctcagcctccccagtaggtgggattacaagcatgagcaaccacgcccagctaatttttgtatttttggtagagagggggtttcaccatgttagtcaggctggtctcgaactcctaagtgatctgcctgccttggcctcccaaagtgctgggatttataggtgtgagccaccgcgcccggccaattttgaacttatgaaccatatcttattcatcattatattctcaacaatacctagcacgattcctgacgcatagtaggggctcaaaattatttttccaataaataaatagattaatggaaaggtataataattaatattgcatttgaatcatttaaatagggtgcatttatatataatagatcaaagatacttgagggaaatctcaaaatagttgttttttttttgggacagagtctcactctatcacccaggctggagagcagtggcgcaatatcagcccactgcaccctctggctcccaggttcaggtgattctcctgcctcagcctcttgagtagctgggattataggcacccgccacgagcccggccaatttttgtatttttattagaaatggggtttcgccatattggccagctggtctccaactcctgacctcaagtgatccgccgtcctcggcctcccaaagtgttggtattaccggcgtgagccactgcacctggcctcaaaatagtctcaactgtggtgaaaagactagaaaacgatcctacctgcagtttctaccatatgaaattatgcattcttgaaaaataagatagcagaaatagcgacagaatccctttataactaggtatcactcctgtaataaaccaaaataatttattctgagggataaaagggtaagcccttcagccccactccttctcgtctctcctttccctcccttttctctcttctcccttttctcctttcttttctgttcccattttcaaacatttactaagacactattgccttaacacactgtgaggatttcagcccttgccttcaaagagcttatagtccagaggaaaaaaggttaagaaatggcaatatctataaccacggtgacaacatctgactttctacaatagcatcaagcccacagttttgcccgagccgccctcgggcgcaccacgaatcccatcttggaagacttgcctgatcttttttccctgagcacaggcacaaagaaaattcttctcctcattctgtaaatacttagtgtatctgactgaactgcatctgactgaactgcaatagcaactgggctttcctctgggagcaaaagctagggaaagcctcaaaacaatattaaaaatgactggagctactcagaagaattataacaactggaaggggacttagagaactttcaatccagctacctcattttccagatctggaagctgagaaccagagttggaaggtggtgacctgcctgtggtcacatagcaaatcagtggcaatgcaataatcctgagattattttaagtagtgcatgacaaacttttacatatacaaataattgtgcatttctctttttttttttctttttgagacagagtctggctctgtcgccaggctggagtgcagtggcacgatctcagcccactgcaatctctgtctcccaggttcaagcaattctcctgcctcagcctcccgagtagccgggattacaggcacacgccaccatgccgggctaatttttgtatttttagtggagatggggtttcaccatgttggccaggatggtcttgatctcttgacctcgtgattcacccgcctctgcctcccgaagtgctgggattacaggtgtgagccaccatgcccagcctgcatttctatttttaacttgtataaatttaatgagtataagtggaatatgcatttattttagtttaggaaatatataaaaagcacatcaagctctgattttatagataaggatattatatagtggtcaaaagttttctttaaattttaaaataaaaagatgaatgggctgggcatggtggctcacacctgtaatcccagcactttgggaggctgaggcaggtggatcacttgaggtcaggagctcgagaccagcctggccaacatggtgaaactccatctctactaaaaatacaaaaattagccagatgtgctcgcttgaccccaggaggcggaggttacagtaaaccgagagtgtgccactgcactccagcctgggggacagagcaagacagtcttaaaaaaaaaatgaatgaattaaaataaaagtattttttaggccgggtgtggtggcttacgcctgtaatcccagcactttgggaggccgaggtgggcggatcacctgaggtcgggagttcaagaccagcctgatcaacatggagaaaccccgtctctactaaaaatacaaaattagccgggcatgatggcacatgcctataatcccagctactcaggaggctgaggcaggagaatagcttgaacccagtaggtggaggttgtggtgagccaagatcacgccattgcactccagcctgggcaacaagagtgaaactccatcccccttaaaaaaaaaaaaataaaatatatatatatatatgtgtatatatatatatatatatgtataaaatatatatgtatatatatgtataaaatatatatgtatatatgttatacatatgtataatatatataatacatgtataatatataatacatgtatcatataatacatgtatcatatatattatatatgtatatattatatacatataatatacataatatataattgtaatatatataatatataatatgtaatatattatataaataatatatatgtatatattatacattatacatgtataatatatataaataatattatatataaataatattatatataataaaaatatataaatatataaaatatatatataaataatatatataatatatattatacatgtattttatatatatataaagtatatacatacatatttttttaaagtagaggccaggtacagtagctcacacctataatcctagcactttgggagcccaaaccaggtggattgcttgagcccaggagttcgaggccagtcagggcaacatggtaaaaccccatctttacaaaaaatacagaaaattagacaggtgtggtggcatgcgactgtagtcccagctacttaggaggctgaggtgggaggatcacctgagcccggatggtcaagtttgcagtgagctgtgatcatgccactgcactccagcctgggtgacagagtgagacccctgtctggaaaaaaaaaagaggtgggagtagtcagtacaataatggagtaaaaaaattacgaaaggggtatgcaaattactgaagtttagaaaacatcatgtttactatatcacactgcatctctccaagataagataaaggactttgaagctgggcgcagtggcgcatgcctgtagtcccagttactcaagaggctgaggcgggaggatcacttgagtccaggagttcgaggctacagtgtgttatgattgtacctgtgaataaccactgcagtccagcttggacaacaaacaagaccctgtctctaaaaaaaaaaaaattaaaatttaaaaaataagaaaatgtaaaggactttgacaaatgtaccggctcagaacattctgagaagacaattttttaatgtaaaggtgatgattgaatagttggatatgtgcacgtttagcaaaaatgggttaggcacagttaagagtaggtattttattcaggaagaatagaaggcaactagatgggggagtttggcctgagttttgacatttgatagaaatgattgtgttttcttttttttttttttttgagatggagttttgctttgttgcccaggctggagtgcaatggcgcgatctcggctcaccacaacctccgcctcctaggttcaagcaattctcccgcctcagcctcccgagtagctgggattacaggcatgcaccaccacgcctggctaattttttttttgtatttgtagtagagacggggtttctccacgttggtcaggctggtctcgaactcctgacctcaggtgatccgcccacctcagcctcccaaagtactgggattacaggcgtgagccactgcgcccggcaatgattgtattttcaagtatgccttcctggattaacaaagggtcaaatagaaaccctgcaacctgttttcctataactgaatgtgagtgaatattttatcagaattgggttcaaatcctgcttctgccacttcccagcttgtgccctctgccaagtcacttaaccactctgagtttgtgaaaaagttacgttgtcaggagcaactatgagaatgtcaaaatgcctcgaaagggagagtgagaaaaagactgaaagaaagatgaagaaaaagaaaaaaaaaaatgacaaaagagaggaagccaggttggaaggactataagaagaatgggagctggtaaaattatttcagactttatgtgctgaaatagtcattcttgtcacaagctgctagattttcttcttatgaaaacatttctaaggtggcagatgaatatatttttaaaatttttcctgaaacataacactccaacaggatgtgttagagaaatgccaagaaaagaaggcagaaggaggtaaagtccttgaatgaaaaggaagataaagggatctatgcatggacctagtggggcagaagtcccacctcctctatgaagccccactgggttcctgggtggagctgactgtctcctccttagacccctgctatatttacacaccttctactagggccagtgcaatggcttaggagcatctctgtttgtcattcccattagataataatccccttaactgctgggactgtcttatttatcttacgtattcccagtccttctcacaggacctggtccatatgatatgcttgataaacatctgttgaatgaatgagcctgtttctaggaacttgcagtgatgatctttgagggataaatggaggtcaggaagacatttggcctggagtgtgtctggggagacatacttactgttttccaatagttgaagaactgtcttggggaagtgtatttttaaaatgtgctctgtcgtccttaatggcacagctagaactaagaaaatcaacctggctaacatggcaaaaccccatctctaccaaaaaactacaaaaattagccgggcgtgatggcacatgcccaaagtcccaactactcgggagtctgagatgggaggatcatttgaacctgggaggtggaggttgcagtgagtccagatcgcagcctgggcaacagagcaagactctgtcaaaaaaaaaaaaaaaaaaaaaggagccatgggcttggactggaatgtactgcccatgtttactgtgttcataaactctggtgcagggcttcaagtgcccagaagtagggtcacctgttttaaatttacacacaagtgccctatgggattaggagtcagaaagacttgagttctaactactcaacttttctagcagtgtgactttgagcaaattaattagccctctgagcctcagtttccttttttcaaatatgccaataactatatctccctcccggggtgagataaggcttaaataataaagcaggctgggtgtggtggctcatgccttgtaatctcagcactttgggggaccaaggtggtaggactgcttgagcccaagaattcaagaccagcctgggcaacttagagagaccccgactcaaggtggccaggcgcggtggctcacgcctgtaatcccagcactttgggaggctgcagcgggcggatcacgaggtcaggagatcgagaccatcctggctaacacggtgaaaccctgactctactaaaaataccaaaaattagccgggcgtgggggcgggcacctgtagtcccagctactcgggaggctgaggcaggagaatggcgtgaacccgagaggcggaggttgcagtgagctgaaatcgcgccactgcactgcagcctgggcgacagagcgagactccgtctcaaaaaaaaaaaaaaaaaaagagagaccccgactcaaaacaaacaaaaaaaattctttttgtagagatggggtcttcctctatcacccaggctggagtgcagtggcacaatcttggctcactgcaacctctgccttccaggctcaagtgatcctcccacctcagcctcccaaatagctggcaccacaggcccacgccaccagacccagctaattttttgtattttaagtttctccatgttgcccagactggtcttgaactcccagcctcaagtgatccacctgccttggcttcccaaagggatggaattacaggtgtgagccaccacacctggccagaattttttttttttggagctggggtcttgctctgtcgcccagattggagtgcagtggtgtgatctcagctcactgcaacctccacctcctggattcaagcaattctcctgcctcagtcttctgagtagctgggattacaggcgcccaccaccacgcctgggtaatttttgcatttttagtaaagacagggtttcaccacgttggccaggctggtctcgaactcctgacctcaagtgatccgcccacgtcggccccccaaagtgctgggattacaggcgtgacccaccgcacccggtccagactttttttttttttcaattagccaggtgttgtgccatttgcctgtggtcccagctactcaggaggctgagatgggagaattccttaagcccaggacttcgaggctgcagtgagctattaatgcaccactgcactccagcctggtcaactgagtaggaccctgtcccacactgccccccacaaaaaagcacataaagctcttagcacagtatcataacaaacatttaatttcttttaagaagacagccctagtgtttttttgtttgtttgtttgcttttttggaggcagaatttcgctcttgttgcccaggctggagtgcaatggcgcgatctccgctcaccgcaacctctgcctcccgggttcaagctattctcttgcctcagcctcccgagtagctgggactacaggcgcctgccaccacgcccggctaattttttgtatttttcatagagacagggtttcttcacgttggtcaggctggtcttgaactcccaacctcaggtgatccgcctgcctcggcctcccaaagtgctgggattacaggtgtgagccaccatgccaggctgccctagtgtttttattttcctttcagtctcttcctagctataaacatggataattgaataaaacttctcaacattgcaacttctctttctgtaggaaacaaccctgttcaatcccattgtctgcctccatgaagacttcccttacattcattaactagatgacattgcatagtcacttccttctgagagcttgtttttctatctgtaatgaagacaggagagggaggaatgtctatttctatttttagcagtccatttccacaagtgtatgttaattttgtaaagaaagaaaagatttttaaaaattgaactaaactgctgtctaatgtccctttttgctctgacattttttgagcctgagaatctaagcctccttctctttcccctgttcccattgccctcctccattcctagcttctctctctctctggccttagaatgcaaaactccattgagagtgcaccatgcaggtggaaggattgcaacaaatacatttctcctctggccccatgctaggacctggtcccagaaatggctatagctgggaacatctagggaagcccagagcagatcggattgccttacttagctggagctcagcctatctattctttttctatttttttttttttttttttgagacggagtttcgctcttgttgcccaggctggagtgcaatggcgtgatctcagctcactgcaacctctgcctcctgggttcaagcgattctcctgcctcatcctcctgagtagctgggattacaggcatgcgccaccatgcctggctaattttgtgtttttattagtagtgacggggtttctccatgttggtcaggctggtctcgaactcctgacctcaggtgatccgcccgcctcagcctcccaaagtgctgcgattacaggcatgagccaccgcacccggccttttctttttcctttctttttttaaaaaaaggagtctcgctctgtcgcccaagctggagtgcagtggaatgatctcggctcactgcagcctccacctcctgggttcaagtgattctcctgcctcagcctgttatgtagctgggactacagtgggactacaggtgtgatccaccacacccggctaattttcttttcttttttttttttttttttgaggagtcttgctctgtcttccaggctggaagtggcgcaatctcggctcattgcaacctccaccaccctggttcaagcaattcccctgcctcagtctccgaagtagctgggattacacgcgcacaccaccatacccagctctttttttttttttggtaattttattagagatggggtttcactatgttggccacactgggtctggaactcctgaactcctaacctcaggtggttttttgttttgctttgttttttgttttgttttgtttgtttttgatggagtcttgctctgttgcccaggctgcagtgcagtgacgcaatctcggcactgcaacctctgcctcccgggttcaagcgattcttctgcctcagcctccagaatagctgggactacaggcacacgccaccacacccagctaatttttgtatttttagtagagatgggatttcaccatgttggccaggctggcttgaactcctaacctcgtgatctgcccaccttggcctcccaaagtgctgggattacaggcatgagccaccacgcccagctcaccaggctaattttcatctttttagtagagacggggtttcaggctggtctcgaactcctgacctcaagtgatccacccacctcagcctcccaaagggttgggattacaggtgtgagccaccgcacttggccttcagcctatgttttcatttgagcacttttctttataatttcacgttgtcatcctcatctagtacccaatttcctttagggaaatccagcagttgagttacagaatgatagacttaaaagtgtgcaaactggataacaaagaaatcatgttccggccgtgtgaggtggctcacgcctgtaatgccagcactttgggaggccgaggcggctggatcacgaggtcaagagatcgagaccatcctggccaacatggtgaagccctgtctctactaaaaaaaaaaaaaaaattagctgggcatggtggcgctggtggcatgtacctgtagtcccagatacttgagaggctgaggcaggagaatcgcttgaacccgggaggcgaaggttgcggtgagctgagatcgtgccactgcactccagcctgggcaacagagtgagactctgtctcaaaaaaaaaaaaagaaaaaagaaatcacgttccacaaaaactgtgcaacccggccgggcttggtggctcatgcctgtaatcccagcactttgggaggctgaggcaggaggatcacttgaggtcaggagctcgagaccagcctggccaatatggtgaaaccccatctctactaaaaatacaaaaatattagccgggcttggtgtatgcctgtagtaccagctactcgggaggctgaggcaggagatcacttgagcctgggaagcagaggttgctgtgagctgagatcactccattgcactccagctggtgcaacagagcaaaactccatctcaaaacacacacacacacacacacacacacacacacacacacaaaacctatgtagtccaccccgtccttatttctgttatcctttttttccctcaaggaccaagtggcttaagcttttctgaccaaataacattaattttatcttttatcctctccccatccctcttcccctccccctccccctctctctccctctccccctcttcttctttcttcttcttttgagacagggtcttgctctgttccccaggccagagtacagtggcaggatctttgctcactgcaacccccgcctcctgggttcaaatgattctcatgccttagcctcctgagtagctaggactataggtatgcaccaccacacctggctaattttttgtgtttttagtagagacggtttctccatgttggaggggctgctcttgtgacctcaggtgatctgccagcctcaggctcccaaagtgctgggattacaggcatgagctctgcagccagccatcttttcttctttaaatgttttatttgtttgtttatttatgtatttatttttgagacagagtcttactctgtcacccaggctgagtgcagtggcatgatctcggctccctgcaacctccgcctcccgggttcaagtctcctgcctcagcctccctattagctgggattacaggctcataccaccatgcctggctaatttttttttctttttttttttgcgatggagtctcactcagttgcccaggctggagtgcagtggtgtgatctcagcttgctgcaacctccacctcctgggttctgatgattctcccgccccagcctcctgagtagctgggattacaggcgcccgccatcatgcccagctaatttttgtatttttggtagagacggggtttcactatgttggccaggctggtcttgaactcctgacctcaggtgatccacctgtctcgacctcccaaagtgctgggattataggcgtgagccaccatgctggcccagttaaaatgttttaaagagaatacaaaatgtaaaaattaggaatatatgaaaaggcatttctgacatttctgggaaaaatgacaagattcggtgagattaaaacccagtcaaaaatcacctgggattcagtagcagctgccctagtatcgcagacactctccagttggtcttcagtctctgtcccttcctgttatcacctgacccccaccaaggtcaatatcaattccaatacactgttaaacccagcccacttcgctagaggccaacccctatagacaaatgagtgtatgactccaagattagaatgagcctatggatcaacaaacacgcagaattatttgcagtcaattagtaaaatgtcaaatgcagttgatgagattgctttacaaaagtgtctggacctggcgtatcacaggcactcaacagaaagtaattgctatgactagtattaaaattattattacttaactgagatgcatcttcttactttgaggacaatcttgcatcagtgacatatccaagaaaacggagtcggtgacttctctgatggaaagcagtctcaacctatctttttccagtcctccaggacttttgctgagtaatgttttcttcattttgttacagagttgtttataacgtgggagcccagaggagtcactgactctatcaggatgagggcacagcatcactggaagaaacctctttattccaggtttcatgtattcacatggaagaacctcctttagggaagtagtggcttatataattggttagtttggaagaagggacaacagcatatacagggcttagcatttacctttctgtttttatttggcacaaccttacatgaacctggtacatatcgtgacctgttccttcatacgtcaaatataaagtatataggagatcaatgattgcctggacctgagtgaaagaaggtcaggaaatgtattacaaaagagtatgagatattttggggggcaatggatgtgttcattatcctgattgtgttgatggtttcacaggtatggagacatgttagaactcatcaaattgtacactacggctgggcgcggtggctcatgcctgtaatcccagcactttgggaggctgaggtgggaggatcacttaagcccagaggtttgagaccagcttgggcaacaaggtgaaacactgtctttacaaaagaaatataaaaattagccaggtgcggctgggcacggtggctcatgcctgtaatcctagtactttggggggtcgaggcaggcagattgcctgaggtcaagagttcaagaacagcctgggcaacacggtgaaaccccatctctactaaaatacaaaaaacaggccgggcacagtggctcatgcctgtaatctcagcactttgggaggccaaggtgggcagatcacgagatcaagagattgagaccatcctggccaacatggtgaaacccggtgtctactaaaaatccaaaaattaggtggatgtggtggcacgcgcttgtagtcccagctacttgggaggctgagacaggagaatcgcttgaacccaggaagcagaggttgcagtgagccaagatcgagccactgcactctagcctggcaacagaacgagactctgtctcaaaaaaaaggaaaaaaaaaaaaattagccaggcgtggcagcatgcgcctatagtcccagctactcgggagactgaggcagaagaattgcttgaaccctggaggtggaggttgcagtgagctgagatcatgccactgcactccagcacgggtggagccttaaaaaaaaaaaaagccaggtgtaatgtcacatgcctgtggtcccagctactcaggaggctgagggaggaggattgcttaagtccaggagtccaggactgcagtgtgacatgatcgtgccactgccctccagcctttgtgatacaagcaagaccctgtctcaaaaaaataaaaaatttacactctaaacgagtgcagctaattgtcaattatatctcaataaagctgggaaaaagccatgtaagtaaatggagagagaagtgtaaaaagtcattttataatggtgaaaaagcattttctataataacatgatttgactgtaaaaccaatgagagtcacctatacaatttgtgtatacacacatggaaaatggaaaaaaagttaatcatttaaaaatctttcagataaagagggtcagtgagttgtttttaactcacttctttcttttttcttttttttgggggagggggcagagtcttgctctgtcgcccaggctggagtgcagtggcgtgatctcggctcactgcagtctccatctcctgggttcatgccattctcctgcctcagccttctgagtatctgggactacaggtgcccgccaccacacccagctaattttttgtatttttagtagagacggggttttaccgtgttagccagaatggtcttgatctcctgacctcgtgatccgcccacctcggcctcccaaagtgctgggattacaggcgtgagccaccgcgcctggcctctttgtttttgtttttttttttttttttgagacagagtctcactctgtcgcccaggctggagtgtagtggtgtggtcttggttcactgcagcctccgtctcccaagttcaagccattcttctgcctcagcctcccgagtagctgagactgcaggtgcgtgccatgacacctgactaatttttgtatctttttgttttttgagacggagtttcgctcttgttgcccaggctggagtgcaatggtgcgatctcggctcactgcaacctctgcctcccgggttcaagcaattttcctgcctcagcctcccgagtagctgggattacaagtgcccgccaccacgcccagctaattctttttgtatttttgtagagacagggtttcaccatgtcagccaggctggtctcgaactcctgacctcaggtgatccacccgccttgacctcctacagtgttgggattacaggcgtgagccaccaggctcggcctcaatttttgtatttttagtagagaaggggtttcaccgtgttggccaggctggtctcgaactcctggcctcaagtgatctgcctgccgcggcctcccaaagtgctgggattacaggcatgagccaccatgcctggccctaacccatttcttaaaactattggagtgccacatcttccaaatagtttgtaaggaaaattgattaaaggaagatgaaaatttactagttggatttcaacaaaatgctgtgcatagtatttataattgaaagaggatatcaagttttagtatagttgtggatctacatgtcactgtgaaacatcttttttagtatgacagtctccaaacaaagcatccacaaaagctgaaattagaacagacgtgggctgggtgcaatggctaataaaaatacaaaaattatccgggcgtggtggcaggtgcctgtagtcttagctacttgggaggctgaggcatgacaattgcttgaacccaggaggtggaggttgcagtgagctgaaattgcaccaccgcactccaacctggatgacagagcaagactctatctcaagaaaaaataaaaaaacagacctttaaatttctatatcacaaattattttaaaatattcttagaataaagaaatacattcgatcacattgtactcattaaatatcactggtcacaaaaatatttttctatagctaatagataaaataagataaaaataatttgaaatgtttttaaaataataatttattagctacaataaaatttaatttttttaaattctgtgtccaaatctttttatttttttaatttattttatttatttatttatttattttttggagatggagttttgctcttgttgcccaggctggagtgcaatggtgcaatctcggctcacctcaacatctgtctcctgggttcaagtgattctcctgcctcagcctctggagtagctgggattacaggcatgcgccaccacgcctggctaatttttgtgtgtgtgtatttttagtagagacaggctttctccatgttggtcaggctggtctcaaactcccaacctcaggtgatctgcctgccttggcctcccaaagtgctgggattacaggtatgagtcaccgtgcctggccttattttatttatttatttatttatttatttatttatttatttatttatttatttttgagacagattctggctctgttgcccaggctggagtgcagtggctgatctcggctcactgcaacctccgcctccgggttcaagcaattcccctgcctcccatgtagctgggactacaggtgcccgccaccacgcccagctaatttttgtatttttagtggaaacaggatttcaccatgttggccaggatggtcttgatctcttgagctcgtgatccgcctgcctcgacctcccaaagtgctgggattacaggcataagccactgcgcccggcccatctttttcttttttatagagtctggttccctttgcccaggctggaattcagtggtgaaatcatggcttattgcagcctcgacctcccaggctcatcctcccgagtagctgggaccacagatgcacaccatcattctcagctaattaaaaaaaaattatttgtagatatatggtctccttatgttgcccagcctggtcttaagctcctgggttcaagtgatcctcccacttcagtctcctgagtagcttcccaactactcaggcatatgccaccaagcccaggtagtgtttttgtttttgtttttttttggtagagacagggttaccctatgttgcccaggctggtcttgaactcctgggctccagagatcctcctagatcagcctcccaaagtgctagaactacaggcatgagccaccgtgcccagcataaaaccaaatattaataacgtcatttggcctcaaacataagccatgttctccaacctagactttattaataatgaaaatgacattttaatcttaatcagccagcatctttgactacaactaaaatagttttgaattgaaaaggaaaaggggggcggaggttgttgatctcctaatagtggtgaccttttgtttgatttttgaagactgagtagaataaggtcaccaagcaaagatgtgagagaggactttgcaggaaaggataatgagtacagagaaaatttcgtgatcaaagttatggaaacattaaagagtctggtgcaccagggaagtgcctggctgttgtattcagggtatgtattgaaatgtggtaggaaaagagcctgttgggccataggcatggatccagatcagtgctagctatatttgtcttcaaaacagaggttgtttttatcatgttctccactggtttcctagcgcttggaacagtgtctggctaagggaaaggaatgaaagacattttacactatgtttaataaatttgcatgttcccctgtaagtgataggggatttggttcttcagccattccctttcttctgtgagttagctcatatcattttttcttaagttaaacatgaccgctttctgttgcttgcaaccaaagaaccctacctgattcagttggcacagttcatccccttacaggagatacatcccctgttaagggagtatctctttttttttgagacggagtttcactcttgttgcccaggctggagtgcaatggcatgatctcggctcactgcaacctccgcctcttaggttcaagcgattctcctgcctcagcctccctagtagctgggattacaggcaaccgccaccatgcccagctaattttttatattttttttagtagagacggggtttcactatgttggccaggctggtcttgaactcctgaccgcaggtgatccaccctccttggcctcccaaagtgctaggattacaggcgtgagccaccgtgcctggccaggagtatctcttacatgaagaatatcaaggacattcaaagtgcttttagtagtgggccacaaattcagaaatccctgggtgtgcagccactggcatttaaactaatggcaagtcaagagggttagtatgcgtagtagatggaagtcaagtgtatgtatttaagtcaagtgtatgcaacatatgaatgagcagaaacattaaacgtaacctttaggaaaagacaacaggcaagtgcaaacaaaaagaaagcggactatgcattattcatatcacaaaataaattcaaggaaagcaaaatctatttagatatttactaaaaggagagcactacgtaacagagcttatgggaacgggccaaatctccacttacaagaagattaacaaccttaaatttctttattgtagaactaagaatgaaaatacctgaactgagcagtcagttcaagaaaaatgacaaaaagaagagagcagactgaatgagaatttggccacagtccatttcataggtgtgggacagggaaaggaaaaagggcctctcaaatgcacaaataacatgatcagagaggtgcaagtacaaccaagggagctcagtttcacagaaccaaggggaacagagttttttggtgtttttgtttcagacagtgtcttgctatgttgcccacactggtcttgaactcttggcctcaagcgatcctcctacctcagcctcccaaagtgatggtgctgggattacaggtgtgagccaccatgccaggccatgggaaatggaggtttttttgtttttgtttttgttttttttgaaacagagtttcactcttgttgtccaggctggagtgcaatggcgcaatctcagctcaccgcaacctccgcctcccgggttcaagtgattctcctgcctcagcctcccgagtagctgggattacaggcatgtgccaccatgcccagctaattttgtatttttagcagagacagggtttctccatgttggccaggctggtctcgaactcccaacctcaggtgatctgcccgcctcggcctcccaaagtgctgggattacaggcgtgagccaccgagcccggcctgtttttgtttttgagacagggtctcactcgtacccaggctggagtgcagtggcatgatctcagctcactgcaacctccggctcctgggctcagggatcctcctacctcaaccccccaagtagctgggactacaggtgcaagccaccacacctggctaatgtttgtatttttggttgagacagggttttgtcatgttgcccaggctggtcttgaacttctgagctcaagcaatctacccacctcgtcctcccaaattgctaggattataggcgtgagccacccatccaggccaggaaatggagttttaatgaataagtgaggagctgcagaagggagggagtaatcaacagggtcaaacaaaaaatgagatccgataagaaaatgtcttaaatttctacagagcttggcaattaccagtaagagatcagcaggatttattctgagctttccatagaaagaaaatactttggcagaattaaagggaaggacactagaattgtggtcatttctcatgtttgccatccaaagtctccttagacctcttacgctacgtgtactccaatttttccggggaagagacatcctttttttttttttttttttgagacagtcttgctctgtcgccaaggctggagtgcagtggtacaatctcggcttatcacaacatctgcctcccaagttcaagtgattctcctgcctcagcctctcagatagctgggactacaggcacacaccaccatgcccagctatttttgtgtgtgtgtgtgtgtgtatttttaatagagacagggtttcaacacattggccaggctggtctcgaactcctgaactctagtgatccgcctgcctcccaagtaccagctgatgcatttctatgtccagggtgtgatatggcagactgtgggttgaataaccccattctcattcccaaccctgttttcccttgcctgcctcacttgtactcactttcccaacaaccttatagcaagcagtggccagatggtatgtatcccaaaacagacatgatatccaggtagatataaatgactagaactgggccgggcacagtggctcacacctgtaatcccagcactttgggaggccgaggcaggcagatctcttgaggtcaggagtttcagatcagcctggccaacatggtgaaatcctgtctctactaaaaatacaaaaattaggcctggcacagtggctcatgcctataatcccagcactttgggtggttgagacaggcggatcacctgaggtcaggagtttgagaccagcctggccaacatggtgaaaccctgtctctactaaaaatacaaaaattagccgggcgtggcagcatgcgcctgtaatcccagctacttgggaagctgagacaggagaatcacttgaacctgggaggcaggggttgcagtgagccgagatcgcgccattgcagtccagcctgggcaacagagcaagactccatctcaaaaaaaaaaataaaaaaaaaaataaaataatacaaaaatcagacggatgtggaagcaggcgcctgtaatctcagctacttgggaggctgatgcagaatcgcttgaacccagaaagtggaggttacagtgaaccgagattatgccactgcactccagcctgggcgaaaggagactccatctaaaaaaaaatacaaaaattagccaagctttgtggcatgcacctgtaatcacagctactggggaggctgaggcaggagaatcacttgaacccgggagcaggagattgcagtgagccaagaggtgccactgcactccagcctgggtgacagagtgagactccatctcaaaaaaataatagaaataaaaataaaagacatggccagatggggtggctcacgcctgtaatcccagcactttgggaggccgaggtgggtggatcatgaggtcaagagatcaagaccatcctggccaacatgttgaaaccccgtctctactaaaaatacaaaaattagctgggcatggtggcgcgccccagtaatcccagctacttgggaggctgaggcaggagaatcgcctctgggaggcggaggatgcagtgagcagagatcgtgccactgcactccagtctgggtgacagagcgagactctgtctcaaaaaacaaacaagcaaacaaacaaacaaaagatacataactggaattgggacacccatcttgtgagaaacagtaaaaaatcaagagaatcccagctctaccaaccccaagtccttgagccactgggtcgacatgttactatatgacttcagacttttgtgtgtgtgtgtttttgacacagagtctcattttcttgcccagactggggtgcagtggtgcagtcaatctcggctcactgcaacctctgccttccaggttcaagtgattctcctgcctcagcctcccaagtagcagggattacaggcgtgcaccactatgcctggctaatttttgtatttttagtagagacagggttttcaccatgttggccaggctggtctcaaattcctgaccttaaatgatccacccgccttggcctcccaaagtgctgggaatacaggtgtgagctacagcgcctggcctgacttcagactttttatgatgtgagaaaaatacacccctgatgtcaactcctgatgtaaagtctgtccttgtacttgaattaatgtctgttacagaagacttgtgacttataatgatgctgattttgtccctagggccacaggtggctatgttgacttaagccttagccaattcacatagaacatttccttgatgacagtgaattgttcagggacaggcataagagccaagtcaggacaattggggccaaagaaactcactttccaggatatttttataaactgtcagagaagcagacttttcttttcctgcagtaattgattaagagaagatatgtggattgagccgcagcagcatcttgagggggagaatctgcctgaggctcgagccagcacaggaaaaactgaacccagagatgaaaaagagaaagtgggttctggtgacatagctctagactcagtcaagccttatttggagtcagcccaacccctggagttttcacatacgtgagccaataaattgccccttttgaaagccatttaggtttgggttttctcttacatgaaagcaaagaatcttcaggagattgtatttttccaaagatggttccatcagtatatttatcccattccacatgctcttcttgcaataactggtactcttcccactattgggtggggtttgttttcccacccctgggtggggcttgtggttgccgtaaccaaggagtatggcaccatgatgctattgacttacaaggtacagattgtctctttctctctctctcagtgcttacctttgtaacctggcctctatattttaaggaaacctaagccacttggagaggtcacatgtaggtgttctagccaacaatcttaggtctcaggacagccagaatctatcaccagatgtgagtgaatgagccttcaggtgattctagcccccagcattcaaatattccaaatgagaccctggccatcctggagcagagacatgccattctggctgtgttcaatccaacctccgcctcctgggttcaagcaattctcctgcctcagcctcctgagtagctgggattacaggtatgtgccaccatgcctagctaaattttttgtatttttagtagagatggggtctcgctatgttagccaggctggtctgagagcacgtgcccagattatcattgttttaatgcaactaaattttggggtagtttattatgtagcaatagatatactaacacggagtcctaattgatagaattggtattctgcgtgagagtggtttaagaagaatagtagaggctgggcatcacaactcatgcctgtaatcccagcactgtgggaggctgaggcaggcggatcacctgaggtcaggacttcgagaccagcccggccaatgtggtgaaacccatctctactaaaaatacaaaaaattagcctggtgtggtggcatgcacctgtaatcccagccactcgggaggctgaggcagcagaatggcttcaacccgggaggcggacactgcagtgagtgaagatcatgccactgcactctctagcctgggtgacagagcgagatgccatctaaaaaataaaaaaaagaaaaaaaaaagaagacgaagacaaagaagaagaatagtggaatgggaaataagattgcagcgtataagaagcgagcaggaggtgagaaaaatggaattagaaaggtagatactctggactctgaacaagttccatgaaggcctctccctggtcttagaaaaggatacaataagtcttaaaccaaagctgacagtcactattcaggcttctggggatcatcagaggactaaaggttatgagtttgatataattctggaggagggtctttactaactggctttgtgaatttctcagaattccaaaaggcattaagaaggaatcaaaggtgaatcaataaaaccctcaggaaagcatttatttcagaagcattctctgctcaaaaactccagcagacttcattgcctctgatacagataaagcccttcagcctggcattcgagggtctccttgccacatctgtttcccaatgctcccctttacatcccccagggtccagcaaaactgtgatgcttgctgactgcactacgtgatattctcccaactctccttccctgtgccacctctaggtgtttgccctcgtggggaagaaactctggagcaccagctgtggtcagagtgctcctcagtgcctgtgcccattctcatctcagccaaagtacagagaccttctgtagtgaaggatcaatgatgatcaatgatgagttgtagggcccacagcctttttcttttatgatttttaaattcaagttttttttttttctttttgagacagagtctcactctgttacctaggctggagtgcaatggcggaatcttggctcactgcaatctccacttcccgggttcaagcgattctcctgcctcagcctcctgagtagctgggactacaggcttgtgcccccatgctcggctaatttttgtatttttagtagagatgggtttttaccatgttggccaggctggtcttgaacttctgacctcaagtgatctgctcacctcagcctctcaaagtactgggattacagatgtgagctgctgtgcccagacagtaaattgaagtataatttatatacagtaaaatgcatagatctcaagtatactgtcctgtgagttttaacagttgtattcacttgggatgatatggtttggctgtgtgcccacccaaatctcatcttgaattcccacaggttgtgggagagacctagtgggaggtaattgtatcatgggaacaagtcttttttttttttttcccaagacggagtcttgctctgtctcccaggctggagtgcagtggtgcgatctcggctcgctgcaacctctgcctcccaggttcaaggcatcctcctgcctcagcctccaaagtagctgggactacaggcgcatgccaccatgcccagctaatttttgtatttttaatagagatggagtttcaccatgttggccaggatggtctcgatctcttgacctcgtgatctgcctacctcggcctcccaaagtgctgggattacaggcatgagccaccgcacctggcccctgggggggcaagtctttcctgagctgttcttgtgatactgaataagtctcacaagatctgacggttttttttttttttagatggagtcttgttctgtcgccaggctggagtgcggtggcacaatctcggctcactgcaagccccacctcccgggttcatgccattctcctgcctcagcccctcagcctcccgaggaactgggactacaggtgcctgccgccacgcctggctaattttttttgtatttttagtagagatggggttccactgtgttagccaggatggtctcgatctcctgacctcatgatccgcctgcctcagcctcccaaaatgctgtgattacaggcgtgagccactgtgcccagccgatctgatggttttaaaagaggaattcccctgcacaagctctctttctttgcctgctgccatccatgtaagatgtgacttgctcttccttgccttccaccgtgatcatgaggtttccccacccatgcagaactgtaactccaattaacctctttcttttgtaaattgcccagtctctggtatgcctttatcagcagtatgaaaatagactagtacagtaaattggtaccagtagagtggggcgtttctgaaaagatacttgaaaatgtggaagtgactttggaactgggtagcaggcagaggttggaacactttggagggctgagaagaaaactgaaaaatgtgggaaagtttggaactccctagagacttgttgtacagctttgacaaaaatgctaatagtgatatgaacaataaggtccaggctgaggtggtgtcagatagagatgaggaacttattgggaactggagcaaaggtgactcttgttatgttttagcaaagagacgggcagcattttgcccctgccctagagatttgtggaactttgaacttgagagagatgatttagggtgtctggtggaagaaatttctaagcagcaaagcattcaagaggtgatttgggggctgctagtatattcagttttttttcttttcttttcttttttttttttttctggagacaaaatctcactctgtcgcccaggctggagtgcaatgatgtgacttcagctcactgaaacttctgcctctcggattcaagcaattctcctgtctcagcctcctgagtagctgggactacaggggtgtgccaccacacctggcaatttttgtttttttagtagagacagggtttcaccatattggtcaggctggtctgaaactcctaacctcaggtaacccacccaccttggcctccctgagtgctgcgattacacgtgtgagccactgcacccagcccaaaagcattcagtgtttttttttttttttttgaaatggagtcttgctctgttgccaggctggagtgccatggtgtgatctcagctcactacaacctccacctcctgggttgaagcgattctcctgcctcaacctaccaagtagctgggattacaggcgcccaccaccacatccagctgatttttatttttagtagagatggggtttcactatggtggccaggctggcctcaaactcctgacttcaggtgatccaaccccctcggtcccccaaagtgttgggattacaggcgtgagccactgcacccagcctgcactgagttttataagggaagcagagcattaaaattcataaaatttgcagtctgacaatccaatagtaaagaaaataccattttctgaggagaaattcaagctagctgcagaaatttgcataagtaacaaggagcagaatgttaatctccaggacaatggggaaaacatctccagggcatgacagaggtcttcagggaagccccacccatcacaggcccaagagcctaggaggaaaaaggcttcagagggtggacaccccaaggcttggcagcttccatgtggtgtcaagtctgcgggtacacagaagtcaagaattgaggtttgggaacctccacctagatttcagaagatgtatggaaacacctggatgtctaggcagaaatttgctgcacggacgggccctcatggagaacctctgctagggcagcgaggaagggaaatgtggggtcagagcccccacacagagtccctactggagcattgcctagtggagctttgagaagagggccaccatcctctagaccccagaatggtagatccacaaacagcttgcactgtgcacctggaaaagccacagacactcaaagccagttggtgaaagcagccggaagggaagctataccctgcaaagccacagaagcagagcttcccaagaccataggaacccacctcttgcatcaacatgacctggatgtaagacatggagtcaaaggagatcaatttggagctttaagatttgactgccctgctggatttctgacttgcatggggcctgtagcccctttgttttggccaatttctcccatttggaatggctgtatttacccaatgcctgtacccccattgtatctaggaagtaactaacctgctttttaattttacaggctcataggtggaagggacttgcctcagacgaggcaggaaggtccacctcagacgagactttggaccatgaacttttaagttaatgctgaaatgagttaagactttggcggactgttgagaaggcatgatgggttttgaaatgtgaagacatgagatttgggaggggccaggtgtggaatgatatgtttggctgtgtccccacccaaatctcttcttggattcccatgtgttgtgggaaggacccagtgggaagtaattgagtcatgggggcaagtctttcccacgctggtttttttttttttttttttttttgagatggggtctcactttgtcgtccaggcgggagtgcagtggcacaatctcagctcactgcaacctctgcatccccaattcaagcaattctcctgcctcagcctcctgagtagctgggactacaggtgcacaccaccacacccagctaatttttgtatttttagtagagacagggtttcgccatgttggtcaggctggtctcaaacttctgacctcaggtgatccacctgcctcggcctcccaaagtgctgggagtactttgggtgagccacccatggtgtgagctaccttgaaagacccaaatcacttctttttttttttttttttttctgagagggagtctctgtcacccaggctggagtgcaatggcacaatctcagttcacagcaacctccacctctggggttcaagtgattctcccacctcagcctcctgagtagctgggatttcaggtgtgtgccaccatgcctggctaatttttgtatttttagtagagacagggtttcaccacgttggccaggctggtctcgaactcctgacctcatgtgatccacctgccttggccttccaaaatgctgagattacaggcgtgagccactgtgcccagccccaaatcccaaatcacttccaatagtagaaatggaaataaatgtgagctcggaaaagatcaatataaacaagaaagataattatttacccaagttttggtatatctgagtgatggcagttgtagtggtggtgggttaagtcatggaataaatgcttagaaagggaaaattgtaaggagtgcttcctacaatcatgcagttcaaaaacaatcacaaatatggtcggcttgctaagtagtttcttcttttttttttttttttggagacggagtctcactctgtcgcctggtgtacagtcgcgatctcagctcactgcaaactttgcatcccggtttcaagtgattctcctgcctcagccacttgagtcactggattacaggtgcctgccactacactcagctaattttctgtatttttagtagagacggggtttcaccatattggccaggctggtctcaaactcctgacctcgtgattcacccgcctcggcctccaaaagtgctgggattataggcgtaagccaccacgcccggcctcgctgaatactttcatactatatcatttattgtcacacatctgtgtgattgttgtatactttatgaattttttattgtacaaaaatttgcattcatttattcattttcttttcttttttttttttttttgagacgaagtctcgctctgtcacccaggctggagtgcagtggcgcgatcttggctcactgcaagctccacctcctgggttcacgccattctcttgcctcagcctcccgagtagctggtactacaggcacctgccaccctgccctgctaatttattgtatttttagtagagatggggtttcactgtggtctcgatctcctgacctcgtgatccgcctgccttggcctcccaaagtgctgggattacaggtgtgagccactgctcctggcccatttattcattttctaacccacttattccagttcaaggttgcgggtagccagagcctagctcggcaggtcatagcacagggctggaacctgccctggactggacactatcctgttgtagagcacactctcacacacacctgcacacacacccacactcactcagaccaagacaatttagacatgcaatgaacccacgctgattaatcaacagcatttgctttgggatgtgggaggaaaccacagtacctgaaggaaacccacacagacatgggagagtgtgcaaattccacacaggcagggcccctgccgggaagcttttctttttttttccctcatctaagttataaggaaaccaggccaggctcagtggctcatgcctctatatttccagcactttgggaggctaaggtgggaggatcgcttgatttcaggagttcaagatcagcctgggcaacatagtgagatcctgtctgtacaaaatatacaaaaattacccgggtgtggtggcctgtgcctatagtcccagctactcgggaggctgaggtgggaggatcacttgaggccttgattgtcgaggctgcagtgagctgtgatcaggccactgcaccccagcctgggtgacaaagagagaccttgtctcaaaaaaaaaaaaaatttataagtgagccacattgtacaaaattatggtcttccaggacctgatacatttctgtcactccaaaaattctgtcattcccctgctcctttcttttctttttttttagacagagtggagtctcgttctgtcgcccaggctagcgggcagtggcgtgatcttggctcactgcaagctccacctcccgggttcatgccattctcctgcctcagcctcccaagtagctgggactacaggcgcctgccgccacgcctggctaattttttgtatttttaatagagacggggtttcaccgtgttagccaggatggtctcgatctcctgacctcatgatccgcctgcctcggcctcccaaagtgctgggattacaggcgtgagccactgcgcccggcctctatgtgcttatttatatatcttcttttgtgaagtgtctgttcacgtcctttactgtctttctcattgatttgtacttggagcctactttgttgccaaggtgacgtatacagaacccagaagcccatcttgaattcacatgccctggcatacaggttcaaggcaggaagaaaggccaggtgtctataattcgaaggatctgcacctacttaggagttaggctacacaggactatacaagtgttgcaaatcgggtcttttggtgttgggcacaacacagcgcacctgggcaaagagcagaactcctgaatcttacactacagtagtgatttataaccctggatgctaataagaaccacctggggaattcttggtcccaaattctggtttaattggtggacgttcagtctgggcatttggaattgtaaaagctttccaggtgattgtaatatgcagtgaaagttgaaaatcactgttctggaaggacattcactgattattaagcatatgctatgctattttgtgaaactatcaagttaatttaaaccaaactttaaattaggtgttttttttcccacatagataaactgggggagctgaagatttttagctctttatcaacatcaagtatcaaactatagaatgtggccaggcgcagtggctcacgcctgtaatcccagcactctgagaggccaaggtgggcggatcacaagttcaggagtttgagaccagcctggccaacatgccgaaaccccatctctactaaaaatacaaaaattagccaggcatggtggcaggtgcctgtaatcccagatactcgggaggggctgaggcaggaaaattgcttgaacctgggaggcagaggttgcagtgagccgagatcatgccattgcactccagcctgggtgacaagagcaagactccatctcaaaaaacaaacaacaacaacaacaaaaactttagaatgtagaccctgatgatcactatccagtctctataattttctcaaggccccatctcatctataataatcatgtttgaaataagaatttagctatcatagttctagacacatttacccagcagttaaaatgagatgtaagagtcctctttatttattgtcttaagctgatatggagacatctcatgtacttgtaatttgcttccaagttctatccccaaaaagccagatttcaaatttgaaaaaggttgtacagagattatgatgtagggccaggggtcagcaaactatgactagtaggccacatccttcctgtgggccagatccagtctattgcctgttttttgtaaagcctgagagctaagaatggttctaatatatttaaattaatgaagaaaatcaaaatgagagtaataataattacatgaaaatcaaatttcagtgtccataaatacattttttatttgaagacagccatgcttgttcatttacttattctttatcattgcttttgcatacaaatgcagaattgagtaattataacagaaacttcatggcccacaaaacctgaaatatccactattcagatttttttggggtttcactatattgcccaggctggtctcaactcctgggctccagagatcctcccactttgacctcccaaatgctgagattacaggcatgagccacctcacccaaccctatttggatctttatggaatagatttgctgccctgtgatttagataaagattctctgaatgggagaagagaagaattggggaattgaggaatgcatagatcgagtctttcactaagaatgagccccgtctacccactttcccactaagccaagccctgggagataaagactaaatagtagtaaataacagaacttctaatttgtttgggtaatctgaatgcagagggctgacccgcttcctggttagagccccaagtatttttttttttttttgagtcagagttttgcttttgttgcccagactggagcacaatgccttgatctcggctcaccacaacctctgcctcctggttcaagcgattctcctgcctcagcctcccgagtagctgtgattacaggcatacgtaccaccacgcccggctaattttgtatttttagaagagacggggttcctccatgttggtcaggctggtctcaaactcccgacctcaggtgatctgctcacctcagcctctcaaactgctgggattacaagcatgagccaccgcacccaaccctatttggatctttatggaatagatttgctgccctgtggtttagataaagattctctgagtcaggaaacaacaggtgctggagaggatgtggagaaataggaacacttttacactgttggtgggactgtaaactagttcaatgattgtgaaagatagtgtggcgattccttaaggatctagaactagaggccgggcgcggtggctcacacctataatcccagcacttttggaggccgaggcgggtggatcacgaggtcaggagatcgagaccatcctggctaacatggtgaaacccccgtctctactgaaaatacaaaaaattagccagacgtggtggcaggtgcctgtagtcccagctacttgggaggctgaggcaggagaatggcgtgaacccgggagatggagcttgcagtgagctgagatcatgccactgcactccagcctgggggacagagcgagactccgtctcaaaacaaaacaaaaaaaggatctagaactagaaataccatttgacccagccaacccattactgggtatatacccaaaggattatgaatcatgctgctataaagacacatgcacacatatgtttattgcggcactattcacaatagcaaagacttgaaaccaacccaaatgtccatcagtgatagactggattaagaaaatgtggcacatatacaccatgaaatactatgcagccatagaaaaggatgagttcatgtcctttgtagggacttggatgaagctggaaaccatcattctgagcaaactatcgcaaggacagaaaaccaaacactgcatgctctcactcataggtgggaattgaacaatgagaacacttggacacagggtggggaacatcacacaccggggcctgtcatggggtggggggagcagggagggatagcattaggagatatacctaatgtaaatgacgagttaacgggtgcagcacaccaacagggcacatgtatacatatgtaacaaacctgcacattgtgcacttgtaccctagaacttaaagtatatatataaaaaaaaattctctgaatggggaaggagaagaattggggaattgagggatgcatagatattatgagtctttcactaagaatgaaccctgtctacccactttccctgggagataaagactaaatagtagtaaataacagaacttttaatttgtttgggtaatctgaatgtagagggctgacccccttcctggttaaagccgcaagtaataaatggctgtgtgatagataaatctaggctcctggttcccaaagtcttgttcccagacttgcagcatcaccatcacctggaagcttgtttgaagtgtaaattctctagctttgtcccagactcacggaatcaggaactttgggagtggagcccaacagtcagcattgcaacaggccctcctagtggtgctaatgcacagaggagcttgagaagctcagcaggtagaaccttcgatagcagcctgaatttcctgtgactgtgcatagcgcccagcctgaaataaagtctcatttcttgaagaagaaatttgtggccaggcgtggtggctcacgcctgtaatgccagcacattgggaggccgaggcaggcagatcacctgaggtcaggagtccgagaccagcctggccaacatggtgaaaccctgtctctacaaaaacacaaaaattagccgggcgcagtggctcaagcctgtaatcccagcactttgggaggccaaggcgggtggatcacgtgttcaggagatcgagaccatcctggctaacacggtgaaaccccgtctctactaaaaaaatacaaaaaaaattagcagggcgtggtggcgggcgcctgtaaacccagctactcggaggctgaggcaggagaatggcgtgaacccgggaggcggagcttgcagtgagccgagatcgcgccactgcactccagcctgggcgacagaacgagactccgtctcaaaaaaacaaaaacaaaaacaaaaattagccggcatgatgacgggtgcctgtaatcctagctcctcaggaagctggaacaggagaatcacttgaacctgtaaggcagaggttgcagtgagccaagatcatgccattgcactccagcctgcacgacagggcaagactccgtctcaaaaaaaaaaaaagaaaattggctgatgtggtggcgagtgcctgtaatcccagctacttgggagggtgagacacaagaatcacttgaacccgggaggcagaggttgcagttagccaagatcacgccactgcattctagcctgggcgatgaatcgagattttgtctcaataataataataataataataataaaataggccgggcacgttggctcacgcctgtaatcccagcactttgggaggccaaggcgggcagctatgcagcactgatttattccagatgggctgctttcctcactgtattcttcctctatgggtgaacaaatccacctgttggtacttatgcattcatatggcatgaatatgccttgctatggattattgctgttcatcatcactatatgatggagaaggtgagtgggggcaagcaagaccttgctggtaggcagcagcaagccactgttacagggaatcctacagtcaaggtttgctcagcattttcccaattcagggggttagtcctagggttattcatcctctatcacacagttctccaagaatactttactgtggcatctcttagttatgaatgttacttctttttccaagctaatgtcaccacagaacagtgaaaacttaggagttcccttccaggctattgtgttcctaactggtacctgcgacttgccaaggattcacgagtgccttgttttggtggttttcatgtggctgtggcttgtctccaggcaggcctgcaatgagatatgtgtatccatgtgggtggtctgcacaaagtacaaccatgggagtggtcagaagaatttcataaggctgaacaaatgggcttggcaggtctttctccagaattccttttgtaggccagtttcccagctgcaatggatgtgttggcatggagtccagtcttagcctcgaggcctgctgaggcctgcggttcttttttttttttgagactgagtctcgctctgtcaccatgctggcatgcagtggcacaaacgcatccggggtatttttttaaatctacattttattatttttatttttatttatttattttttgagacggaatcttgctctgtagtccaggctggagtgcagtggcatgatcttggctcactgcagcctctgccgcccaggctcaagagattcttctgccgcagcctcctgagtagctgggattacaggtgtgcaccaccatgcgtggctaatttttgtatttttagtagagacggggtttcaccatgttgctcaggatggtcttgaactcctgacctcgtgatccactcacctcggcctcccaaagtgctgggattacaggtgtgagccaccacgcccggcctattttattatttttagagacaggatctcgctctgttgctcaggctggggtgcagtggtgcagtcatagctcactgcagcctgcaactcctgggctcaagcgatcctcttgcctcagcctcccatgtagctgggactacaggcacccagctaaggaaaaaaacatttaattgaaggaggggtagcacgtaccaaagcaaattttagatgtcaaattgaaaaaaatgagaaagtatgatatttccatttgttttcacaaacataaggataatataacacccaagtctcctattttaaaattctaccttatgtagaggcatatattgagtatctattaattaaaaagttttaagctgggcgcggtggctcacgcctgtaatcccagcaatttgggaggccgaggtgggtggatcacgaggtcaagagattgagaccagcctgaccaacacagtaaaacctcatctctactaaaaatacaaaaattagccaggcatggtggtgcatgcctgtggtcccagctactcgggaggctgaggcaggagaatcgcttgaacccgggaggcagaggttgcagtgagccgagatagcaccactgcactccaacctggtgacagagtgagagaccatctcaaaaaaaaaaaaaatagatttaagagactgtatctcttgataggtcaaaggagaagatggataaatatataaagctatggaactatgctgtctaatatagtaactactggccatatatggctattgagcaaagctagtctaaattgagttgtgttataagtgtaaagcacatatccaatttcttttttttttttccttttttttttttttgaggcggagttttgctcttgttgcccaggctggactgcaatggcatgatctcacctcaccacaacttccacctcccaggttcaagcgattgtcctgcctcagcctccctagtaactgggattacaggcaagttccaccacgcccgggtaattttgtatttttagtagagatgaggtttctccatgttggtcaggctggtctcgaactcctgacctcaggtgacccgctcgcctcagcctcccaaagtgctgggattacaggcgtgagccaccgcacccggctccaatttcaaacacttaatataaaaaagaataggcggccgggtgcggtggctcacgcctgtaatctcagcactttgggaggccgaggctggtggatcaccagtcaggagatcaagaacatcctggctaacatggtgaaaccccatgtctactaaaaatacaaaaaattagccgggtgtggtggcgggcgcctgtagtcccagctactagggaggctgaggcagaatggcgtgaacccgggaggtggagcttgctgcagtgagccgagattgcgccacagcactccagcctgggcgacagagcgagactccatctcaaaaaaaaaaaagaaaggaaggaagaaaagaaaagtataggccaggcatggtggctcacgcctgtaatcccagcactttgggaggctgaggagggcagatcacttgaggtcgggagtttgagaccagcctgaccaacatggagcaatcccgtctctactaaaaatacaaaattagccaggcatggtggcatatgcttgtaatcccagctactcaggaggctgaggcaggagaatcacttgaaccagggaggctgaggttgtggtgagctgagatcccgccattgtactccagcctgggcaacaagagcaaaactccctttccaaaaaaaaattaataaaataaaaataaaaaaatatagaatacttcattaataattttttctgccagacacggtggctcacacctgtaatccccgcactttgggaacctgaggcaggaggattgcttgagctcagaagtttgagaccaacctgggctcatatctacaaatatatttttttaaatcagctgggcatggtggcacatacctctggtcccagctaatcagtatgctgagtggggaggatcacctgagcccaggagtttgagactgcagtgagctgtatttgtaccactgtacgccaacctggacgacaaagtgagattttatctcaaaaacaattttttttttctaagtgattacgtgttgaaatcatattatgtatctattgggttaaataaaatatcaaaattaattcaccttttaaagaaaactttttaatatggctactagaaaatttaaagtttgaacccaggaggcggaggttgcagtgagccaagatcgtgccactgcatgccagcttgggcgacagagggagactccatctcaaaaaaaaaaaaaagaaagaaagaaaatttaaaattataatatggcttgcattatattcctatgggatagcactgctagagagaaattgtgatgaagacccatgggaaatgtatcaaagttgaaatacatggaaaacttaactaaatggtttaataagtacatttcaataatattttttagcattgtgtcaaaattataacgtggcaaaaacattagcttttcataaaataacccttactaacgaaatttaatggtatttccatgtcattactctgccaatttaataattggtatttggttctaagtctgttaaaaggagttttgaatcttctctgttacctacttgcatgtgcatttgttttttgttgtttgtttgagatggagtctcactctgctcccaggctggagtgcagtggcacgatcttggcttactgcaacctccacctcccaggttcaagcaattctgcctcagcctcctgagtacctgggattataggcatgtgccaccatgtccggctcatttttgtatttttactagagacggggtttcaccatgttggccaggctggtcttgagttcctgacttcaagtgatctgcctgcctcagcctcccaaagtgctgggatgacaggcgtgagccaccacgctggcctgcatgtgcatttgcaattacaaatgtagtgacccaggaaggttgtactgacactcacattctagtagatgcatggccaaaaacaatttgatttcccaaaatggtcaacaacacttggtaaggttcccaaccaaacaaagtacatttttcttacatttacacagcagtttggttcctggaaaattcggtgaatgttaaaaccatgcaaaaatacttctctttgtgtgtatgtggagtgggggcgtgtatgtaaaacagaatcagctcagatcattataaacagatttttatcttacaggaatctctggtgatacagtggaaaatcctaaaagacacaaagcaattatttgctatgaagagagtgtggcatccctgccctcccccattacgtgcttatagcgtctcaatattttgtaaacattttttggggggaataattatagattcacaggaacttccaaagaaatgtccaggaagttccactgcacccttcactccattctccctcaatgttaatatcttccatggctacagtgcaatatcaaaaccaggaaatcaacattggtacaatgcacagagcctattcagataggaaaccaacattggtataatcctcatcacttgttcagacttcacccattatacttgcagtcattagtgtgtgtgtatgtgtcttgctttatataacattaccacatgcctagctttgtataattaccattataatcaagatacacaactgtcgagtagggagggatcatggcagtggggaggcaggactagattgcagctcccacttggacggacagagcagtgtgcagcctctcgcatcgtgaacttttgctccagaagtactgcaggaatagatcaggaaagctgagagaacccacagaccctaggaaggaagcagattgctcctgcaggacctgggagacaccctaaatactgtgttggtatccatggctgagagacctacagatggtcacatcacatgactctgtgcagacaacccccagtattagccaggagcctggtagacctgttgggtggctagatccagaagagagataacaatcactacagttctactatcaggaaaccacatccctaggaaaatggggagagtaccacatcaagggaacaccccatgggacaaaagaacccgaacaacagccttgatccctagaccttccctctgacaaagcctacaccaatgagaaggaaccagaaaaccaactctggtaatatgacaaaacaagttcttcaacactctgcaaaaatcacaccagctcagaagcgatggatccaaccaagaagaaatccttgatttacctgaaaaagaattcagaaggtcagttactaagctaatcaaggaggcaccagaaaaaggcaaagctcaatttaaggaaatcaaaaaaagatataagaaatgaaggaagaaatcttcagtgaaaaagatagcataaataaaaaacaatcaaaacttcaggaaacaatggatgcacttatagaaatgcaaatgctctggaaagtctcagcaatagaatcgaacaagcagaagaaagaattcagggctcgaagacaaggttttcaaattaacccaattcaacaaagacaaagaaaaaagaataagaaaatatgaacaaagcctccaagatgtctaggattatgttaaacgaccaaacctaagaataatcggcgttcctgaggaagaagagaaatctaaaaatttggaaaacatatttgggggaataatcaaggaaaacttccccagccttgctagaaacctagacatccaaatacaagaagctcaaagaacacctgggaaattcatcgcaaaaagatcatcaccaaaaaaaaaaaaaaaaaaaaaaaaatggccaggcgcggtggctcatgcctgtaatcccagcactttgggaggctgaggcaggcagatcacctgaggttgggagttcgagaccagcctgaccaatatggagaaaccccatctctactaaaaatacaaaaattagccagtgtcgtggtgcatgactgtagtcccagctactcaggaggctgaggcaggaaaatcgcttgaacctaggaggtggaggttgcaatgagctgagatcgtgccactgcactctagcctgggtaacagagtaagactctgtctttaaaaaaaaaaaaaaaaaaaaggatcatctccaaggcacattgttgtcaggttatctaaagttaacatgaaggaaagaatgttttttttttgagatggagtttcgctcttgttgcccaggctggagtgcaatggcgcaatctcggctcaccacaacctctgcctcccaggttcaagcgattcttctgcctcagcctcctgagtagctggaattacaggcatgtgccaccatgcccagctaattttgtatttatggaggagacagggtttctccacattggtcaggctggtcttgaactcccgacctcaggtgatccgcccgccacggcctcccaaagtgctgggattacaggcatgagccacctcgcccagccctacctagattggcatttttattattattattattgtttgtttgtttgttttttgagatggagtttcgctcttgttgcccaggctggagtgcaatggtgcgatctgggctcatcgcaacctccaattggctatttttacttagtatgattcacttgaggttcatccaagttgtatgtgttaatagctcattcactttgattgctgcgtagtagtccatggtttgaatgttccgcagttcagccatttatttactgaaagacatttagaggctgggcgtggttgctcatgcctgtaatcccaacacttcgggaggccaaggcaggcaggatcacttgagcccagaagtttaagacaagcctgggcaacatggcaaacccccgtctctacagaaaaatgaaaattagccaggcttggtggttcacacctgtagtctcacctactcagaagattaaggtgagaggatcacctgagcttgggggtgcggaggttgcagtgagctgaaatcatgccagtgcactccagcttgagtgagagtgacactctgtctcaaaaaaaaaaaacacctttagataatttacagtgtttggctattatgaataaagctgctgtgaacactattacgagcttgtgtgtgaaaaaaaattttatgtgagaaaaatgaccaagagtgaaattgctgagtcatatgttaagtccattttgggtggtaaaaaaaaagcagccctggccgggcagggtggctcatgcctgtaatttcagcactttgggaggctgaggcaggcaggtcacgaggtcaggagttcgaggccagcctgaccaacatggtgaaactccatctctactaaaaatacaaaaattagccaggcatggtgccgcgcgcctgtaatcccagctactcaggaggctgaggcaggagaattgcttgaacccgggaggcggaggttgcagtgagctgagatcgcaccactgcactccagcctgggcaacagagtgacactccgtctcaaaaaaaagaaaaaagaaaaggaagaagaaacagcccaagtatttttcagagcggctgtaccattttacgtcccatccagcaaagtatgagtgactcagagtctctgcatcctcaccagctcttggcatcatcactattttttatttcagccattcttagtactttgacaatcaaaatttgcccacaaatttctaaaatattacccagatggtagcattgtgtctactgagaatcattagatgactggctctcaaactaggctgtgcattcagattgtctagagcactttataaacatacctgtggctgggtccctgcttcacagattctagtttaattggtctgggatgtgacctggccatcaagaattgtaaaagttccccaggtatttcaatgtacaaacaaattcatgaatcactgatactattcccacgtctcagtcattttagtcctaaagtttcaaaatcctatggatgagataaatcaagggttgaggccaggcgcagtggctcgtgtctgtaatcccaacactttgagaggccgagatgggcggatcatgaggtcaggagtttgagaccagcctggcaatgtaatgaaaccccgtctctactaaaaatacaaaaattagctggatgtggtggcatgtgcctataatcccagctactcaggaggctgagggaggagaattgcttgaacccaggaggcggaggttgccatgagccaagatcatgccactgcactccagcctgggcgacagagcaagacaatgtctggggggcggggaggggaatcaagggtcgagatcatttctccagaataagatttacagctagtgcagcattattttcccagcagaatgtcagtagagctcaaaggggaagcaaaagtaactgtggcctaacatgctgggttagaagaagaaacttcttaaaatagatatataagactaaaactaagtccaaattacataaaaacaaaccacaaatgcctaggactcatttcaattcctagacatatgatgtagtggtaccaaaagacgggctttcgaattagaagttctggccaatcactgggcacggtggctcacacctgtaatcccagcactttgagaggctgaggagggtggatcacttgaggtcaggagttcgagaccaacctagccaacatggcaaaactctgtctttactaaaaatacaaaaagtagctgggcgtagtggtgcacgcctgtaatcccagctactcgggaggctgaggcaggagaatggcttgaaccaaggagaaggagtttgcagtgagccgagattatgccgttgcacttcggcctaggcgacacagcaagactccatctcaaaaaaaaccaaaacaaagacttagaagtcctggttttgagttctggtttttccatgtaagagctgtgggatcttggatgagtcatttgacccctctaaacttcagttttctatccctgagatctgcaatgatgaaaacctcagaggtttttggcaaagcttaaagtgccaatatgtgctgtatttttaacaaaaacatgctgcaattatgatacaattattacggataggaaaattagaaatatttgttatccagacctcatccaactcactccaaccaatatctgatgaccacattttatgtaatatttaatatgtattgtcatggccaggcacagtggctcatgcctgtaatcccagcactgtgggaggcgtggcaggtggatcacttgaggtcaggaatttgagaccatcctggccaacatggtgaaactccgtctctactaaaattccaaaaattagccgggtatgggggcggtgcctgtaatcccagctactcaggaggccgaggcaggagaattgcttgaacccaggagacagaggttgcagtgagctgagatcacaccattgcactccagcctgggcaacagaacaagactccgtccccctcccccacaaaaaaaaaaggcctggtgtggtggctcacacctgtaatcccagcactttcagaggccgaggtgggcagaccacctgaggtcaggagtttgagactagcctggccaacatggtgaaaccccgtctctactaaaatacaaacattggctggacgtggtggtgggtgcctgtaatccccagctactcgagtggttgcggcaggagaattgcttgaacacggcaggcagaggttgctgagatcgtgccattgtacttcagcctggacggcaagagcataactctgtctcaaaaacacatacacagccgggcgcggtggctcacgcctgtaatcccagcactctgggaggccgagacgggcggatcacaaggtcaggagatcgagaccatcttggctaacacagtgaaaccccatctctactaaaaaatacaaaaagttagccgggcatagtggtgggcgccgtgcctgtagtcccagctactcaggaggctgaggcaggagaatggcgtgaacccgggaggcggagcttgcagtgagccgagatcgcgccactgcactccagcactctagcctgggtgacagagcaagactccgtctcaaaaaacaaacaaacaaaaacaaacacacacacacacacacaccaaaaaaaaaaaaacccacagaacaatacaattttatttatttatttatttatttacagaaacgaggtctcattatattgcccaggctggtcttgaactcctgagctcaagtgatcctcccgcctccgcgtcccgatatgctgggattacaagcatgagccaccatgcctggcccagaataatataatttggggcttcttaagtttagtgtgcctgcgaatcaccaagggatctctttaaatttcagatatgattcagcaggtctttggcagggcctgaggctctgcatttcttttgttgttatttcgagacagagtctagctatgtcacccagggtggagtgcagtggtgcgatcactgctcactgcagtcttgccttcctgggctcaagcagtcctcccatctcagcctcccaagtagctgggactgcatgccaccacacccggctaattttttttttttttttttgagatggagtcttgctctgtcgcccaggctggagtgcaatgatgtggtctcagctcactgcaacccctgcctcccgggttcgagcgattctcttcctcagcctcccaagtagctgggactacaggcgcccaccacacccagctaattgttgtatttttttaaatagagacggggtttcactatgttggccaggcttgtctcaaactgctcacctcatgatccgcccacctcagcctcccaaagtgctgggattacaggtgtgagccaccgcacccggcctaatttttgtattttttgtagagacagggtttcgccgtgttgcccaggctggtctcgaacttctgggctcaagtgaccctcctgcctcagcctctgaaagtgttgggattataggcgtgagccactgtgccctgccaggccctgcatttctaacaagctcttaggtgacatccgtgctggttgtctgctgacattttgagtagcaaagatataattttcaaataccataactcagctttaataactgttaactactggtcagctttgtttccatcttcttatccattctctgccccagatgattttgaagtaaatcttggacattctatgatttacgtgtatttaattacatatctcattgaaaacttcagaatgcttcctttgaaaaatataatcataatagcatcaggagcgcctcaaaagtttaacaatgacttctttttttattatttttattttttatttatttttttattttttgagacagagtctcgctctgtcgcccaggctggagtgcagtggcacaatctcggctcactgcaacctccacctcacgggttcacgccgttctcctgcctcagcctcccgagtagctgggactataggcgccagccatcacgcctggctaattttttgtattttaagtagagacggggttttaccgtgttagccaggatggtctcgatctcctgaccttgtgatctgcccgccttggtctcccaaagtgctaggactacaggcaggagccaccgcgcctgccctaacagtgatttctgagtatcatccagtatccagtcaattcacatttccctgattgtcccatgaatgcttttttattgtgatttgttaatatgtctcttcagtcattttttattttatttatttatatatttttgagatggagtcttgctctgtcacccaggctacagtgcagtggtgtcatctcagctcactgaaacctttgcctcccaggttcaagtgattctcctgcctcagcctcctgagtagctgggattacaggctcgcaccaccatgcccagctatttttagtagagacagggtttcaccttgttggttaggctggtctcgaactcctgacctcgtgatctgctcgcctcagcctcccaaagtgctgggattacaggcgtgagccaccatgcccggcctcttcagtcatttttaacctgaagattctcctttcagctttttcttttccttacttttatttatttatttatttttaagaaactaggtatttgttctgtagagttttccagtgtggattttgctgccaacatcctcctgatgttgttgagcatgttcctttctctcttgtatttcctataaattggtatggatccagagccttaattggattcaggtttgatttttttgacaaggctacctaatacacagtgctgtgcattccatcaggaggtgcctcatgtcttcttgtctttctgtccataatctttgtaaaggagtcatctcgcctaacaatggaacccgtgattggggtctgctgccaccgggtggtagcagcatgccatagccgcaggttcaaggagtagtaaaagggaaaaaacactgctgtgagatcccagacggcaggacttgtcctcttcattgaacctacaataaatcatcatgattctcaaacacgatacttcaaagctacttttattttattattattattatttttgttattattgtttttgagacggagtctcactctgtagcccaagctggagtgcagtggcgtgatctcggctcactgcaaccttcgcctctgggactcaagcgattctcctgcctcagcctctcgaggagatgggactagaggcacccaccaccatgcccagttaattttttttttttgtatttttagtagagaccaggtttcaccatgttgccctgggtggtctcgaactcctaagctcaggagatccactcgccttggcctcccaaagtgctgtgattacaggcgtgagtcaccacacctggcctattattattattttttagagacagtcacccaggctggagtgcagtggcacaatcattgctcactgcagcctcaatctctcgggctcaagctattctcccatctcagcctcttgagtagcggggaccacaggcacacaccaccacgcctggctagtctttttttttttgcttttttcttttggtagagatgtggtctcactaagttgcccaggagcaaagctacttttaaaatgaggctgggcactgtggctcatgcctgtaatcctgaactgaggcaggaggattgcttgaggtcaggagttcaaggccagcctggcctacatggtgaaacctcatctctactaaaaatacaaaagttagccaggtgtccaggtgcagtggctcactcctgtaatcccagcactttgggaggccgaggtgggcggaacacctgaggtcgggaccagcctgaccaagagagagaaaccctgtctctactaaaaagacaaaattagccgtcgtggtggcgtgtgcctgtaatcccagctgttcaggccgaggttggcggaacacctgaggttgggaattcgagaccagcctgacaaacagggagaaaccctgtctctgaggctgaggcaggagaatcacttaaacctgggagaaggaagttgcagtgagccgagactgtgccattgcaccccggcctgggcaacaagagcggagctctgtctcaaaaaaaaaaaaaaaaagaaaattagccaggcatggtggtgcatgcttgtagtcccagctactctggagactgaggcaggagaatcacttgaacctgggaggtggaggttgcagtgagccgagatcaggccactgcactccagcctcgacaacagagcaagactgtctcaaaataaatacataaataaattagttaaattaaattaaacaatgctgctgggtgcagtgggctgacgcctataatcccagcactttgagaggtggaggcatgaggattgcctgagcctaggatttcaaggctgcagtgaactatgatcagccactgtactccagcctgggtaacacagcaaaaccctgtctctaaaaaaataaaatagtctaatgctgtctaatagcatgaaataatagttacaatttattaagcccaagaaccttatatccatatctcatttaattctcacaacacccaggaatattaaaccatggtgttcatgttttgtaaaacagtggtgatgctggagtttgctgtcaagacttgttctcaaccatttctgtgccaatcttctgttttggtctatattggagtcacttgtccttcctgtctccacccgacatccccttacagtggtgctgttattttttctgtttgtcccactgtcctccattgccatccattccccctgggagactgaactttctctttagttttttttttttttttttaaagacagagtctcgctctgtcgcccaggctggagtgcagtggcacaatctcagctcactgcgaccgccacctcccaggttcaagcaattgtcctgcctcagcctcccgagtagctgggattaaaagagcaccccaccacacctggcaaatttttgtatttttagtagagacggggtttcaccatgttggccaggctggtctcaaactcctgacctcaagtgatccacctgccttggcctcccaaagtgctaggattacaggcatgagccaccacacctggtcttacttttcctttctttctttcttttttttttttttgagatggagtttgtgctctgttgcccaggctggagtgcaatggcacgatctcaggttactgcaaccaccgcctattaggttcaagcgattctctcacctcagcctcccgagtagctgggattacaggcgtccaacaccacgcctggctagtttttgtatttttttgtttatttatttttttttgtgacagagtctcccttcgtcgcccaggctggagtgcagtggcgcaatctcggctcactgcctctgccttccggttcagtcaattctcctgtctcagcctccctagtagctgggactacgggcacacgccaccatggccagctaattttttgtttctgttttgttttgttttgttttgtcttgtttttgaaacagagtcatgctcttgttgcccaggttggagtgcaatggcacgatctcggctcactgcaacctctgcctcctggattcaatggattctcctgcctcagcctcccaagtagctgggattacaggtgcccaccaccatgcccagctaatttttttttttgtatttttagtagagacggggtttcaccatgttgaccaggctactcccaaactcggacgacctgaagtcggaagttcgagaccagcaggaccaacatggagaaaccccgtctctactaaaaatacaaaaaattagccaggcgtggtgttacatgcttgtaattccagctacttgggaggctgaggcaggagaatcacttgaacccaggaggtagaggttgcagtgagccgagattgcgccattgccctctggcctgggagacaagagtgaaactccgtctcaaaaaaaaaaaaaaagtttatcctttttccctctgggctccatgcaggtccctttccttctccacttttgttcccagcaatttacggtttccttgattatcatttctctgataactatgttaccagaaagggctcctgatgcacatcctaagagagggttcttggatctcacacaagaaagaattcagggtgagtcactagagtaagtgaaagcaagtttattaggaaagtaaaggaagaaaggaatgcctactttacagacagagcagccctgagggatgctggttgcccatttttatggttatttcttgatgatatgctaaacaaggggtaaattattcatgcctcccctttttagaccatattgggtgacttcctgacgttgccatggcatttgtaaactgtcatggtgctggtgggaacgtagcagtcaggacacccagaggtcactctcgtcgccatcttggttttcgtgggttttaactggctcctttactgcaacatgttttatcagcaaggtctgtatgacctgtatcttgtgctgacctcctatctcatcctgtgacttagaatgccttaaccttctgggaatgcagcctagtaggtttcagcctcattttacccagctttattcaagacggagttgctgtagttcaaatgcctctgacaattataccctcttagttatgtgctttctgttctcttggttaaggtttgttcgcttgtttttgagacaggttctctctctcttgcccaggctgaagtgcagtggcgtgatgttgggtcactgcaaactccacctctggggttcaagctattctcctgcctcagcctcccgataagctgggattacaggcacccaccaccaagcctggctaatttttgcatttttagtagagacagggtttcaccatgtttgccaggctggtctcgaactcctggcctcatgtgatctggccgtctcagcctctcaaagtgctgggattacaggcatgagccactgtgcccagctttggttaaggtttgaaggtgtcacagggtgaactccagaattggggttcagcctgggagaccccttgggttcctggcttcacaggaaggaattcacagcctggttaacatggtgaaatgccatctctacacaaatacatatattaggtgggtgtggtggcacatgcctgtaatcccagctactcaggaggctgaggcacaagaatcacttgaaccccggaggcaggggttacaatgagctgagatcgcaccactacactccagcctgggcgacagagtgagactgtcttaaaaaaataaataagtagctgggagtggtggctcactcctgtaatcccaacactttgggaggctgagggggggtggatcacgagatcaggagttcgagaccagcctgaccagcatggtgaaacctggtttttactgaaaatacaaaaaattagccgggcggggtggtgcgtgcctgtaattccagctacttgggaggttgaggcaggagaattgcttgaacccaggaggcaaaggttgcagtgagctgagatcgcgccattgcactctagcttgggcaacaagggcgaaactccgtctcaaaaaaataataaataaataaataaaaagtagcctccataggcagagcagccctgagggctggtgggtggctctttttatggttattatggttatttctttattatatgctaaacaaggagtggattcttcatgagttttccaggaaagtggcagggaattcctggaacctagggttcctctttctttcagagcatatagggtaacttccagacattgccagggtgtttgtaaactgtcattgcacttgtgggagcttcctttagcatgctaatgtattataattagcatatgataagcagttaggatgaccaggggtcgctttcatggccatcttggtttgggtgggttttgaccggcttcttttactgtatgttttatcaactgggtctttgtgagctgtgtcttgtgaaaccagtcctgccaaactcctgtctcaaaggaagtgccttcatttcatcatcaacattcttaaaatttttttcctttttttttttttttttgagacggagtttcgctcctcttgcccaggatggagtgccatggtgtgatcttggctcactgcaacctctgcctcgcaggttcaagcgattctcctgcctcagcctcctgagtagctgggattacaggtgtgcaccaccatacccggctaatttttgtatttttagtagagatgaggtttcaccatgttggtcaggctggtctcgaacacctgaccttgtgatccacctgccttggcctcccaaattgctgggattacaggggtgagccaccgtgcctggccatgaacatcttttcatatgtttaagagtcatttgtttttactgtctgttcatatcttttccctattgttattctggttgttctggttgttagcattttgttttgttttgttttgttttgagatggagtctcgcactctcacccaggctggagtgcagtggcaccagccatctcggctcactgcaagctccgcctcccgggttcacaccattctcctgcctcagcctcccaagtagctgggactacaggcgcccgccaccatgcctggctaattttttgtatttttagtagagacggggtttcaccgtgttagccaggatggtcttgatctcctgaccttgtgatccgcccacctcagcctctcaaagtgctgggattacaggcgtgagccaccacgccaggcctttttgtttgttttttttgaggcagagtctcactctgtcgcccaggctggagtgcagtggcgagatctctgctcactgcaacctctgcctcccgggttcacaccattctcctgcctcagtctcccgagtagctgggactacaggtgcccgccaccatgcccggctaattttttttatttttagtagagacagggtttcactgtgttagctaggatggtctcgatctcctgacctcgtgatccacccgcctcggcctcccaaagtgctggggttataggcgtgagccaccatgcccgccttagtttttttattgatttagttttccttattgatttggagaaattatgtattaaataagctggccccttgtccgtacataagtgataaatatttcccacattttttatttgcttttgaatttatttgtgttttgatcatgttgatgttttaatatttttatataattgtgatggttaattttaggtgttgcctctactggattgaggaatacctagagaactagtaaagcattgtttctggatgtgtctgtgaggatgtttcctcacagtcagtggactgagaagggaagattcactctcagtgtgaatgggcaccatccaattgtctaggggcccagtagaacaaaaaaagagaggaaaggatttcctcttcctccttcctcactcccctcatccccagagctgggatattctcctcctcttgctcttggacatcagaattccaggctttccagacttgggactccagggcttacaatcaccctcctgcagggttatcaagcctgcagcctcagagtgagaactgtaccatcagctccactggttctgaggcttttgaacttggactgaaccacaatactggcatactaagatctccagattgcagatgccctcttgtgtctcccataattaccagagccaattctccttattaatcctcactcttatatttatatctctttggtatttttttttttttttgagatggagtctcaccctgtcacccaggctggagtgcagtgacaggatcttggctcactgcatcttccgcctcccgggttcaagctattttcctgacctcgtgatccgcctgcctcggcctcccaaagtggtgagattacaggcacgagccaccgcgcccggccgatattgttctatagttttgcaaaatgttaccttggttgaaactgagtaaagcatacaaggaatttctttgtattattattattattattattattattgttattattttgaggcagagacttgctctgtcacccaggctggagtgcaatggtgccatcacagctcactgcggccttaacctcctgggcttgggtgattctcccacctcagcctcttgagtagttgggactacaggtgtgagccaccacactggactgatttttatattttttgtagagatgggatttcaccatgctgcccaggctggtctcaaactcctgggctcaagcaatctgcctgcttcggcccctcaaagtgctgggattacaggcgtgagccaccacacccagcctgtgttattttttactactgcatatgaatctgcaattatctcaataaaattttcaattaaaaatgcaggcaatacagtagtttagaaagtaaatactaacagtcttctctctctgtgcctactctagagaatttcattccctagagagaatgttaacactataatatatatttttccagacttctttctatacttccacatttttctaaacaaaagtggggctgtgctatttatgtatctcagtagcttatttcattcacataaaaaaaaaccagacatctttccatagcatttagggttgccagatacagcaaataaaaatacagcatgcctatttaaatttgaaatggctgatcttttagcataggtatgtccctaatatgttgctattttatttagtaatactaatgggagtaggcttacttaattcttttgataaataattgcataatattcctctgtataacattttgcctttgcctaataatgagggtgctctttacatcacagtgttcatcgtcattctcattaatacagagagtctcttatatttcttttttttcttttttgagatggagtctcactctgtcaccccagctggagtgcagtggtgcgatcacagctcatggcaacctctgcctcccgggttcaagcagttctccctcggcctcctgagtagctaggattacaggcgtgcaccaccatgcctggctaatttttatatttttagtagagacagggtttcaccatgttggccaggctggtctttaactcctgacctcatgatctgcccacctcagcctcccaaagtgctgggactacaggcatgagccactgggcgagacggagtcttgctctgtcactgggctggagtgcagtggcacaatctcggctcattgcaacctctgcctcccgagttcaagcaactctcctgcctcagcctcccgagtagctgggattactggtgcccaccacgaggcctggctagttttgttttttttttttagtagagattgggggttttaccatgttggccaggctggtctcgaactcctgacctcaggtgatccacccacctcagcctcccaaagtgctgggattatagacatgagccaccaagcctgtcctaaaacttttttttttttgtggtcttcctctgttgcccaggctagagtgtggaggtgccatctcggctcactgcaacctccaacctcctgggttcaagcaattctcatgcctcagcctcctgagtagctgggatgacaagcgtgtgccaccatgcctggctaattttttgtattttagtagagaaagtgtttcaccatattgcccaggctggtcttgaactcctgagctcaggcagtccacccgccttcgcctcccaaagtgctaggattacaggcgtgagccaccacacctggccggtaccttaaactttaattattctaactcctatatttaattcagcgaacactaagaactgcagtggaaaaagccttggctttggatccctggctctgcttcttactagatacctaaccatcttttatttttatttattttttactttaatttagagatggggggctgggcacagtggctcatgcctgcgatcccagcactttgggaggccgaggtgggaggatcacctgaggatgggagttcgagaccagcctgaccaacatggagaaaccccgtctctactaaaaatacaaaattagccaggcgtggtggcacatgcctgtaatcccagctactagggaggctgaggcaggagaatctcttgaacctggtaggcagaggttacagtgagctgagatcatgccattgcactccagcctgggcaacaagagtgaaactccatctcaaaaaagaaaaaaaaaaaaattagaggtggggtcttgctctgtctgtcacctgggctatggtgcagtggcatgatcttagctcactgcagccttgaactcctgggctcaagtaatgcttccacctcagtctcctgaatagctgggaccacaggtgtacaccaccatatctggctaatacctcatgtccttcggccttagtttcctcatctgtaaaatgggaatagaaataattattttacaggattagaaataatgtatttacaaccctgtaatctagtgtctagcagagaaggaaacttaagaaataaatcattgtttattatagtaatgttaagattctgtggtgggtactaagggataaacagagttaagattcctgaaatgttttgttactttttttttttttttctgagacagtatcttgctctgttgctcaggctggagtgcactggtgccatttcagcttactgtaacctctgcctcccaggctcaagcgattcccctacctcagcctcccaagtagctgggactacactataccttgcttactttttattttcatataattttttttttttgaggtggagtcttgctctgttgcccaggctggaatgcagtggctctccgcctccccagttcaagcaattctcccgcctctgcctccccagtagttgggattacagtcacacatgccaccacgcccggctaagtttttttttttttttgagatggagtctcgctctgttgcccaggctggagtacagtggcgcggtctcagctcactgcaagctctgcctcccaggttcatgacattctcctgcctcagcttcctgagtagctaggactacaggcacccactaccacgcccggctaattttttgtatttttagtagagacggggtttcaccgtgttagccaggatggtcttgatctcctgacctcgtgatcagcccatctcggcctcccaaagtgctgggattacaggggattacaggcgtgaaccatctcgcccagtcttgattttttttttttctttttttgagacagagttttgctctgtcaccaggctagagtgcagtgacacgatctcggctcactgaaacctccgcctcctgggttcaagcaattctcgtgtctcagcctcccgagtagctgggactacaggcgtgtgccgccacatccagctaatttttgtatttttagtagagatggggtttcactatgttggtcaaggtggtcatgaactcctgacctctggtgatccacccacctcggcctcccaaagtgttgagattaacaggcgtgagccaccactcccagcccggactttctcttatataaccacctaacaacagttcagttatcataattacaaaatttaacaaattcctgaagtagtttctgaattcaaatccctaaagtatttgtaatagctttttaaaactatttccttttctagcaggactgtgaccaaaaccctaattttctatggcttcccacttgcccttggattggatgtaaaatctgtgcatggcttgttgcccgaggctggctaacctgcaggcccacagaaggcaaagggctttgcactgagaggcgccttcagagactggacgccagcctttttctcccgttccactgatgactcagccacacatggcactgagactcgtggcattcactctgccaacagagaagcacagctctcaccctgctttggcaggcctggcacactcctatggtggcccagcgtctgctctggctttctctgaaatgtaaatccattcttttcctggtcagcacacctcccagctctagcctggcacacaaggctctctcactgggtcccctgcttaccagctcttcctctcctgcctttttccatcctgtgctccacccaactggcctttctccacggtgacttgtgttttctcgccccctgcttctgcacacatattttcccctgcctggggaatgctcttcttcccccgttggatttttctattattttcaaggcctggctccagtagaaaatatttcaatcacttccctctgagctggaaacaagatagctacctgcacttgtatttagcacttctatggggtccttcattagtgttagccaactgtagtatgggcctgtctatgggtctggttcctctgtctgtgagctcccttgggcagaaaccatgtctcatttcttcatttctctggtattgccctgaacagggcctggcacagggtagacatgggtgactgatgaaagaatgaatagcacaaattaccctgtgagagaggggcaggcttttgagtatagagatgatgcatggatgtagcacataaatcatttaaaagactgttgtgggttttattattgctgctaatggtgttattcttggtagagatgttacattcggccaggtgctgtggcacactgtaatcccagcactttgggaggccgaggtgggtggatcacctgaggtcaggagttcaaaacaagcctcgctaacatggtgaaacctcatctctactaagaatacaaaaaattagccgggcgtggtggtgcgtgcctgtagtcccagctacttgggaggctgaggcaggtaaatcgcttaaacccaggtggtggaggttgcagtgagccaacattgtgccactgcactccagcctgggtgacacagtgagactccatctcaaaaacaaaacaaaacaaaacaaaaaaaacaaagagatgttaagaagttacatcccggccaggcatggtggctcatgcctgtaatcccagcactttgggaggctgagatgggcagatcacgaggtcagaagttctagaccagcctggccaatatggtgaaaccctatccctactaaaaatacaaaaattagccgcatggtggcgcacgcctttagtcccacctacttgggaggctgaggcagaagaatcacttgaactggggaggcggacgttgcagtgagcccacagcactccagcctgggtgacagagcaagactccatctcgaaaaaaggaaaaaaaaaaaaaaaaggatgttacatcccaaatggcctgacctacccagtcaggccatttttttttttcttttgagatggagttttgctctttttgtccaggctggagtgcaatggcgcgatcttgggtcaccgcaacttctgcctcctgggttcaagtgattctcctgcctcagcttcccaagtagctaggattacaggcatgcgccaccatgcctggctaattttgtatttttagtagagatggggtttcaccgtgttggtcaggctggtcttgacgcctaacctcgtgatccgcccacctctgtctcccaaagtgctgggattacaggcgtgagcctgcacagcggaccagagatcttgatgctcttcttgtaactgttttagggtaccatgaactatacccgtaattagactgcaaacttaattgataaatattgtgtgtgttctgactgcttcactggctgattgttccccgtctctttccctctcctcaggcgttcctattccctgagacacaacaatgttgaaattaagccaattaataaccctacaatggcctctaagtgttcaagtgaaaggaagagtcacacatctgtcacttgaaataaaaatctagaaatgattaagcttagtgaggaaggcatgtccaaagctgataggctgaaagggaggcctcttgtgccaaataattagccaaattgtgaatgcaaaggaaaagttcttgaagaaaattaaaagtgctactccactgaacacatgagtgataagaatgcgaaacagccttactgctgatagatagtagtctggatagaagatcaaaccagacacaaaattccttgagccaaagcctaatccaaagcaaggccacaattctcctcaattctgtgaaggctaggagaggtgaggaaactgcagaagaaaatttggaagctagcagaggtcggttcatgagatttaaggtaagaagctgtaggctgggtgcagtggctcacgcctgtactcccagcactttgggaggccgaggcgggcagatcaactgaggtcaggagtttgagaccagcccaaccaacatggagaaacatcgtctctactaaaaatacaaaattagctgggcgtggtggtgcatgcctgtaatcccagctacttgggaggctgaggcaggagaatcacttgaacctgggagggcgagtttgcggcgagtttgcggcgagccgagatggcgccattgcactccagcctgggcaacaagagcgaaactccgtctcaaaaaaagaaaaaaagttgtctctgtaatataaacgtgcgcagtgaagcagcaagtgcggatgtagaagctgcagcaagttatacagaagatttggctaagatcattgatgcaggtggctccactgaataacaaattttcaatgtagaggaaatagttctaggttggaagaggagccatctagaactttcttagctaaagagaagaagtcaatgcctagcttcaaatcttcaaaggacaggttgactctcttgttaggagctaacgcagctggtgacttggagttgaagccagtgtgcatttgccagtctgaaaatcccggagcccttatgaattatgctgaatctactctgcctatgctctataaatggaacaacaaagcctagatgacagtataactgtttatactagggtttactgaatatcttttttgtttgtttgtttgtttttttgaggcagggtctcactctgccacccatgctggaatgcggtgacgtaattatagcttacagtaacctcgaactcttgggctccagtgatcctcctgcctcagtctcctgaagagctggtattaccagcatatgccgccacagctggctaaggtttactgcataccttaagcccacttttgagacctacttctaagaaaaaaagattcctttcaaaatattaatgctcattgataatgcccctagtcacccacgagctctgatggagatgtacaaggaaatgaatgttgtttggatgtctgctaacataacatccattctgtaggccatagatcaaggaatgattttgactgtcaagtcattttatttacaaaatacattttgtgaggttacagatgccatagatagtgattttatgctggatctgggcaaagtaaaatggaagccttctggaaagaattaactcttctagatgtcattaagaacatttatggccgggcacggtggctcacgcctgtaatcccagcactttgggaggccaaggcaggcggatcatgaggtcaggagatcaagaccatcctggctaacatggtgaaaccccatctctactaaaaatacaaaaaaattagccgggcatggtggtgggcgcctgtagtcccagctactcaggaggctgaggcaggagaatggcgtgaacccaggaggcggagcttgcagtgagccgagaccacgccactgcactccagcctgggtgacagagtgagactccatctccaaaaaaaaaaaaaagaacatttatgattaatgggaagaggtcaccatatcaacattaacaggagttgggaagaaattaattccaaccctcatggatgactttgaggggttcaagacttcactcgtggaagtaactgcagatttggtggaaacagcaagagaactagaattggaagtgaagcctgaatatgtgactgaactgctgcaatctcatgatccaacttgaatagatggggagtttcttcttacggatgagcaaagagagagtgctttcttgagatggaagctcctcttggtgaagatgctgtgatcattgctgaaataacaacaaaagatttagaatattccataaactttgttgataaggcagtggcaagatttcagagaactaactttgaaggaagtcctgctgtggatgaaatggtatcacacagcatcacatgctacagagaaatctttcatgaaaggaagtgtccatcgatgcagcattgttgttttattttaggaaattgccacagccatcccaacgtttagcaaccaccaccctgatcaatcagcagcatggaggcaagaccctccaccagcaaaaagattatgatttgctgaagattcagatgaccatgttaaattaagtttagcataaagctgcctccttatgcattttaagttcagactaacaatttatttctttctctctctccctttctctcccttcctttcctttcccttcccttcccttcccctcccttcccctcccttccccttcccttccccttctcttcctttctttcttttctctctctctttctctctttctctttttttgagacggagtcttgctctgttgcccagcctggagtgcagtggcacgatctctactcactgcaacctctgcctcccagcagagagaatcaagagattctcctgcctctacctcctgagtagctgggattataggctcgcgccaccaagcccggctaattttttgtatttttagtagagacagggtttcatcatgttggtcaggctggtctcgaactcctgaccccaaatgatctgcccccgcccccccaccaaagtgctgggattatagatgtgagcctttgcacctggcctaacagtttctccatacatagtgaattgtagacaactacaattgtaaatgtgtaaagagactgtaaccttgtaacaagtagcgagtctcagtcaatcacagcagcggagttttggccaatcacaggtggccaactgtttaaacagtgctcaaaatagtcagaggttgagttgcaaccaatccagctgtttccatacttgactgcaatttctgtaagtcattttcctttttctgtccataaatgttatttgaacatatggcagcccgaatcactctgaacctattttggttccagggattactggattttggactcattctttggtcaattcaactctgtaaagtttaatttgtctaaagattttctgggccggatacagtggctcacgcctgtaatcccagcactttgggaggctgaggcgggaggatcgcttgagcccaggagttcgagaccagcctggccaacatagcgagatcccgtctctacccacaaataatttagccaggcgtggtggcgcgtgcctgtagtctcagctactggggttcttattcctcgtggcaacacattttggagagggggaggtattcctgtctttgctgggtgggagaacggccagtgggcaagggaggacgaaaatgagaactgtgactgccagagggcacgtcaattttaggaagagaacgtaagaaagttgggttctgtggagacttggcatatccacgccacctggaaaatcatcacgtgccctccggggcaagaccaaggcctcaagtcacccctcgcagcccagtggacctcccggccatccctttcacggctccacagcgaccgcgagccgttgccccggtgagaaccccccggcactgtgcgcgcccccgcctgccgtgcgcgtccgcttccctgggatccggcgccgcgcgcgcccccgccgcgtccccgccccttccggcccgggagatttgattcccttggcgggcggaagcggccacaacccggcgatcgaaaagattcttaggaacgccgtaccagccgcgtctctcaggacagcaggcccctgtccttctgtcgggcgccgctcagccgtgccctccgcccctcaggtcagttctcccgcctgcccgccgcagtcgcagttgatggctggggtctgggctgtgcggggcgcagcggcccaaacccagtttgctcctggctctcgggagactggaggatttcatcggagccccgcgctttaccagccctgttccctggataagatatttgacctttccgacccgcggttttcttctccgtaagtggggataatgaccgtgtctacttaacagggttattgaagaggtgttcaggctaagcgtttgccacctaggaggctgcgatagacgtgaattcccatttcccgtttccagtttccgtgactcttccccgcgaaaaaagttgacagaagggtttcgagttttttctgtttgtacaactcagtttactggggcagtgcaataaaaaaggagatgtgttatcactaccttttcagagtccaaatccatcctctcctatcatctccccagagtagtggcttcagaggctcacactaaaaggggaattttttttctttttcttcaagacggagtttcgctcttgttgcccaggctggagtgcaatggcgcgatctcggctcaccgcaacctccgcctcccaagttcaagcgattcttctgcctcagcctcccgagtagctgagcttacagacatccgccaccacgcccggctcattttttgtatttttagtagagacggggtttcaccacgttggccaggctggtctccagctcgtgtcctcaggtgatccgcccgccttggcctcccagagtgctgggattacaggcgtgagccaccacgcccggcctaaaaggggaattttcaccgaatgctgtatcagtaataggagcagcaggattgctcccaccaagaaacctggtgtagggttgtgggagctggaaagggtagactcagggaaggctgcccaagagaggaatcaggtccctagcacttaggacgggtaattacctttggtatttctcctttgttagtggaatgaggtgagtatcaggagcctggattgttgtttagaggccagtgttcctaactttggtttaaattttggtttctgtttcccatggagtctggctagaaaatcagaaaaatcagaaaagcccttactgggccttcgtgggcttgtttctcccaagggtctgtcctttctgtgtaactactgtggaccaactagatgggcagatcaatcccaatgagtgcctcattgttggtgctcccagaagcctttgcaagggagcagggcaggatgctaattaaatgtgttacaggccacattataaaccattctgagcccggcgtggtggctcacgcttgtaatcccagcacttggggaggccgaggtgggcggatcacttgaggccaggagttctagaccagcctggccaacatggcgaaaccccgtctctactaaaaatacaaaaaaaaaaaaaaaaaaaaaaattaaccgggcatggtggcgcatgcctgtaatcccagcaactggggaggctgaggcacgagcatctctggaacccaggaggcggaggttgcggtgagccgagatctagctactgcactccagcctaggtgacagaacgagaccctgtctcaagcaaataaacagacaaaacccaaaaaaccattctgtattctacttcctgtttgaaattatcctcagcatcagtgtctttccaagctctgtagataaggtaaatgtatttatgcggcaagtaatagaatagcccaaataatattgttaaaaaatgcccccaatttgttgctatcctttaaaatttaaccataaacgtcttctcattatcccaattccttgctcttctgagaagttaaagaccccaattataggccgggcgcggtggctcacgcctgtaatcccagcactttgggaggccgaggcagatggattgtgaggtcaggagttcaagaccagcctggccaagatggtgaaaccccatctttactaaaaatacaaaaaattagccgggcgtggtggcgcacacctgtaatcccagctacttgggaggctgaggcagaattgcttgaactcagagggcggaggttgcagtgagccgagattacgccactgcactccagcctgggcaagagagcaagactccgtctcaaaaacaaaaacaaaaacaaaacccaattatatatacccccaattcttctatttatttagtcaagcccagaagggcactcaggtgtctgattggggtctaatttccttcttcattattcacagttgagaggctgtcttccgcgttgactgataatatacctccttcagcagctacaaagttgggttactctgttctcaaggcttttctgtattctatattaacaaactctagaggataaacagggcacatgagaatatttagaaccagctccacattcacaaagatttacaaatcaagtataatctgctattagtgtaggagtttgtaatgtaagcaccagttttctcacattgcagcaacaacgatattcccttgattcagtagctataatctaggcccacattggtattactcatccaaagacatgatgtaatttgagagaagcgggtagatagagaaaatggaagaaagaaagaaaaaaaaaagtgcatggcttcagtcttaccttagttgttaaataaacaacttgcccatctctgctagttttccagaggccatgactgggatgtttataactcttttgggagaagtctattaagttaattatgacactcttaaatccctaatctgggaagtgaattccagcatcttacaaattgctttctctttctgagtgacaatttgaaatagcccagtcctttgcatggaatgtaaacatgtgcattcagatttatagtccagtgttcctccatttccattctcctgctctcttttttcttctgtatcaggattccaaagatttctgagccttaggttgacctctatacttttactgtttttattgccttttggaatttcttagtcctatggttcctgtttgtttttaggatgaggttccagtttatccccacatttgccccactgacaaatgccctttaaaatatttctgaattagtgttgctgtttaaagtatttaatcctgtgccttcaggtgcccagtgagaataaatttgtcctctgtgatatctccttgccttgagtaactttttctactccagtggaagcagaatgtttcattttctatcaacagttttccctcagtactgggacctgaccttgcttcttctaatgtttgcctactgtgttcatgcagatttcgttaggttaaatgttcaacctacttattaagttgggtccagtgtgatctcttcctaggaaatggcttaatattgtttattttatcagaatgtcgttttgcatgttatctttttgtgtgctatttctgctttgatgttgaagactgaaccttgttttttaaagctgatttaatttttttcttgagtgtcgatatttttccttctaaagcttctgctctagttttctattcattgaccaaattttttttgtttgtttttgagctggagtctcactcctgtcgtgcaggccagagtgcagtggcgtgatcgcgggtcactgcaacctccacctcctgggttcaagcgattctccttcctcagcctccctagcagctgggattacaggtgtgcatcaccacgcccggctaatttttgtatttttagtagagacggggtttctgcatgttggtcaggctggtctcgaactcctgacctcaggtgatccacctgccttggcctaccaaagtgctaggattacaggcgggagccattgtgcccagccgttttttacttgctgataataattttctttttctctccaagtaaaatgattcatggaatcagtgtttcaggcatagaaaaatgatatttttaaaatgtcctttgtggcttttggggttttgataagttcattcagaattttttccacctcaattttaagaagactactcatcattgtatgaagggccttctcttattaagctctgtcttcctttataagctcaccacacttctgaggttgaactcacactctaggtcttccaaattcatggccattattaaggcttagtaacatgctagtcactcagttctggataagggcagggtgaagaacagagaatttgaaggtagtttacgtggcacctgccactcatcagtttgaggcttaaacaggcttgcttggccagggcgatggctcacgcctgtaatcccagcactttgggaggccaaggagggtggatcacctgaggtcaggagtctgagaccagcctggccaacatggcgaaaccccatccctactaaaaatacaaaaattagccgggtatggtgttgttgttcgcctgtagtcccagctacttgggaggctgaggcaggaaaatagcttgaacctgggaggcgcaggttgcagtgagctgagatcgcactactgcactgcagcctgggcaccagagcaagactccatctcaaacaaacaaacaaactagccaggagtggtggcatgtgactcctggcctcaagtgatccacccacctcagcctgccaaagtgctgggattacaggcgtgagccactgcacctggcctcgactagattttaatttttaatttttatttatttttttgagacacagcttcgcttgttacccaggctggagtgcagtggcatgatctcggctcaccgcaacctctgcttcccgggttcaagtgattctcctgcctcagcctccctagtagctgggattacaggcatgggccaccacgcctggctaattttttatatttttagtagagacggggtttctccatgttggtcaggctggtcttgaactcccgacctcaggtgatccgcctgcctcagcctcccaaagtgccgggattacaagtgtgagccactgcgcctggctgttttttatttttagtagagacaaggtcttgctatattgtcctggcttgtcttgaactccaggcctcaagcaatcctcctgccttgacctcccaaattgctgggattacagacatgagccaccatgcccagctatctttacgcttcttccttttgccactcctagctgtaggtttggtatggggaagaccttagctatctatgttttcaacatttcaaatatttgtcttttgcttttaagtctttacaactgttactgattttgtatggtgtgagatagagatccaatgtgtttttttttttccttcacctcatggctaatcaattgtcccagctccagagctgcatttccatcacctgttacctctaaaagcagcctcagttcagtacctgtcaacttttacttcctctaggatctttgcacctaaattccctctttctggaatattctccgtctatttctttgtgggctatgactgttaaggcctacagaccaaagaccacatctgtagtaaaaatcattagatgtatttagtttgctgcgcaagagaaaccatactcttgagaattttgggtagtctcagagtgagttgaaaggggcagaatgagggaagaatgaggtgggcctgaggatgtcattgaagacaatgaagtcagtcaaataaaggatctttattttaacagccttgtatggaaacattgtttatatggttatgttcagattctattgaaaccattgttcaagttttgataggaatatcacagtctgattactggcagggctgattttctcaattctcatcctttgaattagagcttggcttaaatgttaccttctcagaaaccactgttgcttatttttatttcagtatttagtatagataataataatagtaattattattttttgagacagaatcttgctttgtctcccaggctggagtgcagtggcacgatcttggctcactgcaacctctgcctcctgggttcaagcaattctcctgcctcagcctcccgagtagctgggattgcaggcgcacaccacaaggcctggctaatttatttatatatttatttatttatttatttttgtgagatggaatttcgctcttgttgcccaggctggagtgcagtggcacgatctcggctcactgcaacctccgtctcctgggttcaagcagttctcctgcctcagcctcccgagtagctgggattagaggcatgtggcaccacacctggctaattttgtatttttagtagagacggggtttcaccatgttggtcaggctggtctcgaactcccgacctcaggtgatctgcccgtcttggcctcccaaagtgctgggattacaggcatgagccaccgcgcccagcctaatttttatattttttagtagagaccgggttttactatgttggccaggctggtcccgaactcctgacctcgtgatccgcccaccctggcctcccaaagtgctgggattataggcgtgagcctctgcacccggcctataaattataagtattaatttgttgtctacttatttgccttttgtcttctccactagaatatacactccatgagggcagaatcatatttcttctccattatagccctagtgccaagggcaggtttggcatatcataggtgctcagtaaatatctgtatgaataaatgaataagagcaaattcaagagttttctagaactgcattagcagtttttccagacacactgctgatctctaaaagtcaaccacgaggttattttccacaagtaagatggagatggtatgagtgtgactttgtatattaatgtgcataacagggccctacttagctctatggtttttaaaaaataaactacttaattttaaaactcagggagacaaaatcaataagatctacctaattttttttacaactaatttttatttattatttgatgtataattaacagtatatgtaacccacataagttgtgaagcataataataaaatacatatcatatacataataaaattgtgtatgactggggtcttagtttgggttttcctgatgactactgataattttttcatgtcttcttttttttttttttttttttttattttgagacagaatctcgctccgttgcccaggctggagtgcagtggcgtgatctcggctcactgcaacctctgcctcctgcctcagcctcccaagtaggtggaactacaggcgcgtgccaccacccctggctaattttttatagctttagcagagacagggttttatgatgttagccacaatggtctccatttcctgaccttgtgatccacccgcctcggcctcccaaagtgtgggggttacaggcgtgagccaccgcacccggcctttttttttgagacggagtttcactcttgttgcccgggctggagtgcaatggcacaatctcagcttactgcaacctccgcctcccaggttcaagtgattctcctgtctcaccctcccaagtagctgggattacaggctcctgccaccatgcctggctaatttgtgtatttttagtagagacgggtttcgtcatgttggtcaggctggtctcgaaccctgacctcaggtgatctaccctcctcagcctcccaaagtgctgggattacaggtgtgagccaccttgcccagcttcgtgtcttttttttttaaattattttttcttcaggtagcctcccgagccagagtaggctcagagacacccttttccatgtttttgttggccatttgtgtttctttgagaaatttttttttttttttttgagacaaagtctggctgtttcgcccaggctagagtgcaatggcacgatgtcggctcactgcaacctccacctcccgggttcaagcgattctcctgcatcagcctcccaagtagctgggattacaggtgaatgccaccccgcttggctaatgttttgtatctttagtagagatggggtttcaccatgttggccaggctggtctcgaactcatgatctcgtgatctgcctgccttggcctcccaaagtgctgggattacaggcgtaagccaccatgcccggctgagaaaagttttttgtatcatttgcttattttgctgttgagtttttcttattgttttgtcagagtttatgtgtttcctgtgtacatccactattatatttgttgcaagtatcttctcacatttatggttttctttttttgatggtgtctttggttgtatagaagtgcttagttttatttttattttttttatagatgtggtcttgctatgttgcccaggctggcctcgaactcctgggctcaagctgtcctcccaagtggctgacaacacacgcaccactgtgcccagctgaagttcttaattttaatgttgtttaatatattaatttttttcattattattattagtactttatttaagtgatcctctcctatcctgaaataatgacaatattctttaaaaagttttaaaggtttatgtttcatactttttaagtctatctggaattcatttttatgtatggtgtgagataagaatcctttttttcatatggccaataatcagttttttcagtatcatgtaaatgcataagacttatttagatttgcagttacaagaatggaggagatgatccggtattatttcctttattgattatgtactctctgtcttctaggttctttttctaattccaaataaacttgcaagaggactatgaaagattatgatgaacttctcaaatattatgaattacatgaaactattgggacaggtaattgttatttttttttggaggcagtggatagatcaactatttgagagtatagattatttgggtaggtgtgagctttttcgtctaacccacacagttttaaaattcttctacctacttcagtaagaaaaagtggagcaagcagagaggagaatagtaggagaagccctgtaggttattgcaaggactttgacttttattctaaataatttattctaaatatttcttttatttctttttttttttgagacggagtctcactctgtcgcccaggctggatggagtgcagtggcgcgatcttggctcactgcaagctctgcctcccgggttcacgccattctcctgcctcagcctcccaagtagctgggactacaggcgctcgccatgcctggctaattttttgtatttttagtagagacggggtttcaccgtgttaatcaggatggtctcgatctcctgacctcgtgatccacccgcctcggcctcccaaagtgctgggattacaggcatgagccaccgcgcccaggcttcttttatttcttgacttttattctaaattaaagtcattggagagttttgagttaaggggtaatttgacctttgtttttacagagttgctgtggctgcttggtagataaaaggttggatgaaggagggcaagagcagaggcagggagatgttagcagactattgcgataattcaggtgttgatgctagagatgatggtggtgtggatgagggtgatgtaaaagcagtgaaaggggtgggacattttacacacacatatgtacacacctatgtgtgtatgtttttattaaggtataacatatagtaaaatatgcaaagtgcaataatctcagtggagttttacacatatatatgtatacacatacccatatattccctgtgcggatcaagacatagaccgtttccagggagtatctgcctgctttcccccaaggtagccattgatatattttgaggacagagctaatgggatttattgatgggttggagtgctagagaaagagaagggctaaggatggttccagggtttttggcctgagcaccagggaaaatggagttgccctttgttgaaaggaagaagaccatgggagagactactaggaagttctttttggaaatgttaatttggggatttcttttagctgcctgagtggagacatttgtccagcttttggttcagttttgaaaaataattgcttatcttcaaagtttttttttttttttggagatggagtcttgctctgtcgcccaggctggagtgcagtggtgcgatctcgggtcactgcaagctccacctcctgggttcatgccattctcctgcctcagcctcccgagtagctgggactacaggtgcccgccaccatgccaggctaattttttgcatttttagtagagacggagtttcactgtgttagccaggatggtctcgatctcctgaccttgtgatccgcccgcctcggtctcccaaagtgctgggattacaggcgtgagccaccgcgcccggcctcaaatatttaaaactgagtggaagtttcatataatttgtctttggcctcagcaactttatattgtgttctagcagtgttaattataaaggaaatttaattgcaggattattcataaagcagatttctaaagtgagttctgttttttttttattacaaagtttgagatacactatcatggttaaaaaaaaaaaaaccttcagctagacattggataacaagcagcaacaggaaaaaaaagccacaaacttctaggaaaatttggcttgatagagtcttttaaaattattatatataaaaaggtgtttgtgcctgagtccttgcttatgctttcataatacattttcctacttaggtggctttgcaaaggtcaaacttgcctgccatatccttactggagagatggtagctataaaaatcatggataaaaacacactaggggtaagtttagatttatttaaaaaatagtccacttatagatcagtttcgtgaattaaaacctgaattgttctaatgttctagttactgctcttagaataatatttttataccttttaaaaaacgtatagatctgtggttttaaaaagtaatctgggggaagggattactttgttcttcagattttaacgcagtgcagtgggacatatttgaagtctgtagcatccatctgcagtctgtagtctgtaggtgtttctggatattaatgtgtcccatctttcttttcttttctttattattttttatttttttttgagacggagtctcgctctgtcgcccaggctggagtacagtggcgcgatctcggctcactgcaagctccgcctcccgggttcacgccattctcctgcctcagcctcccgagttgctgggactacaggcgcccgccactacgcccggctaattttttgtatttttagtagagacggggtttcatcgtgttagccaggatggtctcaatctcctgaccccgtgatctgcccgcctcggcctcccaaagtgctgggattacagtcgtgagccaccgcgcccggcctcttttcttttctttacttttttttttttttgagacggagttttgctctgtcgcacaggctggagtgcagtggcgcgatcttggctcacggcgacctccgcctcccaggttcacgccattctcctgcctcagcctcctgagtagctgggactacaggtgcccgccaccatgcctggctaatttttttgtattttttttttttttttttttagtagggatgggatttcactatgttagccaggatggtctcgatctccagacctcgtgaaccgcgtgcctcgacctcccaaagtgctgggattacaggcgtgaggcaccgcgcccggccccatctttattttcttatgatactcttactaaatataaatcattttggtactatagataggcaaatagataaatattatgtcctagcttttttttttttttttttgagacagtctcactttgttgcccaggctggagtgcagttgcacaatcacagctcactgcagcctgtacctgctgggcttaagtgatcctcccacctcagcctcctgagtgggtgtgaccagaggcacatgccactatgcttgcctaatttttaaacatttttctagaaacaaggtcttactctgttgcccagggtggtctcaaactcctggcctcaagcagtcttcccatctcagcttcccaaagtacagggtatgtaggggtgagccactgtacttggcctgtcccagcattttattcaaaatggctttagaagttatctaattaaatccttttccaaatcagcctctttttcctctatgtgaattcttccagggggaacagcttgttatctcctaaagcagcccattcagtttgtggtcttggctacaatgtataaaaagttatttttatgttgagataaagcctgtctcttttggtggtttttctggggcttctgtacccattccagtgtttgaagtcaccttgagtcatcttttttttctaattccttctaccattctttgtttttttttttttttttttttttgagatggagtcttgctctgtcaccaggctggaatgcagtggtgcgatctcggctcactgcgacctctgcctcctgggttcaaatgattctcctgcctcagccacctgagtagctggtactacaggcgtgtgccaccatgtccagctaatttttgtattttcagtagagacaggatttcatcatgttggtcaggctggtctcgaactcctgacctcaagtgatgcacccacctcggcctcctaaagtgctgggattacaggtgtgagctaccactcccagcctaacattttgtaattgtccttaattatcaaacataaaaaataatttttggttgggtgtggtggctcatccctgtaattccagcactttgggaagctgaggccagaggattgcttgaggccaggagttcgagactagcctgggcaatatggcaagtcttgtccctacaaaaaataaaaaaaatttagccaggtgtggttgtgcatgcctgtagtcccagctacttgggaggtggtggtgggagggtcccttgagcctaggaggttgaggctacagtgagctgtgattgcaccactgcactctagcctgggcaacagagcaagatcttgtctaaaaaaagtttttttttgatgtttttattgttggaatgagatagggcttaatattaattgttacctacttttttaattgttaaagatataagttctgattaacacataaataagtcaaagggagccaggcactgtggctcacacctgtaatcccagaactttgggagaacaaggtgggtggattgcctgagctcaggagtttgagaccagcctgggcaacaaggtgaaagcccttctctacgaaaaatacaaaaaatttcgctggacatggtggtacacacctgtagtcccagctacttgcggggctgaggtgggaagatcacttgagtctgggaggttgggctgcagtgagccgagatggtgccgctgcactccagactggatgacagaacaagaccctgtctccagaaaaaaaaaaaaaaagtcaaagagtatgtaagtagttttgttacagcaatgtcattaaatcatttgaatttcttcctaaatatatgctaaaatcatacaatgaccagtataagaaattatttttaattatctgtcagtggacaattcaggctttcctccagtttttttgttttattcaattttttgttttctatttattaatctaagaaaaaagcattaaaaccatttttcttgagcatttaaacatgagtatcaattagattaattcccttaagcagtttaaatttcagttataactttagtatgacttactttaacacttcaaatacttaaatagcaaacaaaatgttattacaaaatgtgttatcacactgatgctcaaaacttattctaaagcgtaatatgacattaattcatgatttctaaacttgtttttatattttctgttgttattatgctcattttagttattttctaggattttaataatattttgattacttccatggttttatttatttatttatttatttttgagatggagtcttgctctgtcacccaggctggagtgcagtggcacgatctcggctcactgcaagctctgcctcccaggttcacgccattctcctgcctcagcctccagagtagctgggaccaccacgcccagctaatttttttgtatttttagtagagacgggttttcaccgtgttagccaggatggtctcgatctcctgacctcttggtccgtctgcctcagcctctcaaagtgctgggattacaggtgtgagccaccacgcctggccgattacttccatggttttagtcatcaggcttcctccccacaaagaaagaagattatcataccaagatagtgaaagttacagttgattctttgtcaagacatgatatctagttgcatagtcctggataactgggtcctgagacactggccattaagacggagtccctttttattttatttgtttttcaagatggagtcttgctttgtcacccaggctggagtgcaggggtgtgatctcagctcactgcaacctctgcctcctgggttcgagcaattctcctgcctcagcctcccatgtagttgggattacaggtgcctgccaccatgcctggctaatttttgtatttttagtagagacgggattttaccattttggccaggcttgtcttgaactcctgacctcgtgatccgcctgcctcggcctcccaaagtgctgggattacaggcatgagccactgtagagcccccccgcctttttttttctgatacggagtttcgctcttgttgcccaggctggagtgcaatggcaacctccgcctcctgggttcaagcgattctcctgcctcagcctcctgagtagctgggattacaggcatgtgccaccacgcccagctaattttgtattttttttttttttaattttttcgatacagagtctcgctgtgtccccaggctggagtgcagtggcacgatctcggccactcccaggttcaagtgattctccttgcttcagcctttcaagtagctgggattacaggcacccgccaccatgcctggctaattttttcgtgtgtgtttttattagagatgggttttcaccatgttggccaggctgatcttgaactcctgacctcgcgatctgcccgcctcagcctctcaaaagtgctgcaattacaggtgtgagccaccacacccaatcagagtccttttttttttgagatggagttttgctcttgtttcccaggctggatcgatctcggctcaccgcaacttccacctccagggttcaagcaattctcctgcctcagcctccagagtagctgggattacagacatgcgccaccatgcccggctaattttgtatttttaattttgtgtttttagtagagacgggctttctccatgttggccaggatggtcctgaactcctgacctcagttgatctgcccaccttggcctcccaaagtgctgggattacaggcatgagccaccgcgcctggcccagagtccctcccttttttttttttttgagacggagtttcgctcttgttgcccaggctggagtgcagtggcatgatctcggctcaccgcaacctccacctcctgggttcaagcaattctcctgcctcagcctcccgagtagctgggattacagccatgcggcaccatgcctggctaattttatatttttagtagagatggggtttctccatgttggtcaggctggtctcaaagtcccaacctcaggtagtccgcccaccttagcctcccaaagtgctgggattatacgcgtgatccactgcgccctgcctcagggtccctttttataatgaagttttacttgttacttgatgatatctctaggcttctgtcctttaaagttttttcagcttggcttatcttcctctccccacccaactttttattttgaaagtttcaagacctcagaaaagattggagactgagacagtgaatacccatatacctttcacctaagttcactggttttttgctcagcatgcttcttaaacggtgttgctgaggctgaaagtggtagctcaggcatgatgactgagtagtgtttctgtcattttccttgtttggaatgctaaccttctaaggagtctgagattgttttctggatgttgtactgttgacccacattgaacctgtctttcataaaatctccaatgccctttttatgcacatgcaaataaattttgctatatttttctgtagtgttgaacagtttttggggggctttttgatagcttttgctacttagtattttttttttttgaaacagagtcttgctctgttgcccaggcgggagtgcagtggcgcaatctcggctcactccaagctccgcctcccggattcacgccattctcctgcctcagcctgctgagtagctgggactacaggctcctgccaccacgcccggctaatttttttgtagttttagtgagacagggtttcatcgtgttagccaggatggtctcgatttcctgacctcatgatccgcccgcctcggcctcccaaagtgcgggattacaggtgtgagccaccgtgcccggccagctacttagtattaaagctgttagtattggagcttggaacaccacctgaataagtttattgctcattccatatgatgttttgtcacagagtgatttgccccggatcaaaacggagattgaggccttgaagaacctgagacatcagcatatatgtcaactctaccatgtgctagagacagccaacaaaatattcatggttcttgaggttagtagtatgttccagatacctgaaaacatttgatcactttatcaatagtaaaagagaaaagtacatttcacctgaaagattagaagagatgttaagcgacttacctgttttgttccatttgtaacaatttagattaaatagatgtatataataagttggagattcaatgtaaatgtcatttttctaatacacccctaatggggtagtatggtttactagatagaatatgttagaattttctcctagagggaaggactcattctagtttttttttttttttttttgagacggaatttcgctctgtcgctcaggctgaagtgcagtgatgccatctctgctcactgcaccctccacctcccgagttcacgccattctcctgcctcagcctcctgagtagctgggactacaggcgcccaccaccatgcccggctaattttttatatttttagtagagacggggtttcacgtgttagccaggatggtctcaatctcctgaccttgtgatctgccctcctcggcctcccagagtgctgggattacagacgtgagccaccgtgcccagcctcattctagttttatatggtatattaatttcctagggctgttggaacaaattactacagacttggtggcttaaagcaacagaaactcattgtctgacagttctggaggtttgaagtctgaaatcaaaatgttggcaaggctggttccttctggaggttctgagagggaatctgtttcctgcctctttgctagttgttggtagttgctggcagtccttggcactccttggtttatagatgcaccactcccatcttggcctccgtcttcaaatggtgttttcctctctgtgtagctgtgtctctgtccaaatgtctctcttcttaaaaggacccaaggtttaggcttaccctgatccagtgacagttcaacccccagcactgggtagcttccagtgtcttttatgtaaaccaagcaatttcaagttttaacttgccatttttgtcttgaaagatgtctttagaacttgtattattcaacttctttagttttcgttagtctcagccaaataatatgtaatttgcacatgattttcacaggatagcactgttttaaaagcatattttaaaaatcataattttggccgggtcctctcatgcctataatcccagcactttgggaggctgaggcgggaggatcatttgaaaccagtggtttaaaaccagcctcagtaacatagcaagaccctgtctctacatacaaaagaaaaaagaaaaaaaaaagccgggtgtgatggcgcgtggtgcgcacctgtcattccagctcctcaggaggctgaggcgggagaattgcttgagtccaggagtttgaagctgcagtgagccacgttaatggcactgtactccagcctgggtgacagaacaaacccctgtctctaaaaaataaaaacaaaaaaattataacgttgaatgttttggatctagagctattgtatagtagtacattgtattactacactgtagatctacctacatggtccacattttaaaacctctttgattttaaaacctctttggtaattttaaaacctctttatatttttaggtgatccctttgttcaaataaaattcttagggccaggcgcagggggtcacgcttgtaactgcagcactttgggaggccaaggctggtggattatttgaggccaggagttcaagactagcctgggcaacatgggaaaaccgcatttctacaaaaaatacaaaaacttagccagttgtggtggtgcatgcctatagtcccagctacctgggaggctgaggtaggaggatcacttgagcctgggaggcagagcttgcagtgagctgagatcatgccactgcactccagcctgggtgacagagcgagactctgtctcaaaaaagaaaaagaattgttaaaatctcccaagcatccatgaacctaggagaaaatttaaaaggtacaagagagtggccgggtgcagtgtctcgtgcctgtaatcccagcactttgggaggccaaggtgggaagatcacttgagctaaggagttcgggactagcttgagcaacatagtgagaccttgtttttacttaaataaaaaaagaaaaaaaggctgggtatggtggtgcacacctgtagtcccagctacttgggaggctcaggtgaggagcctgggagatataggctacagtgagctatgattgcaccactgcactccagccttggcaacagagtgagaccctgtctcaaaaaaaaaaggtacagggagtatatattaaaaaacaaaatcctctctttcccctacatcccagtcatccaatattctttaatttttaaattttattatattgttaatagaaatgggggtcttggcctgttgcccaagctggtcttggactcctggccttaagcgatcttccctccttggcctcccaaaatgttgggattacaggcgtgagcaactatgccccaccctagtcatcacatttcttttcttttttttttttttttttttgagacggagtctcacactgtcttgagtgctggagtgcaatggcgtaaccttggctcactacaacctccgcctcccgggttcaagtgattttcctgccccagcctcctgagtagctgggattgtaggcacgtgccatcacccccggttaatttttgtattttttagtagagacggagttttaccatgttggccaggctggtctcaaacttctgacctcaggcaatttgcccacttcagcctcccaaagtgctcgggattacaggagtgagccaccgcgcccggccctcaaattttcttttctctgagccattcatgtacttttcttgtgtctcttgtagatacctacatatattttatacgtatgtgtattttatatgtgtgtgtgtgtagcttacacacacatggtgtgacacaaatggtcacaaattattactttgcaccttgtttttttcccaggtaacaattgatcttagagaccatctgagcacattcagatattttagacatttttatttctctttattttgtatttctttatttgaaaatatgaagtaggctgttttctttttgtaaaacttactgtataacattaaaacatttcctattgaggtataaatttacatataataaaatgtacacattaggtatgcagtttgacaaatgtatatacccatgtacctcccaccccaaagtataaaacatctctatcacctcagaaagttttctccagcccttttgaagttttccctgtaaccatagccaccctgcccttaccagcaactgctcatctgatttctatcacagcagatcagtttaatctattctagactatgatgtaaatgactcatacagtattcttttgcttattcttttgttaggcttcttttgctcagcataatacttttgtaagccactatatcaatctatagtcttaataacttagtactggacattgtttcatatcagtttgtaaagagcttcctcttttttttttttttttttaattattgcctagaattccattccgtgtcatagtttatatagtatcagcatttaggtctgaatgctgttattccccacaaattcgtatgttgaaacttaatccccagtgtgatagtattaagaggtggggccctttaaggaggtgattaggttatgagggcagagcccttatgaatgggattagtgcctttatacaggaggctttagggagcctgtttgctcccttccaccatatgagaatacatagcacatgccaactgtgagcaacagaacctcactagacactgaatctagtggcaccttgatgttagacttcccggcctccagaaatgtgagcaatacatttctgttgtttataaattacccagcgtaaggtattttgttatagcagcccaaatggactaagacagttgtttctagtcttttgcttttacaaacactgctgctgcagtaaatgatctttaaggtacgttttttgttgttgttgttgttgttgctgttgttgtttgttttttgagacgaagtctcactttgtcacccaggctggagtgcagtggtgcaatcttggctcactgcaacctctgcctcccgggttcaagcgattctcctgcctcagtctcctgagtagctgggattacaggcgcccgccaccacgcctggctaattttttgtatttttagtagagacgggttggccaggctggtctcgaactcctgatccacccacctcggcctcccaaagtgctgggattacaggcctgagccacggcgcctggccaaagtactgttttttgatatgagtgagtacatctataagagcagtaactaaatgtggaactgtgaggtcaagtctatatgcatttgtaattttaattgatattgctaaaatggaaacccagctcacagaaaagtggagaaagttttctgtgccctgggaaagggatggaaagccttgagctttgtgctctggtacctgttctgcagcctctgagatacctctgtagacctgggctccttctggtacagattgaaaaccactggtctttgggatagagaaacaataattactgctggctttttaaatttcaggtaattacactgaatgagagtacattaagatgagaatggcttttaatactttgctataaaaatataaaaccctgggtgagctttttaaaatcacagtggtagttggttttacttctacttactggtaataaaactgttcgaagaaagagttattgttctcattcctggagtcattattgacttgtttgatcctgagagtgtacttttgaatataccttactcggttccattccctataaagtcgaattaataatatctctgagttaagtgtacttttttattttaaatttctgtgaagtgattttttaagttgtaacaatatctgtgattccattgctgttgaagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagtaagtgactgcatcacagttagatgctcaccttcagcgtcatttacctgttatttttaggtttacaaatgatctgattaggaatctatctttggtttgctttttgttgttgttgctccagtcatacctatcagatttcttttttcctcttactttttttttttttttttttggaggtggtgtctcactctgtcacccaggctatagtgcagtggtgtgatctcggctcactgcgacctccgcctcccggattcaagcagttcccctgcctcagccttctgagtagctgagattacaggcacagggcaccatgtccggctaatttttttatttttagtagagatggggtttcaccatgttggtcagtctggtcatttttttggagacggagtctcactccgtcgcccaggctggagtgcagtggcgcgatctcggctcactgcaagctccgcctcctgggttcacgccattctcctgcctcagcctcccgagtggctgggactacaggcgcctgccacaacacccggctaattttttgtattttttagtagaaacagggtttcactgtgttagccaggatggtctcaatctcctgaccttgtgatctgcccacctcggcctcccaaattgctgggattacaggtgtgatccaccgcgcccggccaggccagtctggtcttgaactcctgacctcaagctattctttcgccctggcctcccaaagtgctgggattacaggtatgagccaccgctcctggccttggtaggctttttggatgcatttatgagcattctgtgtatctgtcaattgtgtgtgactttataaatgtcttgtttttttttttttttttttaagcaagatctcactctgtcacccaggctggagtgcagtggcatgatcagggctcactgtagcctcaacctcctaggctcaagtgattttcccacctcagcctcccaagtagctgggactacaggcgtatgccaccatgcctggctaattttctgtatttttattttatatatgtatgtatgtatttatttatttttatttttatttttgagactgagccttgctctgttatccaggctgaagtgcagtggcgcaatcttggctcactgcaacctctgcctctcaggttaaggtgatcctcttgccttagcctcctgagtagctggaattacaggtgcctgccaccactctcggctaatttttgtatttttagtaggcctggggttttgccatgttggccaggctggtttcaaactcctgacttcaagtgatgcgcctgccttggccttccaaagtgctgggattacaggcgtgagccagggtacctggccggaaactatctttttccatctgtttatactgaactcgtcgatttcaactcactcttttggtttaaatttgcttttggcacaaattgtgtttgcttgtagttgactctcagaacaccaaggagaaaataggagaaaatggtttatgctagtgagtcttatggggaagtgatagagtgatcgcccaggctggagtgcagtggtgcgatctccgctcactgcaagttctgcctcccgtgttcacgccattctcctgcctcagcctcctgagtagctgggactacaggcgcctgccaccacgcccggctaattttttttgtatttttagtagagacggggtttcaccgtgttagccaggatggtcttgatctcctgacctcgtgatccacccgcctaggcctcccaaagtgctgggattacaggcgtgagccactgcgcccggccctttttgttttttttgttttttttgttttttttgtttttttttttttgagatggagtttcgctcttgttgcccaggctggagtgcaatggcactgtctcggctcaccccaacccccgcctcccgggctcaagcagttcttttgcctcaacctcccaagtagctgggattacaggtatgcgccaccatgctcagctaattttgtatttttagtagagacggggtttctccatgttggtcaggctggtctcgaactcctgacctcaggtgatgtgcctgcctcagcctcccaaagtgctgggattacaggcgtgagccattgtgcccagcccttcttttcccttatatacttcttgtcatttcgttagtttctagtcattttcagtttgttgtacccggactttttaacagaaacaaccttaaatcatttttactcattttaattaatttatttatttttaaaaagtgagaccaggtctttctgtgttgcccaggctggtcttgaacacctgggctcaaataatcctctctcatctgccttcagagtgctgggattacaggcatgagctgccacacctggccttaagtcatttttagaaatggctagaggtgggatgtgatataaggaagtcagtatacagttatcaaaatatctttgttttcccaggaaaatttgctgtttgatgaatatcataaattaaagctgattgactttggtctctgtgcaaaacccaaggtaagtgcagaaataagatgcatctatgttctttgtaaatgcatttatttcttagtgtgtgattttgtcctgacttccacttattctttattgagcttggttgcatccattgagaagaatgttaaatttcatcccaggtatgggtagtttttgtaagttctctagatgatcataacatgcaatcaagattgagagtcactgccctagttctaggattggtcctgctgaagactccatgggtatgctgtgagaatttgcagtgcagaggtgacttgaggctattacagcaagaatgctgacttgaccagtgcttgcagtttgagtatattgccactagatgatgcctttgtttgtttagataaaagttgagaatttagtgcaaatctgttatccaaatggttctataactaacaattagttacattttgagaaacaatccgctttccttttaaaagaaggaaaaagcccatatgcacttctaaatttataactgttatatatttccttaatttgcattccatggttatgtattggtgttctccagcataacttctctttgaggtgactttgaactttctggctctgctgtctgcagcagatctcctgtgtggctgcctgttggaagcttcctctggagttctctaatcatggtactcacaatctctaaaatgagctgtctacactcattaagaatgttgaaattgcagacttgtctcgggctttggtaatcccataactgtttcctgccctgatcagaattagctaggtgcaaagggaagcagattttgcccctttggcagaaagtctgattctttctgattcttctctccttcccttggctctttagaaactataagtggaaccttttttctgggaaccaaatgctagaaggcaggtttttttttttttttttgattgacaaacatataaagaaaaaacatactttgaacagataaactggtttaagttgttctccatgggaggcagtggagaaggtttgtgacagaccctgtgagccttcatttatggctgccacggattacacacatagacaccatctaaggaaagtggggttgcctgggagaggattgcctcagccttcttccaaggagcacactcctgggcatgttgtttcagttgtaaatgacatctcacaattcacaaatcctttgccagctgtaagaactctatacagctgttggactgtagctttattttcattatgtcttggtatttctgtgggagggcagaggaggatgagcagattactcattttaacagaactggaagctaagggagtgatttataactgcatctagaaaacagactttcaaggcactgttctatgtaacatattgcttttttccctctaagaaaatagagctcttctgtatttgtgaagatttcatactggagataaggtccagtaaataaatttttccccccgggatacttggggatggaaagacgtggatgcttggatatatgctgggcttatttatgtatgtgggtatttagggaagtatgaacctgatttgactgagctaaggggaaaggatttgttcatgccaggttgtagtggtgttgggaatccagagaagcagagaccacacgtgcatgcacacatgtatacagagtattgtgttggctgcagaaatcctttattatgtggggtggtttttcatctagcttctctttgcttgtgctcaaataatttttatcggccaggcgtggtggctcattgcctgtaatcccggcactttgggaggccgaggcgggtggatcacctgaagtctggagttcaagactagcccagccaacatggcaaaaccccgtctataccaaaaatacaaaaattagttgggcatggtggcacgctgcgtgcctgtaatcccagctactctggaggctgaggcaggagaatcacttgaacccaggaggcagaggttgcagtgagccgagattgcgccattgcactccagcctgggtgacagagtgagactccgtctcaaaaaaaaaaaaaaaaaaaaaaaagaatgtttatcaaggtttaattctcttaagcgttgtaattaataagtttcatttttatcttattggcagggtaacaaggattaccatctacagacatgctgtgggagtctggcttatgcagcacctgagttaatacaaggcaaatcatatcttggatcagaggtaattattcattgattaattcattatataatcagcagacatttatattggtcacctgtagtgagtcaggcactgtgcgttgggggtataatgatgaagtaagaaataatcttgttaatcagagttcagtctatttggagagtgagacatgattacttataaatgaaattaataacttgcaataaatatagtaacatatacttatgaagcagggatatttctggtgtccttgttgtggctgcttttgtattaaatagtgccatagtttggactggttagtctagctggatagaacaaaagacgaaggttccaggctcagtttcagagatgctggttagcacagagaaaacctgtgcttcgtccatccagagctgactctccaaggccagcagccctgtgtaggagtccaggctgagaaggagtgggatttgcctgatttatatttgctgtatctcaaattatcaaattagctcctctcattctctggagtactagttttgctgatgtgagtgtcataagattaaaaaaacactttagttgtgaaaagctcaggaagtgctcaaacaggtttcctatttcaggacatgtccaaatctttttttgttttgttttgttttttttttttgagacggagtctcactctgtcacccaggctggagtgcagtggcgcgatcttggctcactgcaacctccacctcctgggttcaagcgattctccttcagcctcccaagtagctgggattacaggcaactgccatcacgtttggctaatttttgtgtttttagtagagacgggtttcaccatgttggccaggctggtttcaaactcctgacctcaaatgattcacccacctcagcctcccaattataggcatgagccactgcgcccagcctccaaatctttcttttcttttggagatggagtctcactctgttgcccaggctggagtgcagtggcacaatctccgctcactacaagctctgcctcctgggttcacgccattctcctgcctcagcctcccgagtagctgggactacacgcgtccgccaccacgcctggctacttttttttgtatttttagtagagatggggtttcaccatgttagccaggatggtctcgatctgctgacctcgtgatccgcctgcctcggcctcccaaagtgctgggattacaggagtgagccaccgtgcccggctctggcctccaaatctttaatgtgctcttgtacagtgtgatccttcaggaaaggaacatcacagataacagctggttctgattttatttgcctatgggatccacttttgatggagagcatcttttggaactagcataaggaactttgggaataccaggttacttcataaaatgagaagatgggaactgtttccggtgactttttattttgatataatctctaacttacaagatagtgcaagaatagaatgaggaactttggtatatcttttactcaaattcacagttatttacatttttccttatttgctttatcattctctatgtttatatatatgcatgtttttttttgaatcatttgagagttagctagaaatatcatatccttttattactcaatatttctatatatatttttcctaaaagcaaagaccttttcttttataaccacactttagtatcaaaatttaacattgatacaatttatttaattcataattcatattcaaatggtattaattgtaccaataatgtcctttatagttttattttccccccagtctaggatatggtgcaggatgcatttagttattgcatttagttattgtgtctctttagtcccttttaatctggaagacttccttaggctttctttattttttttgatctcagcatttttgaagaagccagttatttagtagaatgtacatcaatttgaatttatttaatgtttctttatgattagattcaggttatgtatttttggcagaaataccacaaaaatgatgttgtagccttcttagtgcattataggaaagggaccaaatgttttctgaacgtttatcatagtcctggaatcatgctggatactttttatttttaattgtggtaaaatacacataacataaaatttaccatcttaactgttttaaaatgtatagtttagtagtactgaaatacaatcacattgttgtgcaaccgacctccagggctcttttaattttgcaaaactgaaactttatacctgttaaacaattcttcatttctgcctaccctattcccctggcaactacccttctgccttctgtctctatgaatttgactaatctaggaacttcatgtaaatggaatcatacaatatttgtctttttgtgactggttatttcacttagcataatgtcctcaaggttcatgcatgttgtagcatgtatcagaatttcctttctttataaggctgaataatattccattgtatgtatataccacattttgtttattcattcatccattggtagatacttaaattgcttccaccttttggcacctgtgaataatgttgataggaatatgagtgtacaagtatctctttcagatcctgctttcaattcttttgggtatatattcagaagcggagttgctggatcatattgtaattctatttttaatattttgtggaatctccatactgttttccatagtgagtgcaccatcttacattttcaccaacagtgtacaggagtttcacatgggctgggcgcggtggctcatgcctgtaatcccagcactttgggagactgaggtgggcggatcatgaggttaggagtttgagaccagcctggccaacatgatgaatccctgtctctattaaaaatataaaaattagctaggcatggtgatgcgcacctgtaatcccagctacttgggggttgaggcaggagaatcgcttgaacctgggaggcagaggttgtagtgagccgagattgtatcattgcactccagcctgggtgacagagcaagactgtctcaaaaaaaaaaaaaaaaaaaaagagtttcacatgctggatacctttaataattttcaattaagctctacagactttttttttttttttttgagatggagttttgctcttgttgaccaggctggagtgcaatggcatgatcttggctcaccgcaacctcagcctcctgggttcaagcgattctcctgcctcagcctccagagtagctgggattacaggcatgtgccaccatgcttggctaattttgtatttttagtagagacaggatttctccatgttggtcaggctggtctctaactcccgaccccaggtgatccgtctgccttggcctaccaaagtgttgggattacaggcatgagccaccacgcctggccacagacatcctttttagtgaatactgttaccctatcccataagataaagaagatgaagaaactgaggctcagaaatttggtgcctttgcagggtcacacagctggtgactgagtgagatttgagtggagtgaggtactgtttccactattccatttagtttcccagaaggagtgataatcgtatgcctgatctcacaagattcctagaggtgatgagaatctgctgatttgagtgtatctgggtttttcctatgtaattttaaattgttttcttgtccgtgttagttcaacttcctgtccttctcagagtgtctaaaggatagtggactgaggagtcatttgagatacttactaaatgatgcagagctcagggtggtaactccctcagagattttggtttcgttttctgagatggggctttaagaatcttcatttaaaatactaataaaatagttgattctgatgttcacagtcctgatcatgctttaaggacatgttccattgtaaatatctctaatttcttcagtaatttttcatgggaaatggtttcagttctctcttcctcccaattattttatcttttttttttttgagacagggtgtcactctgtctcccaggctgaagtgcagtggcatgactatggctcacggtagcctttacctcctagactcaagcagtcctcccacctcagcctcccaagtagctgggactacaggtgtgcactaccacacctggctaatttttaaaatttctttgtagagatagggtcttgctatgtttctggggctggtcttgaactcctgggcctaagtgatcctcccgccttggcctcccaaagtgctgggagccagttattttttcatgtcaactggtagtttatggatttacttgcatttgctttggtttttttatgattttagttaatttattctcatattcaattcaaaacagcgaagtaaaggtactttcagttaactgaaaaatgctttttctgctttcttttttctaataagtgttggtagcactatggggatgttattatcattttatccctctttaagtttaaccctagacataatctttctgttgacttcttgtgtgtttttttgtttgtttgtttgttttttgagacggagtttcgctcttgttgcccaggctggagtgcaatggtgtgatcttggctcactgcaacctctgcctcccgagttcaagcgattctcctgcctcagcctcccgaattgctggaattacaggcatgtaccaccctgcctggcaaattttgtatttttagtagagacggggtttctccatgttggtcaggctggtcttgaactcccaacctcaggtgatctgcccacctcggcttcccaaagtgttaggattatgggtgtaagccaccgcgcccgggctttttttttttttttttttttttttttgagacaaagtctcgctcttgtcccccaggctggagtgcgatggtgcaatctcggctcactgcaacctctgcctcccgggttcaggcgattctcattgggttcaggcgattctcattcctcagccttccaagtagcttggattacaggcacatgccaccatgccctgctaatttttatatttttagtagagacagggtttgactcaaccctggtgggattgagtgggagtggaaggactgcttgagtccaacaggaccatattggccaggctggtctcgaactcctgacctcagctgatccgcccaccttggcctcccaaagtgctgggattacaggcgtgagccaccatgcctgacccttttttttgagacagggtctcactctgtcactcaggctggagtgcaatggcgtgatcttggctcactgcaacctccacctcccgagttcaagcgattctcctgcctcagcctcccgaattgctggaattataggcatgtaccacgccgcctggcaaattttgtatttttagtagagacggggtttctccatgttggtcaggctggtcttgaactcccaacctcaggtgatctgcccgccttggcttcctaaagtgttaggattatgggtgtgagccactgcgcccagccattatttatttatttatttttttgagacgaagtcttgctcttgtcccccaggctggagtgcaatggcctcctgagtagctggaattacagacatgcaccaccacacctggctaatttttttatctttttagtagagacagggtttcaccatgttggccctgctggtcttgaactccctacttcaggtgatctgcctaccttgcttcccaaagtgtggattacaggcatgaaccaccatgtagttcactctttcctgtgcaacctctttgctttgaattttttttgagatggagtctcgctctgttgcccaggctggagtgccatggtgtgatctcagctcacttcaacctctacctcccgggttcaagcaattctcctgcctcagcctcccatgtagctggtatcacaggtgtccactaccacacccggccaaattttgtatttttagtagagatggagttttaccatgttgaccaggctggtcttgaactcctgacctcaggtgggaggtggctggttttggcctcccaaagtgctgggattataggtgtgagccactgcacctgatctgctttgaatttaataccatgaatgagtgtcataccatcatgtctcaatttatagattaaatatttgacatctcggaggcgtaaatggtcaatttctgacctcctgcaacttggaagagtaatcaagtgtttgcttcaaagcaaattgttcacttgagacgtcatagtagagtcctaataatttgatatgatttggtagacaggactaggggttagatttggcttatctagtataagtactacccagatatgtgatgctgctcaagttattttaactgttttctctttcttttctttctttgttttcttccttcctttccttctttcctctttttctttttttgctcttaaaacttgcctaagcctgggaggcaaatgttgcagtgagctgagattgtgccactgcaccccagcctaggcaacagagtgagaccctgtctctaaaaaaaaaaaaaaaaaatttcctaaggctcaaatgagagtaagagctgtgacttctcctcagctaatggtggcatcattactgactaaggccaaatactgcttgaacaaatagttactgcttaggactcatgggacacatggatatcacatataaaggttaagctcttttctgggattttgagatttgtaggactatttgtgctggtaggctaatttctagtgtctctctctctctctatgtatatatacatatatatttgaggtttgtaggactatttgtgctggtaggctaatttctagtctatatgtatatataatatatacatatgtataggtgtgtatataatatatacatatgtataggtgtgtatataatatatacatatgtataggtgtgtatataatatatacatatgtataggtgtgtatataatatatacatatgtataggtgtgtgtatatatatacatatgtataggtgtgtatataatatatacatatgtataggtgtgtatatatatacatatgtataggtgtgtatataataaatacatatgtataggtgtgtatataatatataatatatacatatgtataggtgtgtatataatatataatatatacatatgtataggtgtgtatataatatatacatatgtataggtgtatatatggacatatatgtatatatggacacatatgtatatgtatatatggacatatatatgtatacatgtatgcatatatgtatatatggacatgcatgcatatatatgtacatatatacatatataatatatataataaataatctatataatatatataaataaatgatatatatttttagatggagtttcactgtgtcgcccaggctggagtacagtggcgtgatctcggctcactgcaacctccgactcttggattcaagcgattctcctgcctcagccttccgagtagctgggactgtgggcatgcgccaccatgcccggctaatttttgtagttttaggagagacggggtttcaccatgttggccaggctagtctcaaactcctgacctcaggtgatccacccgtcttggcctcccaaagtgctgggattacaggcatgagccaccaggcccggccacctctacatttgaaaagtcaatcattgaactttattaaagttctctacatagaattttatagtacaacttagtcatacttgctgattatcaataaattttaagacatcctcatgcctgtttacataatcttcatatgtaacctaaaccttcagtagcactgtagaattgtctcatcttcttatcatgtccaatccagcccagcctactggaaattattttctgttaagtgttagagtccagctggaggagagtgcattaaattggaagtcaggaggtcttcctgggtggcctccaattgactgggtgactttaggcaagcctccttagcttcaggttctctgactatagaataagcaggttgaaatggttgatatctgagttcttttttagctttgcgacaattctgtgattggatcaagagtcctaccattctgaaatatgtttgaatttttgtttcagtaatttttctttttccctctttctctcaggcagatgtttggagcatgggcatactgttatatgttcttatgtgtggatttctaccatttgatgatgataatgtaatggctttatacaagaagattatggtgagtattacaaggcatagaatttcaatgtagaacttttctataccgaatagtatatgctttcattcataaatgtacaaaaacaggcataaaagttattctctgctgttagaagtcaaaatcttagttattctttgggagtggttaaggagtgggcttctgttctgtttcttaatctgggagttggctacacttgtatacagtagtttccccttgtcagcagttttgctttctgcggtcttagttgcccatggtcaactgcggtctgaaaattggtgagtttgtgtaatacagtaagatattttgagagaaagaggcacattcaggccgggcgcggtggctcacgcctgtaatcccagcactttgggaggctgagactggcagatcacgaggtcaggagatcgagaccatcctggctaacgtggtgaaaccccgtctctactaaaaatacaaaaaattagccgggcatggtggcgggtgcctgtagtcccagctactcgggaggctgaggcaggagaatggggtgaacccaggaggtggagcttgcagagccgagattacgccactgcactccagcctgggcgacagagcaagactctgtctcaaaaaaaaaaaaaaaaaaaaaaaaaaggcacattcacataacatttttaacagtatattgttataattattctattttattatgttattgttaatctcttattctgcctaatgtataaattaaactttatcaaacttgtgtatatatatatatatatggaaagaaacatagcacatatagggttcattgctatccgtggtttccggcatccatgggtgtcttggaaagtattacctgctgataagggggactacagcattcagtttttgaaaactcattgaggtgtactcttacgttatacaaacttcttttttttttttggagatggagttttgctcttgttgcccaggctagagtgcaatggtgcgatcttggctcaccgcaacctctgcttcccaggttcaagcgattctcctgtctcagcctccctagtagctgggattacaggcatgtgccaccacgcccggctaattttttgtatttttagtagagtcggggtttctccatgttggtcaggctggtctcgaactcccgacctcaggtgatttgcctgcctcggcctcccaaagtgctgggattacaggcatgagccaccgcacccggcccaatatataaacttctatacatatacttcttcaatgaaaagcttaacaaaataaaaacagaatgctgtgtcaaatcacattttccttttgacttataaaataagaacctcctcttttctttttttggaagataaaattttggcttcaggttataataaaaccacaattgagatcacctactgtaagctttgttaaaatcctatatatcagagacagagagtagataagttgttgcttggggttaggggtggagagtgactgcctgtgagtatgggttttctttttgggatgatgaaaacattctggaattagaaagaggtgatgattacacaactttgtgaatatactaaaatctacactttaaaagggtaaatattatggtatgtgaattatgttcagttaaaaaatcaaaaaaatcacaggaaggaaaataggaaaattatttcaaagcaaactaacaaaagaagacatgtaaagaggaagaaagaacatcttgtgttccatagcaaactgaggtcagactagcagagcagcatctctgaatgcttcactctctttcttcttcttttttttttttttttttgagataaggtcttgctgtgtcacccaggctgaagtgcaggagtgcgatcatggctcactgtagccttgaccctctgggctcaagtggtcctcccacctcaacctccccactagctgggaccacaggcactgcaccactacatccggctaattaaaaaaatttttttgtagagataggatcttccctatgttacccaggctggtctcaaactcctgtgctcaagtgatcctcccacctcagccttgcaaagtgctgagattacaggtgtgagctactgtgcctggccttctgaatgcttcttgaatccaattctgtttaacaaatatttcctgaatttctgctttatataagatgctgaaaggcatagaaaagatctatgaaactttattattgtccaccagggcctgatctcttgttggagacaggtataagctatctaaaaacggcaaagggtgaggaatgccatattataacagagtgtaaatgaaattaatacaggagttggggtggctctgggagggcatcttagaggaagtgaggtttgagcaggtctttaaaagaagggtggaagtgtttcagaaagggatgtgggcaagagcattcctgatagtacaggtagcatgagcaaaggcatagaagtgggagagacgtggggaggaatgggcagttttttgtagctggaccattggatctctaacaattagatgaggagactacctaaagcaactctcacttctaggaagtagcatacagtgttgaaagtggtagacccagttggcttgttgcccactccatagaacaccaagtctaaggacactgagttcaatcttcaacttttatttgacttatagtttttcctatatcccaccttggaagattctttaaagttgattcccaagcttcagagaatagctttggaaagagatggaattgcaatagttccaactccttgaagactgaggagctctgattctgcaggatcaaaaagaagcagtgtgagcggtagctattaacaccgctttggggacccatgtgtgtccaggcttctccttgtgaaggggagataaatgaggcagtgggctggaggccggcctcctagagcctgctgctgtagccaagacagcttgttttcctcctgtcacttcttgagctttcttgaactttgctgggtagcactcgttgctttggcttctgcatgctgactgtggcagcagttcctgactccatagagccatacctgactgcatccacatcaggatacaggggagagtagggttaggatctttttgtggctttagctccagtcaacagaagtggtctttgggcagctcagtaacatttatccagttatacttttacaaaatattaggttggcctcttgaattcttccctctttttgctacttttttctgtaaagtagggctgtgttttttattctgaaataattgtattctagtataggttgagtatccctaatctgaaaatccaaaatttgaaatgctccaaaatttgacactttttgagtgctgagttgatgctcaaaggaaatgcttactggagcatttcaggttttggattttcggatttggcatattcagtcagtaagcgtataatgcacatattccaaagcctgaaatctgaaacacttctgttcccaagcatttgggtaagggatactcggcttgtattataagctgctaggatattttaccctattcttgttttgggaactccatcccaaagaaataagctgacagatttctccaaagtgaactagaattgaatctgctagctggtgtaacacggaatattacacctcctagacttctagaaagactgtggaaacagataatggtagaatttcactgttggaaagcacctgggaaatcatgttttctgacccttgttgcttgttttatatttaatcctcactaaaatgtctcctgccttggctatgtccatgtactctctctcagggtggggaaagttagctaatggatttaattcttcctaaccatagttgcacattagaattgcttggggtgctttaaagagtattggttccacccccagagcaattaaatcagaatatcattgaggtttttgaaattcagaagcttcagaatctctactttctatctgtggactttggtaaattatttagcctctctgtgtcttagtttctttgtctgtaaaaatggatgaaataacacggcatagggttgttgtgaagattaaatgagttaatccatgaaaagcatttagagtggtgctcaataaatgtagctattattattattattattattattattattattattttgagatggcgtctcgtgctgttgcccaggctagagtgcagtggttagattcggctcactgcaccctccacctcccaggttcaagcaattcttctgcctcagccttccaagtagctgggactacaggtgggcaccactatgcctggctaatttttgtacttttagtagagacggggtttcaccatattggtcaggctggtcttgaactcctcacctcgtgatctgcgctcctctgcctcccaaagtgctgggattataggtgtgagccactgtgcctggctgctattattgttttatttttgtttgtttgttttgtttttttctgtgacagagtctcgctctgtcacccaggctggagtgcaatggcgcgatcttagctcattgcaacctccgcctcctcagttcaagcgattctcttgcctcagcctcctgagtagctgggattacaatcatgcgccaccgtgcctggctaatttttgtagttttagtagggaaggggttttgccatgttggccaagctggtctcgaactcctgacctcaagtgatccaccaccttggccttccaaaatgctgggattacaggcatgagccaccacatctggcaattatttttgagacaaagccttgctctgttgcccaggctggagtgcagtggcgccatcttggctcactgcaagctctgcctcctgggttcaagcaattctcctgcctcagcctcccaagtagctgggattacaggcgagtgccaccaagctcagctaattttgtatgtttagtagagatgaggtttcaccatgttggccaggctggtctcgaactgacctcaagtgatcctcctgccttggcctcccaaagaggctgggattacatgcatttctaaatgagatttgccagtattttgtccaggacttaaaattggctcaaaaattaatgtgtacttttttgggaactatctttgtatgtttggttttggtttcatgatttgtattagccccataaagttacattggggagtattctttcttttacttttcttggggagagcttgacaatttttttgtggatgttttgtagaatgtgcttggaagttcaactccacctgtgccttctttatggaaagatttttaactaacatataacatttaactaacatagatcataacatttcatttgaagctctctagtggcctctttctcatctcgagtacaagccagtgtttgccctgtgtgctgtgggttttcccccgtgtaatgtggcctcccatcacctcactgccctcatggtctactccctgcctcacttgtgccacccacattgtcctccttgttgtttcttttttccccttttcctggaacacgctaaggtgtgcctgcctcagggcatttgtacttaccctttcacctgaaatggttttctcccggagagatgctttgttccctcccttctttcaggtctctgttcaaatgttctctaatcagaaagacaaccacttgtttatgtgttcatttgtttgttcatttactcatttattcgatgtcatttcaccttagggaggagtaaaatagttaccaaacacctaatatgtgccaggcacttttctagatgtgtggggtatatctgtgaataaaacagatgaaagatccctgtcctcgtggagtttatcttctagtagtggggatgtagagaaagacaataagcataacaagtaaattttactaaaagatgatatgtactttggaaaagagaaaaaaattgagtaggatgaagaggaatcaggagtacagatgggggagttgtggaggaaagggccagtaggttgcatgattaaataaggtggtcaggataaacttcatggaggcgagatgtaaggagacttgagggatgtgagagtgtcaagtggatatctaggagaaaaatatttccggcagagggaacagctagagcaaagactgggaggtaggaacatgcctggtgttgtcaagggagggtgagagggccagtgcagcctgagtttagcaagtgaggagggcagtaggaaaggaaaccttgggaacaggagtcaagctgctttgggctgggtaggctctcataaggactttggcattttttctacgtgaaatggggagccattggaggcttttgaggacatgatttggtttagtttttaacaggatcacactggctgctatgtggagatgactgtaggaagtgaagagaaccagggcatctggtcaggaggatattgtaatgattcagataagagatggtggcagtggaggtggtaaaaagtgggtagatactagatgtctttttttttttttttgagacagagtctcgccctgtcgtccaggctggagtgcagtggtgcgtcttggctcactgcaacctccgcctcctgggttcaagtgattctcctgcctcaccctcctgagtagctaggattataggtccttgccaccatgcgtggctaagttttgtagttttagtagagatggggtttcgccatgttggccatgttggtcttgaactcctgactcaggtgattcacctgcctcggcctcccaaggtgctgggattacaggtgtgagccactgcttctggcctggatgtcttttttaaaaaattatttttgggttttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtcttctactttctacacagacacagcaaccatccgatttctcaatcttttccccacctttcccgcctttctattccacaaagcccccattgtcatcctggcccgttctcaatgagctgttgggcacacctcccagacggggtggtggccgggcagaggggctcctcacttcccagtaggggcggccgggcagaggcgcccctcacctcccggacggggcagctggccgggcgggggggctgaccccccccccacctccctcccggacggggcggctggccgggcagaggggctcctcacttcccagtaggggcggccgggcagaggcgcccctcacctcccggacggggcggctggccgggcggggggctgacccccccacctccctcccagacggcacggctggccaggcggggggctgacccccccacctccctcccagacggcacggctggccaggcggggggctgatccccccacctccctcccggatggggcggctggccgggcggggggctgacccccccacctccctcccggtcggcacggctggccgggcggggggctgacccccccacctccctcccggacggcacggctggccaggcggggggctgacccccccacctccctcccggatggggcggctggcctggcgggggctgacccccccccacctccctcccggacggggtggctgccgggcggagacgctcctcacttcccagatggggtggctgctgggcggagaggctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagaggcgctccccacatctcagacgatgggcggctgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcagccaggcagagacactcctcacttcccagacggggtggcggccaggcagaggctgcaatctcggcactttgggaggccaaggcaggcggctgctccttgccctcgggccccgcggggcccgtccgctcctccagccgctgcttcccgggcggcgctcgccggcgcggtggcaaagaaaaaaattatttttgtattaacaaaattaaaagtaaaagtagacctgtatatacaaagggtaaagtaaaattgaccctttgtatatacagtaaaattgaccctttgtatatacaggtctatgaattctaacacatatatagattcatataaccattgccacagtcagaatgtagaacagtctggatgtcttttgaaggcatagctaacatgatttgtgcatggattggatgaggggagtaacccgagtagctagaaagttggaaaattattaaaggtatctagcatgtcaaactcttttttttttttttttttttaaggcagagccttactttgtcacccaggctggagtgcagtagtgtgatctcggctcactgcaacctctacctcccaggttcaagcgattcttctgcctcagcctcctgaatagctgggattacaggctcccaccaccgcgcctagctaatttttgtagttttagcagagatggggtttcaccatgttggacaggcttgtctcgaactcctgaccttaggtgatcagcctgcctcagcctcccaagtgttgggattacaggcgtgagccaccgcgcctggccataaaacctgttttcttagaggcaatcattgctatcacgtttatcagatttttacgtatttttttcagacattagcctgcatatgtaaggaattttatatttatatattttctctttctgctacccccttcccagttttttttttttttttttttacacagatggtagcataccataaacactgttctgcactttgttttcctcccttagcagtgtgtcttggaaatcatagcacttcatacccacctcagagcctcttcattctttttatgactgcatagaattgcattgtatgcatgtaccataatttatttaaccagtcctaggttaatggacatttaagtaatttccaagtagtcatttgtacattgtgaatataataaatctgtaagaaaatttctagaacagttggtgggtcaaagatatgtgaattagtaattttgatagatattgccaaattgcttcccagtaaagtcctattggtttatgcaactaccaacagtagcataataatgccagtttctccatacccccccaccaatacagtgtatcactgtttttgattgttatgtttaagacttatttttgctgtgcaggaatttttagtttttatttagtgaaattcatcaatctttttctttttttctttctttttttttttagagacagggtcttgctctgtcacccaggctggagtgcagtggtgcagtcatagttcattgcaacctcaatttcctgggctcaagtgatcctccagcctcagcctcctgagtagctggaactacaggcgtgcgctaccacacttggctaatattttttgtagagataaggtcttgctatattgctgaggcttgtctctggcctcaagtgatcctcccaccttggcctctcaaaatgttgggattataggcatgagccactgtgcccagcctgtcaattttttattgtcatatttggaagggctttttgactttattttttaaaatatctgtgttttcttctagtgtttttatggtttcactttttaaaaatgtttaaatgtttgattcatctagaatttgctttagtatgttttcttgactttaaacatcataaaaaaaactgtagagatttgctttcacattctggattctggattttaaagatctaattgtagaccaggtgtggtggctcgtgcctgtagtcccagcactttggggggctgagttagggacatggcttgaggccagaagtttgagaccagcctgggcaacatcgtgagactccgtctctacaaaaaataaaaaaaaaattagctgggcatggtggcatttgtctttagtcctagctactcaggagactgaggtgggaggattgcttgagcctaggagttcaacgctgcagtgagctatgattgcaccattgcattccagcccaggccatagactccatgtctttaaaaaaaaaaaaagggcccagtggctcacttctgtaatcccagcactttgggaagctgaggtgggcagatcacttgaggccaggagtagcctggccaacatggtgaaaccccatctctactaaaaatacaagaattttctggtcgtggtggtgcatgcctgtaatcccagctactttggaggctgaggcatgagaatcatttgaacctgggaggcagaggttgcagtgagctgagattgcgccactgcactccagcctgggtgacagacagaggctcctcaaaaaaaaaaaaaaaagaaaaagaaaattgaatcatgatgtcaacgtagccatatatacttaagatttgaggttcatttttaacaatagtgtatataagtccttatttaaaatagtcttgctaatttcaagttttgcagacaacttgttaaatctaattaggtatttttttaactttgtgttttggttgatatcctaaaagtagaagtgtcagctccattactgtttgcttgtattcatagtcttcaatctgtggtttctttgcaagagttttgagccacttgtctattcaatgaggatttagcttcattaaaccgtatactataatctgtaaatccatgtaactgtgctcctgtaaagcactgctttgcaataccattctttcttaagagtgtctcatagtgtaggttatatagggactagtgagcgtactagtgccgatccatgtactaaatattaacaaagctcaatttcttatttattagatagatagaaaattaatataaatctttgaagaccgccagtcaagaatgagtgaatggtcaactctaagtatttttttttttttttttgagacggagtcttgctctgttgtccaggctggagtgcagtggcacgatctcagctcactgcaacctccgcctcccaggttcaagcaattctcctgcctcagcctcccaagtagctgggattacaggcgtgtaccactacacctggctaatttttgtatttttagtagagacagtgtttcaccatgttggtcaggctggtcttgaactcctgacctcaaatgattcacctgcctcagcctctcaaaagtgctgagattacaggcatgagccactgtgctggcctaactctacgtattctttaggcagtcccttgataagtataatacctctcagccaggttattgagtgtcagtcaattagggattattctacctggaaattacttgaagttatgggtattctgtgatgctgaataagaacaagaggggccatgagtataactggggctaggattggcattcttctgtaaacattgagccttctaaccatacttacttcttggttatgagatactatgccataaaggataactagagtcattttatccagctaaaattttgcatattcaccttgaccataaaaagtctcaataaagatgtatgatgtgtaaaacaaaatgaggtattatgtagatttaaaaaaaaatggaatgataaagttttcagtgagttttgaaccccccaaaaatatgtagagagtgggggagatgccttctgcaggccaggtctaagtgtctgtaggtgtccagaaatggagttctgtgtttgagttgtgctgaatgaaatctcttctgtctagagcatctgcagcagtcttttggtggtttaattctttctgcttttttctctacttccttgtttcccccctccaaatggatagagctttctgaagtgtgtgtgttgcatatctttgtggctattgcacatggttgatcagaaaaaataaaatgtttgctggcgtgcatattctcatccttttgtcacaaaagtaatacttaacatgcatgagttttgttacttaccaggctgtgctctaaatgaggtggttgctattattgtcttcctcttacagatgaagaaatgaagggacagagaccttaaataacttattcagggtcttatagctagtgagtagcagagctgggatttgaaccctagcagtcaagctggcagcccattcttataaccacaatgaaatattgtttctcagctctgtagttgctagtcacctaagaatcacagatgcctagaggaagaaggatcccctcccaagcatctttttatgcttattaatttgggaaatttcccagacatcccatcttttctgatttactaaggctacaagttagttctcccaattcatttaggtattactgtgcataggctttcccacgcattttaggtgtcaccccgcaaggatacttactggtccttgtttccttcatcagcagcattagagcattgcagtaatcagttattttcaagatccattccagctctgagtagctataagttctttgacttctgtttcttcacattcaatttttcttgtttcagcctagcattctcttcctttttttttttttttttttgagatggagtctcgctctgtctcccaggctggagtgcagtggcgtgattattggctcactgcaacctctgcctcctgggttcaagcgattctcctgcctcagcctccagagtagctgggactacaggtgctcaccaccacacccagctaatttttgtatttttagtagagacggggtttcaccatattggccaggctggtctcgaactcctgaccttgtgatccgcctgccttggcctcctaaagtgctgggattacagccatgagccaccgcacccagctgcattcccttcttttgagattttgaatcttgattctgcactcatgtagtaacagctgtccctgccagcattgcacctgccaacatttgcacatttcttaaatatccctaaactaagttgttcattaaaaaactgaatagaggctgggcgcagtggctcacgcctgcaatcccagcactttgggagactgaggtgggcgaatcacgaggtcaggagctcgaaatcagcctggccaacacggtgaaaccccatctctactaaaaatacaaaaaaatttagccgggcatagtggtgcatgcctgtaatcctaggtactcaggaggctgaagcaggagaattgcttgaacctgggaggcggaggttgccatgaggtgagatcacgcctctgccctccagtctgaatgacagagtgagactctgtctcagggaaaaaaaaaaaaaaaaaaaaaaaaaaaaaaaaaaaaaaaaaacttgagtagaacagaaccactccctaagtgttccgagtattggtttttagttttattctgtttcagctatgcttaactaagattttgtagacttacccacaaagataagtaactgttattttacttacctaccacacccagctaattttcgttattatacttcttttagaccaagaaactaaagcacagcaaggttaaatagcttgtataaggtcacacagctagtaagaggtagatcctggatttgaacctagccaatttgttttcagagcctttcttaggaaacagggccagagagactgaataccttaccctgttaataccttactgaaatggaactattcatggtgatcctaatttattgacttaactctaacctttgctatatttttacctgtctggaccttaatcctctatgctgtttatttgtcttcatttgttgttactgcaagttcacattcatatggcagccatggaattcatactattatcagtatattgtttcatcaataaaaggtgaatgtaccaacatacaaacttcagtgttttctacttttatttatttgaatgcactagtagatcctagattaatcctttgagggagagagcttaccttaaaataataaaaaagtatatcctaatagtatatgtgagattcaagttctgatatttttgaaaaatcaaatatctttgcagtggaatgaatatggtagaaaatgtctaattcttgttcagtggagatttggccttcctaattaatagtatttactaatacttgtatattctttgtttctcctactctgaatttcattttttagtttttcatgtatttgcaagttgaaaattgattcaaattaggacttttatgcattattgtggaatttaatttcacacattatagattttgaaatttattgtaatcttggctcagaactattgttccgagtcgcagtgtaatacagtctgctggttgaatctaattaaggtgtcgtatcacttgcatgcagtatgtatctttgcctagaatgttctaaaattcctcacttgggaataacactttcctcagttcttggtttgattgaaaaacccagcaatatttgacgcaccgtatgtaactcttgtttaaaaggcagacttcgtttatcttttgcatttgttgactattttaaccaaaatgctcaactgcactttctagcatgattactaatggcttgagtattaatcttattaatgttacctatattcatttgtcatcactgcattcaaagacaagcacgagtgtactccagctgtggtatacaaatattagggaagtataaataatttagcaattgaaaattgagtagtttgaaaataaaattgctgcctaacaattacaatttataattttaaggaaaatgagcaagttgtctctttatgaaattatatttttacaattacggagtttactacagcattatgattatgtattggtgagatggcctgcctctcttagaacagtgtgaaaaacaatttcaagccactggaattcccaggattattttgcttagtccatagatcttttctccctctcttcacttggattctcccactgttatctgtttcttgctctcctttgcaagttaattgtcccttaaataaacaaacacaaattctttaaagaatagcagaaacaagggtcctatctctgaccattttttgctctgtaacagtgtttctcaacattaacactattggcatttggaccacataattctttgttgtaggggactgtcatgcattgtaggatgtttagcagcatccattacctttacccactaattgctaggggtaatctccaagtagtgacaattcagaatgtttccatacactaccagatgtccccttgtaggacaaatcatccccagttgagcaccagtgccctacaatattgaacaagtacttaatctccctggctgacagttggtttctccatttgtataatgtggttaatagtccctgcctactacagagggtaaaatatatgtacaagtgttttgcgcattttaaagcacggtgtacaaataagagatttggttaagcctggcagcagagctcatttttggactctattttggccagtatttcagcacagagaatgaagttgagaatgtcaggacatggtaatgagtcacaggccttatgacccacttgtggatgatactctacagaggtgttctgcccaaataggggaattggatggggacattgcaggaggtgatgtgaacagggcttgcctagacgatgtgtaccttaccagacaatcctgagattctgagatagctgcagtggggcagtgctccattgggaaggcctatgacattcctcagaatgcctttagcctttcttgctgcactgagtatttagcacttttggatacaaggcttttggccaatgtgtccatctctggccctcaaaaaaggaatactactttttgaatattcctatctcctgtttatttcagattcaatacatatttattgtctcttacatgcaaggcagtatgccgagtgctttcacatatattctgttggtttataatcctgtaagtggcattagttgtatcgcagataataataatggtagtaatagtatcagcagcagcagtcgaagctaacatttatcaagctcttactgtgtccatggtactgtgctaaatgctttatgtatactaaatcattgaaccctagcaaaatttctatgcagtaggtatcgttattatacttcttttttttttttttttttgagatggagtctcgctctgtcgcccaggctggagtgcagtggcgtgatctcggctcactgtaacctccaccttccgggttcaagtgattcttctgccttagcctcccaagtagctgagactacaggcacgtgccaccacacccagctaatttttgttgttatacttctttttttagatgaagaaagtaaagcacagcaaggctaaatagcttgtataaggtcatacagctagtaagaggtagatcctggatttgaacctagccaatttgttttcagagcctttcttaggaaacagggccagagagattgaataactcttacaagcccatggagccagtaagaggcggaactgggattcaaatataatatatgactccaatccattcctgttccaatgtgccaaacaccacacttctcattcacttgttttctctgcttctttctggataggattgcttccatggtgccagcttatagcaaagcacaggggaatctattaaaagatactttaagaattcaaaataggttgataaaaaggggtgataaaaaggcaaagaggaatttggaatcagtatggtagagctctctttatttagtactttggtctgagtatttatttttacatttggtttctgtggagtactcctacttttagttaagagtacttttcagaattgaaaggcataatgtctcctattatgatagtttcagaatttaaaggcataatgtcttttttattatgatagatctggttatgggcctgttatttgtgtgttggagcagaccagaaagggctgaaacctggaatcagacttgtccttgaggtggacagatgctggtatgggggaggtgatgtgaagcagctaaaccctcatagatagtgtatgagtttcctagggttgttgtaacaaaatactggagagtgatgggttaaaacaacagaaatccattcttgtgcagttggagggatactgttcaacccagtacagatagtgtccagagagtaagcagcaaacggctttgcaaacagcagagggaagaccacccagagtacagggaatgaagctgatagaggacactctaggagcaggctgtgatcagagactcaggcagctcacggccttttgatcagcacataggaagctctttgttccaagctgatctccactctctatgggaccctggcaagagcaagctgaaatatttgagaccgggcaaataagcagtttgccaagaaagagaacaaggcaagtcctcaggactgggatcacgaaaagcctgggtctcaggaataaagtaaagctcagatacgagagtggggccaagtaggtcagggccagtcatgcagcaactgtgactcactactgctgagtcccagagagttggctagagcatctaaaacccctccttcccagggataggcatggagcccaggcagcagtgagccttcagattggggtccagttggctgtagatgaagcgtggtaggggagaaataaattcaaggcttcattgctgtagttcaaaaacaaactttgagccagctaggtggctcatgcctgtaattccagcactttgggaggctgaggcgggtggatcacctgaggccaggagttcaagaccagcctggccaacatgatgagaccctgtctctactaaaaatgcaaaaattagccagtcatggtggtgcatgtctgtaatcccagctactcagtaggctgaggcagaagaatggcttgaaccctggaggcagaggttgcagtgagcgaagattgtgccgtgagacttcatctcaaaaaaaaaaagaaaaaattatgaagggttacattcatcgcagaattgtttatgatataattaggaattggtctatgacaaactccagagggcctccaaaatgaatgaaagacaaaatgcactgaataagggttctaggttagaaatataagtgcaagtgtggcaggccaggtctcactaatgcaggcctccattacaactgtcccagcactgactgagtggctaggttatacactaaaagctgattgagccagtgcccttataccaaggctggaatgtaacaaagagcccaccaagagttttgcctaggcttttccagggccttgaagcatgacaagataacgaaggaattcttctcaggacccttttaggatgaaacaaattttttgggggtctgaagaaagcacaaacaatttctttggagtctaaaggaactccccaaacctttatgatttagcaggatacaagataagggtaatcaccctagcacctagacccatttagattaagtaaacttactgaggctccagaaggtcttcgggactcagaccttagttatagcttaaaagaagttagtcacttacgtttttagataaatgcacacttacacgtagacatatagcttagaaggtgtataggctctggagaactttgtaattttgagttggtctggtgataatttccaggccttttccctgtggctggttacagaaataaaaactcttcctccccagttcatctatatcttgttattgggcctcaagaaatagcagcccaagaggccgggcatggtggctcacggctgtaatcccagcactttgggaggctgaggcgggcggatcacctgaggtcagtagttcgagatcagcctgaccaacatggtgaaaccctatctctactaaaaatacaaaaaattagctgggggtggtggcaggcacccgtaatcccagctactctgcaggctgaggcaggagaattgcttgaacccgggaggcagaggctgcagtgagccaagatcactcattgcattccagcctgggcaacaagagtgaaactccatctcaagaagaaaaaaaaaaaaaaaaagaaaagaagtagcagcctgaccctcagtttagtctgggaacacaaagaagacaaggacaagcacaagcgcaaacacacacacacacacacacacacacacacacacacgccaactgtaaatgaatgcggctagaaggatggaggcagataggtgaggaagccattgacttgtaccagcattggggttctctgttcttatgaactgtctaggatataattcttacagaatcagtccaccttaaaggtgaagtggaaaacagacaggtatggatcactcagagtcctaagatgttatggcaggctggctttcaattatgttaaagaagtaatgaaagtcccagagaagcattgtcaaacaatgaatctaaaaagaaagggtcaaaaatcagcctctctgatgagagtagatggactgacctacaagtgtttcctaggaagaacagtagctttcattttacaaatgacttttaatattattacatttttattccctttatcgaaagcactcagtattacccagagaacccattctctctctctctctttttttttttttttttggagacaagagttttgctcttgttgcccaggctggagtgcaatggcgcgatctcggctcactgcaacctctgcctctctggttccagtgattctcctgcctcagcctcctgagtagctgggaattataagtgcccgccaccacacctggctaattttgtatttttagtagagacggggtttctccacattggtcaggctggtctcaaacttccgacctcaggtgatccgcccatctcagcctcccaaagtgctgggattacaggcgtgagccactgtgcccagcctgagagcccattcttatttatcccttgccagggcaccttaacacttgccagagacagaaactgacaaagtcttttttgtttgttttgtttttgagacggagtttcactcttgttgcccaggctggagtactatggcacaatcttggctcactgcaacctccacctcccgggttcaagtgatttttctgcctcagcctcctgagtaggtgggattacagacatgcgccaccacgcctggctaatattttgtatttagtagagacggggtttcaccatgttggtcaggctggtctcaaactcctgacctcggccttccaaagtgctgggattacaggcatgagccactgtgcctggctcagagtttgtttttgaattgtagcaatgaagccttgaatttatttctccctaccaagcctcatgtatggccaactggaccccaacctgaaggctcactgctgcctgggctccatgcctatccctgggaaggaggggttttagatactctagccagctctctgggagtcagcagtagtcagtgacagttgcctgtgacctttggaaaaggctttttctcaatttgttgttaactttgttaatgaattttttttttttgagacggaatcttgctgtattggcaggctggagtgcagtggcgtaatctcagctcactgcgacctccacctcccggattcaagcaattctcctgcctcagcctcccgagtagctgggactacaggtgcgtgccaccacgcccggctaatttttgtatttttagtagagacggggtttcaccatgttggccaggatggtcttgatctcttgacctcgtgatccacctgcctcagcctcccaaagtgctgggattacaggcgtgagccaccacatccggccaatgatgttttgttatacagaaatatcaaacgttaattttgtcatatattactctttatagttgttggctttgctgtcatgtctagaaagattctaaaaataatcactcatactttctttaagtactcttatggttttgtattttcttttttttttttttttttgagacggagtctcgttctgtcgcccaggctagagtgctgcagtgacacgatctgggctcaccgcaacctccgcctcctgagttcaagcagttctcctgcctcagcctccctagtaggtgggactacaggtgcccgccaccatgcccagctaatttttgtatttttagtagaaacaaggtttccctgtgtcagccaggatggtcttgaactcctgacctcgtgatccacctgccttggcctcccaaagtgctgggattacaggtgtgagccaccacgcccagcctggttttgtattttcatttaatctgggtggaattaattttggtatgttctatgaattacagttcaatcaatttctctcaaataattaacctgttatcttagcatcattaaacaatgtgatttctgctgtgagaaactgttgtattgcttcctctgaattgggaaagaggatgtgtgtggtaagtgtgtaaagagatattctatcatgtattagcatttagccaagtccctgatcttttctttgatgacttggtggccataatttctgagtatactaggttgtatacatttgccttcttagtctcttttagtcctaaaagaggtatttaccttagaaagtggctttcactagttttcctcaaagattgtgaattctgttttgtggatgacctgtttttaaccatagcctatgtactgtcaccaaatatgcttttctgctgcttcattttgtcaactgataattgctctgaaattataaactaataattgtttcagcagtataaaaatagactacagtgtatacttactgtccatttaatactacagattccaaagctgtatgacatttttgttttctactgttatgttctttgtgctctagcccttctctgatatgtggataatttagaggcaatgatagtatttaatatgcccgattttttctttaaggcaagaaattgtttttttttttttttttttgtgatggagtctcgctctgtcacccaggttggagtgcagtggcacgatctcggctcactgcaacctccgtctcctgggttcaagtgattctcctgcctcagcctcctgagtagctgggattacaggtgcctgccaccacgactgactaatttttgtatttttagtagagacagtgtttcaccacgttggccaggctggtcttgaactcctgatctcaggtgatctgcccgctttgacctcccaaagtgctgggacttcaggtgtgagccaccacgcccagccaagaaattgattttttttagttaataatgtttaccaagtattgtagttgggtgaagtcttcaagcttaaaagtaaacctccagcatgttattacctaaggaatttgtgtcaaggctgattgaacctgaatctcttaaatgctttgtttttgtagagaggaaaatatgatgttcccaagtggctctctcccagtagcattctgcttcttcaacaaatgctgcaggtaaactttatttttaaataatagaagtctattgtaattgtttggttcaacttttaagatatctgtggtgctacatcatttcctattagcttgaaaaaaatcccactcatatctaccttgaaaatatcctctattagatcctttcttaattatgttgtaaacctagtttattttagacacctaccatatgttatagctggtatggtttttcttactttgcgaattttctgttttctctaactagttcttgttccactctcttttattccaaaattattgattgattgattgattgatggagatagagtctcactccttagaagaccctcaggttggagtgcagtggcgtgatcttggctcactgcaaccttcgccttctgggttcaagtgctttttctgcttctgccttccgagtaggtgggattacaggtgtgaaccaccatgcctggctaatttttgtatttttagtagagacagagttttcccatgttggccaggctggtctcgaactcctgacctcaaggtatctgcctgcctcagccttccaaagtgctgggattataggcgtgagcctctacacctggccccagctcttttttttttttttttttatttagatggagtctccctctgttgcccaggctggagtgcagtggcgtgatcttggctcactgcaacctttgcctcccaggttcaagtaattctcctgcctcagcctcctgagtagctagtactacaggcgtgtgccactatgcctggctagtttttgtatttttagtagagacgaggtttcactatgttagccaggctggtctcgaactcctgacctcacgttttctgcctgcctcgacctctcaaaatccaaagtgctgggattacaggtgtgagccactggcttttgtttttttgagacagagttttgctttgttgctcaggctggagtgcaacggtgcgatcttggctcaccacaacctccgcttcctgggttcccaggttcaagtggttctcgtgcctcagcctcccaagtagctgggattacaggcatgtgccaccattcctggccaatttttgtacttttagtagagatggggtttcaccatgttgtccaggctggtcttgaacttctgacctcaggtgatccacccgccttggcctcccaaagtactgggattacaggtgtgagccaccgcacccagcctggcctctttttttaaaaaaaaattttatagacagggttttactctgtcgcccaggctggagtgcagtcatatgatcttggcccactacagccttgacccccaggctcaagtgttagttctacttcagcctcccaagtaactgggaccactggtatacaccaccacacctgactaattttttgtgttctttctttagttttcttttttttttggttgtttttaaattttatttatcacttcattccttataattactttcagcaaactgtattttttgtagagatggggtttcgctacgttgcccaggctggtttcgaactcctgagctcaagcgttctgcctgtcttgatctcccaaagtgctgggattacaggtatgagccacggcatcccgccttttcccaactcttgctcattaagtatgttagtagatactgaataaatacttgaatgagttgatgtactattgaatgggccctgttacctagtgcagtggttctcaaacttcagcagatatcaaaattaccccgggcttgttaaaatacagattgctggcctccagccccagagtgtgtaattcaatagatctgaggcaggactgaaattttgcatttctaacaagctcccagaagatgctgatgctgcaggtcttggggccacactttgagaaccacagatttattggaatgagcctctgagggtgaaagataggagtgctgaagcctaggtaagcactctaccaattaatcaatgtatcacctaatctgatctataaaatgggggttctgagcctggcctcactgctatgtagtgttataaggacaaaatgagattgataggaaacactttgaaaatatgagtatcttcttagtgcaatttttttttcattatgtattcagaatatcttctggttttttcatctattaagtcatctccatcttttattcaaaatttacctcaggctcactcaccttgattaagtagggccagaccaccaaatctccgtaatgagattgaaaatgccttactctttcttctagactccaaaataacgttaatctttgttgattaatttttctctccttacatttgaaaattacaaatggaaaggtgtgcttttcaacttgttctgtgtgattgtaagctcattggaggtagagattgcatattcagtatgaatgccctgcattgtggctgcttgaatgtttaattggtgaatatttcccgtgaataggttttccagcaaaagactattacatcatacaatagattgaacttcacgaataatgtccataccaatgaagttcatgtttgttaaacatttatcttctaagcctgtgttggttgctatagttttcttgcctctgttgcctttttaaaagaatttcttccaaggccattttaaagtctttgacagcatttttgtgatgataaagtttacatctgttctgatgcatttttagttttcaggaggaaaggtgttctatgttctctatttgaaatgttaatctctagctactttttaatggccactaggtggacccaaagaaacggatttctatgaaaaatctattgaaccatccctggatcatgcaagattacaactatcctgttgagtggcaaagcaagaatcctgtaagtaaaatgaaatccagtagaatttttttttgactttgtgtggtctttgggtgaattcagaacctacaatgatgtggtctaaatatacaagaaaatatattaatcagattggtgtttgggagacttgtaacctaatggacagtggttccttaaccccatctgcaaatgagaattacctgggaccttaaaaagaaatgcctgctccccatcccagaacacttaatgggagtttttaaaagctcccaggtgtttctcatgtgcagtcagtcacagtgctctgggaatcttggacaagttacttaactttgcagaacctatttattcatctgtaaaaagtaggttaaaccagttctacttcccagagaagttatgagggtacagtagttctcaaactttttagtttgaggatccctttatactcttaatatttatttattcattaaaaactaatatgataaaactattgcatattaacacaaatatttttatgaagaataaccatttacaaaataaatttagcaaaaagaatgacattgttttacaactttgcaaatttctttaaagtctggcttaatagaagacacctgtatagccacctgcttctgtgttcagtctgttttgataggttgttttgattgaagccaaggaataaaatgcagcctcacacagatatgcaataggaaaaggaagaaaaattctaatagccattcagacagtttctgatagcccattaaaacttgacaaatggtagtttcttaaagggtaattgcatgtggaatctgaagccatatcaatgaaattttgtactgtattccataaaatccattgttctgtccattggatcttttcctcacataacatgatgcattggttatttggaaaacactggtttgctgagttatgcaaatcttccaaacgttaacacatttcgttatacaacattaaatcacattccttaaaatcactactgatctcagtagaaaagtctttaactattggaaagcactcaagatcatggtggcaaataaaagttttctaaattctaatttttgcttaaaagctaaaattctatcattgacaacaaatatgtcattctccttgaactgacaaattcccttggttcatttttgagaaaatgtctgctgaacatttaagtctaaataactatagttagtccgtgttctttctcatcaaaatggtgttctttgaaaaaaatggctaattaggccaggcacggtggctcacacctgtaatcccagcactttgggaggctgaggcaggcgtattacttgaggtcaggagttccagaccagcctggccaacatggtaaaaccccatctttactaaaaatgcaaaaaattagctggcatggtagtgcctataatcccaggttctcaggaggctgaggcagaagaattgcttgaactcgggaggcagaggttgcagtgagctaagagcgccaccgcactccagccttgggtgacagagcgagactctgtttcaaaaagaaaagaggctgggtgcagtggctcacatctgtaatcccagcactttgggatcccaggcgggtagattatgaggtcaggagttcgagaccagcctgaccaatatggtgaaactctgtctctactaaaaatacaaaaattagctgggcgtggtggcacacacctgtaatcccagctactcaggaggctgaggcaggagaatagcttgaacccgggaggagagtgagactccatctcaaaagaaaaagaaaaagaaaaaaatggctaattgagctcataattcagtcatacaggtgcttttcctcgagacagctatcaaactttggtattgtagaagtacattatgctacttcctatttagtcacacagagtattaaaaacgtactcagaaatgtaataaaattaatatattttactggtttatcaaggaaattcttaattgaaactggcttcttttcgaactatgggtatatgacaaagaatacaatattttagtacagtttggtgccactgcattgattcatactaaggtgccagcaatttatttatttaattttaatttttttttttttgagtgggaatctcgctattatcgcccagacgggagtgcaatggcacgatcttggctgactacaacctccgcctcccagtttcaagcaattctcctgcctcagccacccgattagttgggattacagccgcctgctacaacgtttggctaatttttgtatttttagtagagatgggatttcaccatgttggccaggctggtcttgaactcctgacctcaggtggtccgcctgccttggcctcccaaaatgctgagattacaggcatgagccactgcacctagctgccagcaattttatcactgcatttgtaccatccatacaaatgtcaacactttgaaaaatgaaaaataatattattataaaaatagtttgaccttggagactctcaggcatctgcagaccgtgctttgagaactggtctaatatgcgtatatgtaaaaaaacataaacaacaccaagtgttatttaagtttaaacaatttaaaaaatactatttctacattgtttttaaaaaatgcttttttttttttttttgagatggagtctcgctctgatgcccaggctggagtgcaatggcgcagtctcagctcaccacaacctccgcctcctgggttcaagtgattctcttgcctcagactcccgagtagctgggactacaggcatgtgccaccatgcctggctaatttttatatttttagtagagacggggtttcactgtgttggccaggctggtcttgaactcctgacctgcctgccctggcctctcaaagtgctgggattacaggcgtgagccactgtgcctggccttaaaaatgctttttttcaaacaaatggccacttggtaaaaatgtggatattactataggacttggatattttgtgtattagttattgctgcattaaaaactaccctgaaatttagtggcttaaaacaataatttggctgggcacggtggctcacgcctgtaatcctagcactttgggaggccgaggcaggtggatcacctgaggttgggagtttgagaccagcctgaccaacatggagaaacccgtttctagtaaaaatacaaaatcagctgggcgtggtggtgcatgcctgtaatcccaactactcgggaggctgaggcaggagaatcacttgaacctgggaggcggaggttgcagtgagccaagattgcgccattgcactccagcctgggcaacatgagcgaaactccgcctcaaaaaataaattaattaaaaaaaaacagtaataatttacagttctgtggaccagatatttgggctgggttcagctgggctgttcttatgtaggccttacctggggtcgtggctacagtcatcttgtaactgggctgaatggtccaagcctcactagaaagactggctgtttcctgggccacatgtgtccatcaggctaacctggacttttttatgtagcaactggatttctttctttctttctttctttctttctttctttctttctttctttctttctttctgtctgtctttctttctttctgtctttctttctttctgtctttcttgtctttcttgtctttcttgtctttcttaccgagtctcactctgtcacccaggctggagcagtggcacgatctctgctcactgcaagctctgcctcccgggttcatgccattcccctccctcggcctcccgagtagctgggactacaggtgcctgccaccacccggctaattttttgtgtttttggtagagacggggtttcaccatggtagccaggatggtctcgatctcctgaccttgttatccgcctgcctcggcctcccaaagtgctgggattacaggcatgagccactgcacccggccagcaactagatttcaaaagaagaaagaggataagccctagtgctctagcatttttcaagcttctgcttgcattgtacttactaatgttccactggccaaagcaagccatgtgacaaagcccagagccactatggaaggtgtatctttcaaggttgtacaattcttattccctatttatagataagggaacggaaaaatgaaaagcaactatttaagatataaatgtagtgagaagagtggcattgctttacatctttgccaatttctttgaagtctgtcttattagaagacaactcatgtgcttctgcattcagcctgttttgataacatcgttttgattgaaacaaatgaagaaaatacagcctcacacagatatgtaattagaaaaaatagaagtattttaatagtgtttccagataattggggatattctctgatatgtcaccaaaacttttgcagtggactaggacatgtgcatgaatcaacacaacagcttagaggtgtgtctcagatatgccacagcatagaattggtagagctgtggggtatttgctttctggaataatcacaccaatgtaaatatccttcccagtagccagctcgtcttggaaagatagactatacttgctccaagccctttctcactgttctgcccactattaatgggccatgtggcctgagctgaaatcactcctgattctcctatgactgtcaactcctaaaacttctgttatctaaattcccccagccctacatgacatctttaatatctattgagcaaatataacataattctaacagcaaccacaccaagatcctaagaaaagcagaatgtgcaagtgtctgagcagtgtagcagcagaaccagggaagctgtgatgtgccccttgtgaggtggagagagtgggtggtgcaaatgcctgtgttcagccattgggggtcatcatttctccatgtgcggagggctttgcacatcttctcagccatgatcctaataggatagaatacattactgtttgtgttagatgccaaaatgaagaaagtctctgctttctacaaccccaagagtttttttttatttgggacacagtataaagtaaaatatataaagttatgagtgttccaaaagagtatacagtttcccttacatcttttttttgtttgtttttttgaaatggagtttcgttcttgttgcccaggctggagtgcagtggtgtgatctcggctcaccgcagcctcttcctcctgggttcaagcgattttcctgccttagccttccgagtagctgggattacaggcatgcgccaccacgcccagctaattttgtatttttagtagagacggggtttatccatgttggtcaggctggtctttaactcccgacctcaggtgatcggccgacctcagcctcccaaagttctggtgttacagatgtgagccaccatgcccagcctcccttacatcttaatttaataattgctactatttactgagcacgtagagtagaatagtgtactattttagtaagggctctctgtatattatactgtggtaaaatataggtagaactgttaggatagtacctttaagagtcaggcactatcctatgggctttatgttgtgttaactcctttaatccatttaatctgtacgccaatcctccgaagaaggtactattattgcccctttttgcagatgaggcaactgagacacagaatcattaagtaacttgcccatggtcaaacaacgagtaagtgtagaaccaggatttaaacgcacaccgaagggttctggaatggaatggatctgataggctagctgattcaagctcagggcccacgtcctgtgtatttgcagcctttgtggcgagcattgcttatctggtgtctgttgaagtagctactggagcagagtgatggagaggtggcattgtgttatggtaggaaaacctggggctaggaatgaaaaatgccagtcttaggcagatcacagtaacttttctgagtcttcattttatcacctctaatatgggtattctaatgtcaatctgtgtatgtttgggtcatgttttgccatttatagagtaactttacatgttgtatcattaatctcttttgcctgccttgcagagctgttacaggatcaaatgaattatatacaggagaggcataatgaattgttgttgctttttaaaggatttgcttttctctttcagtgttgtgtttcatcaagagtgaactattaaaaaaaattcagatttccttgaatatttaaggtatagatgctgtctgttctgtaactctacgcatgatcgcctcctaccattttcatacatagttctggtacccaagtattgcatcaaatagaaattatagtcagtttcattttctgccctggcgaacaggaaatgtagtaggcacagataatccaaaataattggctagcttttggtatgcagttttgtacttaatttgagtatgtgtggctgaggattcagagcgctttaagtattgatcctctttggaagacacagcttgagattaatcatgttttttagacccttggtatcttttctaccacactcatttcattgtttccagttcaggagcccagcagagatagtagaacctccttcttccatctcctgcctttctcacacatatgccttgtggtaaaggtacaggcaggaggctgcgggagagaggggttcttttacagttaaaaaaatattttttttttacacttaagatgatggagggaacctcaaaaatttattttcttgcttgagcagtgttgacatcaacaagaggataccaggtattaaggtgtctaggcttctgaggttgagaccatcttgaggggaaatctacagttctaggagcggtcatagtcaaagcagcacaatgaaaacttattcttagcactttggactttaacagtaccactagtataaacctttgtggtctctactttgtaacccatgaggttgtgcttataccagtcaataatgcaaggctctctcagtctgtttgagctgctgtgacaaaataccataaattgagtggcttagagagaacagaaatttatttcttgcagttctggaggttgggaagttcaagatcaaggcatcatagagctagagttctggagagtaaaaataaagaaaaaaaagatcaaggcaccagcagatttggtgtttgatgagggcccactttctggttcatagaatggctctttcttgctgtgtcctcacgtggtggaacgggagaaaggggaaaggcctctggagcctcttttctttcttttcttttctgtttctttttcttttttaaagagatagggtctcattcttttacctgggctggagtgcagtggcttgatcatacctcactgtaaccttgaactcttgggctcaagtgatcctcccacctcagcctcctgagtagctaggactacgcatgtgagccatcgcacctggctaatttttgaatatttttttgtagtaatggagtcttgctgtattgcccaggccagtctccaactcctggcttcaagtgatcctcccaccttagcttcccaaagccctgggattacaggcatgagccattgtactttggcctggggcctcttttataagtgtaataaccccatttatgagggcagagcccacttgtgacctactcacctcccaaagacccaacctcctaatactattacactagtgattaggtttcagcgtatgaattgaggggaaaaatttgtctttactgtttcttttcatgatggcagcctttctcttgagcttgttgttacaagtgtgatgttcaaaacaagggaagctcatgatattgccctgccttgtgctgggcagacctctctttcttgttatgtttggttctgaatacttcactttgatgtgtagtatcaacctggagtgtgatctaaagaaagggccagaatagtaaggggagttaatcattaaagtggaggttggcggaactagaaaacggaagacttgcagaggaaaggttgcttataataggaatacgcaaatttctgaaaggctcttttagcacagaggaaatagaattatgactgttggtgaaaataaccagtttttgagggcctactctgttgagatgttgtactaggcgcttgctctatgttgcatatattgcagggcacataccatctctctctagcagatgatgaaactgagactcagaggtgtggtcatgttcaaggccgcatggttattaagtcctgttgcaattaaaactaaggtctgtctaattcccaagcctgttagccatcagtttgtaccaattcccagtggacagagatcacagggagacagacctcaggcagcaggagggagatgctaaccattccagctgttctgtgtaccctggagaggaggcctttaagcagaacataaagcatccctcactcgggctgccataaagagagatttttttttttttttttttttggagatggagtttcactgttgttgcccagcctggagtgcaatggcttgatctcagctccccacaacctccgcctcctgtgttcaagcgattctcctgcctcagcctcctgagtagctgggattacaggcatgcaccaccacgcctggctaattttgtatttttagtagagacggggtttctccatgttggtcaggctggtctccaactcccaacctaagatgatccacccacctcggcctcccaaagtgctgggattacaggcgtgagccaccgcacctggcctaagagagttatgttggaaagatgaactttaaagttgtattcctctgcttctcttcctgtgtaatcttctgagctcccttccaggtccaggccaggctattcctgattcctgcctttttgttctcagtgatccttgcttggttctgagaacccatttccagccctacctttagtgaggtaccatcatgtagggattatttggataatttctgtccttaagcaaaatgaattttgtatagaggctcttacttatattcttttttaaagttgtggtccagcaaaataacgatcgtgtggcatctatggcaccatcgtaaaggctccttgaattgtgctaaacataaacataacctgaggtaccctgtgctctacaagtttgaatcactcttttaccagtctgttgtatagccactgattttagatgcctaggtggctgctctttgatgaaaataccaatgcaggtcttgtggtagggaaggggagtatacagtccctgggctgtacaacagaacttttttttttttttttttttttttttttgagacagagtctcgctctgttgcccaggctggagtgcagtggcacagtgtcagctcactgcagcctccgcctcctgggttcaagtgattcttgtgccacagcctcccaagtggctgggattacagatgctcgccaccatgcctggctaatttttgtatttttagtagagatggggtttcaccatgctggccaggccagtctcaaactcctgacctcaggtgatctgcccgccccagcctcccaaaatgctagaattacaggtgtgaactattgtgcccggcattgtacaaccgaactttaacaacagttgctcagatgatgatggggataaagagttgggaaagagcacatcttcttgaaatgcttgctggaatatgcttacttcttaaaagattatagagaatattgattcttccccaagaaattgacagattcatgttttacataatgatatttgattgtataaagtaattatgctgattttaaaatgtgaaaacattgaatatatttgtaattttttgttaataaagtgcataatttttttttgtagtttattcacctcgatgatgattgcgtaacagaactttctgtacatcacagaaacaacaggcaaacaatggaggatttaatttcactggtaagaaatacagcatgggctgggcgcagtggctcacgcctgtaatccaaacactttgggaggccgaggtgggaggatcacttgaggtcaggagttcgagaccagcctggccaatgtggtgaaaccccatctctactgaaaatacaaaaattagccaggtgtggtggcacgtgcctgtaatcccagctacttgggaggctgaggcacgagaatcacttgaacccgggaggcagaggttgcagtgagctgagatcacaccactgcactccagcctgggcaacaagagctaaactccatctcaaaaaaagaaaaagaaaaaaaatacagcaccaatttgagagtagtatcttttgtttcattgttctttattttatcagtacatgaaaaatagtatagcattttcagacctgtgattttattatgggtacaaatattgcatttaaaaaatatttacatatgatttccacacagtcctgatgtgtgctagatatcttctttaaaaatgaacactccatacttaaaacattgatgaagaagaattacagtgaaaaaataattaagaaacaactggccgggcacggtggctcacgcctgtaatcccagcactttcggaggctgaggtgggcggatcacgaggtcaggagatcgagaccatcctggctaacacagtgaaaccccgtctctactaaaaatacaaaaaattagccgggcgttgtagcagatgcctgtagtctcagctacttgggaggctgaggcaggagaatggtgtgaacctgggaggcggagtttgcagtgagccaagatcacgccactgcactccagcctgggcgacagagtgagactccatctcaaaaaaaaaaaaaaaagaaaagaaacaacaaactagtgcacaaagaatggacagagttctaattttgactactttaaagttctctaacatgcaactgggtttctgctgtggaaatgaggtaaacacaaagcaattttcttttcacctgaaagcaacagcagcgtcacgtcacccctaagtggacaaaccaaataccatgaaagcattatcatgatttctggtgttggattattttggctctttcagatgctcagtctctagatcatacctgtgttttgtgtgtgtgtgtgtgtgtgtgtgtgtgtgtgtgtgtgtgtgttttaagagatcaaggcagtcacagctgtctctaatgtgaagggtgacttgtacctcactttgttcctggcccagtactatgtcttctatcacctgtgatttatgtttgctttatctgttctttaacttgcaaggtggagtccttaagcaatttttttaaaaaattaaacaaagctttgctaaggcacaattcttttcagtaaggagaaaatataaaggaattcttctgaatgacataataagtaaagacacacagaatgtatctggaaatggtagtataatttactttttcatggataatgcctttagggaaatagtaagacttgggaattgctgtaagatttgtgtggtcctcagtctttcattagtgaaaatttgaagtttccatttaagcaacctgaaaaaataaattgtaggacattttctttgggataatctttaatggaagactatactttagatactgaaattttaaaaaatgttattatagaaaaatttacccaccaaagtagagagaatagtataacaacactgagtttccatgttctcatcattcagttccaatagttaataacattttgccaatttaatctatatcctaccactttctcccttcttccctttccagctgggatatttccacgtaaatcccagatagcatgtcagtttatccaggacaaattggtatgagatctacaaactttaaaaatctgaatcttaaaagtaacatacttaagccgggcgcggtggctcatgcctgtaatgtcagcactttgggagtccgaggcgggcggatcatgaggtcaggagattgaggccaacatggtgaaaccgcgtttctactaaaaatacaaaaattagccgggcgtggtggcacgtgcctgtaatcccagctactcgggaagctgaggcaggagaatggcttgaacctgggaggcagaggttgcagtgagccaagatcacgccactgcactccagcctggtgacagagtgagactccgtctcaaaaaaaaaaaaaaaaaaagtaacatatttagagtttcaataatcattgaaaaagtctttaaaatggtatcttttatgacgtctctacctataattttcagacttaaaagtgaaatggaaatacaaattatttgctttccttctggtgcataaaacataacaaagcatagtagaagttgtttcctggtgttacagttctctaaagatcttctcagttattctgaaagttaagcatgaccaacatcaagaatgtagtgaggaaagtaatagtttttcttcctttgtactcttttctcattcttaaatccctgttcatacttcgttgagtcccagggatgagtaggttataggctactcactctagatcagagattctcaccttggctgtatagtggcatttcttgggaactttaattctgatgtttaggtctcaaccccacagatgatgattcagttggtctagggtatagccgaggcatgagaatttttagaaatcttcccagctgactgtggtacgcagccagagtcgagaagcagtgctctagatccttgctgttcaaagtgtggcctaggaccagcagcagcagcatccaggtgctttttagccgcgaagactctcaggcctcacctcagacctactgaatcagaatctgtgtcaaatctccaagtggttcatatggttagtaaagcttcagaagcattggtctagctcagttctcaaccaggagtgattttggcactcagggggcatttggcagtgactagagacatttttggttgtcgtaactggggtttgtgtatgtgtactaatgccatctagcgggtggaggccagggatgctgccaaacatccttcaatgcacagaagagcccctcacaacaaacagttatccaggtcagatgtcaatagtgccaaggttgagaaacccttgtctgggtagctcagagaattcatactggctctacatactttccaatttgaagagcctcaggaaaaccaggtttgagactagccagggtctgttatgtttttctgtgacatcctgagagctctgccttcacttttggggctgattagacaggacagagagagattagttctgtgtgatccatatgctggtatggtgctgctgatctttgtgcagagagagagagaaacaatattactctcaaacattcaacttataagaactcccacttttatattatatacaggagcactctgaaactgctttctctatgcagcggtgagcctcctatgtctcatgattttgagtgatctcattgtattccttttgagattcccaacagtgctttccttactgtcttcctgttcctccagccctgagtggctctggattgtggcagcagccagtcctctgctaggggaccttcactaagggtcacatgtgtgttcgagaacctattcagtccaggacagatccattttccccacccctgtgatgtaaacacccatgtgtgtaaagactgaaggcctcaggaggagggtcagaggaagggtaggggccactcctccgtgtctgtgcccctctgcactagtagctgcctctcctcaacccaggtgccaggacacctctttaacatttaactggggatttaagaatgtttttagttttctagaaatggaactttctcacaggtaaccctatcactttactttcagacatttgactttcaaaagagggaattgcctaaaagataagggaaacctttgtcttagacttgtggattgacatcacctgaaagcataactaatgtgttgatttatctgttattgaacacagaactctcctgtgcatcttataatgagaagtatacagtgacactggccagaaagttatgaaaaagatgctttttttgcctagggaaaaggagggtttagaggatggttgtagaaatcctaggcatgtttaggaaactccatctaaaactcttagcactatccaggaattgtttacaatgcctgggttatgccatgccatcattgataagaaagtggcaacttgtttcttagccattgtctctagtcagtttatgacatctctttcaaaaaggtggctatcgtacatggggctatcatagatgtggggtgggaaaaagtctttaatgtagtttttggaaagtggagagtgattataagtatatattttccaccccaccatagtttcccagccaccttctccatgaagcctcttcttttcttttctttctttctttctttttttttttttgagatggagtctccctctgtcgccaggctgcagtgcagcggcagaatctctgctccctgcaacctccgcctcccgagttcaagcaattctcctgcctcagcctcccatatagctgggattacaggcgcctgccaccacacccagctaatttttgtattttttgtagagacagggttttaccatgttggctgggctggtctcgatctcctaacttcaagtgacccacccgcctcagcctcccaaagtgctaggattaaaacatgtatgagccactgtgcccggccatgaagccttactgtcctttctttgcctcaccctgtttggattaaaggcaacatttcataatttatgacactattttatgcttcccctactagattgattgggccatttatgcaaatttcaaagcatatactatgatcgtggccatctaagttattaactaataaaattcattactaaaaacagagttggtagttgacttttgagtcatgtactttgtgagggggctacatagcatgaaagactattccgtactgttaaaagttaacacttttgtagggcagatagccccatagttttctcagtacattatttagaaactttcattaaacatagtggattgaacagctaagtttacgtcgaacacttcctaaaaccttaacaaaaagggataaaaaggcaaaatatttacaagcagaataaaaggggagacaaagggatgtcattagaagtttggaagatataggttagtggtataagtggtagttgtcagagcattttggagaaagctgaaagctaagtgcttgcagtgagaaaggcatcaagcaaactgatgagagctccagaaaggctcaggaatcagaggtaccaggagcctctgaagtcagggaagtgaagaggaaaaacaggaagatgggttagaaccctagattcctttctctacctgtgctgcataacagcctcctcttccgcatcctggcagaagactggaggtcacaaggcattcttgtaccaaatacagctcagatgcggatgatgaacaattctgaaatggatgcgcaaagtcttcatattgaacagtgcaccaccatctcaaattcccttccctattcaactttgagaacgctgaaaccaggatttgtatcctatttgcagtgatggtggggaaaatattggaagatttatctccagggaaaagctaagataaatatcctactatattagtggttgggagttcaagttcctgtccgttcatcttagagaggagccttcaaggtattgagcagccccatcatacacatagaacctctcatcagctgtgtaacgtaattcttcacttttaagtagaaacagacaaccaaaaatcactagaaatttgaggaaaacttctaacatgaaagtcggagatcaaaacaaatggagtaaggtggggagaggaaagaagaaaaagtagatactgagaaaaaaaaaccccagatatgcagggagcgggagaaaatggctaaaaactgctaattaatattctcagataagagaagtgattttcattcttgacataggaataagatgaataaaaatgaacattccaagagatagctcttgaaaatctaaaatgtgaccacagaaattaaaagctcagtaaaagtgtttgaaaatgaaattcatttgaaatcttttaaaagtagaacctggtgggctaggtgcggcggctcacacctgtaatcccagcactttgggaggccagcgcgggcagatcatgaggtcaggagatcgagaccatcctggctagcacggtgaaaccctgtctctactaaaaatacaaaaaaaatagccgggtgtggtggcgggcgcctgtagtcccagctactcgggagtctgaggcaggagaagggcgtgaacctgggaggcagagcttgcagtgacccaagatcgcgccactgcactccagcctgggcgacagagcaaagtagaacagctaggcacggtggcttacgcctgtaaacccagcactttgggaggctgaggcggcaggtggatcatttgagaccaggagttcgagaccagcctggacaacatggtgaaacctcatctctactaaaaatacaaaaattagccaggcgtggtggcatgtgcctgtaatcccgggtactcgggaccctgaggcgagaggattgcttgaacccaggaggcagaggttgtagtgagccgtgattgcaccattgcactccagcctgggcgatagagcgagactctatctcaaaaaaagggaaaataatgcaagaagaaatattccaggccgggcactatggctcacgcctgtaattctaaaactgagaggccaagatgggaggattggttgaggccaggagttcaagatcagcctgggcaacatagtgagatcctatctctatttaatttaatttaattaaattaattaatttatttatttttgagacagaatctcgctctgtcgcccaggctggagtgcagtggcacgatctctgctcactgcaagctctgtctcccagattcacgtcattctcctgcctcagcttcctgagtagctgggactacaggcgcccactaccacgcccggctaattttttgtatttttagtagagatgggttttcaccatgttagccaggatggtctcgatctcctgacctcgtgatccacccgcctcggcctcccaaagtgctgggattacaggggtgagccaccgcacccggcctctattttattaaaaattaaaaaaaaaatttaagattaaaaacaaaaaagagaaatattccagaactgaagaatatgagttttcaagaatgaagaggcctaacctgggatgaaacagtagatgaaaacagattcacaccaaggcctgttctagtggaatttcataataagattcaggaagttttcaaagataaaaatgaaagttcatacaaaaaggctggagaatcaaaacctaaatgactataggtttttcagtagctgtactagaatcaagaagagtatactaccatcaaaactgcgaagattattatcaacccagaattctctgcttaaccaaatcagaatcaattgtgaagatagaatgtagtcacttatcagacatgcaagatctcaaaaaatttacttcccatgcatgcgccctcaggaagtcactggaggatgtgttccacaaaaatgagagattaaaccaagaaagaagaatacttaggatctaggaaactggggctacattgtaagatagaggtgaaaggaatccctagactgacaattgagtagctggctgagaagccggtccagagtggagcagaggatgcagacatcaggtggaatctctctaagtggggaagcagttagcagatgtgtgtgaacatgttgagaggaggtaaagtgttggaaagggtggagttcaatttgtaaggaataactgacttttatttttatcttcaggaaaaacaaaggtataaaaaaatggaaatgcaagaatagcaccctgtgtggtttagctgcagagctgatattcggccagcatgaccacattggttgttaaaatattagtgtatttatatactgactggtaaataaccactatcttcagtgccctccatgttgccctgttacttccctggacactactccctcccctcttctcacaattaaaagattaataattggaaaggcaggcgtctcccaggaccctactgacctcttggcctctattttgatggttgatgtcagggtaacaattaactattttgaacattatccctacttagttgtgaatgctatttacataatcataataatgcaaatattaacttagctaaacattgtgataaaattatagtaggaggatacagggaggagatgtgtgggaaagggagggagttgcagtagagttaaattcatatttctcatactaggaaatttatacatattatctgaagctgaaaaaaattttaagctatgtaagcatttagtttggaaatacagaattaatagcagaagaaatagctaaaagtgtttgaaagttgttccttagggggagtggaaattgtatgtgtgtggaggtgtggtgcactggttgctgtttttcatcatatgctgtgtaaacctattggcttttaaagttctgaatgttacactgaagaaaaaaattaattaaagatagaacatcatttccacaaacaagtaatcttctaaccaacttgattttcttttcctttagtggcagtatgatcacctcacggctacctatcttctgcttctagccaagaaggctcggggaaaaccagttcgtttaaggctttcttctttctcctgtggacaagccagtgctaccccattcacagacatcaaggtaagtgttactgcctgttgtgtcttgccacgtgccctccctgttcctgagtgtgtataccactgggaaggtaaactttccggtgtcaaggagtcagaggcaagatgttttatgatttcaatatttttgatgagaaaaatgggaagttctgaagttgaactctaattttttttttttttttttttttgagatagagtctcactctgtcatctaggctggagtgcagtggcatgacctcagctcactgcaacctctgcctccgggattcaagcgattcttgtgcctcagcctcccgagtagctggaattgcaggtgtgcatcaccacgcctggccaatttttgtatctttagtagagacggggttttgccatgttggccaggctggtctcaaactcctgacctcaagtgatcagcctgcctcggcctcccaaagtgctgggattataggcatgagccaccgtgcccggcctctaaaattctgaatgttaacatggcattttacaaacctcctcccctgactccttttttttcataatagcaattcctgatggctatagaaaatgtttaagccaggccgggtgtggtggctcacacctgtaatcccagcactttgggaggccaaggcaggtggatcacaaggtcaggagtttgacaccagcctggccaatatggtgaaaccccgtctgtactaaaaatacaaaaattagccaggcgtggtgatgagtgcctgtagtcccagctacttgggaggatgaggcaggagaatcgcttgaacccgagaggcggaggttacagtgagctgagattgcgccattgcactccagcctgggcgacagagcaagactctgtctcaaaaaaaaaaaaaaaaaaaagaaaatgcttaagccacagatgagctaaaaggaaaatagaatttacctataaaccaactacctgtggaggatgtagttaatatttattgtgtctttccagtcttttttttaaagcatacttttacacgcattcaagtacttttaaaggacacattattgaattgcagagaacaaaaaaattgttgggagtaagatctgtgatatggaatatataatactttatatgacatgaaacattttgataaatattttcatatttatgttaagggtttaggtttttgtttcttttaaaattttcatactgaaatggagcatgttgattagtgtttgttataaccaaattatttttctctacttcactgtctttgtctcagttttgtcatggactttaaaaaatttttttgttttattttttgaaacaaagtcttgctttgttgtcctggctggagtacagtggtgtgatcatggctcactgcagccttaaccttccaggctcaagcaatcctcctgcctcagcctccctagtagctgggattacaggtgtgtgccaccacacctggctaatttttaattttctatagaaatggagtccagctatgttgcccaggctggtcttgaacacctgggctcaagcagtcctccctcctttgcctcccaaagtgctgggattattggcatgagtgactgcacctggcctgtcatggacatttaaaatggtgaagaagcttacatacatagaggcaccatgtcattcctaaatgcttgtgttagtccttgttttgtgtgattctttgtatttcccatggcttaaaattcagctatccaaatactttgccagatgggtatggaactttgtaatgtcatcttccctcagattaattcaggttgcaatgtaaataatcttagcactaggaaattgtacctcatcctcagagaaaggtagttggttggccctgtttatgaaatccaagataacacaattgactgtgtggatgaaagtttggtttttttcccctttataggcctcaaaactgtaaaaaaaaaacaaaaaatgttaaaatgccacctcttttatgatcttttgttgaattccccctccctcaaattcctttaatatctatctcatttagatctccttttggtactcatcagtcatgtgctacaggtatagtgggtcttatgtcactgccagaactaacctgcccctctttttccctccctagttggtcagtgcactggctgttgtgtaaagaaatctctgaagggagatatcctgcatggttttctagtctgttgttggagagttttaatggctggtaaatattctgtgcctaggcagctcttttgcacatgggctccttgaatcagccaatccctcatcccacccacactgccaaaccctttaaactttcaggtgcaagtaacacatctgggtccaggaaaatgcaaaaccctgaattttgcatctgctcaaggtaattggagaaagctattagatacgtatacctctatgcttagaaaaatcactttcactaaattttaaaatttacgacacctcagttaaggggcctgagacattttcctgagacattggattgtcttttttttttttttttttttttttgagacagagtcttgctttgttgcccaggctggagtgcagtagtgtggtcttggctcgctgcaacctccgcctcctgggttcaagtgattctcctgcctcattgtcccgagtagctgggattacaggtgtgtgccaccacacctatctaatttttgtatttttagtagagatgggatttcaccatgttggtcaggctggtctcgaactccagacctcagatgatccacctgcctcagcctcccaaagtgctgggaacacaagcgtgaaccaccacacccggcctggattttcttatatctgaattggcctggtctcaattgatctgcttatatgagttgtaagtggaaaagacctggaaatatatttactcttatcttccatctactccctaatgaacatttaactaataatttaattatttgcaaagtcatattattgaatcaattttatggcagatcaagagacattttagtaacaagaagtgaaatagaaatcaaattttgggttcgcttctaatctttatgcaaattattgagacacgaagcaagtcacatagtctggttgtactgttcttccccttgatagaattatcccttttctctggggtgttgtttataagaaagtaagtaatcatgatcgatcaatcaatcaataggtggccctttcagtgaaacagcagtacagactgatccaagaatcacaaataaccacgtcatcatcatcagtgtcattagcattttcaggccccatgctgggctgctgggaaacatatctgtgtaaagtataatacttgttctctaagagtcaagacatatatatacatagataatactgcatcatagtagatgatgggggccagagaagtggccagaggtgtcctggggagctttagaggacaggaatgatcaccatgggatccaaactggaccaacagtcaaggttagaaagatggaaaagaagtggcacaacattcagggcaagataaatggaatcagcaaaagcaggggcacctaattttgcttgatgtattctgttgacagtggctggacttgtgttaaaaaagaagagttcaagtagggggagagagagagagagagagagagagaacgcaagtgagctggaagggtggacaagagccagatagtagagaacctgaaaatgcacatcagaattttagactttgttcaatagttaatgaggagccattgatttgtgagcaagagagagagaaatgaacatgattttgaaaaattaatccagtggtgtatacgattgtttagtcaggggtgatatgtgtgctattagtccctactggagtacccatgacagccgtcattcgtacagcactgtacttctccccaccaagcctagacttagctttaggatttttctcagcctagctctccatgcatccagttccaaatgacagtaattggtaatcctggagaactctgtcatccttggttgagacagtggaaagattagtggtagagacaatattgtctgtttgaatagtctaggtatgagaagatttgtccttgatctaggatagtggcagtgagactttgggaaaaaaaggatgagatataagaaattcaagtaaaattgcttggctagattaacaatatatcgagggaaaaggaaggaaggagaaataaaaactccaagtacacccacagtcttgaattcagggtataattagtatacccttagtttatagaggaggaagaatgaaagaacagaagttattttggtggcgttgttagcgcaagaccccaaatgtcctatccctaggagatccttcataaggctaattttcttcctggtagaaattattcactaccctgtatattcttacaaagaagaaacctatatttcgaagttgtttcccctccatcttctactttgtcagatctttttatttgtaaatttgcagtagagttgtctggtattatagtgattatgtgataatgaaaagtagtatgctatataacataagaatgttgcaagacatattatttgagagtcggaggttttcctttctgataatttgaactgaaattttctgacttcctttttctgtactggatggtcagctccttcaatatagtgtctcctattcatttttgtttccagggccttgccctatgcctggaatacagttttgtgctgcataaagacaacgttggactgcatttatgatggtggtcccataaaattataataccatgtttttactctaccttttctttttttttctttcttttttttttagacagagtctcgctgtattacccaggctggagtgcagtggcacaatttctgcttgttgtaacctccacctggtggactcaagtgatcctcccacctaagcctcccaagtacctgggcctacaggcacatgcctggctaatttctattttttgtagagatggggtttcaccgtgttgcccagactggctccaacgcctgagcttaagtgatccacctgtgtcagccttccaaagtgctgggattacaggcatgagccaccatggggacggcctttttctgtttagatttgtttagatacataaatacttattgttgtgttagagccacctactgtattcagtacagtaacgtgctacacaggtttgtagtgtaggagcaacaggctataacgtacagcctaggtgtggcctaggtgtgtagtaggctctgacgtctcagtttgtgtaagtacattttatgatgttcacacagtgataaaattgcctaatacatttctcagaatgtgtctctgtcgttaagtgacgcgtgactgtattttaaatattgaatcatagtactgtcatctttaagttcttctgtctttcattgagtagtcaaataattggagtctggaagatgtgaccgcaagtgataaaaattatgtggcgggattaatagactatgattggtgtgaagatgatttatcaacaggtgctgctactccccgaacatcacaggttcgtcattcttattactatttaaggcagaatctattgtttcaattataaaaacaaccagactaatgtgaaaccaaggtgtgcttgcaaatttaatgaatgcttaagccactgaaaatgtttatgagcgataactggaatacgaatgaaagggaagtcaattatatccaagttgaagaaagccaagattctattttagagctctttactgctcctttatttcctgtttattattattattttttgagactgagtcttgctctgttggccaggctggagtgcagtggcacgatctcggctcactgcaacctctgcctcccaggttcaagtgattctcatgcctcctgagtagctgggattacaggtgcctgctgcctctcctggctaatttttgtatttttagtagagacagggtttcaccatgttggcagctggtctcgaactcctgacctcaggtgatccacccacctcagccttccaaagtgctgggattacaggcgtgagccactgtgcccggccttcttttttgtttaaaatgaggtataatgaggtatactttacatgtagttaaataggtaaagtcaccttttttagtgtgcaattctatgtgttttgacaaatgcatacagttgtataaccaccaccaaaattaagatataaaacagttccgttactcctcaaaattccctcattccccttgtggctaacttcccctcccaactctcggtggcaattgatctgtttttctttccttttgataatctttttattgtgactttaagtttgttgagctttttagattaatgaagattaagtatagattaatgttttttatcaaatttgggaagttttcaatattttatttgccccactctctttattttatcttctggtactccccttccatgtatattggcacacttgatggtgccctacagtacactgaggccctgttcatttttctttatctattttcattctgtttctcagactaatttcagttaacctgtttcaaagtttcagattctttcttctgcttactgaaagttctgtttaatccctctagtgaattttttgttatggttattgtactcttgaactccagaatttgttttgttcttttaaataattttatctttatttatactctctatttattgtgacattgctcttacactttcccttggttcttcagatgtttccttttgttctttgaacatatttaaaaactgattttcagtctttgcttggtaaggcctacgtctggacttcttcaaggacaatttccattgactgtttttgtttttctcgtgtatatgggccatcctttttgtttgtttgtttgttttttgtttgagacagaggctccgctgtatcgcccaggctggagcgcattgttgggatctctgctcactgcaacctctgcctcccgggttcaagcaattctcctgcctcagcctcctgagtagctgggattacaggcacccgccatcatgcctggctaattttttttttttctattttttttttttttttgagacagagtctcgctctgtcacccaggctggactgcagtggcgctatcttggctcactgcaagctccgcctcctgggttcatgccattctcctgcctcagcttcccgaatagctgggactacaggtgcccgccaccacgcctggctaattttttgtatttttagtagagatggggtttcaccatgttagctaggatggtctcgatctcctgaccttgtgatccgcccgcctcggcctcccaaagtgctgggattacaggcttgagccactgcacctggccttttttttgtgtttttgtaaagatggggtttcaccatattggccaggctggtgttaaactcctgacctcaggtgatctgcctgccttagcctcccaaagtgctgggattacaggcatgagccaccgtgcccggccatacttttttatttctttgcatgtatatgtcttgtaattgttgaaaactagacattttaaataatataatgtggcagctctggtaatcagatttatcccctcctcaggatttgatattattgctgtttgttgttgttggttagtgacttttctgaactaattctgtaaagtcgttaagtcatttaggtcagtgttgggctgcatttatgatggtggtccatgagattataatatcatatttttactataccttttctctgctcaattagcatagtgatcagctaatgcttggcgaggtttccttagatgcctggaatcaattcgtctctcagtctttgtgccggctctgtgtacatctggggtatgcctgcaactttcagccaggcagctgacaactctgcattagatttcatttcctatttgtataaaacctcaaggtcagcttgaggtgagatcttagatccttctaaagtgttttttgttttttatttttatttttttgagatggagttttgctcttgttgcccaggctggagtgcaatggcacgatctcagttcactgcgattttcgcctcctgggttcaagcaattctcctgcctcagcctcccatggagctgggattacaggcatgcgccaccacacctggctaattttgtatttttagtagagacgaggtttcaccatgttggtcaggctggtctcgaactgctgacctcaagtgatccacctgcctcagcctcccaaagtgctgggattacaggcgtgagccaccatgcccagccccttctaaagtctttcctgagcaaatgcacagccctgggtatgagcacatcctatacatgtacattgggcttgtagataccctggtatattttggagcttttccaattcactgtggacatcttattctctaacttttttttcagcatttttgttagtttattgtggtcaccagctattacttactgcttcggcagccacaatgtgcaacaattgcctgtaaatttttttttgtttttgagataggatctcattccgtcaaccaggctggagtccagtggtgtgatcatggctcactgcagcctcgacctcctgggcttaagcaattttcttgcctcagcctcccgagtatcggggactataggcatgcaccaccatgcccagctaatttttacaaaattattttgtagagacagggtctcaatattttgcccaggctggtctcaaactcctggactcaagagatccacccgcgttggcctcccaaagtgctgggattacaggcgtgagccactgcgcctggcacctctaaatctttttaacagatgctgctggggaaaaggctgttcatactgggcaggctctgagtaaggtcaaataaagacagctttcaggctgggtgcagtggctcacgcctgtaatcccagcactttggggggctgaggcgggtggatcacctgaggtcgggagttcaagacctacctgaccaacatggagaaaccccgtctctactaaaaatacaaaattagctgcctgtggtggcacatgcctgtaatcccagctactcggaaggctgaggcaggagaattgcttgaacccgggaggtggagtttgcagtgagctgagttcacgccattacactccagcctgggcaacaagagcaaaactccgtctcaaataaaaaacaaacaaagaataaaaaaagacagctttcatagtagggtcttctagggaactactggccaggctaaataatgacagttttctgagcatgaagctttgaaggagctccaacctgttctgccccctccagcggctcctaggttgctggtcttcatcgtgattgtgggctgtgggtttctaagactatcatagagctggagagagaagaatggggataggtagggcaaattcaaacacctcaaactcactgtttctacttagctgttttctatgaataaatgctgcgatctttggctaatacacagagttctgaaacaaaagaggtatactttgtttatggatagggagatttgaaggtatagatttcagtttttcccaaaatgaattttaaatttaatgtaatctcaacttttcagtggatgtaaaataagtcaaaatgattctaaaatgtatgtggaaatacaaaggggcaagaataactaaatcattcctaaagaataagaagatgggaggaaactggtcaacctgataaaagaactattataaaattaaagaaagtaagatttccttaataaataaaacaatgaaacaaataaaacaatgaaacctttcataccttatatttaggtatgtctctttaaaaataacatagctaggccgggcgcggtggctcacgcctgtaatcccagcactttgggaggccaaggtgggtggatcatgaggtcaggagattgagaccatcctggctaacacaatgaaactccatctctactaaaaaatacaaaaaattagctgggcatggtggcgggcacctctagtcccagttacttgggaggctgaggcaggagaatggcatgaacccgggaggcggagcttgcagtgagccgagattgcaccactgcactccagcctaggtgacagagcgagactccgtctcaaaaaaaaaaaaaaaaaaaacaaaacaaacaaagaaaaaaacatagctagatttggtatgcaaactgaaaatcttgtcttttgaattgagcgcttacccaacttatttttattatggatttagttattatatatctttctttttttatgtttcctatgtgtctttttctgtatttcccccttatttcttgattttttatgttaatttccccccacattttattggtttctatttgatttctattcttttaatatttactctaaatttttaacatttaatttaacgaaatataaagtgaatctgtatctttttttttttttttttaagatggaatcttgctctgttgcccaggcttgagtgcaatggcgtgatctcaggctcactgcaacctcttcctcctgggttcaagtgattctcctgcctcagcctcccaagtagccgggtttacaggcacccgccaccatgtctggctaatttttgtatttttagtagagacagggtttcaccatgttggccaggctggtctcgaactcctgacctcaggtgatccacctgcctcggcctcccaaagtgctagaattacaggcgtgagcccctgcaccctgctgtgaatctgtatgtttaatttccttctaaacaatatgaaggccttagaacacttaatctctgattacccctcctggattccatgctattgatgtgtccagtgtattagctcttgaatgtttttaactttttattttgaaatatttatggattcacaggatgttattgaagatattattccactttcttcttgcttctattgttgctattgaaaaaccaacctcagtctagtgcctttttagtctgtcttttctctctggctccttttaggaccttctctttgcttttggtgttctgcagtttcactgttagggctactgcgttgcacacctccagggaacacaccatctgtgtggtgtctctgtggatagtgtcctctggagttgtataatctggtaaatagagatgtggatttcttttatgtatccagttcatgattcatcatgctttctatgtatggggatttgtatttttaatcaatttttgaaaatttcttgaataatatactgctttttctttttctccttttccttgtttctttttttttttctttttgagacagagtttctctcttcttgcccaggctggagtgcaatggcacgatctcagcttactgcaacctctgcttcccaggttcaagcgattttcctacctcagcctcccgagtagctgggattacaggtgcctgtccccatgcccagctaatttttgtattattagtagagacagagtttcaccatgttggccaggctggtcttgtactcctgacctcaggtgatcacatgacttggcctcccaaagtgctgggattacaggtgtgagccagcgcacccagcctgcttttctttaaaacaatatttatataaatttatagagtacaagtacaattttcttagatgcatagtggtcaagtgagaggttttaaggtgtcagctgaataatgtacatcgcaccccttaagtaatttctcatcaccaacccccttccatctcctcacccttccaagtctacattttctatcattccactctctacatccacgtgtacacccttttttagcacccacttatgagtgagaacatgcaatatttgtcattctgtgtctggcttgtttcacttaaggtaacctccacttccatccaccttgttgcaaaagataggatttcattcttttttatggttgaatagtattctatctgtgtgtctgtctgtctatctatctcacatttcctttatgcagtcatctgttgatggacacttgggttgattttgtatctttgctattgtgaataagtactgagataaatatacaagtgcaggtatgtttttgatgtattgatttcttttcctttgggaaaagaagtagagggaattgctgcttttgcattgtccatactatgtatatctggaacttagaatagccttatgttagacattttatttcattttctgtttccttcaaccatctttcacgtatcgtatgtctttttctgtcttggctacattcagagttatttcggatttatatttctattaaaatatctctatttcttttattctgttatttgacatgtgcattgcacttttcatttttatcatgtttttatttctagaagtttttattctttttcaaatctatttgaacagttttggtagtcttttgttctttactcatgtttttgtttcactattttaaacatgcaaacatacttatttatgttctgtatttgataattttaatatctgaaatctttatgctcatagtgcttgtgtcttttggaattttttatgtaggtttatttttctttgaactctatgggaattatctgaggcttgggttaagggcttgagttgggttggagtgaagcttttctttcaggtaggagttgtgcgtgcttctaccaggttcctggggcacaacttagcataggactactttaagttaaatttaggcttgaggtttctgggaccatgcaggttgtattaatttggacctttatttatctgaagactggcctgtgtttacttacaaattattaaaagaaacttcatttttctcctccctcagaaccaagaccaagacaccctttttcttgcctattccctttgaagagcagatttatatttaactcagcctttaattttagctatagcccttcctggctttacatgggagctttggttctaactcaccaccttgcagaggcccaaggcttctgtggctgtagaaacacatgctataggttatcagaggcagaagatagctgcccttagggcagcagagagtttcagccttggttactcctttggattcattctcatgtttttagtttggcctctcaggattttacttactctcttgcaagctcaaccataaatttaaaaggattaaaaagtattttttatccaatatttctgttagagtagtttaacatgttttttctgccctaattgctgactaaactttttttttggtacatgtcagaggcaagccgtgactatctaggtatggaaagcatttcttagtgattgatttgtggccattcacaatattgcctaggatctgagtatgtgtatacactcagcctgtatcatgttgaaaattactgtcaatagaacagactaaagtgatctacatgtattaaagaaaactatatattttcaaatttcctaatgtcaataatatccttttgataattcattttaataaaaatagtacaaggtagtttgcaaatgatcaaggaatgttgtaaagaaattgacttttcttcttcagtgtgctttatctagtaactttttttttccagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaaggtatttgctaagtgaattaagcagtaagaagtttcatttttcttaccatgttaagtaaacatatagcaggtcagaaatgactagcattgctttcaggaatttctaggagaagtgaagctgttttttatcatgtcatttgcattagttaaaatgaaagcatatttgtcaatttcaatttattctcaaatgataccaagtttttcctctttttcacgtttataaaattgaatcatagcatcctaggatatcaaagctgaaaggcaagttagagctcatttaatccaactccctttttcacagctaagaaacctgagactcagaaggagtgaagtgatttgcccaaggtcatatacccaggtttagacctttcatgcccatttaccccgacttatgactcaagctgacgcctccgctgagcctttacttatctggatctccagttgtggtgtctggtcctgttctgccctatggtattactgcctgtcctcagcaggcagggtgaatccatgatgcccttccagatatctgtctttgtccagttatcacaacttcctcatttcccttggtttcctcttcaatttagtcatgagcagttatttaaaccatttcctttatgatacttcactgttttggttgctggcctcatctggacacattctatttgatcagactgcctcttagaatacagtgcctagaactaaactgagttttctagactaggtctcactagggtagagtggtaagtgtcatgacagtagagactctctgccttgtttattgcagcatggcatggtctgtagtaggggccatacctgtctggtacatagtacacagtactagacctgatgcctagtacataataggggccatatttatgtaatgaattaataaattagagcccaaaggaattttatttacagtgatcctgtttatgtcactttaaaaaatgttacctaaactttattagcctttttccccccaccaattgtgaccttctcaagtttcaagattctaacaaacctaaactctggagcattgccatgtgaactgctgggaaaccacatcctgccattgtgcttctagtgtactaatggagctcatagccagtttgaggggttaacttcttgtctataaagatattacggaagactttgccagaatatttgctagaagtcccatttttatgttaacgtcattttccatttcatcaactcaaataacactttccgccaaaatgtgaggccagtttggtgtcctgatgatgtctgtgtttgtgtgtgtgtgtgtgtgtgtgtgtgtgtgtgtgtgtgtgtgtgtgtgtgtgtgatggtgtgtgtgtgggggggtgcggtggcgctgcctgtggttgttatgagaattcagtgagatagcctctaccctgcaatggtagctgctattgcattctttcccaatgaaagggtctctttctgttctgttgtttctcttactgtaaatacagtaccctttgtgactcatgagattgggcagggagataaaacggacctcagctcaccttagctcattcaacgatcttttttttcccctttttttcttttttttttaatttctttgagttggagtcttgctctgttgcccaggctggagtgcagtggtgcgatctcggctcactgcaacctctgcctcctgggttcaagcgattctcctgcctcagcctccctagtagctgggattacaggcgcctgctaccacgctcagctaattttcgtatttttagtgaagacagggcttcaccatattggtcaggctggtctcaaactcctgacctcaggtgatctgccctcttcagcctcccaaatttctgggattataggcgtgggccattgtgcccggcccagggcttttttatttaaaaaaaattttaatgccataatcccttccattattgacattttttactttttgtgtaactctgaaggttttgcaatatgggtagtttggaatttattttataatcttgaaatattatcagttgacatatgttgtcatgacgagaaagattgtgttggtcaaagctattattggttgtttctttttaaacacgagccacttaaggaagcaagtggctgaagccatgattgttagcttccactggcactttgcatttttctttcttttcttttttctcttctctcctcttctcttctcttttcttcttttttttgagacagagtttcactcttgttgcccaggctggagtgcagtggcatgatcttgcctcactgcaaccttcgcctcccaggttcaagagattctcctgcctcagcctcctgagtagctgggattacaggtgcgcaccaccatgcccggttaattttttgtatttttagtagagatggggtttcaacatgttgggcaggctgctctcgaaactcttgacctcaggtgatccacctgcctcggcctcccaaagtgctgggattacgggggtgagcccaccatgcccagacctgcattttactttcattgtgagttatttttgacataaacataaatttcattttcgtcactcctacacaatgcaggcattggcagtttgttgaagggcagttctgtatggtgatagatactgtctgtatacaaagatgaaaactgtttttataaatatttctgattgctcttattttcttgttcttgtggaaagtgagaatgtagccaaatagtcataaacaaaaccaagcccctaatctcttttaaaattttgatattatatctttgtttttatagtgtgaatattatctctaaagggtataaaacttttagatcatgagctaatcagtataaccagattcgttagtacaaatttgtcataaactatctggaatgcaaataccctacttagaataaaacacaaaattctggaacagggaatataaaaaataatcaaagcttacatctctttttttttccgagatgaagtcttgctctgtctcccaggctggagtgcaatggcgcgatctcggctcactgcaacatctgcctactgggttcaagggattcttctgcctcagcctcccaagtggctgggattacaggcgtgcgccaccacgcccagctaatttttttgtatctttagtagagatggcatttgaccatgttggccaggctggtctcgaactcctgacctcatgatccgccctcctcggcctcccaaggtgctgggattacaggcatgagccactgtgcctggccaaagcttacatctctttaataacttatgtcaagctttcacaggggtctgttctttttgcctaacatgagttgaatcgggctatgaattcaattaacaccttttaatactagatcaattaaaagcataaattgggcccttgtataaatacagattgacttttatttttagaaaaagaatcagtaattatgagatttgtatttatatgatctgtttagatttatcatatgatgtttataataaaattaaaagcatggcctaaatttgcagtgaagaaaaaaaagaagagccacacatacaaagcaaaatgattttgtttttattataaatcacatggaaacatttcttgaaagaattagagccttcgacatcacaggtcaagtgattatactgtttctgagtcaatgaataatgtgatacctgcattattattaataatagaaatttcagaaccatagtatgtgctgcatatggattgtgtttgttctgtttctaatagctagaaaccagtgcctgaaagaaactccaattaaaataccagtaaattcaacaggaacagacaagttaatgacaggtgtcattagccctgagaggcggtaagtgtttggtttttttagactctaatctttagtatatgtaaccagatttcctttttcatgtattaatagacctgattaaggtaaatcatcacatagattctgttggagagtaggaatatctgtttatgtgtggatgacctgtggccattcctggacctgtagccactgccttcctcatggggtagaatcatgaaactgatcagcagtaggacggcaccttaagtacaacaggctgggaagacagtggtcctcaccccagccaactagttacctctctgaggcccatcttacccttctcttctgccagtaaaatacagatatcctctaacagattgtagtcctcccaaatcgtaaagatactgttgtttcaaagaaaatcctctgtatgaaaagttctgcagcataggtaactcttcaagttgctattcttttatagcaatttcttaaaggcattgtctattttcaagacaattggagaattagaatgtggacagggtattagatgatattatggaattattattaatttattgatgaagaaactgaggagatcaggaataaaatgatttatcaaagctatatagtacaaagctggagccagaacccaggtcttctcattcctaatcttatggtttttctcccacagtctggaagtgctggagaactacctagaaagccaactaacaccacagtagtttctattgaaaaatgcattcaggttccaaaatatttacataactgaccatttttagaacattatccgttagtatttggtaactgcttagcttctcaataatgtgtatatatgtggttgaactagtttccttaattttatttaacatttttcagtgcaatggtactatggtttttttaaatctcagtgtcagtgcttgaaatacttaactatctccaaccagaaaaatttcagaacaaaaggataaaatatgcctaataaacagccatatgtaacgtaaacttctcagcacactttatggtgttgtctttatggaagacaacatccttattcattggagatgtatactgaagtgtttcagagtaaagtgtcatgatatgttcagatgagttactttcagatggcttagcaaataagtaaatttaatgtattatctacatacattaaatttatgtgtatatatagatatatacattgatgtatatatatcagtgtatatctatatacatatgtacattaatatattatctatatccaaatagaaagcaaatgtggcaaaatatgaacaattgttgaatctaggaggatataccggtgttcattgtactcttctttgaacttttctatatatatgaaaaaaggatatatatatccttttttaaaaaggaaggggataaatagttttgctgagtggcagttgcctggtagaagtgtgacagctcctgtccagggggagatggctttggtgcttcctgaggaagagagaggtgatctggccctggcatacctgagtgaggcatcctaatgtgtatgaagggacaaaagttcacccttgtggaccccacaggccggaggcccagctctacttgtgccttgttttatgttttgtttcaggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaaggtaagcaggctggaattctttcatatggagcagaagctgactgctaatggactgccttttttttttaaggtgctgaatgaattgattagtgttttttatttgagtatttattcacttagttaatatatgttttttgagcaactaaaatctgcatgttactgtgcagtcagtaaatagatacagtcactcccttcaaggagcaaacagctatcattcaaatattcaagaacaggtggagggattagtcacaggggcaacatggaggtgaggaagcagggggcacagatggagagctgagagctgccttaaggagggggacttgagctcagttgtgtccctgattcatggatactttgtaggccctcatgaaatatttgaatgcatgggaagataattggaactttgagtgtggtgtgtgtcaggaaaatagtgagtgacaagcggggaaggtaggccggaagggcctcaaggcctggctaagaaggtgtggatcttatttaatagacccagtatgctttaaaagggttaatgtgtcactggtgtggacaatatatttagtcaaggaaggaaaggaaaaataagctgttagttgatataaagtactttttattctcttggattctctctgagcattcattcaaacatctgatgaatacatgtttgtttggtggaaggggagtaattaagaggtaaagggacgaatgagacagcccattccttgaggaactcttaggctggctgtgaaaacaggctgggatgttgttctgaaacactgggctcagtgctatagtaaaaacacattccaagaggtgtgggcccaagcaggggagaagatggtagtgtgcccatcatttggggactgggtctatgtttagtttttgcactgagactctcgtaatgagcaaatctgggcggtttgagggaaggaaaatgctgagcttttgggcagaagggtgttttagaggagaatgttctgtgatctcatttctgttctgtcttaaagtggaagaagataggagttatccactagcagtcattaccttgaacttttgtagtgtgctgagacgttacatatggctgtgtattaggcatattttatccttttgttctgaaatttctctggttggagatagttaagtatttcaagcaccgacactgagatttaaaaaaaccatagtaccattgcactgaaaaatgttaaataaaattaaggaaactagttcaaccacatatatacacattattgagaagctaagcagttaccaaatactaacggataatgttctaaaaatggtcagttatgtaaatattttggaacctgaatgcatttttcaatagaaactactgtggtgttagttggctttctaggtagttctccagtacttccagaatgtaggagaaaaaccacaggattgggaatgagaagacctgggttctggctccagctttgtgctgtatagctttgataaatcattttattcctgatctcctcagtgtcttcatttgtaaaatctggaaataatgcctaccctggcaacctcacacggctgagatgtagaaacaagactctacatatgggatgctacatggcatattaaatgctttatgagtataaggtgacatgtttccaatgtcaaggattactatcagtgttgagcattttaccacccatgtatagacccatggtcctaattagcacagtcctaagattgaaaactttaactttagatcattaacactttttaatgcttttaagtttttgcaaaactgaaggactttctttgggaaattaaccttattttttttcacctacttcaaatactgtactaaaaactatacacttaccggaagagttgcaaggatagtagaaataataccttagttttttaagatagcaaatcatatgtagttatgtcctcttttaggaagcagtctataaaaaatccaaaatttaagtagataaattaggattcattctttattttaccaaagcagtaatatattgtgatttgaaggtgttcagtttattattaatatcatcttaacagagccaatttagtttggtgaaaagagtgctggatcaggaaccaagaaagagagggtcccttcgttaacactcagtttcacgacatttgctctatgggtgtattgggtgcactattatttatctggtattttcattatgttgactctcctttaacaaatggatttatagagatataactgacatataataaacttgcacatattttattttattttatttgttgttaattttttgaggcagagtcttgctctgctgcccaggctgtggtgcaatggcatgatcatagctcactgcagcctcaaccttctgggctcaagtcatcctcctgcctcagcttcctgagtagctgggatgcgtgctaccacacttggctaattcttaattttttttgcagagacagggtctcactatgttacccaggctggtcttgaactcctgagcccaagtaatcctcctgccttggcttcccaaagtgctgggattacagtcatgagccactacacccggccaactgtgcatattttaaagtacaattaatatgctttggcattatatataacatctgtgaaaccattgccacaatcaagataattttttaaaactcaaatttatttaaaaggaaacctttatatcattagggtttttttgttgttgttgttaattatgttttcgaaatcagttgggaacaaatacatatttaaaaatatttatccatgtgccacccagaattaccttgtctatcttgtatcacactatgagaagcactaccttaagaaatttgtatctcttctttgggccataggttcttattttgaaaagtaagatagttggatacttttcttcctaggcattttgttatttatacaatgaactcaaacctgaaagatatagaaactatggttttgtttgacagtgaaggtacttaccaggaagggagggatttttgtgtgtccaggacccactaaaacagtgcctaccacatagtaaacattcaaaagtagttgttgaatgaatgaaggataaatatcaattaggaatgaaattatctctgagaattaggctctcagtcaatgagaaaaaataatatgacatcacttttttaaaggaatacctgttacatttatttcctcatagaactgtcataaaatcagctcctggaactctataatattctttaaataatccagaaagagttaaggaaacatatccaactaggtacaaagcaaactttgtatggtgtttgtttatctttccgtggtatacatttcaggactgttaatgtctcttaaaatagtgtgggaaggggaaaataggcaaagctcaaacagttagatgggtgctctttaatatttatttctttaaaaggattggtaggagaggaagatgaaagtatgaaaaggaagctatgggtgtgtttactaataaccataacttctccaagctctcccagtgggccattaactcactaagagttgactgtaaattcctttgatattttttaggaaatagttccatttgaaacagtactatattgaggagttttggaactcttgatctggtgtgatggtctttgtgttgatgtaaaaatttacttctcatctcttctttttcttttcttagcttcactataacgtgactacaactagattagtgaatccagatcaactgttgaatgaaataatgtctattcttccaaagaagcatgttgactttgtacaaaaggggtaagaagcacatttacaagctgttgcatttattagtatcttttggactttgagaaaataggagttggttgggcgcggtggctcacgcctgtaatcccagcactttgggaggctgaggtgggcagatcacttgaggccaagagttcaagttcagcctggccaacatggagaagccctgtctctactgaaaatacaaacaattagctgggcatggtggcacatgcctgtagttccagctacgtgggaggctgaggcatgagaatcacttgaacctgggtggaggctgcaatgagctgagatcacaccactgcactccagcataggtaacagagcgagactctgtctcaaaaaaaagagaaaatagaagttgatctcctcacccctgtgctttagaaaaaatgtatttctcccacctcattcccaaaagcttttgaggtagtgttattgcttataatttattctcttttgtttggttcaagctataaaagttttagaagcacagatattgtcccactttatttcaaaataggaaaattcaaaattcttctggctttcttgtagatcctctattttcctttgattgtctgctttacaataatatttataaattataatctaaatttgtgagacatttcaaatgaatcagggatttatacagaatccttctcttcatgactggctgttttacagggctgggttttcagtgctttaggaagttttttcaccttacctctctcccgctgttgaaggaactgccatcaaagcctccttggttatgatctcctggtctcaatagccaggcctcttctggtcacccaagatggccgtatttctaagcatttccattcaattatttccctttaaaatttctttattaaagcaaccagaagagacatgcatggatttaaacatgtaaatagaatagtcaatatagagtaagatttgaagaaacaatcttgtgcagatataatttttagtttttagttatctgtaaatgttggcaagcattccttctgtgaaccctggcattcctctcaggcttcattagaacacatctctcccactctgatctcttcttcatgcttggggctatgagcctctgggcatacctctgtcacaggtctctcaatgatctattatctaacatgtgactaaattgttctatgcctcatcttcttgtcaagaatcttaacttcagggtgctccttttggcatttttgatgttgactgcttatttttgagagatcaagcctctttcccaaaacacatgactaagttagtaagaaaaagaatattttggtacataacagtatgaaacagaaaaaagtacataactgaaacaatgtaacttctccacacatctgtggaacagcacttaatcaggaacccttaagtatttagggaattgaaacttaaaatcagtcctatttattgaagattggtaagacaaacaaaactctaaaatagaatgtaaactaattaaatattattacatgaattaaatttatacagctttgcaggatcatacgtatgtcttaagatgtgtttcaggcttcattttgactgggcctttccattctcagagtagataatgcggcagttctatctataaatgccgtacgtttcagttatgggaatataccatttccttgggctttttcttctgcttttctttctgccataaagtgatgtgatgatcgtcataagaggttatctctcattactaattagaaaaacctcaaaaacacacgtgcctttctgacaggttactggcttcagctttatttatatgaaagacaagtttctgacaaggctcacacacatgaaatattatctttcttgcgctttcctttgttgtgaatgttgtggaaatgcccaatgtttgcggattacacgttgaaaggattgcataaagaatgccagatttcttgagcatgaatggcatgtatagctatgaaacaggggcttttctttggagcaagggagacttgtaataaagccttttcatgcttattcttaggatcctagttcagtttctgggaaaacaccagtcatactctattactaaagcatagctaggtcatttggaaactgtaaacagtaatacattgcttaatatgaaataatggttcatttcctccactggcctcctagaggcttagaaaactcttatacagaatatggttctcctactaactagcttcttatcttgtttttcacagttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatatagcaggcttctcttttttgtatttgattttgatccaaataaaacctcaaatggcttcctgactattaagtagagactatttggagtatgttttatctgttatcaaatatgccttgggcagaaaaacagataagaattcatttgcataattttttcctgtctgatttaagtaggatttattgagatcgttaactgtcacagctgtggttaccagagttaaacaacacatttaatatgttgaataaaagagtattgactttaagtatgtttggtcaacaaatgataagtatccgaactatgaaccccccctgaaatgttactttatggtaatttccctaagtctcaatgttggccccaaatttgtatttttatttcattttattggtctccaaaggctagaactcaagttatattggtatggatttcaccaattaaactagttggagaaaaaatagcactccttctggtcagtagtgaagggaatgttttgtcattcatttattcaataaatgtttactaagtgcttacaagcattaggtcctcaggctgaagctgctactgtctagtaaacccaaggatttactaactgtatttgtagcatagcgggacccacccactttgcatggaattagaaatgaattcttggaagaaacagcatttgtcattgaaggatatataggagttcagcagaaagagaagagtgaggagtatgactttttttctttctttctttcttttttttttgagacgcagtctcactctgtcacccaggctggagtgcagtagcgtgatctcagctcactgcagcctcgacctcctgggctcaagcagtcttcccggttcagcctcccaagtagctggtactacaagcgtgcgccaccacacccagcaaatttttttactttttgtacagacagggtctcactatgctgcccaggctgatctcaaaactcttgatctcaagcagtcctcccacttcagccctccagagtgctgggattacaggcatgagccaccaccccagcttgggacatgacatttttgagagaacaatatgtgcaaagacagggaattataaaatgtcattatgtgtttggggtagaagcagaaggtagtggaagcgggaaatgacagtagatgaggattgaaagtttagatggaaataagtcatgaaagtacttgaatgccccattaaaataagtgttttggcaaaggagagctgtcaaagggtttttaatattttaacaacagctttgttacgatgtaattcatatatcataagatttacccctttaaagtgtgtacaattcagtgggggtttaagagtgtattcaggtcgggcgccatggcttatccctgtaatctcagcactttgagaggccgaggtgggtggatcacctgaggtcaggagtttgagaccagcctggccaacatggtgaaaccccgtctctactaagaacacaaaaaagtagctaggtatggtggcatgtggctgtaatcccacctacttgggaggcagagacaggagaatcacttgaatctgagaggtggaagttgcagtgagccgagattgtgccactgcactccagcctgggtgacagagtgaaactccatctcaaaaaaataaataaaataaaagtatattcatagttgtgcaaccatcaccacaatgtaattttagaacatttttatcatgtcaaaaagaagccccatacctgttaccggtcactccccataccccaccccccagcccctggccaccacttacctactttctgtttctatgaatttgactggtgtatgtcatataaatggaatcatgcaatgtaagacctttggggtttagttatttttacgtagcataacattttcaagatttataatgtagcatatatcagtacttcatttgataactgaataatattccactgtatggatatgtgacattttatttatcacttgatagacgtttggattgtttccacttggctattatgaatgctgctgtgaatgcttatatacaagttttgtgtggacatgttttcatttctcttgtatatatacctaggagcagaattgctgggtcatttaacattttgaggaactatcaaactgtttttccaaagccactgcaccattttatgatcctgccagtgatgtacgagggttctaacttttccacattctgtcaaacacttgttatctgtttttttaattttagtcatcctagtgggtgtaaagtggtatggcattgtggttttgattgtcttttccgtgatgattaatgatgtagagcagtttttaatatgcttttggccatttgtatatctttcttggagaaatgtctgttcagatcctttgcacattttaaattgggttatgtttttattgttgaattgtaagagttctttatatattctaggtatgtctgttaccagctatatgataatatatataatatatgatatgcaaatgttttttccattatgtgggctttttaactttcttgatagtgtattttgaagaacaaaagttttcaattttctgaagtccaatttacctatttttataaaatatagaggtatgattaatcttctatccctatgggaagtggcgtggtttgaaacaatgattctcaaaagtttttgaccctagccacagcaagaaacaagtacacatgatggaagcacttgtagtgtgttagtagtatctatctcatttgcttttaatttacgtttccctaatgactttgggatccatcacatataaacatatatgaagcactgcttagccttactgtaagtgacaacatattctattttctcttataaacatctagtctgacaattgtaatctttaaattagagttctttagcacatttactttaaaatccttttgggggatcaggtttattgagatataatttacatatggtggaatttaccctttttagatgtacactttgatgagttttgatgaatatatgtagttgtgtaactaccaccatagttgagattagaatgtttccatcaccctaaaaagtttcatcttgctcttttatattataggcaatcctttcttctcccaggcccttgcaatcactgataggacttccatctctatagttttgttttttttccagagtattatataggtggaatcgtttactacatgggagttgggtataacttcttttcatttagcatgatgattttgagacttatccatgtggttgtctatattagtagctcattttttattgttgaataatagtttgaataatattgttgacagtagtcaattggatataccaaaatgtgtttattcaccagttgaaggacttttgagtttttacttttgggcttttatgctgctgtaatcatccgtgtgcaggttttgatgtatgcatgtgttttctttttttttttttttttttgagacggagtcttgctctgtcacccatactggagtgcagtggcgcaatctcggctcactgcaagctccgcctcctgggttcacgccattctcctgcctcagcctcccgagtagctgggactacaggcgcctgccaccacgcccagctaatttttttttatttttagtagagacggggtttcactgtgttagccaggatggtctcgatctcctgacctcgtgatccacccgcctcggcctcccaaagtgctgggattacaggcgtgagccactgcgcccggccatgtgttttcatttcacttaggtaactatccaggaatggaattaatggatcctgtggtcagtgtgtttgtagaaggaactaccaacagttattagcacatatgagaggtttttttgtttgttttgttttctttttgagacggattctccctctgttgcccaggctgcagttcagtggcgcgatctgggctcactgcaaccttcgcctcctgggttcaagtgattctcctccctcagcatcccaagtagctgggactacaggcacgtgccaccacacccagctaatttttgcatttttagtagaggcagggtttcatcatgttggccaggctggtctcaaactcctgatctcaagtaatctgcccactttggcctcccaaagtgctggcattacaggaatggagccaccgcgcccagcctgatttctttttttaggtcatgtcaggaaagatattgattcttttgattcgtgaacatggtttttggtcgtctttaatttgtctcatcagtgcctccatgtgtttttgatgcctttgaactggtatttttaaaatttcaatttctaattgttcattatagaaacacaattgggttttatatattggcattgtattttgcaactttcctaaactcactagtaattctagtagctttttttggtagattcttaaggattttctgtgtaaatagtcatgtcatttgtgaataaagccatttttttttccttttcaaattttgtgccttttatttcttattcttaccatatcacattggcaaagacctccagtatgatattgaataaaagtggtgagagaaaacattcctgccttgttcatgattttatggggaaagaataattcttttaccattaggtatgatgttaactgggtttttcatagatgtttgccatcagttcaatgaagagcccttcttttcctagtttgtttagatttttgttcatgaatgaatgctgaattttgtcatatcctttttctgtatcaagacgattacatgggttttctcttaaatttgtttatatagtgaattacaaccaatttatttttaatataattatatagttgaatttacagctaccattttactatttgtttttcttttaatccacccattttatactcatctttctctccttgccttcctttagttcaaatactttatattattttattattcaccatctattaacatgttatacatttgtttgctcccttgttagtggccatactagattttaatatgcatgttagtttattatagtctaccatagcattttccaaacaaagcaaacattttccaatagtttaaatacattactcctttctgcaatttgcattattgttgtctgcattttaaatttcaaaagacattgcagttactgtgttttacaattagtattcatttagatttacccacttcattgcccttgatttcttcctgcatttctatgtttttatcttgggtcttttttttgctaaacttggcataaagaacccccttttatatgcgttttagtgcaggtctgctggtggtaaattctcattttgtttgaagacatttttattttactttcatgttaaaaagattttccccctaggaatagaattccagatgggcaagtttgctttcctgcctgttctttcagcattttaaagatgtcattgcattgtcttctggtttcaatcatttcttttgagaaatcagctgtcagtttcattgttgcttctttgaaggtaatgtttcttttcctctggctgcttaaaaaattatttttatttgtttttgattttgactttgactttgatgtacatttttttgtttgttttgttttctggaatttatgccggttggagttagttgagagacttgaatctttatgtagatgtcttaccagttttgaaaaattctctactgttatctcttcaaatactgcttctgctctagtctttccttctgaggctccacttacatgtaagttaaaccttttccttgtgtctcacatacttttattcccttttgtatgttttccactctttgtgtgcttcagtttacttactaacatgtcttctagctcattaactttgtcttcttgttgtgtgtaatctgcagtcatacttatgtattgattgtttttatttttttaatggagtctttctagacactgaaaaagattatttcttttttaaaattgtaaacattttgatttttgaaatgtttttaagagatggattttcactatgttgcccaggctggtctttaatcctgggctcaatgagttaaatccagctaaccatttttggctgcagggctcaagtgatcctcctgcttcagcctcttaagtagctgggattgcaggtgtgcaccactgcacctggcttatattgattcgtcagtgtagctattgtgtttttaactttaaaatttttatttgattaaaacataattctccagtgcaatttttcttcttttcgtctcttcattttgtcttgttttcttggacataaatctcagcaatttttaaaatgtccttgtctaataaaactctagtttcagaatcacctgtgggtaaatttttattgtatattttttccctttgtttttcaacacgtttcttagaatgtctagtaatttttattgaatgctagatactgtgtattaaaaactgttaaagcttcagatgatatcttcctcaaggagaattcagtgtttctctgtcatgcagagagggtcaagggtgatcaaattaattccatcagtactgaactgatgttttcagttgaaccagggctttcaactgagagcctgctgtatttaccaagatccatgctcccaacaggtcctgaaagatatctaagttttgcgtcctcaacactacaagattgtggaaaactgctttggttagtttttggtttaatcttttacttccagctttgcacagcttcagaatgtcttggggagactgactatgtgtttgaggctccccaagtctccagttttgttactgtagccctgtacaaacatacaaagctctgctgtttctctgatccttggcagtgcccctctgtctggataaagcctggggtcacctctctgcaggtctctcctctccagattttggttattcatcctcattgcttcagcagctccctgatgcttttgaacactttttaattttttatttctttaataatttttatttcagtagtttttggggtacaggtggtttttggttacatggatatgttctctagtggtgatttctgagattttggtgcacctgttacccaaacagtgtatactgcaccaaatgtgtagtctcttatccctcacctacctcccaccctgccccctgagtccccaaagttcattatatcattctggtgcttttgcatcttcatatcttagctcccacttacaagtgagaacatgtatttggttttccattcctgagttactttatttagaataatggtctccagctccatccaggttgctgcaaaagacatttcattcctttttgtggctgagtagtattccgtggtgtatatataccacattttctttatccactggttggttgatgggcacttatgttggttccgtatctttgcaattgcaaattgtgctactataaacgtgtgtgcatgtgtctttttcatatgacttcttttcctttaggtagatgcccggtgggattgccgaatcaaatggtagttccacttttagttcttcaatgaatgtccatactgttttccatagtagtttgaacaaacatattttaatccttttttttctaggtctttgcaggagtgttaatctgccacaaactattctattctactttgagggagaagtctattttattcttaaatatgcagattaaagcttactcagtttatttcatgacacattgactagttgcaacctgcagtttatgaaatgcataaaggataaatgtgtgagacaaatccaggagatgggtagaattatcagattttaggaagtgtttagttgtcaaaggggaaggagatggtggaatgaagaatgcgctgatttttctgactcagacatccaggtggataggcaagccatttaccaagatggagtgataaaacaggagaaagatctattttagagaattgagattaagtttacttttgtacacattgagtttgagatacctatatgacatccaagtggaaatttctgatatgcagaaagaatcacttatttggaacccaagagagagatgggagctggagctgtgactttgttgctcattagtagataggtagaagttttcacaccaattttgtacattttttagttaatcacatcaattcagctgacaaatgctattttactacccatcaggctggatcaagtaaaaacaggtactctgctagttaggctaaacattttctttctttctttctttttttttttttttttctttttcttagacagagtctctgtcacccaggctggagtgcagtggtgcgatctcggctcactgcaacctccacctcccggattcaagcaattctcatgcctcagcctccagagtagctgggattacaggtgcacaccaccatgtctggctaatttttgtatttttttttttttagtagagatggggtttcaccatgttggccaggctggtctcgaactgacctcaggtgatccccctgcctcggcctcccaaagtgctgggattataggtgtgagccaccacacccggcctaaatcttttctttaaggaaaataaaacatcagtggttgccatatcatctaaaagctaccatttagttctaattctatagaaccactaggaaaattaaaggaatgtagacatgagttaggcaaatgaggccggactagttcccgagaggcaaatatgatcaggttgctggcactaaactaaatctgcagagtggtaagtcggcctcatcatccactggccagccacacctaggcttctttgtagggcatttaggaatcttacatccagaggaaggcagtatgaagagatgataagggaacttatggttgaagaaattaagtgtttggaacctgagaaaactcagggcattaccctcaaacatctaaatgactgtcacgtgtgggagattatgagacttgttttagcaggctgtattggggttctctagagggacagaactagtacgagagagatatatatatctcctatttattaagtattaagtttattatttattaagtatttaagtttattaagtattaacttttaattattaacttaattaactcaattaagtattgagtttattaagcattaactcacacaatcacaaggtcctacaataggctgtctgcaggctgaggagcaaggacagtcagtctgagtccccaaactgaagaacttgggagtctgatgttcaagggcaggaagcatccagcacgggagaaagaggtacgctgggaggctaggccagtgtagtcttttcatgtttttctgcctgctttatattccagccaccctggcagctgattagatggtgcccacccagattaagtgtgggtctgcctttcctaacccactgtctcaaatgttaatatcctttggcaacaccctcacagacacacccaggatcaatactttgtgtctgtcaatccaatcaagctgacagtcagtattaaccatcacacaggctaagtaagtccagtgagaagttggaggtagaggttgcatcttactcatctttgtgtttccagcatgtagtagagtctggaacacatcagaggctcagcagatgctcataaagttgaatcacattgaacttgagctaacactaaaaagctttcagagacactcaaaactacctgacaagagacagggctgcttatacagtggtttccttgttgttggagttgttcagacattggacaaccattcatgggatgttgtcatagaagggatttaagtattgaactaaatcccattgtcttaaaagcttcctttaaccttagcatctgtgatccagtaacaatatggaagataatggatcaattatttgggtgtttgttggccgtaatagggagcaataaaataatgatcacagcagcgatcatatattgagcacccactatgtgccagacactatgctgaaaaatttatatcaaggattggcaaacttggcctgtgggccagcctgtggcttctttttgtgatgttttattggaacatagtcttactcacattgtctgtggctgctttggtgctacagtggcagaattgagtagttttgacagagactgatgactctgtcatcagtataaagtattttactatttgaacctttacagaaaaagtttgctgacccctgatttaggtaaatataacaactctgcatattatacatattaactcattaatctttacgttaactctgtaaggtagatggtgtccctttttacagaagaggaagctcaagctcagggaggcaaagtaataactctcaaggtcaaataacttataagtggtttggattggaaccaggtgtggcaggctccaaagtccatgttctttcttatactagaaatagaaggtctacctctctcctgaaattgtaccatatatgaaagcatgattatatatgatatttattaagacattgcctttttatagcagcaatcttacacaaactgttgaagtataggaaaacttcaccagttcagaccagattactgtgtatttactacagttgagagttatgtgattcttatttgttaaagtaacaagttcagagtgttttcctctgaataagaatagagtctactaagaaaataatcaaaagactttcagcttctaggttcctctgtaatttcatgcattttgaagaactttctgttgttttgtaatatagggcctacagcattatataattttaaaaaatcctattctttgcaatgatttataatgcaaatatttattaataattgtgagactaatctctttacaaactagtgagattttgtgatagtcttaaaaaatgatgtaatttgtttatctgaattaatttatttaggttgtcccataagcttcctgaaaaaaaaaatatttttccaattctttccatcttctccaaagaggattacaggtgtgagctactgagtccatccctgatgatttattaataattatcattgactttgagatatgtatacatacatttgaataaagatatatcctgggacccttcttcaaacaaatagtgaagccgcactgaagagcagatttagcagagaatagcagaaagcaccgcacaaggagtctgaagacttagcttctagttctgactcccacttactatctataaaatctcagatatctacaatctctttagtagagcttacctctttcttaaccatctattttctcatcttcataatgaaataataataatatttatcctgtcaaataagatagtaggtacaatgatcttttagaaaccacgaagataaaaatgatcaagacatctggatatcaggtggtggtattaatagttttgttgttgtgagtttatttgtgttacacaacagatctggggtgcctgttgccaagtgtgggggcagagccaactgcaataaatgtggagtgtgcctctctagactgtggtacagatacagatgcgacttcactgctcttttcctaggtagatggactctagctggggctttttctggctagcccaatactcatccagcaggctctacatcaggatttggggtgaaccttggcagagatttagcttgtttctgagttaaaggaactgaaagaagctgtgggaaaggtatgggagactctggaaaagggattgaaaaaatgaaggtactatgatattaagtcctatgttcattggtattcccagagtgttgggtattgttttgaactgtaaggtgttgtgaggcacctttctttggacagtaagtttattgtaagaactatctttcacagaattcctgttcattaccatggcaaaatctcctgcccccactgccacgtctaacagtatttggagtaatcaaagagtaagcaagagcctgaaggttaatgtattaaaatgatgtgattcagtgcctttgatgtttgactttgtaatgcggcatctggagcacatactataagcaggagggtgaggtgatggcgacggttaacatgcaagtgtgaactgctgaaccctgagaaggtctgtctattctggcatcagtggagatacagatcctcagaacccaggcgacttgatgatgttgttggaaaaatggtaagaagctaaggaaactgcgaataaaatggattagacaggaaaatgagactggaacacagagaatctaggatagtggagattggaagggcctcagaataaggacctggaagaaagagcacaagcctgctctaggaaaaccttgtggccaggtggtggctacacagacatctggttcaaccagaagtcaaaaggcagagtatctcgtattcaaacagaggatccagcaccatcaactgttcagagtgcttctttatcagtcttggatcttcagataaactacagcgagaagccttacccctatgcaggagggcctaggggaagagttcatgcccctgacgggtgaatggtttgaggtatctggaaggtctggtctgggctttaacctggtgcttgctaaaggtggggtccatacctcaaaactgtcatctctagaaatgagtttgattataagggtctggagggaggagaggagcatgttgaggggtgaaagaattcaacagttacttggatgccgtcctcaacccttggatgatcagctattacctgaaagcgttaaagtaacaggaggatcacttgactgtcggtgaatctttcccttagtcctgtactttttgtgccttgggagctgtctgccccgggactgatgtttgaggagtatggagacacagagtggcagggtgaggagaacaaaatgtcaaaattgggtgtaatgctggtttctcacttatcagacacatgacccagaggaagttgctttatccctctaattgctttagtttcatctatatgaaactaatgcctgtgagacagtagttttgtaaagaagaaattagaatgtctagaaatgtcctgtaaatgacctgaattaatgtatatgagtcatagaactttgcacaaaatggatgtttttaaaaatgccctgggagttggcttaacatctaaaaataagttaatgtaatgcaccactttaagagaataagagacaaaaaaccctacatgatcatttcaatagatgtggaaaagaattgacagagtccaacacccttctgtaataaaaataattaacaaactaagaataggagggaacttcctcagcctgaaaacccaaagttaggaccatacttcacggtgaaagattggatgctttcactctatgatcaagtacaatgcaaggatgtctgctcctgccacttctcttcaacattgtactagaagatctagccagggcaattaagctagaaaaagaaatgaaagtcatccatattggaaagaagaagtgaaactatctctatttgcagatgacatgatcttgtatatataaaacactaaggaatacacacatacaaaaacaaactattagaactaataagttcaacaaagctgtgggatataaggtcaatatataaaaatgaattttgtttctatacactaacactgaagaatctgaaaatgaaatttaaaaaacaacaattaagaaagaaaaatacttaggaaaaaagtgtaacacacgtacagtgaaaactacaaaacatcattgaaagaaataagacctaaatggaaagacatcccatgttcatggattggaaaacataatgttgttaagatggcagtgctatccaacctgatccaacagattcaatgcaatccctatcacaatttcagctgtgtgttgtagttgtttttacagaaattgacaagctgattctaaaattaatatgaaaatgcaaagacccacaataaccaaaacaatcttgaaaaggaacaaagttggaggccttacacttctcaatttcaaaatttactacaaagctacaataatcaagatggtgtggtactggcatgaggatatacatataagatcaagagaataaaattgagagtccaaaaataaacacattataattgtattatttttctagttctctcataataaccagaaatttagtggctggagacacagatttattatcttacagttctgtaggtcagaggtctatcacaagtcccaccaggccaaaattaaggcactgacagggctgcattcctttctgtagactctgggtagaatacattttcttgcctttttcaacttctagaagcagcctacattctttgactcattgttcccttcctctattttcaaagttaagagaggcaagtcaagttgttctcacatcacatcactctgactttttctgtagtcacattccctctgactctgaattcttctgtctctctgtttcacttttagtgatgcttatgattacattgggctcatccagatactgcaggattattttcctatattaaggtgggctaaatggcaaccttgattccatctgcaactttaattctcctttgacatgtaacatattacatctgtagattccacgaattaggatgttgtgtgtgtgtagggggtcacattgttctgattattacaatggccagttgcgttttgacaaagatgccacgacaagtcaatagggaaagaatagtcttttcaataaatggtgctagaacgactagatatacacatgtaaaaaaaatgaagttggattccctacctcataccacatataaaaactcaaaatggatcagggacctaaatgtaagaactaaaatgataaaaattcttagaagaaaatgtaggagtaaatgtgaccttgggttaggcaatagttccttagatatgctaccaaaagcacaagcaacaaaagaaaaaagttacatattggacttcaccaaaattaaaaagactttttgcttcaaaggacaccatcaagaaagtgaaaagacaacctacagaatgggagaaaatatttgcgagaactcgtatccatttgcaaaaagacttgtatccaaaatataaaagaattcttaaaactcaacaataagaaaacccaatttaaaaatgggcaaaaggtctgaacagatgcctcaccaaagaagatatacagatggcaaataaacatatgacaagatgaaacatcatttgtcattagagaattttaaatgaagagataccactacacaccgattagaatggctaaaatacatacacacacacacacacacacaccaaacaaataccaaatgctgacaagaatgtggagaagcaggaactctctttcactgctagcagaaacaccaactgttatatccactttggaagacagtttgacagtttcttacaaaattaaacataatcttaccatataacccagtaattaagctcctaggtctttactcaattggtttgaaaatttaagtccactcaaaaacctgcatatgaatgcttagagtggcaatttataattgctaaaaattggaagcaaccaaatgtccttcaataggtgaatggataaacaaattgtacatttatacaaaggaaaattattcagcagtaaaaagaaatgggctatcaagccataaaaagacacagagtaaacttaaatgtatatttctaagtgaaagaaatcagtctgaaaatactacctactgaatgattccaattatttgacattatgaaaaaggcaaaactatataaagacattaaaaagattcgtggttggcccagtgcagtggctcatgcctgtaatcccagcatttagggaggctgaggcaggtggatcatttgaggtcaggagtttgagaccagcctggccaacatggtgaaactccgtctctactaaaaatacaaaacttagctgggcttggtggcagacacctgtaattgcagctactcaggaggctgaggcaggagaattgcttgaacccatgaagcggaggttacagtgagcctagattgtaccattgcactccagcctgagtaacagactgagactctgtctcaaaaaaaaaaaaaaaaaaaaaaaaaaaaagatttgttgttgccaatggtagtaggggggcagggggagggtgttgaataggtgataggtgaagcatagaggatttttagatggtaaaactatttcctatgatactataatggtggatgcatgacaattgttcacaattggatggtgaatacttgcaaggtgaattctttcaccgtgttggcaaagctggtctggaactcctgacctcaggtgattcacctgcctttgcctcccaaactgctgggattatgggcatgagccactccacctggcctccttctccttttccttcttctcctcctcctcctcctcccgctctccgtccttctcctacccctctccttcctcctcctcctccttttcttatccttctccttctcctcctcctcctcctttctcctccttctcctcctcctcctcctttgagatggggtcttgctatgttgccccatgattagctatttgacccaataccatttattgaatattaatttaatttcttcctcctcctcctcctcctcctcctctgagatagggtcttgctatattgccaaggcagatcttgcactcctgggctcaagtgatcctcttgcctcagcctttcaaatagctgggactacaggtgcatgtcacggcacccagcttattcattcttggctcacttctaacttcatttagctcatttatccagtcaacattcattaaatttgaacttcatacttgttgctaggtggtatatggaaaagtaaatatgtattatcctgccatcaagttgcttagggccttagtgaaaagcacaccgggtgccaccaagatgcatacaagtttacacataagattttttggtgggtcctttctacacaattttctctgtaagccacctgtttctcatagcatatgagagaaaggtctggcatatgacctcttattcctactgtgaggcacagtagaattctcgaagaccagctgtggtgttgaatcactgcctatgaggctgtgcacattagtgggaaaagcactagattttggaactcaggcacttggactccagacctggaacaccttgggtaaggcactgcttatttgcaggtttgtttctgtacacgtgcaaacacacacacacctaatttagggttcctgatagctgacatcacaaatgacatcagggcttgatgtgtaatttggaaaggtggagagtttacctatgtaacaaacctgcacaggtacccctgaccctaaaataaaagttaaaaaaaagtttcagcaaggtaaatagctccagcggggtagctacaaatagttccctgtgtgatgtaaaaatactcaaaatacacattccttcccaagatgctctggcctgaacagcacatctcttctacattgaggtgtccattctgctcacctgcttggtgtcctaaattctcaccctcatttggacaatctctctggaaaacttcagtcattcccttgatggagaagaagaacttcatagaagcataatccaaatggtcaaacatacagtgtatagcaaaagatgtaattttaggctgggtgtggtggcttacgcctataatgccagcactttgggaggctgaggccggtggatcacctgaggtcaggagttcgagaccagcctgaccaaaatggcgaaacctactaaaaacacaaaaattagccaggcgtgatggcaggtgcttataatcccatccactcgggaggctgaggcaggagaatagcttgaacccagggggcagaggttgcagtgagccaagatggcgccattgcactccagcctgggtgacaagagtgaaactccatctcaaaaaaaaaaaaaaaaaagaaagatgtaatttcataggagactttcaaagaagtttggtgggccaggcatgctagctcacacctgtaatcccagccctttgggaggccaaggcaggcagatcacttgagcccaggagttcgagaccacagtgaccaacgtggcgaaatcccatctctataaaaaaatacaagaattagccggacatggtggcgtgtccctgtaatccctgctactcaggagcctgaggtgggaggatcacctcagcctgatgaggtcaaggctgcagtgagccgtgattgtgccactgcactccagcctgggtgacagaggagatcctgtctcaaaaaagaaaagaaaaagtttgatggctaacaggaaacttctcacatttgtcctgaatgacataaaccagaggccaaaggtgagagtggtgtacttcagtatttcagtgttagaggtgctaaaaagagctttggggaaggggccatctctcagcatttaatatttttatttaatttttgcattttaatgtatgcttaatgttaaatttgattttgttttgggctagataatagaattagaaagcattgatttgcagaatttcagagcccaaggggccctttagatcaaagtctacttcccttctcctcaccccttctcctgtccctgccatgtccttaactaagaggaggatctttttttagagagagagagatgaaaagaaatcacaggggacaagtccagggtgacaagatccaccatccatcacagctcctaactacaaacagttggagcctttctctttactctgtgagttttttttaattaaccttttttcatttttcctactttagaatttcacattatagtcctttgttcattctcctcttttctcttgataatgaaaatggatataatatgaacttaaactcacttgccctgggtcattgccagtgcttaataaaagtgtattagtatttgtagtaatgataataacccacagataatgatgtcgctaaagaccaaagggtccccttgcatgagaagcccccccttctagtcgccttgctttgccggatttaacggagaccttgactgcttctgatagtcattgtcccttctaaattatcaaggtttcatgaagacaagcattcttcacttaagggttttccagactgtctgatgtgctgggctctgtataaccttgttcctatgtcatcatatgtcatgctgcctcttggaaattgttccctgatgtttgcgaaaatgaactacttacagaaattccctttgtacacacacacacacacacacacacacacacacaccactattggaaatggttacagtcagataagtgggtcagggttgtgaggggatttgaagctgtgttgtgaggagtggtgaaaatagtggaggtggccaggctttgcagggagagactgaggaggagatgggacaggcgtcttcaaaaataggaagatgtgtgcaagaggaatttggcctcttctgggtagacccatatagtattaaaaagaccaaatgcatgggtataataagtctagtttggctcgatagaaggcagactttctttttagctgtctgggaaggaaagatgcttgccctggaagtggcaagttctccgtccctggagtgctcacgcagaagcatcagagtccctccactgggactgctgaggaggggttataaggattaggtggtgttggaactaaattacttggggtcaccttcaaaccctgagaggcaataattctatgaggtccttgacttgagaatctaggacctggattttaggttgtagagtggaaggagtttcttgatagaaagttcaagcgtaggatcaggctttaggaaggagaaattaagccctgaccaatggctcagcatctcccgtggccctattccaatatatgactaggtctaagccttaggcaaactgcagctagacccagcctttgtaaaccatggccctaaaaagtaggtgaagaagttgaagagaaatgagaaaagaaacagtaagtcatcaaagccaagagtggagacctttgaaggagggataattggaagtactggatgctgcagaggacaaagagtctagggaatgagaagagggccttggatatgtcaaggaggagccaggggcagtttctagaatgtggtaggggcagaagcttggcctcaggaagacaagagaatggtggggatgtggagacaagaagctcagaccacatgctcatgaatttggctgcaagaataatagggtagaggctagaccagtaagacctatgaatatcaaaggcagaagggaatgaggatgaaggtgaggagaaattgcttcacattgtagacagaaagtatgttaggtagaggagagaggacttcagtacagtatttacagttgtaaagttctttccaggtccatgatgcagtttgttcttttagatagtgcattagtccattttcacactgctatacagaactacctgagactgggtaatttataaagagggggcttaattgactcacagatctgcatggctggggaggcctcaggaaagttacaatcatggcagaagatgaaggggaagcaaagcacatcttccatggtggcaggagagaaagagagtgggagtgccacacttttaaaacatcagatctcatgagaactcactcactatcatgagaacagcatgggggaaatcgcccccatgatccaattacctcccaccaggtccctccctcaacatgtgggaattacaatttgagatgagatttgggtgaggacacagagccaaaccatatcattctgccctttgcccctccaaaatctcacgtctttcttacatttcaaaacacaatgataccttcccaacagtcccccaaactcttaactaatttcagcattaacccaaaagttcaagtccaaagtctcatctgagacaagggaagtctcttctgcctataagcctgtaaaatcaaaagcaagttagttgcttctgagatacaatgggagtgcaaacattgggtaaatgctcgcattccaaatgggagaaattggccaaaacaaaggggctacaggccccatgcaagtccaaaacccaacagggcagtcattaaatcttaaatatccaaaattctctcctttgactccatgtctcacatccaggacacactgatgcaagaggtgggctcccaaggccttgggcagatccacccctgtggctctgcagggtacagcccctgcggctgatttcacatgctggcattgagtgcctgaggcttttccagttgcatggtgcaagctttcagtggatctaccattctagggtctggaggatggtggtcctcttctcacagctccactaggtagtacccccgtggggactctgtgtgggggctccaacccatatttcccctctgcattgccctagtagaggttccccatgagggctccactgctgcagcagacttctgcctagacatccaggcatttccatacatcctctgaaatctaggcagaggttcccaaaccttaactattatcttctgcacacccacaggcctaacaccacgtggaagctgccaaggcttggggcttggaccctgtgaagcagctgcctaagctgtactttggccccttttagccatggctggaactggagtggctcgaacacagggcaccatgttctgaggctgcacagagcagcggggccctggcccagcacaggaaaccatttttccctcctaggcctccaggcctgtgataaaaggggctgccatgaagatctgagcagcccctcccatcacaggagaagtttccctggagaaaatgccctggagatgttttccccattgtcttggttattaacatttggctccttgttactcatgcaaatttctgcagcaggcttgactttcttccctagaaaatgggtttttcttttctaccacatggttaggctgcaaattttcaaaacttttaccctctacttcccttttaaacataagttccaacttcagaccatctctttgtgaatgcatacgactgtacattttcagaaaaagccaggtcacatcttgaatgctttgctgcttagaagtttcttctgccagataccctaaatcatctctctcaagttcaaagttccacaggtctctagggcaggggcaaaatgccattactgtctttgctaaagcataggtgtgacttttgctccagttcccaataagttactcatctccatctgagaccgcctcagcctggactttattgtccatatcactatcagcatgttggccaaaaccattcaacaagtctctaggaagttccaaactttcccccatcttcctgtcttcttctgagccttccaaactcttccaacctctgcctggtacccagttccaaagtcaattccatattttcaagtattgttatagcagtgccctacttctggtaccaattttctgtatgagtccgttttcacactgctataaagaactacctgagactgagtaatttataaagaaaagaggttcaattgactcacagttctgcatggctggtgagacctcaggaaacttacaatcatggcagaacgtgaagggaagcaaggaacgtcttatgtggtggcaggaggaaggtgggggcaagtgccacacttttaaagtatcagatcttgtgagaactcccttactatcatgagaacagcataggggaaatttgccccccatgattcaatcacttcccaccagatccctcccttgacacatggggattaaaatttgggatgagatttgggtggggacacagagtgaaaccatatcagatagtaccctgcagcctttgggtatcagatgcacagacaggcatctgtttcagatgggacttgttttaaaggtaaggtgagaaatctctaggttttagggtgatcttagagtgtggctgtgcaggaaatgctcagaggtggaatctccaagggcacctttgacttacttgctgactccgtgatcactgtttctcttcacagcctgactctgctgaccgcctcttccatctgcatggctgcctgcctttgattttaccctcttcagattttcccaccattcctaccacatctctcagtctgctcttcagctttttcctctgccttccccttgattccaggctcttactttgacccccttctcttcatactcttcacatttctctggatgatcccggcatctcaatggcttctgttgggtcccaaatctgtatctctggcccagacctctctcctgagtcccaagtccctgtgtgcacaattccatttggatgttccatagtcacctaaaaggcaacatttctagagtcaaactactatccccccaaatctactttctgcatagtctccattttcagggtgatatacatcccaggtttcctgggatggtctcagttgaagcctgttgttcccagcataattattaataattctctcttttactccaaaagtgtcctggtttgtatgatacattgtacggtcactccatccattttggacaatggcatgaccacccattcaaagctcatgccggaaacttcatgtttatcctaaacgccctcttgcttccctcccacattctatactgtttgtctcattcctgtaggctctgagcccctggaggggaggggcagtgtcttgttcactctgatgttccccgtgccaagcatagtcttgcctaagaagatgctcagtagatgctgaataaagggcaagaagatggagttaactgatggaatgagaagccatggaaaattagagggaagggtggtcctgtggcctaacttctcatcctgcagatgaggaaattgaggcctagggtggaaaatgaacttgacccaggtcaatgccagagtcagtattagaccccaggtctccagtaacctctccatggctcttgtgtaggtggtttaagtcttcttcattaagtacagggacagctcagcagtcagttcttattaggcccttgtgtgtatgtgcgtgtgtgcgtgcatgtgtgtgtgtgtgtgtgtgtgtgtctcctgggggttttgtgtgtgccacagaggggaagaatagatgtcctttcttccaacaatgttcaaaggagctgagcaaacctttcaaggcttatataagagacattccaccattttcttttttttttttttttttctgaatcaaggtctcactttatcacccaggctagagtgcagtggcgcgaacacagctcactgcagccttgacttcctgagctcaagtgatcctcccaccttagcctcccaagtagctgggactacaggcacgtgccaccacaccccactaatttttgtattattattattattatttttagagacgaggtcttgctatgttgcccagactggtctcaaactcctgagctcaagagatctgcccatgttggcctcacaaaatgctgggattacaggtgttagccaccatgcctggcctccatcagttttctcttggagatatttttatcttcttagcattgccagaaggattaaaacaaaatctgatctcacagtttctcaggtattgtttttttctgatgttgctgttgtttttaaactaaaagtcagacgccatgaaacatcctcagcgtggcaggtaagtgggaggctatgatataatttattgttcagtcctgacatttgtgttggtggacacaaggaggctatttgactgctttagtagaattctccctgccttcttttagttcgtttccgattcttctcttaggctggtcttggctaataaataatttgattttgaaaaatatctttcccttttctgaaccttgtattctgagttcataaaatgagtaggttagaccatacacttcccagctgcttccagcccacaattctgtcatattaagttcctctccccattgcttggagaagacttagacatcatatccacaggttgagaacccctaatccccaaaccccaaatgctcccaaatctgaaactttttgagctccaaaataatgctcaagggaagtcctcatcggaacatttcagatttcagatttttggattagggatgctcaaccggtatgatgcaaatatttccaaatctgaaaaaatttgaaacacttcttgtcccaagcagtttgagtaagggatactaaacctgtaccatatatatctctaatctctctctctccacatatatatatatactattacatctgtgcttctgctttgttcttggccagaacgaatatctctcctttccttactcttgatacttaaattcatcatttcttaaatgtctaatcctctttcttttctaaacactctaataagcttattatttcaaccatttatatttaacattaaagtttaatcatgaagttgttaaccatagaaaattattaaataagtgagtttggaatgagcgtggaacagctgaaaaaatgagtgaatatttcaaaatgagcactttggaaaagaaatttatgcatagaaaacaatggagaattacaattaagagctctggggatctcaaactgatttgtccagctattacacagtcatttcaatttaaattaaaattgtaactattttctagtctactaaaaatatgaggtgtcacattaagagttttaatggtgcgttctctggggaatgcaaaaatgcaagactgtagcacataaataactctatattgaagagtggataaattctctgccaaaagtgaatatgataaaaacagaaatgacagtggattattttattccctctagtgaagcgcagcccacacattagagccaaaaaacagttcacagggtgtctaattccatatcactttgtcggaggttatgaaaagagcaacacaaaaaagtttagctggttgacgaattcaggcataaatgaggccatatattttgttcccaaagtaaaatattttttagctacagagagtaggttgatgttaatatttgatatccttgattcatagaaaattggattagtcaaggttttaaccactgtagaacacgtttaaggcaatcacacttcaggaggagaaaaaaaaaaaagtcaaaagcaggaggtgtgacttccaggaatagaatagtaggataaacactggtgtgtgtgtaggggtgtgtgcgtgtgtgtgtgtgtgtgtgtgtgtgtgtggtcatgtatgctagaatggttggtaagggtaggtggaagttctgatgatgggacacagaaaatttggaattttattgtaatacaagtgaattaagatgaaagcatcgagacatccaggtaaaagcatctggacatctggagaaaggaaagagttaattgaagaaccaggaacaagagagttattataactaagcttgacagagtttcctgggagccaaaataaaaaaggaaataagtgggtttcataattcttgttgtcatgtcaatatttgcctacttctaagctcttggagaaatttgttgtttagagcaatggttctcaaactttagaatgatctgggaagtttaaaaaattcggatgcatgagccccatccccagaaattgtttaatttgtctagggtggggcatgtacatttatgtatttgaaagactcctcaggtgggtgtgaggcacagccaggcctgtggctcagtggttttatggacaacgaattagtaattgctgttctgcagaagatgcagaaactcttaatatagccaattatcatattgattcttaatacaagaagagtattgatttgtatttcagtggaggtatttctaaaacaattcaaattcaggtttcctgccacaggaaattacaggcatctgtactttcagcaatccattcctgaaaatcagacattttctataaaaatgctgactggagcctattttccattatttcagatgggaataaaatacaatgtcatatgtcaacccaaaacctttaaccaaattttcctaaaaatataattacagcataatcaaatgcctttatatatgttataaactatcacattacaatggaaaaattacaacatcccttctagcattaaatgatcagttgggttgtcaacagatttttgtgtgcagtgacaatgtctcttttagtgccagccccatctgagatgtgacgttcaaaattgtgcatgtcgattctgacagtctactaatcggagttggaatataaggagaattttttcagtcattgttttgttcataatgtcacagtgaggtgtggtggtttttttttttaagatggattctcactttgtcgcacaggctggagtgcaatggcacgatcttggctgactgcaacttccacctaccaggttcaagcgattctcctgcctcagcctcccgagtagcttggattacaggcgcctgccaccgtgcccggctaatttttgtatttttagtagagacagggtttcaccatcttggccaggctggtcttgaactcctgacctcatgatccacctgcctcagcctcccaaactgctgggattacaggcgtgagccaccacacccggccgatatgtggtttttttgtagattcagggtgtacacatgcaggttagttacatggaggtattgtataacactgaggtttgggcttctaatgatcttgtcacctaagtagtgaacgtagtacctgataggtagtttttcaaactttgccttcctccttacctccctgcttttgaaatcccttgtatttattgttcccatctttatgtccatgtgcatccaatgtttagctcccacccataagtgagaacatgtgatatttggttttctgtttctgcattaatttgcttaggataatggcctccagctgcatccatgttactgcaaaggacatgattttgttctttctatggctgcatagtgttccatagtgtatatgcaccacagtttctttatccaatccactgctgataggcacctggattgattccatgtctctgctattgtgtggataatgctacaataaacatatgagtgcaagtgtctttttggtagaagcatttattttcctttgggcatgaacccagtaaatgggactgctgcgtcaaacggtaactctatttttagctctttgagaaatctacagtgagtttttgaagtcataaatataaatttcccctttttgaatatttgctgaaataatatattgaaaggtacatacattctatgaaatttaaactaagatgcattctaccaagaaaatgttacacagaaagacattctgtattttaaaacttcaagatgcatgaccatggttgagagttgaattagtaaggatgttcttcgggctgcagtaatagaacattctcgttaaagtgggtattcatagccagaaatcaatccagagctgctgttaagtccagcagcctaacaatacaaccaaaggctaatgccattcccacctgctttatgttttaccacattcgtggcgttggtgatgtctccgctcatggtcacaggatggctgcagtagctcagagcaccacatctgctgtcaacagagtccaaaagcagaaagggagggagtttgtatttttctgttttcatgctgctgataaagacttacttgagactgggtaattcatagagataaagagatttcatggactcacagttccacatggctgggaaggcctcacaattatggcagaaggcaaaaggcatgtcttacatagtggcagacaagagagaatgagagccaaatgaaaggggtttccccttataaaaccatcagattggctgggtgcagtggctcacacctgtaatcccagcactttgggaagccgaggtgggtggatcacatgaggttaggagttcaagaccagcctagccaacatggcgaaaccctgtctctactaaaaatacaaaaaaatagccgggcatggtggcgggcacctgtaatcccagctactcgggaggctgaggcaggagaattacctgaacctgggaggtggaggttgcactgagcctacatcgtaccattgcactccagccaagtgaaactccgtctcaaaaacaaaaacaaacccatcaggtctcatgagacttattcactacaatgagaacagtatgggagaaactgcccccatgcttcaattatctctcaccgagtccctcccacaacatgggggaattatgggagctacaattcaagatgagatttgggtggggacacagccaaacagtatcagaactcatcctataagcctctccttatatcgggagcaaggtttgtctttctcacaagccttcaagcaaaattctgacatgtccctagcagaaatgggtttcatggccatccacagctataaagaaggctggaaagtagttactgtgcatctataacctctatcatcatgcaaggaagatggaggagaagataggccagtggaaaggtctacagagtccatgctctatcatttatgagctatgtgttcttggctaggtatcttaccttccataagttgatagggttttccaacagagcacttttgcctgcatttgaagatatcacttttaaatgcttgacttgattgagaaagagaatatctttggagattctcagggcaccatggcatataaaaatctctaacaagttttgcagtaaaaagaacagtttaactgtgttaagtgcagtgtttccaaaatgtatttgactacacaaccttttttttttaaaaaattggaaacttgttaatatgctgtggacccaatgttctatggagttcttccagaaacacagctgtgttagattgaaatttcttgaagatggcagctccatctttaagttttcaggagtctcagtagagtttccaactaactgctactccttcaatcataggttcaatctctcttcctctgggaagacctctcctccatccaaacagggtcaatatcctgtcctgaccttggtttggtctgtatcctgtccacgtgtatcctttctatcctgtcctcttttttcataacaccataactgcaataaattattgagtataactataactatatgtcatctatcttgccagatagactgtaaactccctgacggcaagggtaatgtctggttcactgctttgtctccagtgtctaccacagtggctagcatatagtaggtgctcaatacatatttttgaatgaatgtctcacacgtgatggactatagaaatatttgtgtaatggacacattttgttttgttccctagcaccaaaccatcttcttctaggattacccgctaatcccctattttatctatatggtggggtgtttcccactagtaattggtccaggagtggttatttgggacagtaagctgtctcctagggcttttaaaatttgggatagaaggaagcttagatttctttcttctcagtgaatagaaacattaagaggcaaagctcaggcaccattggtcaccatatttctttatctttgaaccagagaactagagaaggcagagagagagagtgagagagagagaggatataaatatccagccagaaaagggaaatgaagagagtgtcctggcaaagtctgtacccctgggttttgcactgggaccctgccatattcctgttcatgggttccacgagcttctcttttatccttataataactctgtcttccgccaggtacggtagctcacacctgtaatcacagcactttgggaggctgaggcggggtagatcacttgaggtcaggagtttgagactagcctgaccaacatgatggaacccccatctctactaaaaatacaaaattagctgggcatggtggtgcatgcctgtaatcccagctactcaggaggctgagaaaggataattgcttgaacccgggaggcggaggttgcagtgagccgagattgcaccattgcactccagccaggacagcaagagtgaaactccgtctcaaaacaaaacaaaacaaaacaaaactccatctatctcattcaagctcattcgagttggtttcctgctacctgtgaatcctaagtaacacaatttgctaaatgaattaattatttggcataagtcagatgggaaaagaaagagaacgtagggtccttgcattcaccattgtgtataaagcagtgagcagagggactgcgttgaattcaaacttggtgaaccaggactcaagcagagcaagccaaattcaagaagaggaaacattcaatctatttatgtacacggtggttttgggggtcaaatgggttaagaagcatgcatgtgcttaaaaactgaaatacaaaaaatttttacaataaacccaaatagacattcttggaggaaaaaagactactaaaatcccaaaccacaggcattaccaagaacctgatggccaacattctgtagctgtcatcgtcccctcgaatgcccagacctcttctgccttccccacgaagagcactcagccccacgctgccaaagcacctggcccatctgcattctgcaggtgtgttcaaagtcattcagcttcttgtttcttgtttgccctacctgaagacactcaggctgtgtgaaggacaccagcaggccactgtagggtgactcttatgattgaataatgcatgaactcagcagtggccgggtgggagcctccccaagtgggtggtgggttgaggacagggtctggcctccatctgtggggacctggctttccagccgtgggatctttcagattgatggctcagtccatatggaagaagtacctttagtatgttttcttaaatgtttcttagctgggctggaaggcagtttggattgacaaattagacaatcgtgcttaacagtttcacaggatgctcatgtcccgttaatctcataggggcctcactatagctctggtgatacagggatcatggttgttatctatcatctgttgacagggaaactgagaccctaagaacatatgacttgcccatgagaagattaatcttctgggttgacttaaaaataatactcctagattaactgaattcacaagatgttctgttcttaaggcaagttggaatttaagaattatttctctagaaaaagtttggtattcttggccaggcgcagtggctcacacctgtaatcccagtactttgggaggccgaggcgggtggatcacctgaggtcaagagttcgagaccagcttggccaacatggcgaaaccccatctctactaaaaatacaaaaattagccaggcatggtggcaggcgcttgtaattccagctacttgggagactgaggttagagaatcacttgaacccgggaggtggaggttgcagtgagccaagatcatgtcactgcactccagcctgggtgacagagcaagactctgtctaaaaaaaaaaaaaaagagagagaaagtgtgatattctaatttccaaacctgtctgaaccaaaataaactagaaagattttaaaaaagacaaaatgctggaatccatttctatagattctgatttaacccggggcaaggtctgggaatctgtattcctagaaatttccccaggggttcctgaggagttgtaagatgtggaaaccactgttggattgaaggaaggcctggtgtgggggtcaggctgcctgcatccggtcttggcatcaccaccaactcctggggcctcactttctccattcatacaataaagagactggtttagaatagatgatctcaaaaaaatctctgcaaatccttacattctatatgatcttttaaaagttgcccatacagggctgggctttgcagagctctggtccctaaaggctctagaacaaagagaaccttgataaaagtgtcggagctgatgttgttggttgtattctcaacatctgttctctcttccccccacctaataaaattccagttttgtgctgatatcccttcctctcccatgcagtcatgtgcttgggaggaaatggacgtgcctttattatataagccaatcagaataattccattttcccagtcgtggtgcttgatcatgggcatgtgacacatttctggccaaagaaaattgagggaaggtttgttaggggcttctgggaaaggagggtcctcgctgttctggagagcttctggaagtgacactctctctatcaatggatgtaaacagggaagccgacagccctgattctcttggcagccatcttgcaaccagctttctgatgcagctcactgttgactgcagtgcagaatgatagcccatcagtcaggatgattcccattggctgcttaacaaacaaaccccaaatctcaatgccttacaacagggtttattacttgatcttgtaaaccccaactaggagtctggaaaaaaacttgcacgaggttctagtgaatggtgttcccccaagactaatatgctcaagttctaatccccagagcttcagaaagtgaggtattggagatacggtctttaaaggggtgattaagttagtatgaggccattagggtaggccctgatccagtctgactggtgtccttctaagaagaggaaattatgacacacaaagagacaccagggacatacacacacagaggaaaagactctgaggacaaagcgagaaggtagccatgtgcaagacaaggcaaaaccaaactgcagacgttttgatctttgggcttctaccctccaggccactagggaagaaatgtgttatttaaaccacacagtctgtggtattttgttatggcagccctggcaaccgaacacgtggtaatttagggcattaccttcctccagatgggtggttctgcaatccccttggaccttggggtcctctggatctggttggcagatgagggaaggcacaatggagacgtgcgtgtgggtggtctctgcacaccaggcttggaggtgatgcccttgtaccaacattctattagttagaactgagtcacatggccacatctacctgcaagggaggctggtgctctggaaggtgtgtgctctggaaaaagaggaaatcggttagtgagtatcctatttccaacagacagagaaagctcttgaatatttgatggcaaggctgaccctccaaatccatctacccaggagtctgctgtacttctgacttccagttatgggatccaatcaatgtcctcattgcagaggccagcttgggctgctgttcccgttcattacagctgaacacatcttaactgatgcaggtgccagctttctctttcctcctcctccccgctggccagaattgctttcatggcaacattgcaggactaggagatgagttaggggcagggctttcgctcggagtgaaaagcagacgttgtcattctaggtaaagaggatctgggcccttctctcctgatgaagtcgtgggacagagagtggtgtcctgtaagatgattcttaaatctgatattataaggccaaacacatagaacttaattgaccaatttaaaaccttatcttctatacctgtatatctctcttctacaaatcccaatatctggcatgtcatagttaacaaatatttgtaaaatgaatgaacaaatgaataaatgaaggctttccttgactgctttcaaccccatcttccacctcatctttattttttcattttttattttattattttattttttgagacaaggtctcgctctgccgccccaggctggagtgcaatggtgtgatctcagctcactgcaacctccacctcctggattcgagcgattctcctgcctcagccactggagtagctgggattacaggcatgtgccaccaccacgcctagctaattttttgtgtttttagtagagatggggtttcaccatgttggccaggctgtcttgaactcctggcctcaagtgatctgcccgcctcagcctcccaaagtgctgggattacaggcgtgaggcactgtacccagcccacctcctcttctattcctccccttcacatgtcctccactcctgccaaatgggttatgtgtgtcctgctcactagggtctttatctttgtctacattctttcctctgcttggagagcctttcctctgtctctttctggcccaatcttgcctgttctcaccccagcgaaggggcctgcttttcatgaacagtgccagagccttcctaccacgctccatctctccttccccatctctgcctcttccctctcctacgccacttgggcagttctgcaggctcttgtggttctttgtgctctttctgcatgtgtctgtttcctgtagtagaatgaaaactccttgagggcaggcatggccagattccccacacatcctacagcctaggaccttgttctttgcagaggagggctcagtgactgcttcttggaattgaaagaagcaggtggactgacatacctcatcctgtagaaaataaccaaatagcctgagctgctgaatgcaatgtttgccatttgagcagatgattccaaatgtcttgcctgctctccttttcctattaatttttttttactgtggtaaaaagtatataacatagaatttgtggttttaaccatttttaaatatacaatttaatggcattaagtacattcacaaagttgtacaaccattatctttgtctgtttccagaactttaaaatcttttcctacagaaactctatattcatcaaatgatgacttcccattctcccctcctcccagctcctggtaaccaccaccccaccttctgtctctatgactttgacaactctagatgcctcatgtaagtggaatcatgcagtatttgttcttttgtgtctgacttattttacttagaataatgttttcaaggttcacccatgtggtagcatatatcagaatttccttcctttttaaggctgtatagtattccagtgtacgtatatactacattttgttcatccatttgtccatttgtacacacttgggttgtgtccgccttttggatattgtgaagaatgctgctataaacactggcatacaagtatctgtttgagtcctgctttcaattcttttgggtaaacacctaggagtggaattgctggatcatacggtaagtcttctgaacttcttagggaagtgccatactgttttccatagcagcgacaccatttcacattcccaccatccctttcctatttttaggccagaattcatcctctgccacagctctccagaatctcccattcatctacactccccaaacagccaccctgtgtacaaagcggatgcgcctgtcccacttattagagaaaagaagttgcattaatagtttaaagtgtggtgttatagctggctctggcagcaggtgattgatggcttccattacaccccattagatattttattcttgttaaatgaagagcagccaactttgtcaagtatttttagttccctctggtcttattggtccgatctattcttcaggatggcctgtaaatggccacatatggctgcgtgtctgcaggacggatggccgtgcagctggtgttcattggccaccaatttaccccggcccccttcattgtgagcctgacagcgccgggaagccttgtagatctaaccaaatatatctattttctaattgtctatttatcaccttctggggatttgtgggcctcccatctgaaggcaaaggggggatggccttgaacaatgatccttgtcaaggctctcgctcgctctaaattagggcctagttgctaaataactaatttagtcctgctatcaagctgaaaaagtgggtattcagcgcaaagtgccagctggggaattgattatgtcttctctcagcgagtgtgataaacctgctgccgagccactgcggaaggccggagacggctccccgggggcggcggcatttcataacggagaattggcagaggggccaggttcactccctgcgtggcagctgaagtctggggcaccaggtctgcccgccacggcgcccatgggagtcttccctcacggcacccccctggttggtggcttctgcttagagctgtggggacgtgcgcatctgtcagagaaggggacgaaggtgagaaccggggaggggagaggaaggtcatcctgacagccccaatttccaattagagtgagattattgaaggtggcccaggctcagggtgggggaagtggcaggaaataaatgggaataggaggtacttaggaaaatgtattagtaacaactcccagattctgagcagagaaggaggggtagctgaaaatagagagttaaggtttactgcttgagaaatctaatcatgacaacaacaacccttatttactcagccctcccctccaccaggcaccgggccagccacctccagacccgggatctcctggaatcctctcaatatccaggcagattggggtttccaccccaatttgtacttggagaaaaggaatttcagaaacttcacctaatcaactcgtctaaggctgaactctgcctggaaatatcttcctcactcaaaatcttttaatgcctccatcattcctttgttcaactgattttcatcacatgctcttctgaatgctaagggctggggcagtgaattgggcagacaaggccctgccttcatggacctggtgttctagtgggggaggcagaccaagccagtggttctcaacacagttggaccctgtggagaaataaaaggaaagaaatttttaaaaatatggatttcaatatgcaaatgtttggtcgtaactacatgagaaagcacggtgaagaactcaggcatttacacttatttatattgagtgtttgaatgtaagaagaaagataatatcctacggaatgttgatgacattttctctttatctttgacattttgaaataagggctaaaaaaagtacattggtaaatatacttagaattgccttcaatgtgacagacacagatgcagaccgatagagggagagaatcagtgactcaaataccatggtatttcttcattttctgaaatgacaaaactctgagttgaaggaagtaaaataatcttaaaaaaaaaaaaaaaagaaaaagaaaaactgagccaggcagggtggcatgcacctgtagatccactactcaggaggttgaaacaggaggatcactagaggctaggagtttaagatcagcatggacagcatagcaagacccgtctctagaaaacaaaacagaacgaaactaaaaaactaaatgttggttacattcctggaaaagtcagtgtaaattgaacacaatccatgccttgcaggatgtctagtatcccagtcgccctctccctcccaatcactgtaacagccaaaatacaactgaacaaacaagaaaataatgacacagtgactacaatgatcaaaacaaaactggctgacaggattgagagaagacaaggggctacagtgcattgagaagtcaaagtttctgaattgtgttacgtggtccatttaaacccagatgctcctggggaggaaaagacataagcatcctttggagtattcatttctccatgataaaaaaaaggaaagtcaggaatctggttggtttggaagcccagaagacttggattggatgctgctctaccagctaccaggtgaccttgggcaacccactttttctttgtgagcctcagttttctcatctgtcaaatgaggagagtgattattacattgttttccctttaagttaataagaaatccaaagcgatgggaacaagtgctttaatcaccataaaattcaaagtggactttgtatttgtaatgggaaaaatgaaaactcaaaagcctccaacaaagggagtggtttttaaaaagcatggcacaaccaattctactgaacattatgtaatcattaaaatgatgtgaaataatagttaatgccatagaaagatgttcatggagtgttaggtcagaaaagcaagttgcaaaataatatggaaaatatgaacgtatgattgtaaccaaaagagtgaacaaatgaaacaccagccaacaacacagaaagaattagaagaatttataccaaaaaaataactgaagtcatctctgggaattagagttgattgtagtggtttttgctcctctgtaaaatgaactgtatcttgtttataataagagaaacaagccatggacataatttttaagatgcttgtcccatgctgacacccttgctatagtcactggcgctgtgtctcggtgggtggctagtttagaactaaagcttatcttctttcttgcaattttgcatgtgcaaagataaacagtgtggtcacttgctgtccagggaaagctgtgtcctcccaaggagagattggttctctttgtatattacattcttgtattagtctgttttcacactgctataaagaaatacctgagactgggtaatttataaacaaaagaggtttaactgactcacagttctgtatggctggggaggcctcaggaaacttgcaatcatgacggaaggggaagaaggcatatcttacatggtggcaggtgagagagagagagagaatgtgaaggaagaactgttaaacacttataaaaccatcagatcgcatgagaactcactcactattatgagaacagcgtgggggaaactgcccccatgatcccttcacctcctctcaggtccctccctcaactcctcgggattacaattcagattacaattcaagatgagatttgggtggggacacagagccaaaccatatcagttctctaccctcagcatatgggtcacctggctccaggttcttactggcagtgtgtaagatatactggtttctgggctaagaactattattttaatccacatgacaccctatgaggcaggcattatcatcccaattttataggcacaaaagtgaagcccagaaggattaaatgacttgctactgatcatgtgtcttctaagtagaagaacaaagatttaaactgggatgtctaactccaaagctagctctgagtcactgggcaaaagtttgtaaccaccagggagactaattattggctgggttttcatgtctctataaatgctgttgaaaaatatctagagctttaatctcctcatggctaaatgcacataaacacccacctcacggcctggctgggagacttagcagggtggcagcagagaagccttggtgcactgtttgtacagacgttgcaccaggtcaacgtggcttcctttccctggctggggactgggtagggattacagcccttaccactgggctctctctctgcccaaactggaatccagtacatggataggtcagtcaggagagattccaatgaaggacactgaggaccctcaagggcagccctccataaacctcaacctgggagaggggctcttgaatttagccaaagacttcaactttcaacttcatccactcacccattatgtcccaaaaaagagggatttaccttccattcacgtccttaccaaatccctcctgttacagaccttactctcaatcacttaattttgacccacaaagcactatttgggaacagtgtattagtccaaagtaacttcaatcgatcctatgtttcaaatgcttataaaggtcacttaccggagcaaaaatggagatgaaaacacgaagcatagatttagtcatttttccttatgattgcaagtgttggatgttgtaaacaagccttttaacgatccctttaaaaaacaatacactaagtggttcgtttgcagagctcgtgaatagcgaatgggtacttggggctaggagtatcatttccagtgacagcatcatccacgatgcaaaacgtcctgtatcttaaatgacttagatggaagtgaagatgatgtgctccggaaagctgtgctagatgattcgagaagtggcttttagtgatgacaaggatactaatgtcaaagatgtacatgaggagtgaatacaattggttcatgaattaaatgtgaacatggaaaaaaagcaatgtttctaaatatacttgtgattagccaaagagtttatattcgtattttaacttctgtttaacacattaatttatgactacattggtgtgttaacgtatttcatgtgagtgaatttaaatgtatgtataactgaaattttaaattaattaaatattttaagtagaactttgattatctcatctatatttttaaaagtttatacatgcaagttgatcaaaagctttgttctggacctttccattgggaaaaggcagatctctctatgcttggggttgtcacatggttaggcatgtttactgtaggcctactatgtaccaggtgtggtactagctgcacagtgagggagcctgggtgaaggggaaaccagctcaaaccaccacctgggtctcctggggcttgtgtgggaagaggcctgattgaaccccttcgtttgcctgacagggagattgctggggcctaaagggaggtaagcacttgcccaaggttacacagaagaaaacccaagttcttcagcaaggaaaagaatgacagcaaacttccaggcatatctggtctggtagccaaagaccatctttctcagatagcaatgtctctacctctgagcctgagcagggtctaaagagaagcaaagaacaaacacatccaaaagagaatatgttttttttttctgtgcagaggatgcctccagttgctggggtaggctagtgttgaaaatggagttgacaacatcaagtggggctaaccatttttgctcaatgcagcctaaaacaattttgaaaatctatgtcccttcttgaacatttaaattgatgtttagaatattttataacaatttaaaataattataaaggaagtaatgtctggcatataataaatatagacattgtgagataaaactcttgcatttctgttttaaatgtgtccaataaaatacagagatcataacaatttgatacccacagtcatccttttaaaaaatacacgaatgagatcttatttaacagtaggaaattgtatttccaatccacttcccccacagaattttatcctaatgtaatgtatttttatgcttgaaagtcttttattgattttcctatcatacttctccacaacaaaaagatgtatataaattgaactttttatttcctatgaatgcaagcctctaagtattaaaaattcttttggattgagttatcatttcaactattagtaatacaaacttgattaaaataagatggatgtactgcaaattttaatgaataattattaaacagttaaattttgttgagaatgtttctcttaataatatggatgggatcagaatcttgtcatacagccaggaaggctgtgcactacaaaactccagaaagtcattcacatcggctatgatgtaaatagcaacccctggagtattgcagtggacaacctgcactgctgtttgtggaggccctggatttggggagtcgtggttataatgattaaaggtgacattgagaacaacatttgtggaatcgtccctttatttgaccccaaaagttttgactcaacaggacaatgcacagtaataagattcagtgtgaaaaagacataaagtacaaagaggagtctctttgtaccataaaagaaggtgattacggatggggaggtgggagtagaaaactggcatgatgtttctaccacaggcagatcagttttaggaaagagttgatatggaggttgagaactaggaaattaattcctttaaagttatctgtgctaggaatcccttggaaagtataggaccgtgaacctctggaaccactccacatccaggtgacagcgatggttgagctttccgcggtgctgactggaccgaaggcttcccaccattaattagccagagcctctgccccttggtcttggcgggctctctcagccgagaccccaaatccacagagcccaccacaaagcccgaccctaattgagggcctggtagataccacaccccagactaaggaagagcataatactagtgccctcttgtttagaagtaattgccaagcaatagtctcagcattttactaaactcatttaatcctccctgaaaaacataagataggtactattataaccattctgcagatgacgaaacagaggccagcagatattaaataacttgcccaaagtcaaacaagtgtatgtggagaaggaggcttccaaaccaagcctgggtcagcttagctctgaagcttgagccactttctatctcaccacgtccctttaaaacaggatggagaggcggggcgcggtggctcacgcctgtaatcccagcactttgggaggccaaggctggcagatcacgaggtcaagagatcgagaccatcctggccaacatggtgaaacctcatctctactaaaaatacaaaaattagctgggcgtggtggtgcatgcctatagtcgtaactactcaggaggctgaggcaggagaatcgcttgaacctgggaggcggaggttgcagtgaatctagatcacaccactgcactccagcctggtgacatagtgagactctgtctcgaaacaaaacaaaatgaaacaaacaaaacaggattgagaatgaagctactgtatttatgggcctactacgagccaggtactttgcacatcgtcaaatttaaatcccactcaaggctgggcatggtggcttatgcctgtaatcccagcactttgggaggctaaggcaggcagatcccctgaggtcgggagttcaagaccagcctggccaacatggcgaaaaatcgtctctacaaaaaaatacaaaattaggcctggcgtggtggcttatgcctgtaatcgcagcactttgggaggccgaggcaggtggattacctgaggtcaggagtttgaaaccagcctggccaacatggtgaaaccttgtctctactaaaagtacaaaaattagctgggcatggtggcgcatgcctgtagtcccagctactcgggaggctgaggcaggagaattgcttgaacccgggaggtggaggctgcagtgagccgagatcatcccactgcactccaacctgggtggcaaagcaagactctgtctcaaaaaaaaaaaaaaaaaaaaaattagccaggcgtggtggcgtgtgcctgtaatcctagctacttgggaggccgcggcaggagaatcacttgaacctgggagggggaggttgcagtgagctgagatggcactgctgcattccagcctgggcaatagagcaaggctccatctcaataaataagtaaataaataaataaataaatcccactacaattctggaaggtaaatcctatgatcttcttgttacagatgaggaaaatgaagcccagggtggtaaggagtagaactggagtttgaccctgggtccatccatcaccaaagagaagcctctctcccctccagccctccaggaactccaagcccatgactgagcacagtccagtaccctttactacaagtcctttggtagatgctatcctgggtttccttaggaagaataggcatataaaggcaataaagctactgctggaaaatttggcctttcagtccatttggcccggcgccatatttcacacaactatttcatttcaagaatgctctgggccctggccatctgccaggtactcagctaggtgctgcgaaaggcattggggatgaagaaaaggcggcccctgacctcagttgctgccacttgacatacaggcacatgtaatattccagaaagacactggtcaacatggagccatggacgttagaggaaggaggtatggatcctgatgagagaatggagaaggagccatgagcatgccagaatctgaactaggaggtcgctgtttagttgatttagtcaaaacaggcagtttaatctgaaggatctaaagaactgtgaccatgtgttcttagcaggggcatgcactgcctgagcctgtctagacctctgctgattgggcaagtcctaggtcatgtctattcagagcttgaagcttaatagtttattgggcaataaactatactttagagtctaaagtatggcaactgtcgctaaaaacagcccagagaaaatggaaacacaacttcccttgatccacatgtggcattcatgcagcataaggacccgtacccacttagctgtgtggtcttgggcaagtcactcaccctccctggacctgaggtttctcatctatagaaaaagggcatggaagggatgatttctcagggactttatacttccaaagtcctgtgcttcaaatgccacagtaaatttagaagatttgtggagctgcagcccatctgatattctccccaacttgaccttttcttaaattcatttcattaattctcttattcataagaatgcattttcatttcatgcttcctatgtttagtgctttctcctgatgatgcttctcttccccggtataattttttgttccattaatttccaaggaccattttgccagatcagagtgttaagaatcattcacacctcttccatttgtctaaccaaccgctcatccatttctctccagaaataattgtatatggttcaataagtttattgttcaaatctgtttacacttcaggatgcatctcatcaggatttgctgtaaagggtggaagccagcttccaatgatcattattatatctatttctccaagtttttcaaatattcattttcttcatcctcaggagctgctttttcctctgtttatttttctttcatagtgaaggcagacttttctttaaaagcacccattcttttagatatttattggcctctgtttctctgactcagctgggtgggatgctgggatttttctgtttccagcatgactctatcttgattctgaaaagttccctatgaagggctcactgggcctttgtgactctatcaggttgtggacccagtgggcaggggacatctgagaaaggagagaggggagagaagaaagaaagagaagcggaaatggaagcctggaaatggaagcaagaacagaagtgagattttataagtggtgatgttgcccagactcaggacagaaggcaaacaagctaccaaactagacccaggtctgcctgctcctggactctcccaggggtgcactggtgtggtggataagagtttgcaggtctgggaccccaggtgggttccagttgtgtcccaccgattagcagctacgcagtgtgagtaaactccttaacctatgcctcggttcctcagctgtaaaaattgggataacaatagttcttgctttgtaggatcatgtggggatttatttatatgtgcatttacacaattatttttcagcttcctacgatgtgccaagctctgtactaagcactggggatatagccgagggcaaaatccagcccccacctctgtatttccggagttgtggtcagggtggagtggcatatatccatctattaactgctcatgtaaaatggacaggtactgctagggagtccccaaagacctgaattcagggagccctgggagtgtttcaggtgaggagaggggagagtacagtaggcaaggcaggtgaggcgtggtagagaggtggggaattcgggaggggtgtgtaagctgcctgcatggagttaagtatggctctgctccaggaattgcccctgtgagtactttagcaggactgcaggctcttcctaggggccatagccatccccctgaataggaatggagctattggatacctcctgaccaactgtgggtcagcagtgacaggctctagaggaaggggctgaggtcgagggtcccagtggtgggggcactaggattctggatgtccctgaatgggtccagctgcaggagggtctggagtgaggtgaagcatgagacaggggccatgcgatggtctgaaactatcctcagttgtggttcataactttcggcatgtatcagaaccacctgcagctgcagacatctgagctccatccctggagattggtttatcaagttgggccagggcccaggaatctgcattgtaataagagccctgggttggggactccactgagaagcactgcccaacagcaacttggccttctgaacaaacctgggccttgtctggattcctgcagtctcagatggaggagctgagaagtttctttcaggaaaggattcttgctatctgggtccaaaagtgctaatattagcagccttcctgaacctgagaacattgagcaactttgaaatccatgtagcagtgtgaaatgggaattaaggagccatagcttggtccatcatttcaatgaagatgtgggaaaacctggccagatgttccatcagctgtgggaagagcctagcaggtccaatgaacatctagatctggcacccactggtgagagacatttggagaaagagggacattggcagcttccttggcacagaagagtggaggggccgttcattcagagagggacccaagccctgggaattcctgccaggcctaggggcccaagagctggggtggaggcctgttcacaggtgcaggtcctggaagaggtggaggccatgcggagggagcaggcagagatgggcaggaggagtgagggactcttgatcttggtgatcaggtgatcaattaccctggtttatcctagttttagcactgaaagtcccatatcccaggaacccctcagaccagggcaaaccgagatggttggtcaccatactttacttggcaacaagggaattgcattctattggaaggctcgatttctcagtggttacagcagaaactatgacccctagagctggatgttgattctggctctaccgttactgtgtgatctggggcaagggttttaattgctcttggttttagtttctgatatataaaatgggaataatatttccttcataggaggatttgggggaggggtaaaaaggataatgcatgtagaaccttagcatagggcttggtatgtttatttatttgacaaatatgttttggccactatgaccctattttctcatatttcattgaatgtaagatgccatcaattaattgtatactgaacaatgattggcctactatgaaggaaagaatgctgcccattacactttgacttatgatggattgcaagttatatctcaatttcagagatactaacatgtgaaaaaaaatacccaccttagaatcgatgaaccaggtaccacgttgggaacctctgggctatggtggtgaataaggccattaaagcctctgccactgctcaatttgcagctcagtgcaggcttctgggtggagacacttttccaaaaactcctgaggtctaagtatgtctccttgaagactgtggcaggtatcctatgttcaatttaaaatgtcagatgtgagggagagttccaggctgtatggggtgccagaagagaaaattcttggtttacatggtcacatgattgctctgggacctggggccagtcagttgtgctttctgtgtctctggtgtgaacagggggattgattctagctctgaggccttcctggcttcaaccttcagggactctgttgggtcccccatggtggccaagtccccctctcccaattgcaggaagggcttccttctggatatatggtctgccaagggaatgcaactctcccttggtgagtgccactcactgccagactgggatgggtgggagtggtgcttggggtgggataggcaggggaagctccaggtgtcaggttacactccttgcagagcactgctgggcctgaatgggagccagggagaacgtcctgccttctccatctttgttcctactagtttttcacaaagggacacatgcagttttccccttcattgtgggttccctatgtgggaaaattccatttgctaggcctcagaaccagtccgtggaaccatgacggcaccttcccccacccagtgtgcccgattagcctccagaggaggcttctgaaaggtcagctggtggggcatttctaccctgttgtggacgatgtgaggtcagcacagactccagggagggcggccagtttctacctagtcctgaaagcagcactaagttaaatgctcgcgggggtggggcaggagggtgggaaacccaaggctgagaatactgtttgtttagagcgtgatccacagagcatcgagggcccgctttctgtacctcattatgtgaagccttgaagccttgtggtgccagctaaggggggaagtgctcagtgtgggccaagggaggagctacccctggggtccctcctgctgaaagtctggagtggtcatggggatgagggcagaattagatacctgtcccaggaccctggttgagggtagaaagtcatttcacgtcgggaggaggctgggggctgatgcgacacttgaaaatatatatttatcatttttttatgactagataaatactagaaaatctagaaacatagacaaaaatccaaaagaataaaataaaaatcacagcaatccaataatctagagtcaacttcctttgacattctggtgtattttctattagaatctgtgttctaaacacaggcctagatcttacatttgaagggcccagggcaagggtacaattggagttccacataccatatgtttaaatatttaatatttaaatcattttttctaagaaagattttcttctgaaacattcaaaattatctgtcaagaccaaaaggcaaaactcaaattacaatgagtaaatcttaaaaatttagatgaaaattatttctgtaaagcagacattaaaattttttaaaaacgtttgattacattccattaggtattaaaaatagcaaaactctatgctatttgaatggccaggatccagggtctatagttgtcaatgtaaagaactgatatacttcatacatattatgtctggacctacacgcagggaaatttaagagtgcaatgaatcgtttgctattgcagaatagtcttcagctgttaggttcctctggaaccatgaattagaacatgaagaaaagcaaggaaatggacacttggcactgctgggagactatactttgttatgtaagaaaatgttgcattccacgctacctgagaggaagtgtttgacaaattaatttgtctattctcttacatgcttaagcacgtccactgctcaaattttccctgtactctgaagcgtcgtccatctctgatgtcagccacagcacagcccacgtggtgttgtggcattgggattcagtcccttttgtctcaaagacagaggacaagacctggagacacatctcctgggtcttgatgatgttagtcccaagttaatgtttagggttacgctatgcagcactgaacaccaggtcgcaagtaacagaagtgactgtcttcataataactatttgcctatgtgtgtttatgaaatgccgaacactttgaattgtgggatctaaggcatggaccacacttacccaggtctaaggtctaagcgtgtgtgtgtgcgtgtgtgcgtgcatgtgcatgtgtgtgcgtgtgtgtgtatataaaactatgtatatatttaatttaaaattaatatatttattttaatattgtaaggtctaattttaaaaaatacatatatagaaaattagtactaaatagtgagtacctctggaaccacaaattatattttatatgcacaaggaattttaaaatattaggaatgtacaatatgtattatttcctcagttttctagcataatttttttctttatacatattcttctaaaaatttatttttaatgattatacagtattccacaaaacagatatgtcattatttatttatttattgagacagagtctcactctgttgccctggctgaagtgcaatggtgtgaccttggctcactgcaacctctgcctcctgggttcaagcgattctccagccttagactcctgagtagctgggattacaggtcgccgccaccacgcccggctaatttttgtatttttagtagagatgaggtttcaccaggttggccaggctagtcttgaactcctaacctcaagtgatccacctgccttggcctcccaaagtgttgagattgcaggcatgagccactgggcctggctgtgtcatcatttattaaagcagtcctgtagtggttgtttccaatttttatgttgcttccagtttttctctactatcaacaccgccacaatgaacatccttgtgtgcatgtaagctacatttctggaagtggcatcctcaggtcggagcatatacattgtgtatatttagttgagtcagggggcagcccctttaaaaagacccaagtttcattgataagctcttttattttttgtttgtttagagttggtcccagggagaccgaagcctgcaggcagtactagaattggcccagggaatggggtctggagttatggatcccaactctctctgagcttgggagagtcccttcccctgtctgggcctcactttctttatctgttcaaagaagactcattggtactgacctaatgagaaaaaaaagggaaaataaaagaagaacaaagaggagtcagagtaggttgcagagtccttgcaatcagaaacgctctgattctgggagggtttgcttgctgggtaagtggagccaagctccagcctctggggctctgtccctgagaccatcctgccccctgctggccagttgccaaatgccagctttgttcctgactcccacagggagattccccggaaatttgctggactcccagcaagtcagttgcccactgtgaaagcaggaggctacaagagtatgagaagtgagcgccaacattgctacaattcatttagctgctgtttcacttctggaaattacattctttgggctgtgcttccaaatgtctcatttcattcatttgttcagcaaatgcttccaagttcctcctttgtgtctgggctatgttagggggctggagacacagtgtttgcctgcaaaaaatgcacaggctagatagggccaaagaactggccataggttactaccatacagaggacagagaggggcacagagaaaagccttcagatgtttaattattaggctattgctgggctttcaaacccctgatcctcatctgtctagataaagagcataaatagatgtatactgggttgaatagcatccctccctaacacttgtccacccagaacctgtgaatgcaatacagggtctttgcagatgtaatcaagtaaagatgaggtcatgctagtgggccctaatccaatgatgggtgtccttataagacgaggagacagagacccagagagacatgcagaggggaaggccatgtgaaggcactcataagtcccagaatggcggggattgccaggaaccaccagcaattagaagaggcaaggaaggatttctcccctggagagaccatggctagctgacaccttaattttggactttgggcctccagagatacgggacaatacattgatgttgttctaagccacccagtttgtggtaatttgttgcagcagcccttggaaactaatgcaacaaacttcttgaggatgaaagttagcaaactgaggagtactcggaatccaagtgagtgagtgtgtgtgtgtgtgtgtgtgtgtgtcagggtgggaggagctggaagtttcaagttacagcttcatcttggctgactggctgtgtgtccttgggtaagtcccttccttcccctctctgggcattggtttcttggcctatataggaagacattagactagcccagtagcctttgcaattcattctgctgctgtttcatttccgaaaactgcattctttgggaccatgacaaaacctttttttgtccttttttaaagaatctggaccctttttttttctcaaacaaaagtaaacatattgccccgcatataaatgagcacagctaagctgtgccaggcacagggttctggggctggtgaagtacttttgggatttcctgacccttctccaagaacaccaaggttgtgctggatcctgtactggcccctctggcattcagaaggtgacatatgatgtcaaataactgtgggtaatcccagagtgagtccctttcttcatgatttaacaggaaggtttatttagtccttggggtttatgagtttgggatcacagagcttttatgtggactcaggaagggtgagtgtatcagtttcctgtggctgctgtaacaaatggccacagagctggtggcttcaaacaaccgaaatttattctcttgtagttctggaggccagaagcctcaaatcagtctcaccgggtggaaacggaggtgctggtggagccatgctctctccacaggctctaagggagattcctttcctcgtggcttccagaacctggcgactgcctgtgttcctggcttggggccacatctctccaatctctgcttctgtggccacactaccatttcctctgcctgtgttacatctccccctacctctgtcttatgaggacacttgtgactgtatttatcccctgcccccagataatcgaggatcatctatctcattttcaatttatccacatctgcagagtctattttgctgtataaggtaagtgcacagtctaatctgggaattagaccctgatactggggccatcattcagtgcactgtagaaggtgatatatccatgatgaagcccatggcagagaccaactctgtcagtctcctctcttattctcattactcccaccctccctctctgcccaggaaagaagctatagaaggcatttggaacccttttttgggtaaggggcggaggcggggagggaggaggctgtggcattgtttgccggccaacctcctgggcagctcctgctgagctgaggacacaggaaggcagagccattcccatggagaaatagaacaaggcccaacctggcagccatgtctggaggcagccctttgtcaaaagttcatctgaccagggagagaaattgcatactcagagttagatcttgtgcaaggagcttccccatgccatgtaatcctctcaagaaccctctgagacagaggttattaggaccactttacagatgagaaaacaggctctgggaaggaaagtgactttccaagctacatagtgttaaaagaaaaacttcagctgaattaaatgtaaaggaatttaattgagcaatgaacgattcgagaatcgtgcagctcccagaatcacagcagatttggagagactccagggatgcctcctggtcagaacaaatttatagacaacaaaagggaagtgacgtacagaaatcgaaagtgaggtacagaaacagttgattgctcacagtttggcgtttgccttatttgaacacagtttaaacacttagtggtctatgagtggttgaagtatgccgctgggattggacaaaactcagctgttgttacaggcacatactcctaagttaggttttcaatcttgtcagcctgttaagctaggttacagtttgtccacaaggactcagatatagaagtatggagttctggctgggtgcggtggctcacatctgcaatcccagcactttgggaggctgaggtgggtagaccacttgaggtcaggagttcgagaccagcctggctaatatggtgaaatcctgttgcttccaaaaatgt

SEQ ID NO: 197 - DNA, 63799 bp, Homo sapiens
tacatcgtgaatgaggtacatcatggggactgctttcccctagtacttgcaaggcagagagcatagtacatttaggcaaataaccccccatgtgttgtaatgggaggttttggaggagccaggctgtaagtctgtggtcggagggacgaccgcagcgaggaaggcaggctgcttagccagcagacatgagggattcatgtcaggtcctttttaatgggcaggggagtataattcagtgggttttagcctgttccaaaagttggacagctaagtctagagtatgtgtatttaaatttttaatagcagccaggcatggtggctcacacctgtaatcccagcactttgggaggctgaggcaggcggatcacttgaaaccaggagttcaagaccagcctgggaaacatagtgaaaccctgtctctataaaaaatataaaaattagctgggtatagtggtacgtgcctgtaatcccagctactcaagaggctgaggtggggcaaattgcttgagcccaggaggcagaggttgcagtgagccaagatcaggccactgcattccagcttggacaatagaaccaggccctgtcaaaattacgacaggacaggataggacaatttatttttcccaaaagttagatcacttatactttcaccagcaattaacacaagtgtccattttcttacatctttgcctgcactgtttgttgccattttatgaaaatgtttgccaatcagatggatgagatcagtgctttacaaactgggtaccccggtgctggagaggttctttgaagctgccccagggcctctaagggttggagaggaccactcaggatggagtggaagggtgacgggtgctgcagctggggccagctggacagcagcagcaggagggcatctgtcatgactaactgggctttctgtgttgcctctggttttccccggtggattagccaagggacgtcgggtaccttgctcagcaccagctctttgaccaggtaagtctgaggccacgcacctctgcccctcaccgtctcaccttcccctctcctcccctcctgggctcagtgcggctggagcagtgagcgtgagtaggagggaggcagcaggtgaggctaggaaggtgacaggacgtgggtgatgaggagccattttcctaaagtgacaggaaacactggggggtcgccagtgccccgaggattgtaggggctgctattcagagatgaagggagcagctgtcggagcgggtggctggctgggctattgctgtggtgcaaggagaggtgatgctggcaggtggagcagttcaagaccggtgtgaaccaccgagccctggacgtgggtggatgtgtgggggagggagggaagatcggggaagatgcccagattcaggaccccaaaacactaaatagatggagctggggcgcccaggagggacctggctggtgtggtgtctgccaggagtgcccaggaaggcagcccttggcaggattcaaggatagggccaggtgcgtgtcccgaacgtggaagactcgagtcagtcagggtcagggctacagccaggggtgggctggggccgcacctctgtagcctttgcagtggggccctgggatgctgatcagctgctgtatctactgctgaagccaggactgcttctctgtctcgatgggggacccagggccagtaggggctgtgccaggagccttcatgccgacattaaaggacgctggcggtttctcttccccaggcctccctattaggacctgtgcatcctgcgtcctgtccatgtcacttgctaagtgaaggaaagggggattctaattgatcaggtccctactgtgtgatcccgagacccacctttctcctgaccctggtcatcctgggggcatggcctcagtgtgggctggggaccctggaagccatggttaaccttggctccctgtcctggagcagctgtttcatactttgtaggacaggaggagttatatttaggagtagaaggccaagttcacagtgactttcaagatgagccaggacttgaaagatgtttcgggtaatggagggccgcctgggtgtttaccttgggtcccagagctgagtgtctaccatgctgtggagaggaccctggagaagtcccagcagcccatgcccaggtgttatcatgccgtgtggcaaggacagtgttctagaaccttctctacctacaggacgctcagggactcctaccaaattcttgtcccagaacctcttattgacttttctcccagggaccccgtgttctagaagattttggccatcagtttaagcctgcctcagttattagtcacatctcgggagcactgattcccttcgggtctctgcatcctcggccagtgattctgatgacatgatctggtcagccaatcacctttcagaaatcctgatgatgtcatcagggaccaatcatagtttctgctcagattccacagggccagttctggtcaaaagcagcagcgtcgggttacctttgggaggaacccctcacagccctgggagggacctcagcttgcgaacttgtacttcagtcctaagcagcaggcgcggctgcgtttctgcacagctgatttgagacaggttcttaaaggtctgaatagcagtgtctgggaccaagctccctgcagggagaacattccagcttttcctggtacacactggtttctgagccagcagcctgaagttaccgtcactgctcccgaaggaatggtagtgtccacctgcaggtgccttcaggctgcggagcagtgactcttaaaaagccctgtgtccctctggcaaccctgttttcatgcctctcaagcttgaaaaatgccgccaggtccatccagggtcccgtgaagaaccctggggttctcggtggcctggggggtgtgggctggtggcctgctctggtgggttcaaccccggaggtaactgaggtgcctgctaagggtctggacaggaagtggacttagagtgagtgtgttttcactctgagaccctggctttgtgtaaaggaggccagggccatgtgcagtggctcatacctgtagtcccagcactttgggagaccaagcaggaccagcctggacaacatagcaagaccccatctctacaaaaataaaattagccaggcacggtggcatgctcctgtggtcccagcaatttgggaggctgaggcaggaggatcgcttaagctctgcaggttgaggctacagtgagccatgatggtaccactgcactccggactgggtgacagaacaagactgtctttgaaaaaaaaaattacaataaataaataaaggaggccaggccactgcggccctgccccaccgtgaacatccaagatcgcttgatgtgtggcatataactctgtcagaggccatggggagccgcgccacccttactgcatcatataaagctcagagcacagacccaggcccacacctgcctttctcgtcaggcagtttctcttctctgcccagcctgtttctgccaggtatggcaacaaatcctctgtgcctaccctggcttttaaaactaggacggcaagggccgggtgcggtggctcacgcctgtaatcccagtactttgggaggccgaggcgggtggatcaattaagtctaggattttgagagcagcctatgcaacatggcgaaaccctgtctctacaaaaacaaaaattaaaaaaaaattagccgggtgtggtgcatgcttgtagtcccagctagtaaggaggctgaggtggggggatcacttgagcccaggaggcagaggctgcagtgagctgagatcacgccactgcactccagcctgagaaacagagccagaccctgtctcaaacacacacacacataatggatataggtatgtgtttctgactcttcgttggcctccgggctgcggtgtccccagccggatccccacatctcatgtctgctctgccgcccacagatcccggagttgaagcaggacatcagcatccccgactactgcagcctgggcgatggggaggaggaggaaatcaccatcaatgcctggtttggtccccagggaaccatctccccactacatcaggatccccagcaaaacttcctagtgcaggttggagctgcagctggaatagtggccttctaactcctcctggcccagacacctggccggccacattctctgcctttaaacaccgggctcttaaaaagaaacaagaagcactgaaggggatgaggacaaaaatataaagcaaacccacaaacggccccaggcccaggaaggcctctgcagtcggtgcttccagaagcggctcctcctgcatgtgctcctcccaagatccctcacaggggagccctcgggagagggagcgagtgctggtgtgggtgcccggtgcctctgcccctccccgcctgctacccatgcgatccagaccagcttccaaataggaggtggcaggttgggggaggagttttctcagtcactgggaggtttttttcctgaggcccagtcagaggagcagatggatttgctgcaaggggaggcacctctgtctactgctgtaagaccaccctggttttcgcaggcaaagagaggtttagtaaaggagaacgttctcctaccccagcagaccagtccagagaggcagcccaggagtgggctaagagctgggcttcgggagccagcgtgcctggcgcagacagcagccctgccacacctcagctgtgtgagcttgggcagctcatttaatctctctgtgcttcagtttcctcacctgcaaaatgagagtgaagataaaccacctcagagaggattaaaccagttaacacacataaagcacttaagcagtgcctggcacagacaagcgcctaataattgtgggctccaaaaatgaagttatttttcaaaatgtatttggaagaaaaacataccttaggccaagtttggtagttcacacctataatcccagcactttgggagaccgagtcaggaggatcacttgaggccaggagttcaagaccagcctgggcaacatattaaaacctaatctctaccaaaaataaaaatacaaaaatcagctgggtgtggtggggcatacctgtagtcccaactactggggaggctggggcaggaggatctctggaggccaggaggtcgagactgcagtgagccatgatcgtaccactgcactccagcctggatgaccgagtgagaccctgtctctaaaaaataaaaaagaaagaaaaacatacacgtggaaccataagcatgtgtgtggtggggaagggcaggctgggcccagggagcagcatgtggaagggcacagaggccagagtgggcttggggcagcagtggagtgaggccaccagctgactgtcagggtctctctccccaggtgatggggaggaagtacatccggctgtattccccgcaggagtcaggggctctgtaccctcatgacacgcaccttctccataacacgagccaggtgggcactgggggtctggggtgacgttgcaggttctccccactgcccctggagatgatgacgtcctttgctttcttcaggttgacgtggagaatcccgacctggaaaagttccccaagtttgccaaggccccattcctgtcctgcatcctgtctcctggagagatcctgttcatcccggtgaaatactggcattacgtgcgggctctggatttgagcttctcggtcagcttctggtggtcgtagccaggataggagctgaaagggcctgacatgcagacagcattcatctgttcactaatttcctgggtcctggaatctatagagacaagcaggactgaacctgtgtcctgaagagccttcactgcccagtggcagccctggggggctgagctccagcactggacaggcacagagcaggggctgcccaggaaggagcacactccaggccaggggtgcatggcagaggaaggtggggagagcccagaaggacattgcagacagacagcctgcatggggactctggcatcagaaagccgaatgtttttgggaaacgggtgggtcacacaggcaggggtgaaacatgggctctgaggttggctacctgattcaaacccggccgcgctgtgcacctgctgggtgacttggccaggatcccccacttcgctgtgcccatatggaaaagagggcaaggccagtcctcactgccgagggccgagaaggcggtgccgagcccctgctgctgcatgaaccttagccgctgtcactgatcccaattactctgatccttttgcccttccttcccataacggcctgctggacgccacagcctgaatactggagagagctgggcattgcccaggtcacaggagagagtccgtagagacctgcgcaggagccgggacccctgctgagcagtgggagctttctgtcatccccatggctcaaggataacctacctgcctgcagagaagtgcgaaggtcttgctggatgacttttcacccgcactcacccaggagcaggctcccaagtgaagaaaccaccgaaccatcaccagctcctagaagcctccctcctaccaccttctagtcaccatcccccagaagtaatgactctcaaacctgggggatttgaggccagggggagagccaggctctatgctttctgtaattgtgtctcgtttgtgtgcacgcaggtttgttttatgttttggccattaagattttccccagccctctgttttttgttttttaaactaaatagagatgggatcttgctatgttgcccaggctggtcttgaacttctgggcttaagcaatcctcccaccttggcctcccaaagtgctggggttacaggtgtgagccacatgccagccttggcttctttcttccccgcttctaagataggcctggggaaaagagccctgagggttgagctgccatcctgccagcatcctgccactggctcagctgcttgtcttttagccaaaaatcaagcagccccaggaaagattctggttggccaggaggtagctaccctggggtaactagaagggggatgggaaagtggctgtgggcagctgaactccagctcctgatgccctctacccaggccaaggaatttgactttatcgtgtaggtcctggggttctcagcctttgagcagacacagcagaatctgcattctcgaaagctggctgttggcagggagaggccgtgatactcatcctgggagtgggctgccgaggggccatgggcgtgctggggagtgacaaacacaagagctatctggaagctgagtccacttggctccgtgggcagctgtttgcaaggacattgtttattccctgccatggttaatagtgaattacctaatctttcacaggaagaatttacaccagatgtcaacacccctgaaagtagcgaggcataaaacagggacgccctcatgactaggttcgccattagtgaggaggggtggcggcccggccacagtgggctgtgactcctggcccgcctgtgtaactcaaaccccttccccagctgaaggacaggtggactgtggccccagctcccagtgcctagccgctccagctggcaagccccacggcccatctgtagtgtagcgtgacagaaagctgggcacgggaggccacgttcattaacgtgtggtatcctggccaggtggcttcaagcagatgtcccttgtcagatgaggaatgggaaaaggggaaatgtcctgccctgtgggtgaggacacgcagcatctggaactcctcatgagggttttgagtgagtgctagtgtgcgttgtgggacgttcatgtcggtgttatcatgcaggggttggaggcaagagagacaagcagcaggagggctggtgtccccagtggccaagtgcccagaggcttcctgagtccccagccaggactgactcgagctcaaagaatgaacagccagaaccacaggacaactgggacagtccggagctgccccggcccctcctgcaggcattatttgctagttggctttttgccttctggcgtccatcttcccgtcttccagaacggcaagctgactgcattctggagaatgacctctgccccagggatgcggtcctggaaggtctgtacatcagctcctccctggaccggcatcttgagggcgtgtcgggaggagctcagacaggctggagccgaccccctgtggcagcagcgcccgcagtgacagaattgtcttgacatccatgacccttattccaaggtctcccattctagactggtcctgccttcctgtcatttctgcaagccacctcatacgtttccaaaaaacccctctttaggtgaggccggccggggctggcagtggctgaacgtactgggcttaccaatgggcgtgtctctgcccactgacgaagggctgggctgggtccccggctgcctcactatgggaaggtgggcttgagggctgaggagcccagacctggttctgggagggtgagcctcccaccagcaggggtcattggttcactgagccttggatgcctgctccaccctgggtttatggaggtgaacaaagtggggtggtcctgcctgcagcgggggaggccagccaccaattcagtgtccaagttcactccctgctgcccctgaggctactgaagatgtgatcgcaccttcgatatgcttagggaaaggcccctgctccctcagccacgtggcctgagagggacagtcccacccctctctccgaggtgggtctaattttccaatgccagctggataatcccatccccacctcacaggtgtccacgtgggagctgtgggccatgaggatgcttgcaaggatgtgggagccactaagtgagagccaccctcttcctcctgatcccaggcatgatgcgcgaggcccagaggcatggcagctattttgctaccatgaagaaggcagctggatttctaggaaaccacctcgtaggccccaagcatgcagccagcccagtgaaagcacagtagacacagaaatatggctgtgtggtgaccttgctggagcctctagaccaggcatctcctcaagacccctgtggccaagtccgtccttgtttcagccagtctgagttggcttttctgtcatgactgaagcatcctgactgatgctggggttcaagagagggatgaagatggggacttaacaagtgtgaggatggaggaagtgcagggagcgaggggctgaccagtgccaaagggcgagcgggtgctagccaggaaacaaagccagacaccagaggggagggcgcgcaggcccagggcgctctgtgtagaggctccggagctgacgaaggaagcgctgcaccctgagcagtgggtggggggaggcggtggcagatgagcaggagcctcaccaggggtcacagccctgctgcagcagtgggggcatccaggggtcttctgcagggagcacagaggcagagtgtgggccggggctggagctcagcctgaggcagcagtggcagggctagagggctattggcagctgggctggacaggatctggtgacaatgggatgcaggagggtcagggagaggaagcactgaggctgactcccagtcccggctgggacagctggatggcagggctgccgggcacccacagggagcagagcgtccagggagggagagcacgcatcccgcccaaacgcccagcctcagcccattcaggccagtggcaccttgggccaggggagagtccagactggggagctggggaggccaaggctcacacatccaggttcgggccagcccagtcctgctgggacagctggccaccgctgggactggaggcaaggctgccctgggcaaggacagtgagctgttctgagtcattgctgggggctcttgctggcttcacctgctggagcccaaacccagggggtctgagtgacgaccgaactccaggaaaggcaaggccccaacacggagcctcacacacgggctcgagaacacagacgggctgcagcaacttcccaggatggtttattccaaagctgtggacggtgaacattaagacgaaagaggtgactcgcgtggaacctgaaacacggacgcctttcttccaagaagggctgtggcgatcaggccactcaaggcagccagcccctcagcagggcacgatggctaatgctgcctggaccgcagggactttttgttcgatttcaagacaccagactccctctccttctcagggtcgaagacttctgtagacagaaaaggcaggaaagacacagtgaatggaggggctggcagcacaggggcaccagctggagccagcagctacgtctcctgtgccaaggactgtcctaggtctacaccatccttcactgctaaccctccccagcccgtgaggaaggcagagttagccccagttcagagaggaacaaactgagggagctgtggacatagctttcacgtccccctcctgagagggctgccagagagagagccttgtctagacaaaatgctcatacacgttggaatttcagctgggttctagaaagtcctctggagcggtgcacgtagctcagcctttacttcctgcagtggcttcttctaggattcaagctgctaacacggacccccacacaccctggagcccttcagggccctgtctccaagggcttccctggcaccaggccccacgtcctgctggcccagcccctcccatgagctcctcagggcccacgcacttgggatctcgtggggccagtagtcgttgcagtgggggcagcgcggttcagcattcgactggaagtacttggccacgcagggtaagtgcatcctgatcccacaggtttcgcagctttgaccctgaaacaggaaaggccaatgacggcggagctggtgcacacctccatgttctgcaaacctccggggaagccacaagggaaatgggcagcaggtggcatcgtgttatcttctgggccccagattaatattgaaaataatcccaaacgccttagtgcagtggagtcttttgtttgcttgctgcttgttgcggtgggttttactaaacaattctgaacacatgaacgcagtgacagaagccgagggctcccaaactcctgcactcagatcctgcaggtggcgtgtggacagccacagcttttcagaagcttatttgctaatgtgaatcaaaagctttcaaaaaaaaagtgcactttgtcccagaaactccgcccaaggaaataatcaccaggtgcccaaggatacaggtgtacgaggcccgtaagagcaattgcaattacaaacagctacagctgcaaaacgatagaaactgaaagacacatcaatgtccacgctggttcagcggttgcaaagccctgcaaaccagtgttaagaccactccagaaagcagcaatcgacaagagacactcactacaaaactaccaagatgatgcaggttgcacagaacactcagccttcctgagaaaaataaagtaagcgagggcccttggaccccaacagcagaaccagggaggagggcggcagtgcgtccctgcggggcacagcagggaggcgtcctgacacgtcctgggagatggcctccgccagctcttgtgggaggatgcgccagcagtgcaggagggctgggcccagagccaggattccgggaagtacctgtacagagccccgggagccgagggcccagtgatgagctcccgtgccctgccctgcgggtacctggatgaggaggctgtgacagatattgcagatcttcaccgcgtcggggtacgtctcccggatgtattgctccatctccaggatggcccggccgtgcagggtgaactccccttccttctgcagggacacacaggaggtggccaccctcagccaggccctctccccattcaccacctctcttccctctgtgatcccacagcccagtgctcaggaagacacaagggtctacgcagcttttcaccaaccccagccaacgggcatcagccacatccccctggcagagcctcggcaagggaaactgaggcaaagaccctaaagacatggaggcgtggctccctgacacccgccttttctcagcatctgctgtgccttcagacgtgacttctctgtctgcacggcagcctcgagggaggcagtcacagccctcctgcagatgaggacgctgaggcccacaagggggtcagtctccccagggtgcaaacccaaacacccactgctgccatccgccacccatcccactcccaaaaagcagcatccctggtgcctcccagcacttctgcctcccagcacttctgcctccaactgcagtagggaccctcagagatcacttccagccacatcactttacagatggagctggaaggagtctggagagggcagacaggccccatcacactgtgggcagtggagcctccagtggaagccaggcctcctggttcccatgccagggtgcggtccacccatcatgcatcctgaaatccctgggagagcccggaagcacaagaacaatgcagctccccaggccgaccctactgccaggtcacaggagaaaggcagcactgagggagacccaaggcaggcaaatgacacgggacccaggacatggacccatgcaggctgattccagtttctccacagtcagctcatgcatcggatatgaaccacaccaggagatgacgtcactgacgcctgcaagtcacccgagtgctcaactgccttttctgttattttctaatttttaatttttacaagcaagagctgtcactcccgtttcttttcttttctttttttttttttttttttgagatggagttttgctcttgttgcccagggtggaatgcaatggcacaatcttggctcaatgcaacttccgcatcccgggttcaagcaattctcctgcctcagcctcctgagtagctgggattacaggcatgcgccaccacgcctggctaattttgtatttttagtagagacagggtttcaccatgttagccaggctggtcttgaactcccgacctcaggtgatccgcccacctcggccttccaaagtgctgggattgcaggcgtgagtcaccgcacccagcccactcccgtttctgacaggtagagccccccaccccattcccaccttcatccccacagtgcaatgtggaggggtgtgcttgcgtaatctgggctcacagtgcgttcgctctggaacaccagtagaggagctgggtgagcacaggaaggaaggcagggcagaagcgtggggttggggcatggacagccgctgcgggaacagtggagggaggccggggcaccaggtgcttgtgccctgcaccgcagctgttgctggtgcacaggggctttgtgtcatccaagtgctgtgggcaatgggaggatgtgaccagcccccaggctgtcctcggtcctcagtcctatggctgttaccttcccccaaagctcccaaatccatcatggcaccccacctccctggccaccgccctcttccagcctcccctccagatccatcacggcaccccacctccttggcccccaccctcttccaccctcccctccagatccatcacagcaccccacatccccagccaccaccctcttccaccctcccctccagatccatcatggtaccccacctctccagcccccaccctcttccaccctcccctccagatccatcacagcaccccacatccccagccaccaccctcttccaccctcccctccagatccatcatggtactccacctctccagccctcaccctcttccaccctcccctccagatccatcatggcaccccacacccccaaccaccgccctcttccgccctcccctccagatgcatcatggtaccccacatccccggccaccgccctcttccaccctcccctacagatccatcatggcaacccacctccccggcctccaccctcttccaccctcccctgctcctgctgctctctgagcccactctcctccagcaacgcactcgctaccgaacaagcctggccctgtcactcccaactcacccccaccccagggcttcccaccacccttaggtccaagagccaagcccctaatacgcgtatctcccgggctgccctccgtctgctcgcctcgcaatctttgtgctcagatggccctggccttagcttcttgagtgcacctgctggccacagggccactgccgggctgatgatcctcccaccccaggctccaggcaactcccacacagccttcagctcaagtgtcacttcctcagcagctgagggccggttcctctgggacagctgtcataaagccatgtttcctttccatctgtaccaggactgcagtgagatgaccgtctcactgatctcgggctccccctccagaccatggccccatgggagcggccaccagctctggctgtgctcactcctgtgtccgcagcacctgctgtggggcccagcacttggcaggcctgtgataaacacccacgggaagatgaagtagaccttgcactgatcccaaaggaatgcctgacactaagcaagttcaagctcagactgaggcaggagctgcatttattttttatttatttatttgagacagagtttcgctcttgttgcccaggctagatcatgcaatggcacgatctcagctcactgcaacctctgcttccagggttcaagcgattcttctgcctcagcttcccgagtacctgggattacagatgcccgccaccacacccagctaacttttttatatttttagtagagacagggtttcaccatatcggccaggctggtctcaaactcctgacttcaagtgatctacccgccttggcctcccaaaatgctggaattacaggtttgagccactgcacccagccaagctgcatttactgaacacctgctatgtgcctgaaactgcacccaaggctcaccattcatgacccactcagtcctctgagggcccatcaggggaggggcaggagggatgccctagccctcaaagacgacgacagcccaggtgatctcccaggcgcctcgccacaacacttggaagtcaggacctcgtgtagggagcagtcctggggtgtatggaggtgcgccgatcagcagacgcccagctcccatgagccgcgcttgctctcagaggcctccccgctgaccccaaccacctaccacccctgggccttctcctggacggacagctgcctcagcacctccatgccgggccagtctcacacaggactggctgtccaggagtgacgtgtccttggggtgatatacccacctggaagggccttgtcagtgggcccctggctatttctgtgggaagccctgtgtctgagaggccaaggatcagacactgacatgtggtctctctgatcgaggtgctgccctaggaagacctgtcctgggtaagtgagcacccgccccggttctcagtgattcctccagagtgccgcagacctcaaggcaacccttaccaggccatgtaggtcagagagcactggaccctcacagaaaacacctggagctggcaatgtccccatcctgcagatgaggaaacagtctccgcaacgagaagctgctcaccacaggcagcggaggaacctggaggagtctcaccacacagcccctgccacattagcttcgttccttcgtcctcctgagggccccagcaggccaggcagtcaacaagaagcctctctagggctactgcccagcgccagtgctgagggccccctgctacttctgcagcgctcctgcaggtggcagctcccggatcctctgtccaccctccctcgagctcagaggcgccctgcagaaggtggtgccagcactgccaccgaactgagaaaggcacagagtacaagcgcctgcagccacagctcaccgccacagactccagggcggggcctctcctatccaccaccgccctctccagacaccaagggcagacaaagggcaagtcaaaccataaagctgggggcacgccctgcaagccatgcacaatggtggcagcatgtgctaggcatggtgctcttgggtgcaaagcagggtgcaaagtgttgtgtactgggatgttggggcactcggctctagggtctgggataacaggtgacttcagtgggtttctttatgcatctcaacatgttctaatcctcctgtaatgagcagatatttcctgtaacattttttgtaagttttaaatgctgttcctctgcaacctcatccacctgtccagtcatccattcagcaagcatttattgagcagttgaggtgccaggcactacattctgcaatggggaccagccatgaagaggtcataacccctacccttaaaaaacttggcctgtggccgggcacgctggctcacgcctgtcatcccagcactttgggaggctgaggcaggcggatcacctgaggtcaggagttcgagaccagcctggtcaacatggaggaaccccgtctctactaaaaatagaaaaattagccgggtgtgatggcgcatgcttgtgattccagctacttgggaggctgaggcaggagaatcgcttgaatccgggaggttgaggttgcggtgagccaagattgcaccattgcactccagcctgggcaacaagagcaaaactccatcttaaaaaaaaaaaaaaaattggcctgaagaggggctgcaccacaagcgagaatggtcagttataacctgagtagccctagaacattccctagtgccaaatacagcctggagggcaagaacaactgtgacaaagccattgatgggagctgcagtccccaaaccggggcctgaactcggccctgccactctcagggtgtccgacgtcatccagacccctgagctgtcagctaaaaactaagctatggagccactgcagggcagcagacagcctccaagacatgacatacgggaacgcgcccagcagatcctgcactcaccaggagctcccagccctgccctcaccccatgacctctccaccctgtcttcccatcaggtaccccaggaactgaattcgggtcaggttcctgggacaggcccaccctaaatagaaatcagtaactcagaacacagacttccccaacccagacgcgagccttcctgaaaaggaagcggagaatcgctgcagccacaagcagcagcctctggccacgagtccgaccaccaagtgaggaagcggggacccggcgtgagtgcgtcctcaacacacatgggcacaagcacctgggaggcacagctgtggtcaactcggcaaacactgagctgttgaaaacaggggtgccttttgtggaaaaagaactgaaacatttgttctgctccattcagcaggactagacgtgggggtgggggcaacatctagaaactggagctgcagtggggcctgtcccagatgtcacagctcctttcctgaagcaggtctatgcctcttctaagcactggccctgaggaactcactgctgacaaaaacaacagtggtaatgtcaccaattcctctgccgcctcccccgcgagccagccagcctagcaccgagcacattactgtgaggtcccattcccgctcctgacacacccagccccgaaggggaaacaacgactcccctcttacaaggaacatgaggtcacctggctcagggttcagacccgggttagatgttagagccacactctcagccacggaactgccctgccttgcagtctgtgggctagagccttgatcctggggcccaagtccctgggcgcggctcctggctctgccattctggctgtggcatcctgaacacatcatctgggtgaacggggagtgggaggcaggaggagtgaggcccaagtcctccccacggggtcactgctggaatgcatgaaagcagataagggatccgagaaggccgggctcctcagacatcagttggctacaagtacgattttggagaaaaaactgttattcacttgaaaaagtgaaccaggctggaaaaaccatgagacagtacctcaatcagccacttgttttgaacaaacttctgcagcacctgctccgcttccttcttcctcatcttcttgcctttaagttgatcaaccaggttcaatatgtttgtggaagacgcaaagccggtttctgagtcaataatcagttccagctggaagaaagagcaggtatcatgctcatctattaaaatggcaaaaataacttttaaatggtaataccaagtctggcagaggcacagtaaaaccactcagatcacaggcagaactgtacactggcatggtattccgggaaaacaatttaatgtgcatcaagagccaggactgtgctcagttcttttgactcagaggtcacttctataacatcctcccaaataaatcatcttaatgtccccaaatcaaagagggtcgccttgcctcacggctggcctcggaggcagtgagagagagacacggcaggcaggaaccgctggggaagacaggttcctgcacacgcaggtgtgtgctcagctcagcacctgctcctcaaccttggtggctaataatccccaggagaagatctaaaaggaatgattccaccgcctggttctcagagatttggattcaacagatcgtgagtggggctgaaatgtctgaattatttttcacctctgcagttattatcattgcatctaggcctgagaaccactcttagccatgtgtttgagcagaaggctgagcaaatagctctgaagcctggtagaacagtacctgtcaaatgtgcacgtgcaaaggattcagtgggcacctggcaaaaatgcagattcggactcagcagtctagagtggggactgggaccgggcctttctaacaagctcccaggcgatgctgctgctgctgcctttcccagatggcacttggagcagccaggcaggaacgcctgttactaccagtgaagccctgctcttgcccatccagttggggctcacacctggcccagcacttccttctcaggcagccatggggaccccctggcagctgtgagttccagatgggtagacagtgacatctccctgcaaagccttttctcagacagcaatggtggcccatgtccccccagtgatccttgaacactgcagttgccactgctaatgacggagacagaactttcccataagaagcccacccaatgggcaatggggattactctacttacagcctttctaaacaaatccagttcattctctgcaaaatccgtagccattttggaaattgaagttgtagcaagattcacctaagaaataagtcagcacgacagtcaggctgtgctctttgcgtgttggttaacgtgtcgctggctctccctccctcccctcctccatctctggccagtcactgagctcctgtatccaggcactgcgggccgcagggatggatctgtaaccaggcgtatattacagactttattctttagctcagccaacatgctgggccctcagaagtttcagaactccaaagggtgtgcagtattttccaaactcagataaatttgggagatttgtctgcatgttaatggagcttcaaatgcaaaaaaagcactgagaagtctgatagcaaggaaatctgctttgccatgtctgaccagcatttccacagttctttgactctgtaatgttttttttccagggaattgagtttgggcaaccctggactagagtgcccctttctgagtgtgagcctggctgggagcagccagatgtcctctgaccagctgaggtgtctcctagccagggatggggcatgtcagcttcccactcctgtatttcaccctggctgtatttcactcctggctctgccattctggctgtggcatcctgaacacatcacgtgggtgaacggggagtcggcggcaggagggatgaggcccaaatccctacctgtgagagtaaatctgaaaaccactgaaggccccacccacatggcctgcaatccttgacactcctacagagtttcttttcatagcttctatgtcttattctaaataaaaaaccattttctccctttattcctaatattctatacatttggagtgacttctttgcaaagaactgtccaaaagagaaatcaaaccaaagcaaacacaggctgcctgggccctgttccagctcctcaaaaatgccactagagggctctgccgggcactcaccaacgcataaatgggtctcccatcatcttccgtgactcctctctttatctcaatatacaaggactccaagacactgttaatgttgttgatgaagtcctccaacttatctacggtggcattgcctggaaataaacagaccaaaaaaaggggggtgaccagggggcctcatcaaaaaaatgtagcttgcttgaatcattccatcccatctcaacgcaggggacagcaaccccagacatgggtggaggctgcagcctcttgggtgaacgccaatgccacgtggcttctttcttcctggagtacttggaagacaaacagacaacagatggagggcgttgtgaggcaggagggccagggagatgctatctgcaaccacggaggctgccgcgggcttcctgtctttgctcgctgcctcctgatgagagtcccaatcagcaccttcagcgcattactcaatgatgtgctcagagcctgcgtgagctcccgccgcacaaacatcctatcccatctcagcccttctatcgcatccccagtgccccgcgagaggcctctgtccctgtatgtccccacacatcttaggtggagctttattcctttctctttttattcaatgtcgggttatcctcacttacatgccaggcttgtgctgggtcctgggctggaacagtaagaataacaacaaacggggtgagaagggtggcttgcagcgagccctcagcatggagaggccctgtcctgggcaccttttgtcgtcatgaatccaccctccagcagctctctgggcacaggggaagaggctgagacgcagagaggtgaactgactcgcccagagttgcaccacaaggccggggctttgacttctctgtcgcccacctcccctggccctgccagcaggatgctcacagcccaggggccaccatccaggtccatcagtctgaggagggggcacccacactattgccgggggctcagctgaggaggacagagaggctgcggtgaggacaggagcccgtggccggggacagcagggcctttctcctgtggcaccaggaagcctctgagcactggaagcagtggaaggacatggccagcgttgtgtcccttttatgctgtgaaacttttttttttttttttttttttttgagacagagtcttgctctcgccctggctggagtgcagtagcacagtcttggctcactgcaacctccacctcccgggttcaagcagttctcctgccttagcctcccgaggagttgagattacaggcatgcaccaccacacccagctaatttttgtatttttagtagagatggggttttaccatgttggccaggctggtctcgatctcctgacctcaagtgttccgcccacctcagcttcccaaagtgctgggattataggcgtgagccaccacgcccagcttgtgctgtgaaactttttaaagcaagagtatgtattattgttttcactactgtttttatgtattaaaataaataatttcaaaagattcatgccttagaaaatcattctggaaaaaaaactgcaagaaaaaatggacaatatgatacattcatgtgtgaaacaaaaacagaaccaatgaaacagtcccacaggaaaaggcccagcaggttacccactggactgacgaccaaggccatcgccaggaagggactaaacgaagggtcatcacagggcactcgtgctgtatgtctgtgtttgatttcttattagacagaggcatttctaagctacccgtacaactcaagattcataaagttaaaaaaaaaaacaacagaagatcatgctggtgacaatggaggatgtggccgtgtgaaagagtcaaggaaaacccaggccaatgagctctgtcagaggatcagactgtggggcccagaaaagctgagaacaaagcccagggcagtgacactaatgtgccatgctcagcgaggagctaatcttccctttcagttaagtttttaaaaggcagtttaaattaaaaagtagtcatagtaagtgggtggaacatggatgtggtgagatcgtaacatatgacaatgacatctggcctcggcggctggagagcaggcatcaggagggaggcatggcctgacttcctgcctccatgcccctgctcacgggcccctcctttctgaaaactcctctccctccactgcggcagccaccttggatggcctgtttttccaggaaatgttctcttctgcccccggtgctgtcttcctcttccacagcatgcaaggcagctctttgctggcgtgggagccgagctgttccgtacctgcctgtgccagtgacttggccagacacacttttccacccccaaggggagccaacgctgggcagctcaggtgcaagaggcccagacatcaaaaagcctcgttcagtgcggagtgagtgacaggaaccctgtccacccagtgtgacactggggcaagtcccacctctctgaaagtgacaattcacattttccactaacgaggcccctcctgggtatcactgagaacaatgtgccctgtgggcagatgagaagcattctgatctattggactttccagacaccccgttgcagggagggagccagcagccctctctgcccttcccctctccacaccacctctggtttggcgtccagcctcatttttcagaaaccatgaatgttttgctgtattttcatctgaccaaccacttcctcctactgtactcgctcactgcacacaccagccactgcttgggcgctcccgttctctccgctatcgccctctttccttccacacgcttcctgcatcagggtcatgtccacgatctccatcgctgaccctgtaactgtttctcacggaggccccgcgcccttgcagctcctcttaatcgtgacctgagaagaaacttctcttacactcagcacccccaaacccttcaactgactcctttcagcagcaacagaggtggcgtggtggcatggggccagaagcagaggtgtgggctctagcccatcctgccctcccgctctgtggggccctgcgtgagcctctcccccacttctcatctctaacagccacacacagtctcgcctccagcctcacacatgtccagaaccctcttccctcccgcttctctaccaccacccctggctggaccccagcctcctgatcctctggcagcctcccgtacaggccttccccaaccagataagctgcacttcccagctctgtcctcccatggcagcacttccttcctcatcacgtggcactccagttactgtgtccagccgccgccccaagacaggagtcagctggtgacacctgccagcccagcagccatgtccctccctaacgagaccttcgccttttttctttttttttttttacaattgtctttctcttacatttgcggttttggtgagagaataattccaggtatgatattcagggaaccagaaagcagaaagctgaagggaccagagattagggcagccaggagtagacagagaacccctatcagccagacactctcccaatctgagcaagggacaaaaggaagcttggaggtggctccagcccagaagctacagagggccagctgctctggccatgaggtgatgccatgcttcctgcctatccccaactgtgcacctggccaccaatgagtcctatgtgtccctcccccaatagcatcccgacacatttttttttttttttgagatggagtgtcactccattgcccaggctggagtgcagtggcacagtctcagctcacagcaacctccacctcccaggttcaagcgatcctcctgcctcagcctccccaggcactgggactacaggtgtttcaccaccacacctggctaattttttgtatttttagtagagatgggatttcactatgttggctggtctggtctcaaactcctgacctcaagtgatctgcccacctgtctccccaagttttgggattacaggcgtgagccaccgtgcccagccccgacacattcctttctaagttgaccagaactggggtctcttgcttgctcccaagatccttatgatgtccactaagcgctaaggttgcaccagatcgctgcttcccagcctcaggtcttcaggacagctaatgtccacagctctgcccctggtctctcccctgatccaggagccctggtggagaagctacagtttgccaatctgtagggatacactgggctaaaggcatgtctgaggatccttttgacctcaatattctacgagcccatggtcatgataaagagtgcggaataaagtccgtatggtgagattctgagacaactactttcagtcttagaaataccactttgaagacttaggagttaattaacaacaccactccttttcagaatccagaaccaactgaagaaaaagacacaaccttcagtaaatatcaaaacatcaggttttctgtaggtagcgctggatcagaggctggttctctgcacaccaccaacctccagtcagtgatatgggaggcccagctatgaggacagaggaacgaggccctggccctagcacagatgtctcctctagagggaaagagataccctagccaggacaaccagcaacatgtttaaatcaagcaagttgaacctctaaacctctaaacacagtgctatctgtgttctctctacttggaagaggcagggtgtgtctggatttcttaagggctatagtaaagtagctcatgttaggctaaaatcaaggggcctgcaaatgtgtggctatgattaccttattatgtgccagcactatgcattcacatggttcatttcatcatgacaataacagtaactccgtaagatgaaatcactagtatcatctgtatatacaggaggcttggagaggttaacaacttgctcatagtttccgtaacttggaaggaaatggagcccgggcttgcccaaccccagatcctaagctcccaggcactaagccccatgggctccacagaacaagcctgaggacatcctctataccagaccccaccgtcatctcgtctataccctcctgcacctgccctgtgcttcagagtcaccaagagagactgggccaacagggaaggatggaaggcatctgggcacctgattaggacaccagaggtggtacccaaagaggagctgcactcacagaggagatgcattggatcagcccggcctggcccagcccagcatccatcatcccctcagctcagaccagcccagcatccatcatcccctcaacccagctcagcccagcatccatcatcccctcaacccagcccaccccagcatccatcatccccttggcccagccctgagcactgggccaggtccagcgtgcagggacagcatgcagggcagcaggagcagctgaggaaaggcaaagaccctggagcgaacagagccactcttcctttaacaggaaatgcccatcagtggtggcaattgaaaacgggcctccaggcaagtgacaagcactgaacaaaacaggacacttctcccctaaggagaagggttggctcaagtcatcttgagagattttgttttggactaattctgtatacagtttctccttttcttttaaaattaaattttaaggccaggtgtggtggcttacacctgtaatcacagtactttggaaggccaaggcaggaggatcatttgaggccaggagttcaagacaagcctgagcaatggatcaagagctcatctctacaaaaaaatttaaaaatcagccaggcatggtggcatgtggctatagtctcagctacttgggaggctgaggcaggaggatagcttgagcccaggagttggagactgcaatgagctatgatcgcatcactgcattctagcctgggtgacagagctaggccatctctcaaaaaatgaaagaaatgattaagttacattggaatgtaatgttaccaatgagcctcttcttgctatatcagggtccctgcttcccagaggctactggaacctaggattcactgtgcacttgggcaacaggaaattgggaagtctactgccctgacctctgaccaacaaatagttttgttctaaactaggcaataaaaacataaaatgttatttttaggcagaggaaataacagcaaaaaataagactccaagggcccaagccactgtgagccaacttaccctctgacagccctcccgacagacagggtggacgggcggtcctgctagcacagcactgaggacagggcagggcaggccctggatgagacgggggtgcaggagtggagctggcccaagagagcagaccctgggctgggaagaaggaagggctggtgggcaggacacggggctggggaggtttgtgaggggccacaggatttcacctctcagcctgtagctctcatctttcccccaaccgcctggggaaaaagattctctggaccttcaggcacacagatgcaaagatgagaactgccatgggcacttccaagcatggccagtgaacaatgctgggaagagccgggtggaaggagagtggctggtctgtggtagatcacttagtgacgaaccgtcctctccatcggtgcaccagctcattcactacacgctgcagcgccgctcctcacctctcagcagaccctcagcaaccaatgcagaggcgagccagaaaggatcgctgcttctctttctcagaggtcagagagatgaaggacatacctaagacgggacaggaagcgacaaagtctagaccagaaatcagatgtctggccattagctggatgcaatcacgaaaggatgtgggcattcatcagaaaaaaattcttacatatacatgcaatgatgttgagaatacttcaaaataacgtgggtaagcaggtacaaacataaataaaacaagatcagtcctgcgttcatcatcggaactgagtgatggcacacagggcttcactgtatcagtctctccacttttctgtttgactttttccataataaaatgttgtaaaaatacttcagtgctcaacaatcatataacttgactccttgaccctcatgaatctcaatctaaagagaaaaatgagtgttgtgtgacaaggtagattagctcagtgctctgacagtagagaagaaataggattttaataacgtatggttttaaaacctattgttctgagatctgtacacagagttcttttcttcttaaactcaagaagtttattacaatcagaagtttattacaatcagaaaatctgctctttagcctcactcaaatgacagagcataaaacttatttcatgttactgggcacagtacctgcatctcagctgcatgcatttatggtactaaaacctatgacaccactgcaggagtggtgatggggacatccacttgctgtccctatctatgcagcatctatgggaccttcccctggctggaggtctaccagtcaggactcccactggcaataaagcagtgcccactgctttatcacggtaaagttctggatcataatggaaatcgtcatgagaaacataaactactatatattttgctactgatgctgttcatacacatttcatctaatcacacccactgaaaacaggtggtccatctatccttgagatgagtggcagctctgacaccttctgtggcgctctggtccccatccctacccatgcaggagccctcgcagagctgatacaggggctctgcaggggacgggagagaggcttcctggtcaccccagcccctgaaaccagagcagttcttcctgatccctgttgggtaagtttcctcctgctcagattgcactgagcgaactgaaaatggacaaatctgatgcctacagaggcaggcaggaagcacagctgcagacagctgtgggcacagcagggagctggcggcacgcattctaccaaagaaggcagcactgctctgctccagccgagtgcccgagttttgggtgtttacacagaatctcctggcggttgttttctgtttaacctggtaattcttaaaaattacaaacactatagtgcaaacaaacaatgcctgtaagttatataccactgaccgttcaccgtctcccaattccgatgtgggcaggaaacccgctgtcatgagacacagtgattaatgaggtcactctgttccctgacccaccagctaagcagttactatttctcacacaggctggactgtgagcagctcaaaggaatggaccgtgttacactcattcttctgagagattgaacatacaaacagccaatgggctgcagccaatggccagaccacgtataaaagcagaactccaacccaaaatctacatcaacctgcccagaaagccagcccaccacctctaagccagacctgcaggaagccaggccagtcccctagcaaccagtccagaagccaaaactaacccacaatcatggcccaaaaggaccaaggcaggatcagtaactgatactaccctaattgattttattttatattttagagatggggtctcgctctgtcatctaggctggagagcagtggtgcaatcatagctcactatagccttgaactcctgggctcaagtgatccccccacctcagtctccccagtagctgggactacaagcacgagccactacgctcagctaactttgtttcttctgcagaccctgaggtctcgcaatgttgcccaggctggtctcaaactcctagcctcaagtgttcctcccgcctcagcctcccaagtagctgggactacaggcatgtaccaccatgcttgccagcttccctaatttttatccctgtttctaagagacaacaaaccagagaaagccacatatgtacttctaaccaatcacataggacgccccacttctggttagctgtctccaccttgccctggccagcagcctccactcaggcacacctgaagcctccccactcctctgccttcctggagtctctgctaaacccaagtggaggctgcctctcttgctggagcaagctctaaataagcagctgctgcctgttctgctgcctggtctccgtttatgttcacactttatccgtggaggactcaatttggtgcccattctgggctaagcaggggctaagaagtggctggtatgaaggcggctgactgcagtcgctctgacaggcgcacgcccttccctttccccactcactacagtctgaagcagacaacagcctccaacattctcccggtgtcccctctagccttctccatctgtctgtcctccacatgcagctgagtggagccaggtcccagcactcagcctggaagatgtctggggctccatcccctgacctatgttgccacctgcctttctgtcccccactcccccacaccaagctcctccccatctcagccccttcactcatgctgccttccctttggaaagcgtctcccgcatatctctgcagggctgcccctcatcacccgagcatcgccacatatggcagctccacagaaaggtttgaacagaggccctggccaaagccacaccccaggcccgctctaccgagggactcaatgcttccttccagcacttagcaccccaaactaccacactgtctgcctccgagttacggtctttctctttctaagcagaatgccagctccctgaaggctgggatctgctcatcctattcaccacagcagcccaacattcagctgacactcaagacgtatccgtccacgaaccgaggaagatgtgtggtacaagtggtgaccatgctttgtgaattttctaggaaaaccccaagagaattcagccctgtggtctataaaataattcctatcacactatcataccagcaccatgggtcttctgatagtcaccccccaccactcacccccagcaattgggattagatggcaagttaaggggcagaaaaggaaggaagaggcagtggtgagcatgaagtgaacgtgtgcccacaagcactctgtgccaggcgctgaacatacattcccttgcttaatcctcaagactcttccatgaaatgaatgtgatgtcccttataacacagaaagctgagactcagaaaagtaaaagaactttccccagaccctggaagaaacaggacttgaattcatgcctttgaaaaatggcttccctgttccagccagcggggtctgtggtaatcccactgaatccattcccagtacttccacgcatcagcacataacctctctcatgtctgggatccagttcaaaatgcattcccaaacacatgatgtgtgtgcttaggggagcgtgaagcgcacagaaatcctggctcagcaactccatgctggcctgaaagggctgcggtggagcagtccagcctggactcccaggctgcagacatgaagaacgggcaggacttggacacatctaggccagcaagagccagagacacaaaagcaacatcaatttccttgtggttacagagcttcttgaacccaaagattcctgtctaagcacttaataactgccggctgtcaattctgtatgttgagaaattcatcgagtcacacgttagatgttacttttcatactcattttttgccacttttcagttatgatcccagactttatctcccttgattaactgaaaggcagaccggctctgacagtggtatgctgattaactgttcatcattgccaaaggggagatctataaatgaaatcactaaaaacagaaggaaaatgtacttggagccagcttctaattatgactgagtcttccttggaaagagaaggtgcttacaaataggactacagacaggatggaatactaaaccaaaatgtcaacatcgctgattcaccatcaacgcacgtagcctgatgatgtacaggagtccagcgtgagacgacgaagcagatacaggcatgtcaatcagcacgctggaaacaaacccgggatgaaggcagataagagagttgacaaaaacagaaaatctttatcaaaccccaacgtgaccatgatacttgactcactcatctagttttgacacatgtatttcagcgacctggtttttgcccaaacatcaaattatttactctgctcactgaagtatttctaaacctaaatttttaaatctaaaacttcagacatttttacctaacttgtccttaaaacaatagataatttaaaacctcataaaaattaacattaaacatgataatacagtgtaattagttctaaaatgttagtgctggagagtatagaactgtacctcacagcagtctggcaaccataaaataagaatgaatccagggaagtattttaaaactaataggtaaaaatgggatgaagagtgggattattttttggaacagggtcttgctctgtcacccagctggagtgcactggcatgatcttggctcactgccacctctgcctcccgggttcaagggatcctcccacctcagcctctgagtacctgtgattacaggctcatgccaccaggcccgactaatttttttattttatgtagatacagtgtttcgccatgttgcccaggtttgtctcaaactcctgagcttgagtgatccacctgctgcagcctcccaaactgctgggattacaggcatcagctactgcaccgggccaagaatgagatatttaccttgtctctaagtacctccctgcaatatacttattaatcacatagaaaaagagtaattgtacactggagaaacctggctgaccccatcaacaccgtagccgacctggtaggatgcagagagaacacaacaccgcttccatattatatctgcaaagttaaaactcctagatctaattaggaggaagctccagacaaacctaagctgaggaacattctacaaatagcacatgtggctactgagcacttaaaatggggccagtctaaactaagtgtaaaatacatattggattgcaaagacatatttccatcacccccaatatggtttggctgtgtccacccaaatctcatcttgaattgtagttcccataatccaaacatgtcatgggaggggcctggtgggagggaattgaatcatgggggcagttaccctcatgctattcttgtgacagtgagtgagttctcaagagatctgacagttttataagggtcttttccccttttgctcagcacttctccttcctgcctgccaccatgtgaagaaggatgtgtttgcttccccttccaccatgactgtaagtttcctgaggcctccccagccatgctgaacggtgagtcaattaaacttcttccctttataaattacccagttttgggtatgtctttattagcagcgcgagaacggactaatacactcaccaagtttccttgtgcctctttgtaatccctctcacctacccatcctatccctcctctatgccatccccatgcaaccactgaaccatcctgtcattacagtcaggtacgcattgtctagaatttcacataaatgccttcatatggccgggcacagtggctcacacctgtaatcccagcactttgggaggccgaggtgggcagatcacgaggtgaggggatcaatatcatcctggctaacacagtgaaaccccatctctaccagaaatacaaaaaaattagccgggcgtggtggcacacacctgtagtcccagctactcaggaggctgagggaggagaatcgcttgaacctgggaggtggaggttgcagtgagcggagattgcgccattgcaatccagcctgggcgacagagcaagactctgtctcaaaaaaaaaaaaacaaaaaacaaaacaaaacaaaattgctttatactctttcacctcacttcttccactcagcaaaatcattctgattcattcatattctagcatgtaggaagagctcacttacttttattgctaagtagtatggatttatcacagtctgttcatctgttcaactgcaaatggacaactaggtgttcacatttggggccattacaaataaagatactctatctctgcacaagcctttgtgcgggcatatagcttcatatctcttgaataaatgcctaagagaggaatggctgaatcataggaaattgccacactgttttcctaaatggctgtcccattttacattcccaacagtagtatattagagttccagttcctccatgttctcaccaatacttgccttgcagagtcttcttcattttagccattttaatacacatgcagtggtagctcactgcggttttagtttgctttttttttttttttttttttttgagacagagtgttgctctctccccaggctggagtgcagtggcgtgatctcagctcactgcaacctccgcctcccgggttcaagcaattctcctgcctcagcctcccaagtagctgggactacaggcacccgccaccaagcctggctaatttttgtatttttagtagacacagggtttcaccctgttggtcaggatgatctcaatctcctgacctcgtgatccacccacctcggcctcccaaactgctgggattacaggtgtgagccaccatgcctggcctgcattttttaaatgtctaatgatgttgagcatcttttcatgtgctcatctgccatctgtacaaccgatttgcagtgttcaaatattttgcacacttcttactgggttgtatgtttttccttttccttttctttttttgagacaggatctccctctgtcacccaagctgaagtgcagtggcacaatctcagctcactccaacctctgcctcccaggctcaagcaaccctcccacatcagcctcccaagtagctgaaactacaggtgcatgccaccatgcctgactaatttttgtatttttttgtagagacggagttttgtcatgttgcccaggctggcctcaaactcctgagctcaagcaatccaccggcttcagcctcccagagtgctgggattacaggtgtgagccaccacgcccagccgggttgaatgttttcttatttttgagctttgagaattctctatatattctgaatacaagtcattcattaaatacattatttgcaaatattttctcttagtattttgcttgtcttttcagtctctaaagagtattttttaatgtaaatttttaattgtgaagttcaatttatcgattcattctcttatggagcatgcttttggagccaagaaatcttggactaatcataggtcacagaggttttctcctatgttttcttctggaagttttatagtttcaggttttacatttaggtctatgactcattttgagataatttttgtatttggtgcaaagtatggcttgcagttcattttttgattatggatatccaattattccagcactcattttggaaaagactatttccactaaattacctttgcacttctgtcaaaaatcagctgtccacctatgtgtgggtctgttatctagctctcttatttttttcccttcatctgtttgtccatcatgacatgactaccacactgtcttgataggacagccatacagtaagtcttgaaatcaggcagggttcctcaagtttgtctttttcaaaatagttttggctcttctaggtcctttacatttccatgtgaatttcagaatcagcttgttaatttttataaaaagccttgctgggatctaactgggatttctttgaatctatagatcaatttggggagaattgataccttaacaatactgaatttcccagcccatgaacatgctatgtctttccacttatttaaatctcctttgacttctctcaacaatgttttgtagttttcagtgtacgggtctaacacatttttgccagatctattcctaagcatttcttatttttaatgttattataaatggtgctatttttacattaccatttctgattatccattgccagcatatagagaaacaattggtatttggatattgattttgtatcctacaactttactaaactcacttattagttccagaagattttttgtagattccatcagattttctacacagatgatcatgttgtctgtgaactgacagttttactgtgtcgtcctttctaatccagctaccttttgtttctttttctcgcctcagtacactagctagaacaaaagtggtgagaacagacattcttgtctttctcctgagattagggaaaagtattcagtctttcaccattaagagtgatgttagctgtaggttttacagagatcccctttatcaggttaaggaagttcccttcttttctcactttgctgagggtattgtttttgtttttgttttttaatcaggaatagctgttggatttttttttttttttaaactctgtgtagagggccaggcgcggtggctcatgcctgtaatcccagcactttgggaagccaagccagggagatcacttgaggccaggagttcaagaccagcctggccaacacggtgaaaccccacctctactaaaaataacaaaaattcgtcgggcgtggtggcacgtgcctgtaatcccagctactcgggaggcggaggcaggagaactgcttaaacccaggaggcggaggttgtagcgagctgagatggcaccactgcactccagcctgggaggcttttttgagactctctctcaaaaataaaataaaataataaaataaatgaaatttatttaattttaactgttttttttttttttttgagatggagttttgctcttgttgcccaggctggggtgcaatgcacgataccagctcactgcaacctctgcctcccggattcaagcaattctcctgcctcggcctcccgagcagctgggattacaggcatgcaccaccgtgcccagctaattttgtatttttagtagagacggggtttctccatgttggtcaggctagtctcgaactcccgacctcaggtgatctgcccacctcagcctcccaaagtgctgggattacaggcgtgagctaccgcgcccagccttaattttaattatttaaaatatatatatatatatatatatatatatataaatatatatatatatataaaactctgtagagttcagactcctcacttgtgttctaagtctatttatcctatttatcccctgctacttaggatcccttagcttcctataaaaaactttctgctacatcacaccagggcaaacatgagattttgtcaaatactttttctgtacctattgagataaacacaagatttttcttttttagcttaatatggtgaattacactgattttcaaatattaatactaaatcaaccctgcaaaatcaggataaaccctacttggttatgtcgtaccatcctttgtaaacactgttagattagatttgccacagttgggtttagcacgttaacgtctacgctcatgaggagtcttgtttggggttttctttcctcgcaatgtctttgtctggttatggtatcagaatcatgcaggtctcatagaattagttgtaacatattctcttcaattttacagaagagtttgggtagaaatggtgtgagttcttcctcaaatgtttgggccgggcactattcccagttctgtgaatagctggcattgttttctctaatccttcaactagttctctccctggccttaagaagttttcttgctcatcagttctcagcgggatccttgagtggaggggcactttggacatctcaagttttctctctgtgcacctctggtccaccttatactccattgtaagtactccgtcctgcaacctctacctgccttagtctccctgaactctcatctccatctcctcaacgcagggaggctgcctagctctgcctgggtttcccctgtgccatggcctagaaactttctaaaggcactgagctggggcagctgtactgctcactcccactatcgcttgtggcagaagaaagttacttggtctttcccccaggttcctggtacagaacttctaaaactcttagaattccctgagtcatataggtgatagaagcatcttttgctctaatgaggcaactcttggcaggcccctaggatgggggctggtcaccagaatgaccaagcctcaataaaaaacatggaactttcagccactccccaatatctgaggagaagagagggactggagatggaagcactcgtcaacggccagtgactgatcaatcatgcctgtgtaaagaaacctccatagaaacccaggaatggccaggcacggtggctaaataaatatttcaaatcatttctaatggtggattcacaattttgtgggattatttttcttagagtgtgccaaattcaataatcaacaggccctataaaacctgaaactgggctgggtgcagtggctcacgcctgaatcccaacattttggaaggctgacgcaggatgatcacttgagcctaggtgttcgagaccagcctaggccacagaagaagacccccgtctctacaaataatttaaaacttagccgggcgcggtggctcatgcctgtaatcccagcacttggggaggcggaggcaggcggatcacctgaggtcagaagttcgagaccagcctggccaacatggtgaaaccccatctctactaaaaccacaaaaattagccgggtgtggtggctcacgcctgtagtcccagctactcaggcggctgaggcaggagaatcgcttgaacctgggaggcagaggttgcagtgagccgagatcttgccattgcactccagcctgggcgacaagagcaaaactgtctcaaaaaaaataaaaataaaaataaaaaagaaacccttgaacgacaggatttgaagagcttcgggttattaaacacacagaggcgttgagacggtggtgcaagtagagagggcacggaaactccatgccacccccacttcccacagctggccctgtgatctctcctatgtggctgttcctgagttgtagcctttataaaaaaaccacgtaagtcaaaatgtaagtaaagtgttttcctgagttctatgaatcattctagaaaattatcaaatccaaagagggagttatgggaaccactgatgtacagccattggtcagaaacacaggtagcccaggacttacaactggtgtcttaagttgggtcagtcttgtgacactgagccctttaacttgtaggatttgatgctaactccaggcagatagtgtcagaattaaactgaattatggaatgcccagttgttatctagagaactggagtagtgttagaaaagataccacatcaagtgtcaagagaaaaagaaaccctcattgcccatctctcgaaagatcactggccttgactgacgaatgtccagtattttatactttgtccatttttgaattgtttcaggcaagaaggtgtactgagccctgttgctccatactggccaaaagtggaaaacctcaaacccaagccttctccaccacccccgaggcctcctgtgccgacttctatcaaggaggcctatattggaatcatctgaccccttgtctgtatgactcatgagagccatggtaaaataaaaattcaatctctgagtcaccagtccctagcacagaggcctggctcacttgagattctagggaagctttgctggttgaataaacgtatgtgtggatgcaagtcctggctcaaaaatctaaggtcctctaagaacacaggtccctagcgccattccgaaaggctcgacccaaggcctgcactgaacttgagaacaaaatctaaactcttcactagccaggagaattggggactttgtttccccttaacgacagtaagaagagaacccaaaccaaagcctagaataagaagtgatttgataaactggacaaacaccctgggaaatggcaattagaataacttgcaatttcaatcactcctttgtttcataattttcctagaagctaaatatttttctatttggtacaaggggattttcctggccatctcttcaaaagataggaaattaataatattgggtcttgcgagtattcacttaagtttagataatttctgtcatttcctgtttaaaatctccctaataacaagaacatgcagtaacaagttttttggcatttttcttaaatgaagataggacaaaatagattgttctaccctgttcaccctggccataaccatatctaggtgcaaagaaatggtacacagtgtgaagaataaatcaattcctagacacattctacaggactttcctaaattagatcataacaattttaaaggtcaaataaaggcaaaaacactttcagtcttagtaccaaggcatcatgtggctccttgcagtgagctgtgaaacttccccaccaacatgaaagcttacagtcaagactcacaggagaaaaaaagagaaaaggactaaattgtcgtgtaaataagagattcaggattaacacaagcattcttttatttttttgagatgggggttcactgtgttgcccaggctggagtgcagtggtgcaacctcagctcactgcaacccccacctcccctgctcaagcgatcctcctgcctcagcttcctgggtagctaggaccataggtgtgtgccagcacacctggctaattttttgtacttttggtagagactgggtttcaccatgttgctcaggctgaagacaagcgttcttatgcacatttctggaggatattgaggggtaggtttaaagtccaaccatgctttttttttttttttttttttttttttttttgatacatggtctcgctctgtcgcccaagctggagtgcaggggcaggatctcagctcactgcagcatctgcctcccaggttcaagcaattatcctgcctcagcctcccaagtagctgggactacaggcatgcaccaccacacccggctaatttttgtatttttagtagagatggagtttcaccatgttgaccaggctggtcttgaactcctgacctcaggtgacccaccctcctcagcctcccaaagtgctgggattacaggtgtgagccaccacacccagccgctactatgctttttaaagagcaagagaaactagcttaacaggtataacatcccctttcaatacaaaagtctctcaccaaagatccttctctgctggtacaactgcggcgcatctaccttcaccacggagatggttctcaaacctaaaactgtctctctcactctctgctttgaatacttcaagagggccacactgtccgcagaagtaaaaagccattactatggtgtatagggttcttcatgatctgcaaacctacacacgaaaagaatgtattctcttcccacacatcatatattcttgtctagggattcccagggtaggttatcagtaggtcaattaggtttggatacacagaattaaacacagttcaacaggctaacttgttcctggcattactgagctcccagaattccccatggaacacctccatggaccagtgctctggagaacgcagatgctactctccagacacttcaaactgcttcttctccgtctaacacgccaccttcttttattcctccttcctttgcacaccttgaaagaatattcgtttctgttctgtctccctcttcttattcccattcactgctcacctctctgggatcaggctttgaactctaacatgctgcagaaactgcagtgctccaaatgtgacacctaccttttctcgtgtcccttcacattttgaaaagtataaaatgatcttcatcacttttgaatgcatttgcatgcaaaggcataaaagtggctgggaagaagatgtaatgcactcatgaagtgtttgcctttggggacaggagggacaccctttctggtgtcccttcgccctttcacagctcactgcaaggagctacaggatgcctgtggactaagaatgaaagcatctttttgccttttttttgtgtcccttcacctgtgtacttgctccctgtgtacctgtacacgccctttctcatacctcttggcttggctcacttctatgtcattttttatctttttcttttgaaaattaaaaatacagagagaaaggcagaataaggcagaataaaaaccaaacgcctgcattcccattcatcagaggtgacaaccagtagactacactaattaatgtcatgttgttaggctaataatgtcacgttggcttcaagacttttctttttaataaaagaacataacaggataaaagtgaagggtcctgtgatctctgctgacagcccactcccactctgcttctcctcacaagcacctcacaagtgtcctgcgtcttcttctggtccacttttatacctttacatgcaaatgcattcataaccaatgaaaacgattttgtacttcacaaaaaaacaacataatcacatcatacaattactcatccatcacctttgtcactgcataaaatctaatcagtaagatctacccatattggcacacaactcaacaatatctgccaatgctaattcgactgatctatcaacactgatcctactgtttcttccaccatctccagttacttagaacttagcaccatgtcctgtctccaagggcttcttatttgcccctcccagtggccccgtaagatgccccaaatgccttcagctgacacagggcagggacacactcttcaggtccggcccagtctaaggctgtgcccttaagtgttgtgctaagctcccccatttttttgttttataatttattttctttttttcaaataaaaaaatagagagggtcttgctacattgcccaggctggtcccaaactcctggcctcaagctatcctcccaccttgattcccagagtgcagggataacagcgtgagccaccgcacccagccaagctgccctgtgtccatcaataccccactaggcactgtctctgcgccactgtcttgtacatatcatgtctctcaattccctgaaccatgcacttacttatgtgttaagtacaattactatcctcactttacagatacagaaactgaggctggggcaggtcctggaggcttggtgtgaaccacaactatacagctttagactctaagtttttatccacagggctaaatgtcaggtttacttggaaaaaaaataaaagtggaagatgaaattagaaagatgggcccgtgtaagattgtgaagaggcttgaatgctcagctcaggagtaccggttaacaagttacatggtattgtacctatgtcactggtccctgatcaacacagcaccagagcgccctgggaacagggaaacggtactcacggtcatggaccttgtagcagtgcgtctgcaagcgcttcacgtcccattcctctagcacgccatgggtcatcagcaactggaggaagcgccggtggacatcagtcatgacgcccattctccttgtgctgccctgcatgtgggaacgaactgaaaaggaagtaaatgacactagtcaaccccaagcacatcagaagcaacgtcctgggtcttgtactaatttacattaacaaatataaatttgctatcatttttaaaagtcattcttcatgctgtttactacaaaggtgagaagaagaacacgagtcacagcatcaggactgggcagtggtaagaggtgtggattctggagctagaatgccgggattcagggcctggctctcccacttactaggcgtgtgagattgagcaacttagtccccacaggctttggtttctgatctgtaaagtgggactaatgatagaaacgtcctctgcagaactgctacgaagattagatgggttaatacatgtaatagcctggtaacacagtaagcactaaataagtctgagctatttttactatcaggcaattctgggtctaacccttggctgagcctttttaccagatctatggccttggagaaattgagcagaggccccgttttctcaccataaaattataatgaagttcattactgagagaactactagtaaacacttaataaatgttagtttcctcctctccccaaaccactaataaaacaactatcatggcaggacttcagactattttcgaaatctcctgctcactaacaaaatgggatctttccgtaaaccacaaagatcacagttaataaaactattccacaagccctgatcaaaacgctggctactgccatggagcacgcagtgcaggggctaagaatgtgaatttggaactaaacaggaagcactgagaccagaaagtcccagatctgcctgatcctaaggatttcctaatgtgcattttaacaatacagattcccaaaccctttcctggatgttctgactgcaatgggtcctggaattctgaggtgtttacattcattttaggtgatgtcaagatctgacaagaaagaagttcactggtgccttgggcaaatacagcaggcaaacatttttagctaacaatgctcagcctccctaaggcctagtctcttcacctctaaaactgggaaactagtagctaccttaaagacatagaggaagcctaaatgagtcacaactaccaaaggcttgccaagcacctggcacataagagatccacaagactgctaattactgctcttttgttcttttttttttcttttttttctgagatggagtctcactctgttgcccaggctggagtgcagtggcgtgatctcggctcactacaacctctgcctcccgggttccagtgattctcctggctcagcctcccaagtagctggaactacaggcgcccaccaccgtgcctgactaattttcgtatttttagtagagacgggtttcaccatgttggccaggctggcctcgaactcctgacctcaggcgatccacctgcctcagcctcccaaagtggtgggattacagtgtgagccaccacgcccagccagtgctgttctttaacagcatcctcaactggacctcagggctgggaaaatgcgccatctcataaccagtccctccaactgcctgctagaaaaatatcctccatctcaccaaatctgcacctcaacaaagcctacgttagactcatcctctccttccacctccttagcccctttcctctcccaagtccttctctttgcaaatcatctggtgtggacggtgcagtccacacaatcataccacacacctgagcatcgaactctggtcctcctctccttaaacctcaaatccagcctgtcatcaactttatttcctatcactagggccattccatgtcgatgtacttagcacccccgtatttgccagtggttgttctgggcacagggttagaatgtgctaggctaaaaacaatggacttctatcctgcaaatgaaggatctctacaaactaagggtcttgaagcaggaacatggtgttgcctagctgtgttttagggagattatcctctttggcatcatggaggtgtagaggaaagaaatgggaggcaaagagtccagaaagcagtctcctgaagggatcctacaaaaggggatgaggtatcaccgaggcttggcagtggggacaaatgatacgaatcactgtcattgtgatcccatcaaatctcaagcagaataaactctaaaatatccacctaggctcatcctaataaaaccacacaataccagagattaaacacaatcaaagaaaaagtcagatgacttctaaagagcaacaagtagactgccggctgccatcacaatggcaacaatggaagccggtcacagtggaaacatatcttctatgctgggagcgggtgtctcaacagagaattctataacgagctgaagactgaggataagacaaaaacatttccaaacaacaaaaaactgaaagagcaagtgaccagcaggtgctccctaaaggaaattccaaagcatatagttcaggaagaaagaaagggatacaagttggaaggtctaaaatgcagggtagaataaagagcaaaaaaagttggtaaatatgtggttaaatccaagttaactgtataaaacagtaaaaatcagaagaaatgcttctatctttaaaaaaaagtttttaataccacagtaaaaagaatgaggtttttaaaaaactaaatacacaaaaataataacataaatgggaggtgagcaatcactgggattagtgttctaatagccttgtgatggtcaggagtagaagctggacatgaataaattttacacttgcattttacaatttctagagtaacaacttttaaaaaaacaaatagtgtatataatttccaaatagtaaaggggaataatgtaatgagaaaaaataatggaaaggaaaaccaggataggaaaaacaaacacaaaaaaacaaagtaagtcaggagaaataatccaactagattagtaataacaatgaataaaaatagactaaatgttccagcttaaagacaaggactgttagaccagatttaaaaccttatcaaattaataatgaataaaatctacctctatattataagagttccttataggctgggcacagtgagcccaggagttcaaaaccagcttgagcaacatggcaaaatcccatctccacaaaaaacacaaaaattagctgggcatagtggcacacctccgtagtcccagctatttaggaggctgaggtgggaagattgcttgagcctgggaggtcgaggctgcagtgaaccgtgatcacaccactgcactccaggctgggcaacagagtgagaccctgtctcaaaaaaaaaaaaaaaaaggttgcgggggctggtcgtggtggctcacacctataatcctagcactttgagaggccaaggcaggtcaatcacctgaggtcaggaggtggagaccagcctggttaacatggtgaaaccccatctctactaaaaatacaaaaattagccaggcatggtggtgcgtgcctatagtcccaactactcgggaggctgaggcatgagaatcgctggaacatgggaggcagaggttgcagcgagctgagatggcaccattgcactccagcctgggtgacaaagcaagactccgtctcaaaaaaaaaaaaaaaaagaaactataaaaagaactacaaattaaatccaaagaaaggtaaaatgagaaaataataaagggcagaaattaataaagactgaaaataagcatatatctaaggtcaacaaaaccaaaactattctttgaaaaaacataataaaagtgaaaaacttctgacaagattttccaagagctaaaacttataaacaaacaatatttgaaaaaaaaggaaattaactgcaaatgagacaaatatctgcaattaacatacttaaaaatattatcaataatttataataatctgaaatttaactatgtaaaaagtcataggaaatttattcaaaactaatgaatgaattatctgaaaacctaaacactcctataaccattaatgacattttatagaaaatccatcttctcacaaagaaaacttcaggtcccaatgactttatcaagaagttctaccaaatagtctaaaaacaaataatttcaaatgttacacaatcgcagcgccagaaaaaaagcaaaccctccccaacccatctgacaaggctaacctaatttggccctgaaacctaacaaggatgtcaaaagaaaggaaaattacaagccagtatctttcatgaacacagctacagtatgtcctaagcaaaatgctaacaaacttaatccagatatgtaaaaggaatgacatatcatcacttaggtttattccagcaatggtttcacatctaaaaatcaatcaatgtgagtcaccacattaataaaggaaaaagcattttaaaattcacacagggccgagcgcggtggctcatgcctgtaatcccagcactttgggaggccaaggcgggcagatcacctgaggtcaggagttaagaggctagcctggccaacatgatgaaactctgtcgctaccaaaaatacaaaaattggttgggcggggtggcacgcgcctgtaatcccagctactcaggaagctgaggcaggagaatcgcttgaacctgggaggcgggggttgcagtgagccaagatcacgccattgcactccagcctgagcaacagagtgagacttcatctcaaaaaaaaaaaaaaaaaatcacatggaaccaaaacagagcctgaatagcgaaagcaatcctaagcaaaaagaacaaagctggaggcatcacgttacccgacttcaaactacactacagggctaaacagcatggtgctggtacagaaacaggcacatacaccaatggaacagaatagagagcccaaaattaaggccatacacctatgaccacctgatccttgacaaagatgacaaaaagaagcaatgggaaaaagactccctattcaataaatggtgctagtataagtggctagccatatgtgaagactgaggctggaccccttccttacagcacatacaggaatcaattcaagatggattaaagacttaaatgtaagacctaaaactataaaatccctggaagacaacctaggcaataccatcctggacacaggaacgggcaaagatctcacgacaaagacaccaaaagcaatcacaatgaaagcagaaattgacaaatgagatctaattaaacttaagagcttctgcacagcaaaagaaactatcaacagagtaaacagacaacctacagaatgggagaaaatatttgcaaactatttacgagagaaaatcaaacaaccccattaaaaactgggcaaaggacatgaaccaacatttttcaaaaagaagacatacatgtggtcaacaagcatatgaaaaaaaagctcagtatcactgatcattagagaaatgcaaatcaaaaccacaatgagataccatctcacatcagtcagaatggctattatcaaaatgtcaaaaaataacagatgctggcaaggttgcagagaaaagggaaacttatatactgttggagggagtgtaaattagttaaaccactgtagaaagcagtgtggcaattcctcaaagagctaaaagcagaactaccatttgacccagcaaccccattcctgggtatataccagaggaacagaaatattctaccataaagacacatgcacgggaatgttcactgcagccccattcacagaagcaaagacatggaatcaacctaaatgcccatcaatgacagactggataaagaaaatgtggtacctatacaccgtggaacactatgcagccataaagaagaatgagatgatgtcttttgcaggaacatggatgaaactggagactattatcctctgcaagctaacacaggaatagaaaaccaaataccacatgttctcacttataagtgggagttaaatgatgaaaacttatgaacacaaggaaggaaacaacagacactggggtctatttgaggatggagggtgggaggaggaagaagagcagaaaatataactatcgggtactggacttaattcttggctgattaaaaaagctgtacaacaaacccctatgacgtgagtttacctatctaataaaccttcacgtgtgctgccaaacctaagtttttttaaaaaagcatatgatcatcttaatgatgcagaatatacaattgataaaattcaacatgtacctacaccaaaaacaaatttggaatcgaagaaaacatcttttatctactaagtgacgtctacaaaaaacctgcagcaaacatcatactgaaaaatgaaatgttggcagcaatcactttaaaaaccaaattgacccaatgcaattgaatcaatgctattacagtcagcatcccaagaggctttgtgtatgtgtgtgtgtgatttgacaagatgattctaaaaatttacatagaaaacacaaaggcaaaacagcaaagacattcctgggagaaaataaaggcagaaggacttgtcctaccagctataaagacttctcatatttgctgggcgcgatggctcatgcctgtaatcccagcactttgggaggctgacgtgggcagattgcttgagcccaagagttcaacaccagcctgggcaatgtggtgaaaccttgtctctactaaaaacaaaaattaaaaaaaaaatcgctgggcatgatggtatgcacctgtagtcccaggtactcatgatactgaggtgggaggactgcttcagctcgggatgtcgaggctacagtgagtcatgattgcaccactgcattccagccaggatgacagagtaagatcctgtctaaaaacaaaccaaaacaaaaaaagcacttcttataaagctagagtaacgagtacagtgtggtaatggtacagagatagacaaataagaccaatcaatggaacagaacagagaactcagaaacggaaaggtatacatatatggatacttgatggcggatgaaagcaaactttccaataaaaggtgccaggaaaacttgttatccatatgtaaaaaaatgaataaaatttgattcttacctcatactatatacaaacatcaattctgaagggataaggtcataataaggaaaaatactgtaagacttttaggcaatatagagaatatatttatcacctaagggtagggaaggatttctttaagagatataaaaagtacaggtcataaaggaatatactgataaacttgacttttgttaaaattaagggcctctattcaccaaaaataccagaaaggtgggggttaggggatacaaactggagggcatttaaaacaaacataagctacaaaatacaaaagattcatattcagactatataaggaattcctacaaatcagcatgggaaacacaactgtaaaagagaaatgggcaacagaaattttacaaaaagaggatgcataaatgatgaataaatacagaaaaaagatgctcaatctcaatgttatcagacaaatgattatgaaaaccacagtgaaggaatgtcttagccaccaccagacaggcaaaaattttaaaagaatggctgaggctgaaactttcatctgctgctgggagagtataaattcttttccttttttttttttttttttttttttgagacagggtctcactctgttgcccaggctggaatgaagtgacacagtcatagctcactgcagccttgaccttgtgggctcaatcgatcctctgacctcagaaccccctagcagctatgactacaggcacacaccactatgcccggctaatttctgtattttttgtagagatggggtctcacctgttgccccagctggtctcatactcctggactcaagcgatccacccacctcagcctcccaaagtgctgggattacaggtgtgagccaccactccaggctgagtataaattattgtaaccatttcagataacagttgatattactagcaaatttgcatatcccccgaaatctactattaggtatataccttacagaaacttccacatttgccctaggagatatgtttttacagaagcaccttgtaataacaaaagtctggcaacagtataaatgcctaccaactgaagaactacattaaaacaatataatcatcccatagaattcaaatcagcaatgaagacaaagtagagctcctcacatcaacacgcatacttctcagaaagataatgttaagtgcaacaagcaagtcacacaaaatatattttaggatcctattacataaaatcgaaaactcagcaaaagcatacattcattcattagaaatacacacatacatggtaaaaactacaaagcaaaacaaggcaacaagtaacacaatattcagggcggtggttatctttgaggagggaagaaaggattcagtggagggtctggcaatctgaaaatgtctatttcttaacttggtggcaggtacatgagtgttcattttatttttgttcttcaaacttacacttccacacaattgtataggtatgttacatacaatgtttttaaatgtgatgggctgggcatggtgattcacacctgtaatctcaatactttgggaggtcaaggcgggaggactgcttgaggccaggagtttaagaccagcctgggcaacatagcaagatccactctcaacaacaacaacaacaacaaaataatgtgaatatgttaaataacagccaaaataaatgtaaatgagaatgagaacaggataggattgaatgctataatttggtggaaaaggagtgggaaaagtaggagtggaagaaagacaaccataagcttgtttatgcatattatgtcccttgtctctatgagaagagactgtagggagaatggtgggattagcatagacatgtattacctacttaaataattttattttatacaaaaatcagccaggcgtggtggtgcacgcctgtaatcccagctactcagaaggctaaggcaggagaatcgcttgaacccaggaggtggaggttgcagtgagccaagatcgcgtcactgcactctagcctgggcgacagggcgagactctgtcacaaaaagaaaaaaaaaattactttttttaaaaaaattaattaaaacagtttattggctttaaatgtacatcagtaaatttttaaatgctaaaaagttatgataaaataatacagaaccaaaacatcaaagaaaatagaggctcagcagcatgatttcaatatattttcccggataaacagattttttttctaagtatatgcctttttattcaagaacaaaaactccctaaattcaatgtttagaactgaattttttttaactaagcccagaaaactggggctcataaaataaggcataatgtgggcagcaaaagaaaaaaggagaaaaaaaatgggagaaaaattggttttaatcccatgtataatataggttggctggttttgtttttgttttagccaatttaaggcagaattatctctctgcaaccttgcagataaatcctagtgttttagccataagtttcaagagttcatatatacagataaaccaattaaaaaaaccttttcgaaggcttttgaagcattatataaatctttaaaattcctatcacccacattttaagaaatacatctatacgtttaaatttattattaaattaattaaatgcattaattaaatcaatttatttaaatttaataattttaaaatagaaatgtttgtggaataagtaaatctcagtcataccattcgtgcgggtgctaacacaattctagtgcttcacatgcccgacctcatttaacccaaaccagaacaaccttatgagcaaagggtcactgaccccatcttacagatgaggaaactgagactaagagggcacaaggtgacacacaagagttggtggcagagatagacgtgaccatacaacagcacagttcctgttttcaaggacactctctatccagcgagagtgagaaaagtgagtgaacagaacaactacaatccaggtccctcatctgcaaccctcaaatctaaaaaggtatgaatactagtggatgatcggatgcaggggaaaaaaaaaaaaaagtctgaataccaaaacttgtttaagttggaaaacttgacctgacttaaggtgaggctatttatggttatttatcccaacagtgtaaatatatgcatttttttttttgagacggagtttcgctcttgttgcccaagctggagtgaagtggcacgatcttgattcactgcaacctccgcctcccgggttcaagcgattctcctgcctcagccttccgtctcagcctcccgagtagctgggattacaggcacgcaccaccacgcccggctaattttttgtatttttagtagagacagggtttcaccatattagccaggctggtttcgaactccgaacctcaggtgatccgcccccctcagcttcccaaagtgctggaattatagccgtgggccaccgcgaccaggtcaatgtaatatatgcgtatcttcataactttagctgtggaaagggtcgtgtatttgattacaagccgctgctccagccccctctgagggtgaaacctaacatagaacatagggactttacctttccaaactccgagaactcctcgattttaaacgcatctggcctcggggctgtaacataagcggctgcggacttgtacaaagtaagaaactccgtacacaaaacagaggggagcacggagggcggcgggacaaagagggtggtcggcaaaggctgtattttccatagatgtaatcacagtttgaatcgaattttatattttgctttttcacctgttacaatgaaaagtatctttacctgttaaatcgtaattacgattaaaaatatttttcactaaatagtaagatttttagatgtctgcgtgtgtgttgcgggaggacatcccagtccgctgttttctgcggcccctgtctgggcctcagtttccccatcaagaagggggaaaccccaagaccccagtccccgagttccacagcccacggggaccgaccccggggccggaccccactgcctgtctcgcccaccccaccttccgtcctcccctcgccttccttgaagtccctcttctttcccctccaacccctagctccccacgttacccaccagggagcccaagcgcatcccaggccgcgctagcggatacggtcgcaaggtggactcttcttcctttgaggcggggcgaacgcgaacgcggcgttcccattggtggcctgcggcttattcgcccgtccgttgagtgacgcacttccggttctccgtttgcgccattgccctggtggttccgcctcgtgggttagatcccaaattacgcccgctctcgatccttaataatgggaaggggcttccacttgtcgccctccgcctcctgcacctcagtgacttccctgaccaaggaggaagaattggcgtgcagcctgggcttccctcaatggccaccattccgctggcacaatgtagtgccctgccccgggcctcagtttccccatctgtggaactgagtgtggcctcgacgtcaaaaatgtggactctggtccggtcgcggtggctcacgcctgtaagtaatcccagcactttgggagaccaaggcgggccgatcacttgaggtcaggagttcgagaccagcttggccaacatggtgaaacccccgtccctactaaaaatacaaaaagtagccgggcgtggtggtgtgtgcctgtaatcccagctacccgggaggctgaggcaggagaatcacttgaacccgagaggcagaggttgcagtgagccagatcgtaccacagcactcgagcctgggtgacagagctcaaaaaaaaagaaaagaaaaatgtggactctgtggtcatagagcctgatctagaatcctggctctgccacttactagttggcaggcgcttgggcaagtcactgagcctcagtttcctcttccattaaatgaggatattagttcttgcaaaatagtgttggtgagatttacaagagataataacacctatatcaggtgcttagcatggccattgaaaagtgtcacatgggagtgctgattatatgttaactgttatcttacctagggattgtgagaaagcaagtgaaattactcgtggaagtgaatggactgctttgagtcttcaaggcgttaattttccaaacgtttgaattctatccctggtctgagagctagggatgcagcctagcaagggaaacaggtaactaatatagaacagcagtacctgcaaatatctgtctctgtgaggatagatcaaatccaggcttggtcactcaccacccctgtgatcttggacaacctcttaacctctctgggcttcagtttcatctgctaagtgggaaagcagtggtgtgtggtgattaaaagcttcagctttggagctggatggtcaacatggaatcctgggccttaaactcagtgtctctgagacataggacaaagtacagtcagctgtccatgtttacaggttccccatctacggattgaagcaactgtgggtggttaatatttgtgggggaaaacagtaaaaaataacagttcaacaataaaaataatacagattccgaaagcaatacagcatagcaattacttatatagcatttacattgtattaagtattgtaagtaatttaaagatgattttcaatatactggaggatttgtgtaggttaaatgcaagtattctcgcattttgtaagcacccaatggttctccttgcctgcttcctagacagaaccaatttatcaagacaggggaattgcaatagagaaagtttaattcacacagagctggctgaacaggagaccacagttttattattactcaaatcagtctccctggaaattcagggttttcaaggataatttggtggctggaggtgctggggattagagagtgttgataggttggatcagagaggaaaggagtcaaagctgtcctcttgcactgagtcagatcctgggttaggaccataggaccagattagccagattacagggctgggtggcgtcagctggtgcattagaacacgggttctgcaaaatatctcaagcactgattttaggttttagaacagtgatgttactcccggaagcaatctggggagggtcagaatcttgtagcctccagcttgcgtgacctcctaaaccataatttctaatcttttagctaatttgttagtctacaaaggcagacccgttcctaggcaaggaggggatttgttttgggaaagggctattattgcctttgtttcaaagttaaactataaactaagttctttccaacattaattccacctatgtccaggaatgatcaaggacagcttggaagttagaagcaagatggagtcaggccagatctctttcactatcataattttctcagttatgctttttacaaaggtggttttgattttacataagggacttgagcatcgagaattttggtatccatggggactaaggtaccaatccctcacagatactaagggatgactgagctcaagttttcagcttcagtttgctcatctataaagcaggtttaataataacactttgttgataatgttattctgaagattaaaggaagagtaaacgtaaactacttagaagagtgtctctggcacattgtaagccctcaataagtgtgaactaacaccactaataagttctttataaactgcctaataggtagtcaaataagaggggaaataaagccctaaggagtaatatttgtgttttgtttgccctacatggttttgtgaaattttctattcattatcaatatttaaagttggggttttcaatctttgactgggcatgatggctcattcctgtaattccaacactttgggaggcccagctgggaggatggcttgagctcagaagtttgagatcagccatggccaacatggtgaggcccccatctctacaaaaaaaatatatacgcgcgcgcgcacacacacacacacacacacacacacgcaaaaattagccaggcatggtggtgaacacctgtggtcccagctactcaagaggctgaggtgggaggacagcttgagccaaggaggaagaggttgcagtgagctgagattgcatcactgcactccagcctgtgtgacagagccagactctgtctcaaaaataaataaataaacttgggacatttcacataaaaccctactgtagctgactgctctggaaaagtggggaagtctgacgacagtgggccagccttcccccatggcagcacttgttcagaacttgggagagaccgtccccttttgtgaagcatgtgcttccctggtgtgtggagagataaaagaatagaaaacgctgggaacaccagcatttcaagatcaaagcgtcaagaaaaaaaggtagaaagaaaagaaagattcaagactgagggggttggtctttcacttgaagaccatagaagtgatggaagaccaggaagaaatgagagaaggtttgtattttagaaaaagaacttgggtatatctattcttttcaaacatgcttggaacatttacagaaattgattactgggccacaaaggaagcttcaagaaattctcaagaatctataggtgacattcatgaaccacatgctgtgaaagtggcatcagaggcacataggaatacagacttttgagaaggagggtgtggtcagaatcgtcaatgctctggagaggtcgagtaagatgcgccactgatttagaatttgatggccaacaaaggccatcttaatagagaggggaggaagccagatcgaactccaagagtgaagagtggaagttgaggaagtggagagggaatgctgactgctcttttgggaagtatggcttcagaagggaagacttgaagacataggagcagagataataatccataaaataaaaacaggcagccgggtgcggtggctcacgtctgtaatcccagcactttggcaggccgaggcgggtggatcatgaggtcaggagttcgagaccagcctggccaatatggtaacaccctgtctctactaaaaatacaaaaattagctgggcatggtggtgcgtgcctgtaggcccagctacttgggaggctgaggcagaagaatcacttaaacccaggaggcagaggttgctgtgagctgagatcgagccactgtactccagcctgggtgacagagtgagattccatctcaaaaaaaaaaaaaaaaagaatttgagactagcctggccaacatagtgagaccccatctctactaaaaatacaaaaaattagccgggcgtagtggcgcacacctgtagtcccagctactctggacgctgaggcaggagaatgtcttgaacccaggaggtggaggttgcagtgagccgagactgtgccagtgcaccccagcctgggcaacagagcaagactctgtcttaaaaaaaaaaaaaaaaacaccaaaaaaaaaacagacaaaaagggatggggtcaaaggtgtatagcgacaggattactgttaacctagagaagagaagagacacttctgaaacagcaggaaaagaggtgaaagtggctaaaaaaagctcactcctgatgttttccgttttctccgtaaggtagcaaacagtatcaatctttggctgaagagggcctggcgtggtggctcacacttgtaatcccagcactttgggaggctgaggtgggaggattgcttgagatcaggagttcgagaccagcctgggcaacacagcaagacctcgtctctacaaaaaaaaaattaaaaattagccgagtgtggtggcatgtgtctgtagtcccagctacttgagaggttgaggtgggaggatggcttgagcctgggaggtagagcccaggaggttgaggctacagttgaggttaaggttgagggatggtgccactgcacaccagcctatcccaaaaaaaggttgggaggtgctgaggagatgctaagggatttaaggggaatggatcaaaaggtttggaagagacgctgacgacaatgcagagatgagttcctagctgaggttgaaaccagaaatgtgtagagatgacagttggttatctgatccctccctcaacacccccatccccatcctgggggcttcagagcagaagctcagcctggattcatactgaagtgggccttagctggggttaagcaactgattcatagaaggccaagtgacgggagaatgctactgtcaagtgatccactatggatctggcaaaaataaaaagaagggaaagtgctgacaaattaaaatggaagcagtacagcaatcagaggcctctatgaggtgaatctcgttcagcaggaacaagtagtgagtaaggatcgaagttcatcatgcagagtggtcccccatggggtgacagtcctgcctcagtatgactcagaggacggctcattccctagtgggctctgtgagtatttattgggcctttgaagtgccagactttggactctctattcctggacagctctgatggttcagacttctcaaagctgaccctaaaatgcatgagagctatgagtacataaatttgttgaccacaaggcgagggccaaggccttggctagagaggaagcttcgggaaataatatgctgagggtgttggtctttcacccgaagaccacagaagcttatgaaaagtaagtgatgagatcaggcttgtattttagaaaaaaaaactttggtatatctattctttacagaaattgactatgtactgggccacaaaggaagcttaaatgaattccaaagaatctatagaccacattcacaaaccgcaatgtggtaaaattaaacatcaacaacaaaaagagagccaaaaaggtgtagatacaatacaccttaaattagtaactgcagctgcttctgaggaaggggccaggaagtcagaatgaacttttttttttaaccacgtacatctattacttacgaatttttaaaaattaaaaattgggcggacgcactggctcacgcctgtaacccctgcactttgggaggccaaggcaggtggatcacctgaggtcaggagtttgagaccagcctggacaacatgatgaaaccgcatctctactgaaaatacaaaaaaatcagccaggcatggtggtgagtgcctgtaatcccagctactcaggaggttgaggcaggagaattccttgaacccaggaggcagaggttgcagtgagccaagatcgtgccattgtactccagcctgggcaacaagagcaaagctctgtctcaaaaaaataaaaattaaaattaaaattaaaaattataagcatatattcgagttttatttcttaagtgaggtgttgagtacaggaccatgtacacaggtattatattttttatatgttgaaagattttatcatacatttttaaaagaaaaagaacacatgtttagaaactgaaaacattcagattaaaaagaaaaccaatatggaaattataaaatatttggaaataaatgacaatgaaaacctgacatcataaaacatgtgggatccaactaaataattagctgggcacggggttcacgcctgtaatcccagcactttgggagcctgaggtgggcagatcacctgagatcaggagttcgagaccagcctggccaacatgacaaaaccccgtccctactaaaaatacaaaaattagccgggcatggtggtggatgcatgtaatcccaggtaatcagcaggctgaggcaggagaaccgcttgaaccctggaggcggaggctgcagtgacctgagatcacgccactgcgctccagcctgggtgacagagcaagactccatctcaaaataaaaataataataataataataataattagagggggacttatagctttatacttcttacaaaataagaaaaaatgtaagggagttaattgttaaaagttagaaaaataacaactacagaaacccagagaaagcagaaggaaggaaataagaatgaaaaagcagaaatgagtaaaacaaagaacaaaagaaaatgaagttgattatagaagccaaaagctggtgttctcttaatgactaataaaatagaaaaacttcatgtaagattgatcaagaaaatcatacaaacaatacgataaatggcaaactgaacataccagctagagtaaaaattttagaaagcacaaaagtataccacaaactttatgccaatacatttgaaaaattagaaaaaaggtaattttaacaaaaataaaaattacaaaacttgacccaagaagaaaagtgttaggttggtgcaaaagtaattgaggtttttgccattaaaagtaataatcactaatgaaatcgaactagaaatataggatatgcttcacctcctaagatgtccagaacaagtaagttttactggagtgatcagcacacacaaaaagactatattatgcaaaattcactggaatatgaacaagatagagaaagctattcaacacattctgagactagtttaattttgacaccaaaaagagaacagcaaaattaaagaaaatgtcaggctcatctatattacaaatatgtattgaaaaaaattcagtctaccagtgtatcaaaagaatatctcttccaaaagagaaaattcacatggccaaaaaatatgtggggaccaggtgcaatagctcatgcctgtaatcccaggattttgggaggctgaggcgggtggatcacttgaggtcaggagttcgagacaagcctggccaacatggtgaaaccccatctctcctaaaaatacaaaaattagctgggcatggtggcaggcacctgtagtcccagctacttgggaggctgaggtgggagaatcacttgaacctgggaggcagaggttgcattgagccaagatcacaccactgcactccagcctgggtgatggagctagactccatattaaaatatatatatatatatatttatatatatgtatatttataaaatatatatttaaatataaatataaaatatacatttaaatataaatatatatggaaagatgtttaacctcactattagttggaaataaaacaagaaaaggaaaccaactttttccctataagaatgacaaaatgtggtcaagggtaaagaaagaccagtattgtacgtatatggtggggttataaatgttgtatatagcccctctggagagctatttggtgttactgaaattgaaaaagcttatctagcaattccacttctaggaatttaactgaagaaaatctcccatgtgtgcttgagatttgctgcaacaatgtggtgggaaaaaatgaaacgtcctaaagagccattaataaggaaatcaaaaagcaagatagtcatgtaccacgggtggtcatataacatgaaaaggaatgaattaactcacaagtgtctacatgaatgaatcctgaaagcatagatagagtgggggaaaagcaagatataaagatgatacagcaagatcaccatttatgcaaatttggagcagtgcaaaatggcaatattataatttgccagtagataagcatatgcatataaaactattttctatttaaggattgaaaagattgttataaagctcaagctagagggcctctaggaaggggaaaggaagattgggatgggagaagagaataaagatcttgaggtttatctggaatattctaattttatttctattcatttattttgagctggagtcttgttctgtcacccatgctggagtgcagtgacgcgatcttggctcactgcaacctctgcctcctaggttcaagcgattctcctgcctcagcctcccaagtagctgggactacaggtgcacgccaccacacccagctaatttttgtatttttagtggagacggggtttcctcatgttggccaggctggtcttgaactcctgacctcaagtaatccgcccacctcagcctccgaaagtgggattataggcgtgagccaccgctcccagcctggagtattctaattgtgaactaaaataataaaactatgtattcatatagcaatgaatttaaggattgaaaagatttgaaaatttaatttttcaaatattggctttaaaaaggcgttaaagtcaaatatgccaaaatgttaacagtggttaatgttggatggtagaaaaatggacaactgtcatttttttcacttttacttttctgtatttgaaaacaaatttctgataggagtgaaaatatgaaaaaagaattaaaagtgtatttttgaaaagtacatagcaatgaatggagaagagaatggagactagagaccgggtttttcacagcccaggtcaagcccttttcagagtcgttttcatcagcatttgtatactacatcatttttgtttctttttttataaagctcagcagtgtgataaatacataatttttggattcatgaaattttaagttcaagccaggtgcagtggctcatgcctgtaatcccagcactttgggaggccaagacaattggatcacgtgaggtcaggagtttgagaacaacctgggcgaaaccccatctctactaaaaatacaaaaatacacacacacacacaaaattagccaggcatggtggcacatgcctataatcccagctactcaggaggctgaggcaggagaatcgcttgaacccaggaggcggaggttgcagtgagccgagatggcgccactgcactccagcctgggcaagagtgagattctgcctcaaaagaaaaagagagggagggagggaaaagaaaagaaaagaaattttaagttcaatctagcagaggtgatgcgcgcaagttggtagggaaaaaaaggaaaatgatcgccctctactcatcactcttcttaaaaggaatggtgacagctcccaaaggtcaattttaaaaactgtcaataggccggccgggcacggtggctcatgcctgtaatcccagcactttgggaggctgaggcgggcagatcatgaggtcaggagatcgagaccatcctggctaacacagtgaaacctcatctctactaaaaatacgaaatattagccgggcgtggtggcacacgcctatcttcccagctattcaggagactgaggcaggagaatcccttgaacccaggaggcggaggttgtggtgagctgagatcgcaccactgcattccagcctgggagacagagggaaactccatctcaaaaaaataaaaat

SEQ ID NO: 198 - DNA, 127846 bp, Homo sapiens
aaaagaaaatgtagagagatagcattaaagaatctagtttttttcttatcaatctactggttaatcagtttatcatcaaccaagggtctacatatatactgtgtaccatctgtgaggctgacatttaggtgctgtgtgggttcaaggcgtaacaaacttcaactctttttctaacgacaaacagatgactgtaatgccacaatgagagagagaaaaaaagagactgtataaagataaagtgtgatgcattttgtgctttcaactgtaggtggtagaataacttcatttatgtatttaaaaattcaattaaatgaacatttgccgagaagttatttggaggattcagagatgaataaagtcagcaaagaagacagatacagaaacaaaaatgacaataaaatatgctaactacttcagtagaaatatgtaaaaaacatggaagaaggctgggcatggtggctcccacctgtaatcctagagcattgggaggatcacttgaaaccaggagtctgaggccagcctgggcaacattgtgagatgccatctctacaaaaaaattaaaaaattacctgggcctggtagcatgcacttatagtcctagctactgaggaggccaaggcagaaggatcccttaagcctaggagttcaagattacagtgagctatgatcatgccactgcactccagcctggttgaaacagtgataccttgtctcaaaaaagtaaaacaacaacaaaagcaggcaagaggtgtttcctggcagtgcagcgatgggtggtgtttgacctgagtattaaaacaagaagaaaagttagagagtcaaggcatgtgcaccaaccaagcagagggattagtttatgcaaagagacagttttttagaatgatatatcattcagaatggctggagtacaagctccagttgagagtgatggcaactgaatatagaaagatgaacaagctccagttctggagagtcttaatgtcatgctgatggtattggatttaatctcgtagtcagtggaaaaccgttgctagatttcaagtcaatgcatgacttgatcagatttgcattttagaagtataacaatcataataacttacattctttgagggcttgctatgaaatgaatactgtgtgccttcttgcatttagcagaaggatgacttaaactgatttccagagttgagagcagagataaatagtaaccagagaaagcttcctagacagcggaccttgtagactagctggcacttggagagggaagcaaaaaggggtgatacatcaggtaatgtgaaaagtaggaaagattcacctgtgttggggatcaacttgtatttatgagaaggtgaggagacctctgaatagaactgagattgtgtgcggtttagtgccccgtaaagtgggttcgaaggggcctgtggaggtcctgtagaggtttctaaaagtcagatggaagaatttaggatggattaccagccaacagggagacaatggcaatttctgaatgacttggaactgagggaagaggaagaatttctaacgtgagtatgtagaatagactggggatgaagactggggatgtctggggacagatgaagtatgtaggtgtctgcagtcatcctcatgtgagtttatgtcctacttgaagatggcagctgcaggaagacagaggaggaaactggtgaaatcaacaggacataaagattgtgtaaatatgacaggtggaggaggcatgaattagatgtgactccatggtttcaatcctgagggacagggaaaatgatggtgctgctataaggcccagtgtgagaggggtttcttcagctcacctgcgctggaagagaatgacagattccatagcttggtctcaccagctgcagttctgcctcccaccaaaatccttgcctttgggtaaagtaggagaggggaatccctgagtctcacactctgcgcaggatcctacatggtttcttggtcttgcatgatccagaaatggtggaaatggaacattcccaataatgtagagtttctaatgatgctcctgctattcacagggtgggattagtaaatgaatttggccaagttttgtattgaccataggtcttgatgctatttctccaaggccctggggtggctaacccctttctcctccagctgaggtgtggtggctctccactacccttatttacataggctcggtttcagctatggctcaaacactcgcaagctatgtttctttggacaagttactaaacttctgtaagcctcatttctctcatctaataattagctacctcaaagaggtacaggaagaattaaatgaggggatgactgtaagatgcttatcacagtctagcacacagtagacccggaatacacagcagcagcatctgcagttgttgtggttgttaggaagacaatgacaatgaagatggtaaacatctggtaaccaccatgttcaccatcttcatcatcatcctaacaaccacatgatggcaaacatgagctaacaagatgctctagttcctccaggccaccagaccccttggcagccttcttgtgttgtttttgaagcttcccttatttctattcctctacaccggtaagagagtcccatcttgctttctctttccctttcagttgttttcttgggtacctcttttttttttcttcaccaattaatactccacttcatctccagttttagccaagctccttactgagcatctttcagcagatttttaccttgtgtttctcttcaaattttcactatgagagaaattggggaggaaaaagtattgaatattttcaaatggaagcacaagtggaagaaggaaaagtaaggtgaataagagatacttcaaaataattttattttatttaatattttttgagacggagttttgctcttgtcacccaggctggagtgcaatggtgagatcttggctcactgcaacctccacctcccgggttcaagtgattatcctgtctcagcctcctgagtaggtgggattacaggtgcccaccagcatgcccggttaatttttgtatttttagtagagatggggtttcaccatgttggccaggccgatcttgaactcctgacctcagttgatccacccacctcggcctcctaaagtgctgggattacaggcctgagccactgctcccggcccgagatacttcaacatagttttgaaagcagagaaaatcttgaagtttttctctccttcttttcataaatgtgttgtttaatcatttgaagttacaagcctcttcaggctagaaccatgttccattctcctttcctatgtcctgagttgcctaggcctgtggtaggtacttaataaaatctttggtttaaagagttattttaaaagaaatcctgcaccttctgctgacaaaaatgtttgctaatggcaagcaaactggaagacagaaacaagcaaagtggtgttgtccatatgttatattcaaactattgtttgatagggagctattctccaaacaacttctggatgttcacttagctctcagctgccaacattttctcaaaatggttgtaaaattcatgaagctataggactgggcaaaaaccatagggtctgaaagaattcagaaacttacatagttcatgtaatgaaaacatcaaagatattccctaaaatggagatgtttcacttagattggcatttctggggagtaaataaatggaggaaacaaaagagtcaggagcagaaggtcactatacaatctctaacacaaagacatgaccagagaaaatggagaataggagaaatgttagtaattaatataaatggttttcatgctgaaagcggtaattttttttacttaaagtaatgtatgagttggaataatatgacctgggaggcttggctaattcacaaattctctgagcctcagttttcttacttgttatatggggatcatagagtttttgtggggctgcttgaccagtgtcttgcatagggtaggctattgagcaccaaatgaataaacattgactatataaataaataaacaaatgagtcagaaaatatgcataaaagggttttattaacaagcaagtgctaaataaacatgaaggattagcgttatgattgcatgtgctttgtcacagggctcttctctgagatctgtcttctctgagtggaatccatggccagtacaagtaatgtgactgagttgattttcactggccttttccaggatccagctgtgcagagtgtatgctttgtggtgtttctccccgtgtaccttgccacggtggtgggcaatggcctcatcgttctgacggtcagtatcagcaagagtctggattctcccatgtacttcttccttagctgcctgtccttggtggagatcagttattcctccactatcgcccctaaattcatcatagacttacttgccaagattaaaaccatctctctggaaggctgtctgactcagatattcttcttccacttctttggggttgctgagatccttttgattgtggtgatggcctatgattgctacgtggccatttgcaagcctcttcattatatgaacattatcagtcgtcaactgtgtcaccttctggtggctggttcctggctggggggcttttgtcactccataattcagattctcgttatcatccaattgcccttctgtggtcccaatgtgattgaccactatttctgtgacctccagcctttattcaagcttgcctgcactgacaccttcatggagggggttattgtgttggccaacagtggattattctctgtcttctccttcctcatcttggtgtcctcttatattgtcattctggtcaacttgaggaaccattctgcagaggggaggcacaaagccctctccacctgtgcttctcacatcacagtggtcatcttgttttttggacctgctatcttcctctacatgcgaccttcttccactttcactgaagataaacttgtggctgtattctacacggtcatcacccccatgctgaaccccatcatttacacactcaggaatgcagaggtgaaaatcgccataagaagattgtggagcaaaaaggagaatccagggagggagtgaaaaaagagcttagggatgaaaaagtgatacaaaatgtatgtctgattactctctgttcttgaaatggattttgattttagtgggatattcaagaatgacagaaacaaatataaaggcttaatgatactgctgctgtgattctgcttagtagccaaagacacttggtatgctggtgtaatgtttgaaggacagaggtcagatagtctcgcagagtcttagagaacttgattggcttcatgatatccaacaatatcatgggcttgggtaatatgaagcctcaaaccaagtgcaaatgcaaaggagaacatgttgataaatgttttttagattaagtcacttcttcctgttacctcctcccttcctcacttcttttctttctcccttttgctcttcctccttcctccctcccttccttcttttcttccttcattctttctcccctctttgttcaaactccctcatgataacaaactctatttcattaaaaaaggaaaccaaccagaggaattatcagggaatatttaggaaggagggcaccaatctgatctacaatgttgacaagtatgtctttgaaaattacatccagggacttttcttttcttctggttggctcctggtatcttgtaccatggaccatctgaccataagccccagaaaagtccctggagcatttttagttcttgtgatatgttttcacaagagatggtccttaaatctgtctggtctttctcacaatgtccaacatttgtaaaaaaataatatcaaaatgacatagattctacttatcactatggaaagatcaagtcaaatattttcacaaatacagtgtttcacaaaaacattgttagtcttatccagatgtgaaaaatacaaaatgttagaaaatgcttattaggcctaacttaaagaatgaaggggagagtgatactgtccaagcatacttctactccagaccctgtcccttgttctaagtgaccatgcaaggccatttcttttaatgcctattagtatttcttggtgaagggagatgagatcgtctgtgtctgcacttttggttaacttctcagcatctctgccttaccccattgtttcatataattgtacataatttatagaatatcataaagttgttccctgttggctttaaaattgcacatattggcattgaatttgcacaacatcctctgctttttcttgagaatcaggtgaaataattcatgcagcttccctagcagagggatggagtatcatgggtgtgctatatatcttagggctttttcctttctattataggtgctggttgaacacgtaggtaaatagtggttttaaaggcaccagcaaacttctcacttcccttagtgttcccattaaccctgtccatagacgaccatcattaatccctgagaaaatgttgctgcttctgcttggaatgactttacttcccttttctgtatggcaaaatcctatacattcttcaagacctaggttcaagtcatcttccttataagaccttctctgacttccctcctctttgggttgaatttatgtctcctttctgcagtcatttttacatattattgccctatcacttcaattctgattatttgatgtgtttgtctctcaatagactgtaagctctcaagggcaggactgtccactgtcccttcttctttgcagctctaaatatcatgcacatagttgatacttcttaagtgcatgtggaataaccaaccctttaggctcatgcacaatccttgctatattaattcttataggttccttttgaacactttcatggtgaggagcacatcttcctgttgaaattttaagagctcaggctctgacatttgttaggctgttccaattgcctgtgagccacaacccaggatccaaagtacttaacttccctgaacaactgtttatgcatgagtataatgactaacaatactatgaagtttataagattattctggctgggtgtggtggctcacgcctgtaatcacagtgctttgggaggctgaggcaggtggatcacttgaggtcaggagtttgagaccagcctggacaacatggagaaacgctgtctgtactaaaaattagccaggtatggtggcacgtacgtgtaatcccagctactcgggaggctacggcaagagaatcacttgaacctgggaagcggaggttgcagtgagccaacatagcaccactgcactccagcttgggtaacagagtgagacttagcctcaaaaaaaaaaaaaaaaaagaaagaaagaaaaaaaagggattattctgaatattaaatcagataatatacctgcaaagcttttagaacagaacatggtcatcaataaatattagccatcatcatcttcatcattagaactgattattaattttattttgtgtgatgactgcatctcacaatgatcattctgtcctgtagagctactcagaataggccttgattccaccccaaaagtgttcaagcattctaaggcagttcaatagaccttctctgtcgcatgccacgttgcttctctgaacgtaaacattctctgttaggccatctacctggtgcatcataggtactcacttagtatttgttaaatagatgttgactgtaaaatagcttccctataatcttttatgctaatgcttttatatcttgttaatgtatattttaaagcatttgctccagaatgaaacacagtgaaggcacccttcctttctcttgatatcttgcttgtattaaagcaggctaggactttaggttgcaggttgtggtaggagtcccttactcatgggcaggtttggtttcctctctgagaactatggatagaacaccatcagtgaactctgagtggttggatactgcacaggcagataatatctattctaattgaatggtcaaaattcttaaggatcatgtcacctactctcaaccctcaagagagttgagacttaggtctgttgagagctgattactcactttgttctggccttgctgcaagaagcacataagttaaaggaaaacattttttcattgttttaagagacagagaatgtcataaaattttaaaaatgtcttctcaatgaacagaagtagtaataatctaattataccacttagcactagagagcatgtagttagctcttggttgttgattttatcacaacattaaaaatgtatttttaagagaatcaatataacatgctttctttaaagaaaaactagtagagtgctgtaaactactcagatacataattttgtatcctttgtccattaattatttgtattcatttaggtataggtttgactgcatataacagggaaaaaagcaacttttaatgagatagagttaaaaaagttcagaggttgaaagtccagctctgatggagatattctatatctgtgcagttcaatatggcaatgcttctgagcattatggtatagggaaaaaatatcgtagtgtctgttgagcacttgaaatatggctagtgagacccaggaagtgaattttaaatgtatttactttaaataagttaagcctcaatagccacatgtggatgacatattggacaacacaactctagctttgcatttctattccaggggacagaagcagagaaaggaggcggaaaaactgatcactttccctttagattttccaaaagtgccatatagcacttttgctttcatcttgataacgattagtagcatggtgaaacctaatttcaaagggggcagggaactataatttttgttttgtttgtttttttttgagacaaagtttcactctgtcacccaggtggagtacagtggtgccatcttggctcactgcaaactctccctcctgggttcaagcgattctcgtgccttagcctcctgagtagatgggacgacaaatgtgtgccaccacgtctggctaatttttgtatttttagtagagacagggtttcactatgttggccaggctggtctcgaactcctggcctcaggtgatccatccctgtcagcctcccaaaatgttagaattacaggcttgagccaccacaccctgccaactataatctcttatagtgtgtggagttgtgtgcagtgaaaactcagggttctgttctgttcctaaagaggaagagaataggtgtaaggattggcgtatagtctcaggcactttacacaatttccgtgtaattaaaattttttcataaatgtggtttgcaatatcacagagtctcattgttgcctaattcacttaattattcactcatttcagggcttttaaggtcatttaataatttactcaacaagactcactgagcatatattacatgccaggtgttgttctagagatgtggtggtacgtaggccagagacctttcctgccttcatggagattgcattctagatagacattctgttttctgaagctgctgtggtctggatcagcattgccaatagaactttccatgataatggaagtgttcttatcgtgtgaatacacgctagtccctagccatgtggctactgagcccttgaaatatttctaatacgactaaaaaatgaaattttaaattttagttaatttaattttaattaactaaaatgtagatttaaatagtcacacatgaccagtggctaccaaactgggcagcaaaagtctagagccttcagtgtttacttctgcttcaaacttgtacctcttaatcagggtcagcagcaagactgccctcgtccctggcacagtgaaggctctgtggctttaatttcaggctttcactagccagctcttctaactcatcctcacatggtcatcggctcactactcttcaccccattgaggtgccaaggtggctggagagaaggggcacagcgccagcctgtgccattcccagtccaccttgccccgttgtctctccacctgcacttcaggaatgaacttcaggcctgtgtgacttcgtgcctcatgattagtaacttcttacaaggaccttttgcagcatttgacacagctaactagtctctcctggaaactatacatctttgtttccatgatcccattccctcttggttcctttcccagcacactggctactcttctcagtttcctttgctgatgccttcttatttttccaatttctaagcatctgcctgacccagggcttcattttcaaacccctgccctacctactcgaggagttcccactgagtctcccagctttaaataacattcatgagtttatgactctcaaatttatagcttcagcctgaacgtcctccctgaactgtgatgtatatacttaactgtctactcaacacctctgctggggattttgaaaggtaacttcacttaatgtgtctaaaaacggaaccatcttccccacttcccggcttttcccacagtcattcccagctcagtaaatgcaagtctggtccaattgctgaaaccttggaggtgtccttgatttctctctttttctcactccttgcaataaaagaccagcaaatcttgttagttctaccttcaaaatatgtccagaatctgactacctcctaaaatcttcattgctagcatgatggctcaagtcatagtcatctcttgactggcttactgtaatggtctcatgactggtttcattgtatttcccacttgacttcattattctcaagacagcagccagagatcctagtaagagatgacctttccttacgaccttatgtaaataatatccaccagcattccccatcatcctcaatctgttttatttttctctataggacttattattatctgatttgtctatcaagttttatttattttctatctccatttccattatgtgctggtggggatatgaagggtgcaacctccacaagtctaggcattttttttcttcactgccaaatctccaacacctagaacagtgcttggcacataataggactcaatattatttgttgaagaatgaatgagtgggcaaatgacatctctttcagaagaaattctcatcatattacatgattatgacccactttcatcattgatggggagactgaggcacagggagactaagcgatttctgtttttatttttttaaagacaaggtttcattctgtggcccaggctggagtgcagtggtgtattcatagctcaccgcatccttgaactctggggctcaagggatcctcccacctcaacctcctgagtagctaggattgcaggcacatgccatcatgcccagctaattttttaaacttttttaaaattttttttgtagagatggggtctcactatgtttcccagtctggtcttgaactcctgggctcaagtgatcctcctgcctcagcctcccaaagtattgagattacagttgtgagccactgcacctggccccagactaagtgactttatatgtgaatacatgaatgttagaattggaaggcacaatgaagataatctagacgaatgctgtcatcttatatagaagtggaaataggggaggatgaaaaggagaaatggcatggtcatagttaaccactgggcccaagctagcacccaggtagcctgacttcctgtccagtcctctttttcttctctatttactcttgtatttattctcagtagtcaaatctgggcaaaaagtcctcttcatgtcttacttacaactttcttctcctactaccttgttattggttgcagaaactttatggaaatctcattaaactaattgaaaccgatttcatacttttcctcaagttatttgacaaagttttactctagagaagagaaattccatggggaagtcagtctcttgatgatagtatgtggcttactttgttttaaatagttcaaggatcttgacatctaatcatagcccttggactttgagtggggggataggttttctacatcaaaacaggattggagaatctctgggttagctgcttcctatggtgtttgcttatttcttagatgttctaaattcaaatattaaccatgatgcagatcccctgaattttccttatttgtgtgacttatcttaaacagcatctactttgttttctaaaagctcccaggaccgttggtgatttttccttggggacaagttctgatcattgaattgcagtagcaaccaccatccagtaccattagaagacagcctaatgttgaaagagcacaggttctgagttagtaatctggcaaataactagtgtgtggctttgagaagcaggttaattctgccctgcctctgttgcctcatttataaacagaggaagttggagtaaaatctctctacctattgtagattgtaatatttttcaattgtgctttctaactggtaattccatttgaattttcttattgtaatagtggctttcgtttgacttatgtctttctcccctaggtttacatatagaaattttgcttgcaagaaacagaggcctgttcaaagtagcttagacaaaaagaagaatttatttgaggaataaggggctgttcctggtatccaagtacacatgggctgaattagggtttaaaaagtcaaggatcggggatactctctgcatctctgagatgccatggtctctttctgtactacttttcttgctctagaatactcatttctcaatgtttaaaggttcaaggactttagttaaacttcagcatgtgcccttacatgaggaattctgacacacactgatttgtttccttctgtccacatcactgactttttttttttttttgagatggaatctcgctctgtcgcccaggctggagtgcagtggcgctatctcggcttactgcaggctccagcccccgggttcaggccattctcctgcctcagcctcccgagtagctgggactacaggctcccgccatcacgcccggctactattttgtatttttagtagagacggagtttcacggtgttagccaggatggtctcgatctcccgtgatccgcccaccttggcctcccaaagtgctgggattacaggcgtgagccaccgtgtccggccgacttttgttttgttgattctgttctttactattcaaggtatatttttagttctttaaaattatattttaaaaacatttcacatatgaaattggagataatgggaaaaaatggggatacattttatagcagagaatcaaagtgtatcaaatcatatatatatgaactatatatgaacttacacacacatatacacacacacatacacacacacacacacacacacacacacacacacacacatatatatatatatatttttttttttttttttgagatggagtctcgctctgttgcccaggctggagtgcagtgaatctcagctcactgcaacctccgcctcctgggttcaagcgatttttgtgcctcatcctcttgcctagctgggactacaggcatgcaccaccatgcttggctaatttttgtatttttagtagagacggggtttcaccctattggccaggctggtctcaaactcctgacctcaggtgatctgcccgccttggcctcccaaagagctgctattagagacatgagccactgaacctggcccatgtatatatattaatcttacttctgagggatcagatgtggtgaaaaattcccagtgggcaccttcatctagagaatattgttttgaatcacatgatattgttagcttaaggtatgtattgtgatctgtattcttctgtgtaatctgatgagtgtttagatgtataagaggttctctcagtaggtgtttgttccagcgaagtagcttagagagaaacctcccctttttttttaaaaaaatgttaaatttaatttgtttttatttcttctaaaaaaacctgggatacatgtgcagaatgtgcaggtttgtcacataggtatatgtgtgacatggaggtttgctgcacctattgacctgtcctctaagttccctcccctcacccccagcctgcaacaggccctggtgtgtgttattcccctctctgtgtccatgtgtgagagaaacccttactcttgctgccatatgctttgctgctgactgccaatccaggaccctggattgagagtcagaaagattggtcctgggtcccagaattcactactttctgtgtgaccttgggcaaataaccatttctcttcaacttcattttctaataataaaattaaatacgttaaaattggctgggtgcagtggttcatgcctgtaatcccagcactttggggagctgaggcgggaggatcgcccaggagtttgagaccagcctggacaatggggtgaaaccacatttctacaaacagtataaaaaattatccaggcatggtggtgcacacctatagtctcagctatctgggaggctgaagtggatcatctgagccacggaggttgaggctgcagtgagctgtgatcacaccactacactccagcctgggtgacactgtgtctctctgtagacacacacacacacacacacacacactcacacacacacacgtgttagattgctaatatttaatgctgaatgaatacacagtggcttaaaaatgagtgagtaataagtgtattatagagtggcttacactctctaaagtgctagaaatgaggtgaattagtgttgtgatcattgttttattgcagggcactcactgcctggcatccagcacacctgcattgaatccatggccagtacaaataatgtgactgagtcaatgatcaccagccttttccaggatccagcagtgcagagagtgtgctttgtggtgtttctccccgtgtactggccatggaggtgggcaatggcctcatcgttctgacggtcagtatcagcaagagtctgcattcccctgtgtacttcttcctgagctacctgtcattgatggagatcagttacttcactgttgtccctaaattcatcacagacttacttgccaagattaaagccatctctctggagggctatctggctcagatattcttgcacttctttggcatcccctggatctttctgctcccactgatgaccaatgaccaatatatggccaactgcaaactttattactacacaaccatcatgagctgcctgtctgtcaccttctggtggctggtttctggctgaggggcataattcactcaatggttcagatccttgtctctgtccaattgttcttctgtggtcccaacatgattgaccactcattctgtgacctccaggtcttattcaagcttgcctgcactgacacctttgtggagggggttattgtgttggccaacagtgaattagtatctgtcttcttccttatcttggtgtcctcttaatatcatcatcctagtcaacttgaggaaccattctgcagaggggaggtgcaaagccctctccacctgtgcctcttatcttgtattttgaacttgccattttcctctacgtgtgactctcctccacctttactaaagataaactcgtggctgtattttacgtggtcatcacccccatgctgaaccccttcatctacacgcttgggaatgcagagatgaaaatcaccatgaggagattgttgggcaggacagtgaactcaggaatggaataaaatgacaacatgaaaaaaaaatagcacaaagagagagaccatatatgcaatctgattttagttaactatgagggaatagagcaaaagttagcttatttatattttttgttgtatttcggatgagctgcttatactccatggtatcaatcagagacagctaatagttgttagtattttggagaatgttgaaaactttcttctcttcttcagtagtccatagtgcaaagtgcatagacttttaaggaggaattatctagattggaaacccctaccctgtcatctgttagctgtgtgaccttagatttatttcagttcacctcttggtgatagcccactgtgggatgtggaaagattatggcccttggagacaaaagttcatgttttgcttcatcccttcttactgagaggtgacagcatgctggcagccttcgattgctctcagcacctcctgggccttggttcccactctggccacgcttgaggagcacttcagcccaccgctgcactgtgggagcccctctctgtgctggccgaggccggagccggctccctctgcttgcgcagaggtgtggagggagaggagtgggtgggaaccggggactgcgcgtggtgctcatgggccagcacgagttctgggtgggagtgggctcggcggccccgcactcggagcaggctgctggtgctgcaggcccagggcagtgaggggcttagcacccaggccagcagctgcagaggggcagccaggtcccccagcactgcctgctggcccacactcacttgaattcttgcggggcctcagccgcctcccagcggggcagggctcaggactgcagccagtcatgccggagcctcctcccactggctgtgggctcctgcatggccagagcctcccctacgagcactactccctgctcctttgcaccatggtcccatcaaccgcccaagggctgaggagtgcatgcgcaccgcaccgggctggcaggaagctctgcctgtggacctggtgcgggatccactaggggaagccagctatgctcctgagtctggtggggacttggagaaattttatgtctagccagaggattgtatatgcaccaatcagcactctgtgtctagctaatctggtggggacttcgagaacttttaactctatctaaaggattgtaaatgcaccaatcagaactctgtgtctagctcaaggtttgtaaacacaccaatcagctccctgtgtctagctcaaggtttgtaaatgcaccaatcagtgctctgtgtctagttaatctagtggggacttggagaattttatgtctagctaaaggattgtggatacaccaatcagcactctgtgtctagctcaaggtttgtaaacacaccagtcagcactctgtgtatagctcaaggtttgtaaatgcaccaatcagtgctttgtgtctagttaatctagtggggacctgaaaacttttatgtctagctagaggattgtaaatacaccaatcagtactctgtgtctagctcagggattgtaaatacaccaatcagcaccctgtcaaaacggaccaatcagctctctgtaagctggaccaatcagctctctgtaaaatgggccaatcagcaggatgtgggtggggtcagataagggaataaaagcaggctgcgggagccagcaggggcaacccactgggtccccttccacactgtggaagctttgttcttttgctttttgcaataaatcttgctgctgctcactctatgggtctgcactgcctttatgaggtgtaacactcactgcaaaggtctgcagcttcactcctgaggccagcgagaccatgaacccaccaggaggaatgaacaactccagacgggaggaacgaacaactccagatgcgctgtcttaagagctgtaactctcaccacgaaggtcggcagcttcactcctgaagccagcgagaccacaaacccaccagaaggaagaaactctgaacacatctgaacatcagaaggaacaaactccagacatgccgcttttaagaactgtaacactcactgcgagggtctgcggcgtcattcttgaagtcagtgagaccaagaacccactaattctggacatattaccagtgtgatcttgggggagctccaggaaagcttctgtactttatttggtttccctcaccccgttaacctgattctaatgcctgaaatgccatggtaggagttttagttcatgagaaagagtggcacttttagagtgcacatgtctctgggagttgaaatataagctaattgattaacccttaatatcttaatctgaatgactttataagacacttctctttttattatttatttattattatactttaagttctagggtacatgtgcacaacgtgcaggtttgttacatatgtacacatgtgccatgttggtgtgctgcacccattaactcgtcatttacattacgtatatctcctaatactgtccctcctccctacccctaccccactacaggcccctgtgtgtgatgttccccttcctgtgtccatgtgttctcattgttcaattcccacctatgagtgagaacatgcggtgtttggttttttgtccttgtgatggtttgctgagaatgatggtttccagcttcatccatgtccctacaaaggacatgaactcatctctttttatggctgcatagtattccttggtgtatatgtgccacattatcttaatccagtctatcatcgatggacatttgggttggttccaagtctttgctattgtgaatagtgctgcaataaatatacgtgtgcatgtgtctttatagcagcatgatttataatcctttgggtacatacccagtaatgggatggctgggtcaaatggtatttctagttctagatccttgagggatggccacactgtcttccacaatggttgaactagtttacagtcccaccaacagtgtaaaagtgttcctctttttccacatcctctccagcacctgttgtttcctgactttttaatgatcgccattctaaatggtgtgagatggtatctcattgtggttttgatttgcatttctctgatggccagtgatgatgagcattttttcatgtgtcttttggctgcaaaaatgtcttcttttgagaagtgtctgttcatatccttcgcccactttttgatggggttgtttgtttttttcttgtaaatttgtttgagttctttgtagattcttgatattagtcctttgtcagatgagtaggttgcaaaaatttctctcccattctgtaggttgcctgttcactctgatgctagtttcttttgctgtgcagaagctctttagtttaattagatcccatttgtcaatgttgacttttgttgccattgcttttggtgttttcgacatgaagtccttgcccatgcctatgtcctgaatggtattgcctaggatttcttctagggtttttatggttttaagtctaacatgtaagtctttaatccatcttgaattaatttttgtataagatgtgaggaaggagtacagtttcagctttctccacttggctagccaattttcccagcaccattgatgaaatagggaatcctttccccattgcttgtttttctcaggtttgtcaatgatcagatggttgtagatgtgtggtattatttctgagggctctgtgctgttccattggtctgtatctctgttttggtaccagtaccatgctgttttggttactgtaaccttataatatagattgaagtcagatagcgtgatgcctacagctttgttctttttgcttaggattgtctttgcaatgagggctgttttttggttccatatgaactttaaagttgttttttccaattctgtgaagaaagtcactggtagcttgatggggatggcattgaatctataaattaccttgggcagtatggccattttcatgatattgattctttctatccatgagcatggaatgttcttccatttgtttgtgtcctcttttaggtcattgagcagtggtttgtagttctccttgaagaagtccttctcatcccttgtaagttgtattcctaggtattttattctctttgaagcaattgtgaatggtagttcactcatgatttggctctctgtttgtctgtttttagtctataagaatgcttgtgatttttgcacattgattttatatcctgagactttgctgaagttgcctatcagcttaaggagattttgggctgagacggtggggttttctagatatacaatcacgtcatctgcaaacagggacaatttgacttcctcttttcctaattgaataccctttatttccttctcctgcctgattgccctggccagaatttccaaccctatgttgaataggagtggtgagagagggcatccctgtcttgtgccagttttcaaagggaatgcttccagtttttgcccattcaatatgatattggctgtgggtttgtcgtagatagttcttattattttgagatacgtcccatcaatacctaatttattgagagtttttagcatgaagggttgttgaattttgtcaaaggccttttctgcatctattgagataatcatgtggtttttgtctttggttctgtttatatgctggattatgtttattgattttcatatgttgaactggccttgcatcccagggatgaagcccacttgatcatgatggataagctttttgatgtgctgctggattcggtttgccagtattttattgaggattttcgcatcgatgttcatcagggatattggtctaaaattcacttttttggttgtgtctctgccctttggtatcaggatgatgctggcctcataaaatgagttagggaggattccctctttttctattgattgaaatagtttcagaaggaatggtaccagttcctccttgtacctctggtagaattcggctgtgaatccatctggtcctggactttcttttgttggtaagctattaattattacctgaatttcagatcctgttattgatctattcaaagattcaacttcttcctggtttagtcttgggagggtgtatgtgttgaggaatttatccatttcttctagattttctagtttgtttgtgtaaaggtgtttatagtattctctgatggtagctcgtatttctgtgggatcggtggtgatatcccctttgtcattttttgttacatctatttgattcttctctattttcttctttgttagtcttgctagtggtctatcaattttgttgatcttttcaaaaaaccagctcctggattcgttgattttttgaagggttttttgtgtctctatttcgttcagttctgctctgatcttagttatttcttgccttctactagcttttgaatgtgtttgctcttgcttttctagttcttttaattgtgatgttagggtgtcaattttagatctttcctgctttctcttgtgggcatttaatgctatacatttccctctacacactgctttgaatgtgtcccagagattctggtatgttgtgtttttgttctcattggtttcaaagaatgtgtttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagtgctttacctccacctatgtggtcagttttgtaataggtgtggtgtggtgctgaaaagaatgtatattctgtggatttggggtggagagttctgtagatttttattaggtctgcttggtgcagagctgagttcaattcctgggtatccttgttaactttctgtctcattgatctgtctaatgttgacagtggggtgttaaaatctcccattattactgtgtgggaatcttaatctctttgtagatctgtaaggacttgctttatgaatcagggtgctccagtattgggtgtatatatatttaggatagttagcacttcttgttgaattgatccctttaccatcatgtaatggccttctttgtctcttttgatctttgttggtttaaagtctgttttatcagagactaggattgccacccctgcctttttttgttttccatttgcttggtagatcttcttccatcccttttttttgagcctatgtgtgtctctgcacatgagatgggtttcctgaatacaacacagtgatgggtcttgactctttatccaatttgccagtctgtgtcttttaattggagcatttagcccatttacatttaaggttaatattgttatgtgtgaatttgatcctgtcaatatgatgttagctgtttattttgctcgttagttgatgcagtttctttctagcctcgacggtctttacaatttggcatgtgttttcagtggctggtaccagttgttcctttccatgtttagtgcttccttcaggagctcttttagggccggcctggtggtgacaaaatctctcagcatttgcttgtctttaaagtattttatttctccttcacttatgaagcttagtttggctggatatgaaattctgggttgaaaattctttgctttaagaatgttcgatattgtcccccactctcttctggcttgtagagtttctgctgagagatcagctgttagtctgatgggcttccctttgagggtaactcgacctttctctctggctgcccttaacattttttccttcatttcaagtttgttgaatctgacaattatgtgtcttggagttgctgttctcgaggagtatctttgtggggttctctgtatttcctgaatttgaatgttggcctgccttgctaaactggggaagttctcctggatagtaccctgcagagtgttttccaacttggttccattttccccatcactttcaggtacaccagtcagacgtagatttggtcttttcacatagtcccatattttttttgtggctttgtttgtttctttttattcttttttctctaaacttctcacttcatttcattcatttgatcttccatcactgataccctttcttccagttgatcaaatcggctactgaggcttgtacatttgtcacatagttcttgtgccatggttttcagctctgtcaggtcctttaagggcttccctgcattggttattctagttagccattcatctaattttttttcaaggtttttaacttctttgccatgggttcgaacttcctcctttagcttggagtagtttgatcatctaaagcctttgtctctcaactcatcaaagtcattctccatccagttttattctgttgctggtgaggagctgcattcctttggaggaggagaggtgctgtgatttttagagtttccagtttttctgctctgtttttccccatccttgtggttttatctaccttttgtctttgatgatggtgatgtacagatggggttttggtgtggatgtcctttctgttttttagttttccttctaacagtcaggaccctcagctgcaggtctgttgaagtttgctggaggtccactccagaccctgtttccctgggtatcagtagcggaggctgcagaacagcagatattagtgatcagcaaatgttgctgcctgatcattcctccggaagttttgtctcagaggagcacctggacaggtgagatggcagtctgcccctactgggtggtgcctcccagttaggctacttgggggtcaggcaccgacttgaggaggcagtctgttctgaggtctcaaactgtgtgctgggagaaccactactctcttcaaagctgtcagacagggacatttaagtctgcataggtttctgctgccttttgtttggctatgccctgccctgagaggtggagtctacagaagcaggccggcctccttgagctgtggtgggctccacccagtttgagcttcccagcttgtttacctactcaagcctcggcaatggtgggtgcccctcccccagccttcctgtcaccttgcagttcgatctgagactgctgtactagcaatgagtgaggctctgtgggcacgggaccctccaatccaggcattggatatgatctcctggtgtgccatttgctaagaccattggaaaagtgcagtattagggtgaaagtgacccgattttccaggtgccatctgtcatccctttctttgactaggaaagggaattccctgacctcttgcacctcctgggtgagcaatgtctctccctgcttcggctcatgctcagtgcacttcatccactgtcctgcaccctctgtctgacactccccagtgagatgaacccagtatctcagttggaaatgcagaaatctcccatcttctgcatcgctcatgctgggaactgcagcctggagctgttcctattcggccatctttgctcccagagcttgggtcttgtttgcatatgtatccttgggttctggttctggccaattcattacagataaatttgccaaataacaatttgttaatttaactgaattaccacataactaatttactgaacttttgattcctcaaaacctatttctgttaatcctttgtaaaatctatagcacttatgttttgcagatgcctgcaataagcgatgtatttgggggaggaggatttttgtgtattctcaatttcagttttctggtaattaatgaatatcaaggattttatataagtttgtttcactcttccagtgaattttcaatctagtcaactgtctttcttatttttcttcattcttgaattgacttttctcaagaaagggacccatgtatacgtaacagatgaggaattttacctggatatgttttcacgtgtgctaaccaaacttacctgaatcagattgaatgatccgccccagttctttacttcttcttttgcctgtgccctgctccttgtaattttgcagttcttcccatcagaaggagtgtatgtttccatcccctgactttaggcttagccatgtgactagctttggctaatggcatgggtgggtggaaatgacaatgcctcagtgagagcctaggccttactaggccttgtgtatttttgtttgcccccctgtgtctctgccacgatcatgagatgataggcagcagctgcactacagcctgaactgccaaatgaacacatacggaacagaacttctctagccgacccaccaaactgcagcctgaggaagagcttccccagctcacctgcagacccatgaacatgagaataaatgcttccagttgcatgctgctgaggttctgtggttgttaatgttacacaaactctttagacttgacctgacaaatatgcatatcaaaggagaatagaaaagtcaacgtactggactaaaagtggttaatatttattagacctggtacacttacctcatagttctttacaatgattttgctgagcatgggcattgaacatgtcctttctgctaccttgagggctttgcccttgatttaactgtctggaaattgtgtttgcaaatttctgccaagttggcataactcaattgcttttctttaagttcaatggatttgttgatccagacgtgttgaatgctgactttgtgaatgttttacaatccagattccttagagcttcttaattaagaggaaaaggattagctgagattggaagtagaagcacatctttcgtgaattgataattcagtggactggccatttgcctgatagcaaaattgctgaattggttaatcttgtgaattgactgttggtaatttgaccatctggcaaactatagttggtgaattgattttaggtgaattgctgcttttgcacttcgtgtgatgagtgacaggtggtggatgctcaagagctgtggaaggaataaaatatatcaaaatgatgtcggcattattagtttttatcatttgggaagggcttgagccagaagtgagattgcttgaagcagccagaaaagaacttatttgagagctcgaaatagtgttcatatattgtcttgcaacaaaaaataccaactgtccaaactaatacatgaaatccatatttgaacttattaattgatataccctatatttgcataataccctatgcatatttcaaagccctttcacattcattacttcattggcgtctcattgtaatcctgtgatgtcaatgaaatatgaattaatcattctcaatgtacagttttagatgaaacatcatttagattaggttttagctgcaaggatcagaatctaaaccaagatagaagtcaagaagttcacagtctgggatagaaatgttctctatcttgtttctccatcctttatagtattaattcccaaggtcactgcatggccccaaatggctgatggagctccagtcataatggcagcatcctgttatccaaaagcaggaagagatgaaataagacatgtccccttccttgaagtttcaagggaggctgggtaatgtaattttcattccaggtaggcatgtgccctcataaaaattcagggattctaatactatagaaggaagaaggagaaaataataattaggaacactagtgatttctgctccagggtaaatcaagcacaaagcgtgggcacaaactcagatattctgattcccagaccagaagtttccttcattgtggtttcccatctcagttaggttttactttatgaaaataattttgtttagtttttactttaaaaaaagtcgacagataaaattgtatttatcatgtatgacacattttgatacacacacacacacacacacacacacactcattgtggaataacaaaatctagccaattcacttgcattacttcacaaagttattgtttttgtcgtgataacatttaaaatatattctcagtaattgaagtaaaatttacattcagcaaaatgtacagaccttaagtgtacaatctaatgagttttgacaaatttatacttctgtgaaccaacttcccaacaagatgcagaatatttctatcactctggaaacttctcttgtgacttcttccaggcaatctcctcccctcctcaggcagctactgatctaatttctatcatcatgaattagtttaacctgtcctaagcttgtttaaatgaaagcatgtactctttttgtatctggcttctttcacttaacataatatttttgggattcatccatattgtgggttatgattatttttatttagtgagtagcattccaaaatcatgtgtatatgtaaatatacatatacgtgtgtgtgtgtgtgtgtgtatacacatttttttttcttgtggtggtggatattgggttgatttcttttttcttttttttgctgttatgaatagaagctgctagaaacttttacattcccatttttttctacttttattttaggttctgggggtacgtgttggggcttgttacataggtaaattgcgtgtcactgaggcttggtatacgaatgatcccatcaccaaggtggtgagcacagtgcccaataggtagccttccaaccaacacccccacccaccctcccccctcaagtagtccctagtatctattgtgctcatctttgtgtccaaccgttttcaatgtttagctcccacttacaattgagaacatgtggtatttggttttctgttcctgtgttatttcacttctgataacagcctccagctgcatccatgtggctgcaaaggacagggtttcactacttttttatggctgtatagtattccatggtgtatatgtgccacagtttctttatccagtctaccactgattggcattttgattgattccatgtctttgctattgtgaatagctctgtgatgaacatacaagtacatgtgtctttttggtaaaaagctttattttcctttgggtatatacccaatagtgggattgctgggttgactgatagttttaagttctttgagaaatctccaaactgctttccacagtggctgaactaatttacatccccaccaacagtatataattgttctctttttttctgtaaccttgccagcatctttttatttgactttttagtaatagccatttgactagtatgagatagtatctcattgtggttttgatttgcatttctgtaatgattagtgatggtgagcattttttcatgtatttgttggagacatctatgtcttctttcaagaagtgtctgttcatgtcctttgcctgtttttaaacacatttccacttttttaaaaaagcacatactgatatttcatttttcactgcaaaataaattttcacgtggaggaatgcgtatagatataattttaaaagaaggatctgtgtattttttttttttttttgagacagagtcttgctctgtcagccaggctggagtgcagtggcatgatcttggctcactgcaaccttcaccctgccaggctcaagcaattctcctgcctcagcctcccaagtagctgggattccaggtgtgtgccaccatgcctggctaatttttgtatttttagtagagacggggtttcaccatgttggccgggccagtcttgaactcctgacctcaggtaatccacccgcctcggcctcccaaagtgctgggattacagggttgagccaccgcgcccggccagatctgtgcattctttctaataacaggatttaattataacttgagaaatgagagcatagtcaacgggttaatctttgctaggttaggaaacaaaatcaacctcttatggcacaatttataatcttctgtgaacaaatacaatttcataccaaaaatgtttaaacaaatttagtttcctataacaaacattcatagattcatgcttaacaatgatcttccttagatttatgaaaccaaattattcaatgtagaaaagattttgactgacagactttcacggaaactcaacttcatgatgacacggtacaaaataaatatagtttctacttaagtacttggggcttttttgtaattatttgctaattttccttgtgtttctttataaaggataatgctgaattcagtgtttgcatgctcaaaagcaatgtgccagatcttttctgaaatctaaaaatatctcattatagttttcttatcaatcattagttggaacttgtggaatcttgtttcaactctttcaatcaaggctgagttactgatatttgtgagtagccctagtacagggcacatttcattttatgaagtgctcttatgacacttttaaaccttttattacagaaaatttaaaatataaacaggtgtgatcaaagcagtgtaatgaactcccatgtactcaacacccaatttcaatgattattaattcaggacaacttttgtttcacctaaaccagagtatatcaatagcagcactatttacacattgaatgagataattctttgcttggggggactgtcctgtgcattgtagggggtttcacagcatccctggcttctacccactagatgtaagcagcactcctttcccagccagtttgtgacaatggaaaatgttcccagaccttgtcgaatatcctctgggggcaaaattgcccccagtagagaaccataactctactatggtgaatgatccataactcatccacaccaaagacacagagaagtgctaatacagtttcctgacacttgtggtctctatcccatgggcccactattctgaatagtgtcactttatgtaaggtcacacgactgagttcttgataagcagggggggaggggtcgttcatgaacttctgaacagccccaggcagagtaagtgcaaacatggggtgaattgaatttgttcacaattcctactgatttctgaacttgttttctacaaggaagtttgagattttcctacaagtgtgagttgttttctgcaagttatttcctacaagtaatttgaggtcctaatcaggtggtctgcctgattaggaaggggaaagggtgaggctctctggggaacgaacttctctcacctgatcacttacctcctcccccggtgtcttttaagcagtatgaactcagggctgagctgccaggctttaagttttttgtggaacaccttggggggcaagtctactttgctcgttttaaattaggtataattgaaaccccagtggcttagcatttctcagcatttccaagcctgagggtgcaggggagcagatcctctccgttttggaactccagtgaggcagcagctctggctgatagtgtggccatttgtaattcttcttgattggctaactgggaaacctgtgtgagcctagggccattctcagggtgttatttacctctccggggttagacagaacaggcaactggtgagaacagcaaagccacagaaacactggggtgagttttgtttgtgaccatgggtttcttttgtactaatgattgattccaccttgaaagtaaagagaatggttccaggaagtgtatagcacattacaaagggctttcgcctccatctggtctttgagacaaacacaagtgctaggctctgggattcagagatgaagaaggcgtggtgttagtccttggggaactttcttcctcgatatttactgaacaccaacctaccaaatactgtgctaagaaggctgggaagatacatatccaatattattcatcctatctacattcattgaaggctattgcatggctggcactgcagtaagcattggaggtggagtggtgggcaacgatcatctctgccgtaaggaaacccacactccagtgggcaggtggccacacaaaaacaatgataattcagtgtggtaagtgccgggatcccaaaatgtcctgagagaagaggggcccctggcagagggggcctgtaaactgtggagctggcttggagaggaatccggggcaggacataggactggcccttaacttatcctgggatggggctgggagtgggatttatggcacctacctgtgaggcaggcattatctgcatgttacagtttagaccttgagtctctgagaggttaaagaactttctagatcttacacagacactccctgaaaaatatgactataaatccaggagtccagactgttagtgctctcttctgtgagcagcttcttggtaaagttccccagctgatctgagattttggggctggcgtctgtcctttctctgtttctgtaactatatgttctatcagtgatttccttctggttcgtggtggtctttaatcacctgagattgtcccaatcatggaagcaaggaagccttgtggtgtgagtggaagtgatctggctcccaggctcaggtggcctggagtgttactgtaggagaggctatgtggatatacaaaaccttagccaccttggacagagttcagcatggactgggacagcctgccaatcagtcctgagcagtcttggtgatgctctgaggtgttgaaagcctgggctgtggagaaggatgtgtcagagcatgagggggcactgggatgtgtgtgtgtgtgtgtgtgtgtgtgtgtgtgtgtgtgtgtgtatggggggtgttggacctttgttgccactggaggatgtgactggagaaagtgaaagccccagtaaagaggagaatcatacatggattaagttgagctgggcccttggaaggggacaagctcaccaagtgaccaagtgtagaatgtgagaattagagggagaagcagaaataagaggagatgttgattgtcaaaggaggtccactagggatatctcttctaaagactctgaatggtatgtggagaggttgaggacactgttctgcaaaccaaggatagaaaagaaggccaggagcagtggctcatgcctataatcacagcacttcgggaggctgaagtgggtggcttgcttgagctcaggagctttagaccagcctgggcaacatggtgaaaccctatctctacaaaaaatataaaaattagcagagcatggtggcacatgcctgtagtcctagttactcaggaggctgaggtgggaggatcatttgagctgggggaagtcaaggctgcagtgagccaagatcacaccactgcactccagcctgggtgacaaagtgagcccctgtctgaaaaaaaaaaaaaaaaaaaaaaaaaaaaaaaaaaaggagaaggaagtggcatgaaggaaagctgtaggcacaagataatttaaaacactcatctaacatggagacagtaacactatcctggctgttccacatcatccaatgagggacttattaacttcctaatagagctcctcctctaatctgtttccactggacagccctttccacactttagttctacatactacagactttgtctgatcctgcagacaatggggaatcatcaagcatgttcatcaactaaaaggaaaaacactttgggactgctagggtcctcaaaggccctaacagtccttcacaaattggtactaatgtctatctacagctttatttttttgctattctcccctttattccagccacacacaaagcatttgtacttgctctctgccttcttggaatgctcttcccttctacacataactaactcctactcacctttcaatttccaactcagaagcatctcagctatgcaagggctttcatgtaattcacccactgagtgaagaagtattttgtatcatttcagatcacaccacccaaattgctgcctcttgatgatgacctcttggctaacatacacaacatgactgaattcatttttctggtactttctcccaaccaggaggtgcagagggtttgctttgtgatatttctgttcttgtacacagcaattgtgctggggaatttcctcattgtgctcactgtcatgaccagcagaagccttggttcccccatgtacttcttcctcagctacctctccttcatggagatctgctactcctccgctacagcccccaaactcatctcagatctgctggctgaaaggaaagtcatatcttggtggggctgcatggcacagcttttcttcttgcacttctttggtggcactgagattttcctgctcactgtgatggcctatgaccactatgtggccatctgcaagcccctcagctacaccaccatcatgaactggcaggtgtgtactgtccttgtaggaatagcatgggtgggaggcttcatgcattcctttgcacaaatccttctcatcttccacctgctcttctgtggccccaatgtgatcaatcactatttctgtgacctagttccccttctcaaacttgcctgctctgacaccttcctcattggtctgctgattgttgccaatggaggcaccctgtctgtgatcagttttggggtcctcttagcatcctatatggtcatcttgctccatctgagaacctggagctctgaagggtggtgcaaagccctctccacctgtgggtcccatttcgctgtggttatcttgttctttgggccctgcgtcttcaactctctgaggccttctaccactctgcccatagacaagatggtggctgtgttctacacagtgataaccgcgatcctgaaccctgtcatctactctctgagaaatgctgaaatgaggaaggccatgaagaggctgtggattaggacattgagactaaatgagaaatagaggctgagtctttgtattgatacttgggtttagaatgactgttgagtccaaactgaaggagcagaataggttgaaggaaagttcacaggacctgttagttgcagattattctacctggcctctctctttaaaaagttcattttcataacttgaatagtatttctttttgtggaggtactaattttttaccaccataaataacactgtagttaatattcttgaatagacatttttaaccatgcttctgactttcttttaggcttatttcctagagtgaatttagtgttagagtataaagacttttggtgcacagtgttacactgagtcacctatcttgtgaaagtgctcttgacagaatagaatcctgtcattaaacacttttttttggataagaaatgattttacattgtttcaaagtatctttccttaggacaccaaggggtattaattacagagagaaaaatgtaactttatagcccttcccctctaaaccattgcccaaagtgagtatcaccagaaataagatccattgatgccatgtgcctcttgatatggtgcactggagaggcacacaatatcattattgtgctattcttaccaaaaatacacaacctgagtctaatcataaaaaaacacaaggagagcccaaagaaagaatattctgcaaaattactgtccttaactcttcaaatgtgtaaagatgaagaaagaagaattactctggattaaagataggtgacaagtaaagcaacatgtgatcctggattggatcttggatattagatagaggacatttgtggggcaaaactctgtagatgagataataaaattacatgaatgttaatttcctgattttgatcattgtactgtgcttgtctcaaagaatgttcttggattagggaattgcttattgagatatctagagatggagggacatcatattggcagctctcaaacatttcagaaaaattattatttttattgtatatctttaaggtgagcaacatactgttttgatatacctatactatacacaaagaaattattagtcaagcaaattaacatacttatcactttgcagagtttgcttttttttaatggtaagagtacctaaaatctactctcagcaaatttccaggatacaataccatattatttactatagtccttatgttgcacgttagatctctagacttgtttattctatgtaactacaagtttgcatcctttgacctacttctccacacttcccctgtatcagaaaatttctacccatctgtttgtctacatatctatttattgagagcatgaaggataaagaaaatgtggcaaaataccaatatttgggaaatctggattaagggaaaacaagaattcttttttggaagtttttgtaggtcaaatcattttataacaaaaagttaataataggggaggggtgagggatgagaaattatttaatggttactgtgtacactatttgggtgatggctacactaaaaatgcagacttcaccagtatataatatatccatctaacaaaacaacatttgtacccccaaatctataacaataaaaataaagttttgtaaattagaaagacatcttaccattgtttaatttgcatttttaattttttgcaagcgtgaacgttttcatgtttaattggttttgagccttatttacaaagttttcaatgtttcaaagctgacatttctttacagtaaaatctatcagttttaagttttatattttatttttccccttttatttttagttgacacttaataattgtacatatttatgggatacagagtgatattttgacacatgcacacaatgtaaaatgatccaggataattagtttttaaaatgatttattccattgtttttgtgtttagattatcctacaccattaattagagacatattttctttgaaaaattacttaaatttttattttacttttgtgcaagggtaatcttcattgagttttaaataaaataaaatgaaaagatacgcaagtgaaaagtgtcatttcattcctttccccatttctactttccccctttctcttttggtttccttagtttcctgtatttttttcagtttctttttttgagacagagtcttgctctattgtccaggctggagtgcagtggcatgatctcagctcactgcaccctctgcctccgaggttcaaatgattctcctgcctcagcatctgagtagttgggactacttgcacgagccaccatgcccggctactttttgtacttttagtagagatggggtttcgccatgttggccaggctcatcttgaacttctggcctcatgtgattagcccaatccaggtctcccaaagtgctgggattacaggcctgaaccaccttgccccacctctttcagagtttctttaagcaaatacaagtataatatgtatgttctcatttatttctaccttttacatgagtgatcgcatactatataaatgcatctgaaacttattaacagtgtatctgggagttttaaaatatttgaacaaggaaatagtcttcattcttttcttatggttttgtggtattcataaaatgaacataccattattttcttttttttatttattccttctaaaaaaaacccgggatacatgtgcagaatgtgcaggttgtttacataggtatatgtgtgctatggtggtttgttgcacctattgacctgccctctaagttccctcccctcaccccccaccccccaacaggccctggtgtgtgttgtttccctctctgtgtccatgtgttctcattgttcaacttccacatatgagtgagaacatgtggtgtttgcataccattattttcttaggtagtcttctactgatgggtatttggattgttttccaatagtgtggcagcaaataaccttaatttaaatatgtaaaactaatctgtaagttatatttccaaaaatataactgctggatcaaatgtaagtttttcaaagctggagatttcacatgtcctgattttaaaatatattacaaagctatagtaattaaaacagtgtggtactggcataaagacagacatagaccaatggaatagaatagagagcccagaaacaaatccacatgtatatgatccactgttttttgacaagggtgccaagaatacacaatgaggaaagaacagtctcttcagtaaatggcattaggagaactgaatatccacatgcagaagaatgaagttagacccttatatcaccccgtacacaaaaatcaactcaaaatggtttaaagatttaaatgtagaacctgatactgtaaaactcctaaaagaaaacataggaaacataggggaaaagctttatgatgttgagttttgtaatgattttatgggtttgacaacaaaagcataggtaacaaaagcaaaaataaaaatgcaagactatatcaaacaaaaaaggtgcacagcaaaagaaacaatcaacagagtggaaaggcaacctaaggaatggaggaaaatatttgcaagccatatatctgcaaagggctaatctctaagatatataagaaactcataaaactcaatagcaaaataactaatagcctgatttaaaaatgggctaagaacttaaatagacatttctctagagaagatatacaaatgaccaacagttatatgaaaaggtgcttaacatcatgaatcatccagaaagtacgtatttctttgtaattggatagagatgaccacattgcccttcacagtagtcataccaacttgtactctcaccaacaaatttgtctttcctgcaaaatgtattgttaaattctgagattttgctaaactgatagatgaaaaatgggagcacagtataatttaaatttatatttctcttatgttgaataacgttgaaataattttatttatttattttttctcaaacaggttctgacagatcttttcatatatttaaaggccatttgtagtttttgtaaactgtttctattatttattcatttttgggttgtggttcttattatattctaataattatttatatataaaaattagtcctttccaaagtgaactgtagatttttgtcctggtcattggtcttttgactttgtttatggttttttaacatacagaagtcttttctttttatgtaaattatcattattttcctttatggcttctggagtatccagagccacgttgtttcttattctggaagttgtacagaatgttttaatatctggtgggctaggtcctttttgttgctctactttttcaaacttctggatatttttaaaaatatgtttgaagtcaaatgtatattttataaatacttataaatgtatttagaaagaatagacactataatgctatgagttttcctatccaaaaccatgatacatctttccatttgttcatgtcttcttttgtgttcttcagcagagttttaacatttttttccctccacaggtcatgcacatttcaagtgttgcctattatagggaattgtttgacataggtataaaagccactgattccacatattatttttttgctacctataacacatgtcaatgcaaataggcatacaactgtcatacagcaaactcagttaagtctccactctatcctttggcattctgatgaacaccttgcataaaagagtcattccaaaatagtctgcagagttagccaaccatctagttggatcaggcaacagaatcaccaactgaactcacaggaccaaatagagctcttcttgaaaggcatctggctgtgatgcttgctagaatcattttgtaaccttcttattatcgaacatgtaaacatatatcaaaatagacagtatagtataaagaatctcttttacccataacataatttccacagataactcatggctgagcttgttttatttatatccgcatctacctcttacctcatcccccataacattttgaaaaaaacttaggcattatgtaatttattttgtaaatgtttcagaatatatctttaaaagataatgactccttaaaaatttatccagaatagtattataactctaatggtgaatggaatcatatcattatgaaatgttccagttatagtagttttctgcttttaaatatattttgtatgatattatagcttcaccagaggtctttgagtttggatgggtaagtctttttccattctttaaccttcaacttttcagtgtccttgtgttttaggtgtgtttcttgttaacagtataggtttgaatttcatctagtatatccattttggtttaaaattagatgatttattccattctcatcgaatataataacgataaatttgcatctagacctacaatcttacaaacacattccaattgtttcatctgttcttatatattttgatttaatcaaacatattctgttttcctttatttttaatttttaaaattttcaacttttattttaggttcaggggtacttgcacaagtttgttacattggtatattgtgtgatgctaaagtttggggtatgattgataatatcaccaaggtactgagcatagtatctaataggtagtttttcagcccttcccccctcttcgctccccactctaatagtccccagtgtctactgttcccatctttgtgaccatgagtacccagtgtttagctcccacttataagtgagaacatgtgatatttggttttctattcatgcattaatttgcttaggataaagacctccagctgtatccatgttgctgcaaaggacatgattttgttcttctttatggctgcatagtattctatggtgtatatataccacattttctttatcattccatcatggataggcacctaggttgattccatgtctttggtattgtgaatagtgctgaaatgaacatacaagtgcatgtgtctttttggtggaacaatttattaccctttgagtatatacccaacagtgagattgctggattgaatggtagttctgttttaagttctttgagaagtctctaaacagctttccacagtggttgaactaattcacattcccaccagtagtgtataaatgttcccttttctctgcagtctccccagcatctatttttttttaataatagccattctgacttctgtaagatgatatcttattgcatttctctaattattagtgatgttgagcatttttgcatatgtttgttggctgcttttatgtcttcttttgataagtgtttgttcatgtcctttgcccactttttagtggggctgtttgttttttacttgctgatttgtcaaagtcccttatagattctgggtatcagacctctgttggatgcataggctgaaaatactttctcccattttgtagggtatctgtttattgtgttgatagtttcttttgcagtgagaagcactttaattaggtcccacttgtcaattttttggttgttgttgttgagattgtttttgaggtgttagccataaattcttcaccaaggttgatgtgcagaatgatatttcctaggttgtcttctaggatttttatagtttgaggtcttacatttaaatctttgagccatcttgagttaattttgcatatggtaaaaggtagggatcctatttcatttttctgtatatagctggccagctttcccagcaccatttattaaataggggatactttccccattgcttatttttgtcaactttgtcaaagatcagatggctgtaagtgtgaggttttatttctgggctctccattctattccattggtctatgtgtctgttttgtattagtaccatgctgtttaggttactgtagccttatagtatagttttaaatcaggcaatatgatgcctcctgctttgttctttttgcttaggattcctttggctattcaggatttctttgggttacattataaattttagaatttttttcctaaatctgtgaaaaatgacattggtagtttgataggagtagtgttgaggctgtagactactttgggcatatagccatattaaggataccagtccttccaattcatgagcatggactgtttccctttttatttgtgtgatctctgattttcttcagcagtgtttcataattctccttgaagagatctttcactcccttggttagaggtcctcctagatattttattttttggtggcaattgtgaacggaattgtgttcttgatttggctctcaacttgtatgttgttggtatgtagaaacgttattgatttttgtacactgattttgtatcctgaaactacagaagtagtttatcagttctagcagccttttggtggagtctttagggttttctaggcatagaatcatatcatcagcaaacagagatagtttggctttttcttttcctatttggatgccggttatttctttctttttcctgattgctctggctagaacttctagtactatgttaaataggagaggtgagagtgagcattcttgtcttgttccagttctgaaagggaatgcttccaactttttgcattcagagtgatgtgggctgtgggtttgtcatacctggctcttattattttgaggtatgttcttttgatgcccagtttgttgatggttttattgtgaaaagatattggcttttatagaaagcttttcccatgtctattgagatgatcatatggcttttgtttttaattctctttatgtggtgaatcacatttattgatttgcgtatattcaaccaaccttgcatcccaggaagaaaacctactacattgtgatgaattaactttttgatatgctgctggattcaatttgctagtattctgttgaggatttttacatctatgttcatcagggatattggcctgtgattttcttttttcagtgtctttgctagatttttgttatcagggtgatgttggcttcttaaataatctgtttcccttttctgcttttcttagttgggaaattacatattattttagtttttctttaggtctattctagagattaaaaatttatcctcaacttgtagaagtttagggttgactagtactttagttcctctgggattatcttacagttcactaattctctttagttatgtctaatgtgctattaaaatcattcactgagatctcaattttaaatattatatctttcatttctggaatttatagttagtcctgttatacagctttcagttctgtcttgaaattttcaaacttatcatttaagtatttttttttccaagaaagtaagtatattttctgaactcttgtctgagtggtattcttttgtttttattcaagaatctcatgctcaatgaaatttttcatatgtaaagccaaagtaagttaatctgatttccttctttgtgtattctactgggatcattcttgattaaaaacatattctagaaaataaaacaagagtgaaaatatacaatttgaatatggtataggatattatgtggatgtttctgaaattgatgttgggagtataatttgataaaaagcttgttgaaagcaacttgacattatctaaatgaaaaatgtttacatcctttgaactagcatcccacttgtgaaaatatatcctagaaatctatttgtacttgtgaataaggattttcaatgtggtaattcttataatagtaaatacctagaaacaccctaaatgtctatatatttaagagctgttaaataaataagtttacatgcatccatctggaataccacacataactaaaaaactattaggcaaattcatacatgttgctttggaagatcaccaagatatatccttaaatgaaaacaatgaaaatgaaaatataccagggagctgataactttggatagcatgttcatgtgtgtgtgtgtgtgtgtgtgtgtgtgtgtgtgtgagagagagagagaaaaagaaagagggaaagagagagagacaataaatacatgcttttaaagctatttgtgcatactaattcacaaggatttataggcacatagaatatttcattttcagtaagacaaaaaaattcttatactgcaggctgtgacattctaaaacaaagagatatgaataaaatgaacatctacaatattaactaatactggagcaaatttcatttatttccaacatttgttcctgcctaaagagatttacttgtggcactatccctaccagggataatgtgccgccatgaatctcccagagcactctcgatcatctcctgttttcatccaagttattttctagattttgaataatcttccaaatagatgtagagagaaaggtgctgatagcaggtaggggcaggtaaaatgttggctgttttaaaatcagtatagactgattatctattgtttgaggtttacagcacaggctctggagtcagactgtttacttttaaattataactctgtcacttggcaagtgtgataatcagacagtttcttactaatttgtgcctcagttttcttatctacataatgggataatgtaagtactcatttcatagtgttgttcaataattacataaaatttcacctaaaatgtttagcagagtattttagtaggaagatgagaaaggctgtggctatgacagcagccaatgctatttcatttgaaactgataacttaggaagttattaatgtaatatatagaaatacttaacatagatttctttaaataggagaatacccagggatttaaaaatgaagcttgatggaggtggggggctaggggaggaatagcattaggagaaatacctaatgtagatgatgggttgatgggtgcagcaaaccaccatggcacgtgtatacctatgtaacaaacctacacattctgcacctgtatcccagaacttaaagtataataataaaaaaaaagatgagaaaaatgggaaaaaaaagagcttgagtttttatagtgtttcaggagggacatggagaaaaggagtaggccacacttatacccttgttttatgatttatttagccaaggacacagaactttgaagaagtagcatggctgcacagaacagaagcaggtgggagtggggaaacttcattcaactttccactggcttgtttgcttcctaaaaagacatcagctgccggtcaaagattctgagtggggaggtactggaacaccttgtcatttgacccgactggacaatttattagtttcataggtttgaaccattctcttaattcttctgagcctcagttacctaatccatcaaacaggaatactagttactctaatagagtgttactttgactgtatgtgaggtattggaaaagttgaaagatatgataatgcccaacacaaatgtaatgtgctgttgcttaggaaactatgtctagaagtggacatagtcaacttgagcctttctgaagcccctacatgtgaaaaccacatgttaagaatttgtggttaaatgcttagaactttaagaacaagcagttggacggctcttacggtaggtgttaagagagaattggtttagcaagatacgagtacaactaatttttcctctttggctgttttctcatctttaaactggatgaactggacaggatgaatttgagggggctaatcatgagggaggaagtaaaagttcatgtgtgtgtgcgtgtgtgtgtgtgtgagagagagagagagagagaatgaatacatgcttttaaagctatttgttcatgataattcactaggttttatagacacatacaacatttcattttcagtaaggacaaaaaaattattattctgcaggcagtgacattctaaacaaggagatatgaataaaatgaacgtctacaatattcactaatacaggggtaaattacatgtctagcatgctgtgattcaggtgacatgtccaaagttcatctgtgaagtggtccaggtccacttagttagagtcttcctggaattcaccaacatcattggtccaatgaggcacgagggcagaagaagtcaccaagggccccttgagtatgtctgtggtggggacagggggtgatgggatgttagattctcctctgtcacttacttgagaatggagagggaaacccacggatgccagaatgtgagggggttaatcatgagtgaggaagtagaagtccctgttttataattggattaatgagagataggttccctaacctctgaatgaagcagttgggaaattgacttttgcttttctcagaaattccctagagagtgggtgctagaaaagttcagggaattcaattctctgacctcaactttccatttcgtacatcttaaatgctttgggcctctcagtccagcaaacatttccctcaactctccttttagtgagttttagggcagactgaccccgttcttttcccctgcaactttcttagcaagaaagtcattaagggctggacttggcaaatggaggggtggcatctttcaggtggtgtatttcagacacatcggtgccttctgttattcctcttgcttccacatgttttcatacatggtgaaccttcttagatttgctcactctttcagctgatggggcagaccttagacatcaccccttaaagcctcagctgtctagttaaaggacagggtgacaaagttactttatagtttagcttagagcagatgttacagtcattctcaccagagccactggtaacatggccaacatggaatagtttgcaaaactaagttttctgaatcaacagctgaataatgtatttttcagcaatattcttttgataaatttgaaggacttggctaagatgttctcacatctgtcctcctatgggagaaaaaaaagtattagcctatctgagcctgaatggagattagcctacatagaaatctaaaatttgctgggaagcaatcctgaaccaagatctccaagttttagactagtgaacactaacacactatttagatttctttgatctctttgtctttagactttgttagtgaaataaaactttcttgggatgacgtggtgcaagtgaattagtgttctgactgcaaaaaagaaaatatagaagataaattaagaatcaaaacaacaaacaatgttcaaggtaagttcattcacctaatctttagtggggcatgcttggaattagtttcaaaaagaggagctaatttttttagattagatatcctccctgcatgtactttaacctctgtgctgtttataggacacctctagtgtcttaaaaatagatgtaatagcagatgaaggattcagggatcactccaaaaccacctcttaacgtctaccatgttctcagctgtgtgcaacatgttatagaggatgtaacagacacttaaccagccttcaaaacttatgtcttcaccgagagacctgacagatgtacatgaactaggtagagaataattggtgacaaagtcttagagcttagatctcaagtcccaaaggcaaatcttgcaaagacttctttccctggcagtgcagtttggctggctcctgaaacattgtctcctctccggggcctctaagctctgcacaggctgcctgggaagaaattacaccttgggcaagtagatgactgaagtcagatcatatttttcgtttctcctaaaagttttatttttatttttaaaaatttaatttaatttaattttaagttttgggatacatgtacaggatgtgcaggtttattacaaaggtaaatatgtaccattgtggtttgctgcacctattaacacctcaaagacctagaaccagaaataccttttgacccagcaatcacattactgggtatatacccaaatgaatagaaatcattatattataaagatacatgcacacatatgttcattgcagcactattcacaatagcaaagacatggaatcaacccaaatgcccaatgcccatcaataatagactggataaagaaaatgtggtacatacacaccatggaatactatgcagccatgaaaaggaatgagatcatgttctttgcagggatgtggatggagctggaagccattatcctcagcaaactaacacaggaacagaaaagcaaacactacatgttctcacttataagcaggagctgaataatgaggatcacatttttgtaaatttactttcttcctgccttttgtttttttaaaagattttactcataaattaggtattgatgggacgtatctcaaaataataggagctatctatgacaaacccacagccaatatcatactgaatgggcaaaaactagaagcattccctttgaaaactggcacaagacagggatgccgtctctcaccactcctattcaacatagtgttagaagttctggccagggcaatcaggcaggagaaggaaataaagggtattcaattaggaaaagaagaagtcaaattgtccctgtttgcagatgacatgattgtatatctagaaaactccattgtctcagcgcaaaatcttcttaagctgacaagcaacttcagcaaagtctcaggatacaaaatcaatgtgccaaaatcacaagcattcttatacaccaataagagacaaagagagaaccaaatcatgattgaactcccactcacaattgcttcaaagagaataaaatacctaggaatacaacttacaagggatgtgaaggacctcttcaaggagaactacaaaccactgctcaaggaaataaaagaggttagaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactgctttaaagctcatatggaaccaaaagagagcccacattgctgagtcaatcctaagccaaaagaacaaagctggaggcatcatgctacctgacttcaaactatactacaaggctacagtaaccaaaacagcatggtacttgtaccaaaacagagatatagatcaatggaacagaacagagccctcagaaataatgctgcttatctacaactatctgatctttgacaaacctgagaaaaaccagcaatggggaaaggattccctatttaataaatggtgttgggaaaactggctagccataagtagaaagctgaaactggatcccttccttacaccttatacaaaaattaattcaagatggattaaagacttacatgttagacctaaaaccatcaaaaccctagaagaaaacctaggcaataccattcagaacataggcatgggcaaggacttcatgtctaaaacaccaaaagcaatggcaacaaaagctaaaattgacaaatgggatctaattaaactaaagagcttctgcacagcaaaagaaactagcatcagagtgaacaggcaacctacaaaacgggagaaaatttttgcaacctactcatctgataaagggctaatatccagaatctacaatgaactcaaacaaatttacaagaaaaaatcaaacaaccccatcaaaaagtgggtgaaggatatgaacagacacttctcaaaagaagacatttatgcagccaaaagacacatgaaaaaatgctcatcatcactggccatcagagaaatgcaaatgaaaaccacaatgagataccatctcacaccagttagaatggcaatcattaaaaagtcaggaaaaaacaggtgctggagaggatgtggagaaataggaacacttttacacagttggtgggactgtaaactagttcaacccttgtggaagtcagtgtggcgattcctcagggatctagaactagaaataccatttgacccagccatcccattactgggtatgtacccaaaggattataaatcatgctgctataaagacacatgcacacgtatgtttattgaggcactattcacaatagcaaagacttggaaccaacccaaatgtccaataatgatagactggattaagaaaatgtggcacatatagaccatggaatactatgcagccataaaaaatgatgagttcatgtcctttgtaggaacatggatgaagctggaaaccatcattctcagtaaactattgcaaggacaaaaaaccaaacaccgcatgttctcactcataggtgggaattgagcaatgagaacacatggacacaggaaggggaacatcacacactgggacctgttgtggggtgggaggagaggggagggacagcgttatacctaatgttaaatgatgagttaatgggtgcagcacaccaacatggcacaggtatacatatgtaacaaacctgcaagttgtgcacatgtaccctaaaacttaaagtataataatgaaaagaaaagattttactcttccacttggcttggcctttgttgtaaacacaattctcttccctgtccctgttattgctgcattctggaagctggatttgggtgagcaccaggtggaagactcaatggatttgatgatctataaagcaagcattgaatgggaagctgagacacctagttctagttcaggctctgcaccaaccagctgtatgtgactttgggccccagattcctcttctgtgacatgaagaatccatgagcccccttacaaatttgacagcttatgattactctgtataggaaactaggaaggagagaggcctctgcatctgacttctctgtgataggatatctttggagagaagaatgttcgaaaagaccagtctgaccaatcttatttttcaaaacctcatagtacatgaggttctatgacaggaaaagtgaaataagaaaccacaaagtagggactggtttcattttaaatatttagaaattttcacagaagttgtttactgaggttaggccttctttgagattctgtgtgcatccccattttaggtttccttaactgtgaaccccggaaatgtccatttaatgtgctgtctgattagaacacagatttatgtttcaggttctcttcttttggccctgccaattacaaagtcagtattaaagtattttagacatcgcaggcaaaatgtcactaacactgtcagtggtttacacatctattgacctctttatgaaattatctctcaaaggtatttcttttccgtgcagaggcttaatacatgttaatttccttttaaaaattctactctaaatccactcaatttgtagctttttgagacaatttgatgattatattgtaaatacatcttgttctgttaaccttcaatacgcttggactaaaaatacaacaatgaatcttttaaaatcagaagactaaagtggtccttacaaatcctttgaggggacctctcattgacactccaaaccagaagtaattatagaacatttgctttcaagctaaatttcacagaaaatactcacctagtgatagagtcattgtttccgtgaggatgaaacctccccatgtaagattcctgccttctgcataaacatcctgtgtgtgaaagattggtatatggcagaaggatcagctgggtacacagaggagcatggtggggagctaaagggagggcacaacaacgaggggatggcattatggctgttttatagatcaggaaactgaggctcagagaggtttcatcacttgtcccaggccacacaactcttctttggaccaaggtctgtattttcgagatgtacatgcttctaccacatcactcacttctgcagagtaccttatagtggttcatcatatcaatcttgccttatactatcacgtggaatgagttttctacaccgagtgctaacatttctcaaccccaacctcaaatctgtgaagctaaccaggttccctaataggcataagaaagaaactgagaagaggaaaggaaaatcacaaagcctcaaccactgttcttggaggaaggtatggagaaggggaaatttatgaggcagtaacaagtcagaaggcatttcaataattagttagttaaattggggtaaaatacacaacaggatttaccatcttaacaatttttaagtgtatagctgagtaacattaaaatacattcacataattgtgcagccatcaccacctttcatctctagaacacctttcattgccccaaactgaaactaccatgaaacactaactccatattcttcctccccctgcagtccctggcggccaccattctactttctgtctctatgaatttgactattctaggtactctaggtgctgtataagtggacttacacaatatttttatttctgtgacttagtatgtcacttagcatattcagtcccattttataatgtagctgactgttctgagggcttgttgatgtgcttaaccctgggaccctttaatcagaaccctgggacatgacaagtctgcacaagcagatgtagacatcaggcactctttaggcataggagatgtagtggaagcatgtacattttgagaaacacagatctgggctcaaataagagctgtgtggctttgggcaagtggctggacctctctgagtctcagtttttttcttatctataaaatgtcctctgatttttcttgtgagcattcaatcagcatgtgctagatcagcaaaaacacttcaaggccgcaacactacaaaatcgaggcttatgttgggaataacatcaagcagctgatatttgctgttttgttcacttgtctcagaacatgttttggggaaaaccaagggagagaacaaactcaagagggagcaggatgatgatagtcctcaggcctgggaaggatgtttctaatgattgaggagagttctttgatttctgtgattccaggctgtcagctcctgtgctttaaaatatggttgctacaaacaatgtgactgaaataattttcgtgggattttcccagaattggagtgagcagagggtcatttctgtgatgtttctcctcatgtacacagctgttgtgctgggcaatggcctcattgtggtgaccatcctggccagcaaagtgctcacctcccccatgtatttctttctcagctacttatcctttgtggagatctgctactgttctgtcatggcccccaagcttatctttgactcctttatcaagaggaaagtcatttctctcaagggctgcctcacacagatgttttccctccatttctttggtggcactgaggcctttctcctgatggtgatggcctatgaccgctatgtggccatctgcaagcccttgcactacatggccatcatgaaccagcgaatgtgtggtctcctcgtgaggatagcatggggcgggggcctgctgcattctgttgggcaaaccttcctgattttccagctcccgttctgtggccccaacatcatggaccactacttctgtgatgtccacccagtgctggagctggcctgcgcagacaccttcttcattagcctgctgatcatcaccaatggcggctccatctccgtagtcagtttcttcgtgctgatggcttcctacctgatcatcctgcacttcctgagaagccacaacttggaggggcagcacaaggccctctccacctgtgcctctcatgtcacagttgtcgacctgttcttcataccttgctccttggtctatattaggccctgtgtcaccctccctgcagacaagatagttgctgtattttatacagtggtcacacctctcttaaaccctgtgatttactccttcaggaatgctgaagtgaaaaatgccatgaggagatttattgggggaaaagtaatttgagaagagaagtagatgatttagttagggaaaataggaggagtaagggatgggaaattggggcatgtaagatctcactctgcatctaccttgcccaatggagtgagtggccttgggccagtcaccttttttgaagtttcagtttcctcatcttatgggattggacaagattaaagggagctctaggatggagtaagaggggtcttctagtgctgtgcttccaaatctgacagtggctttgagatatattggttggtctaaagagaataaactcttccagaaaaccaggtcagtctgggaatggtgaagagggaggtgaggattgagaatgactgtttcagggagcactggtcattatgtcctatcagtttgaacatttgcatgattggaaagtctcttgacttgacatactgaggttttgctgagagggttttaagcaggcaagctgactgagaagggttagtcctgagaatggaagacgttgactcttgtcaagagattcacatgagctcatgctagcattagactcagggttctcaagaatccaaaagaacaacagggaaattttaagcaaattgaaggcactgctgtcccatattttaaccttcttctttgagtcttattccagtagccaccagactataagaatgtgcccagaaccctaaccctaatcctgcccctcactgccatcagataaattttcttccacatgctttcagactcatcaccttcaagcagttctctgatttcatcactctcctcctcaaaaatcttcaatgactccccattgccttctgaatcaactataaattcctacttgatatgaaataccctcaagtcatgaccttctcataatgttagattttcatttttcaattacactattagagcatactgttttctgaacatctccttgtgccctccacctataatattttccttatctctacctattaacatcctacctaccctccatggcccatctgaaattctcctatctttaggaagcccccatgtttatcttatctgggtatgtcattttctttctttgaattctcacagcactcagtgggaatcctttagggctgttactacctttatttcaaagtttatttctccccagtagactgtgactcctttgagaatgtggcttgaattttattcatctgtgtatctctaaatagcaaaacaataaatatttggtcaattaaatttctggatgtcattagcacttcagattgtaggtggacaatggttgttatatctctcatttcatgtaaataatctaagtaatatatcagtcacatcactcaagacaaaccagtaatccttcctgatattgtttctgagaatatcatttatatataaataaggagcatatatgtatttgtattttttacaatgaactaagagatttaatgatttatctaacttgattctaaaacacactggtgaagtgggtatgagtacagaagaagagattggagattggggaggcaggtgtcttgatcaaggtcaccggttagtaacccatgaagcctgaattcaaacctagctgtgtctgatttctcagcccatgctcttctctgcttctctttaaatgtcaccacacataagtatatgtaagtctctgaatttcaaatctgagggctgagaatatcctattgtcaggtaattccctctggaattacttcagattaaataaaaagtgttttaaaaaatataaacctgaaatgctttttgggtgttcacaggtatttctgggtccacagagatccagtggccaggatactggatctggaagtagagggaaggaaagcaggggctatgatgcttctgcaggtgaggctccttggtcctcaggaggaaaaaacctgggcattgactgggttagggtgggtcatatgttgctcaggtaattttatgtttctacagattttttgggtgaagagtggcctaaggcctgacatcaaaactcaatgagctggccaagacaagttttttttttttttttttttgagacagagtttcattcttattgttcaaactggagtgcaatggcacgatcttggctcactgcaacctctgcctctggggttcaagcgattctcctgcctcagcctcctgagtagctgggattacaggtgcgcaccaccatgcccagctaatttttttgtatttttagtagaaacggggtttcactatgttagccaggctggtcttgaaatcctgatgccaggtgatccacccaccttggccttccaaagtgatgggattacaggtgtgagacaccacacacagccaagattgcttttttttctagtgacataatgctggaaaggcagcattcttcagaatatcatagaaatcagaaaatgggaaataagaggcaaaagattaatatgaattatgcatccgccaattaagtttcctaacatttaattatcaggactgcgctgtcccattggtggtgcgattcattttgcaggtggggaaactgcaggtcaaggactgtttctaaaccctcaatgtttcttctacaccagttgtttgtgaactatgtaggattcagtgtccagaattctgcaggtatctgagggactggggtaaaagcagagcaggaaaggacaggagacatatgaatgggtaatcagcagctgattaccttaaaaaaatctgttttatataagatttactttgataaaaaatactcaaaaccttaaaaaagcttaaaaatcactataacatagcatgcttatacttttaattttgattggtcatagccaagtcttctgtgggttggttatagaggggcagacgttaggaaatgacctctatttccaaaaagggaagcagaatcaagccttcttccaaagttccagtgccagagagtcaggcaagaacctcctcaatgacagttaaggcatgcctcagaaaatgcagcatatccaatgcaggtgaatgcccttgaacatgatacgctgacccagccagctctgaaatggcctcacttcttggggtgatgccacacccaaattgcattttccattatgtttgcagactgaatctctttgccatgagactcatagcatttagagttttcatatatatatttttgaaaaatttgtgatttgcaaagaactaaaagttctgcgctttatctatatgtaatgtcaagaaaacttgagtggaaattatattattattatttattatttattttattttattttatttttcgagacagagattttgctcttgtccccaggctggaatgcagtggtaggatctcggcttactgcaacctccacctcccaggttcaagtgattctcctgcctcagcctactgagtaggtgggattacaggggtgcgccaccatgcccggctaattttgtatttttagtagagatggggtttcaccatgttggccaggctggtctcgaactcctgacctcatgtgatccactcaccttggcctcccaaattgctgggattacaggcgtgagccaccacaacttattttattttattttattttattttattttattttattttatttttgagacagagtcttgccctgtcgcccaggctggagtgcagtggcatgatcttggctcactgtaacctttgcctcccagattcaagcgattgttgtgctgcagcctcccaagtagctgggactacggaggtacaccaccgcgcctggctaatttttgtaagtttggtagagacagggtttcaccatgttggccaagctggtctagaactcctgagctcaagtgatccacccagattcccaaagtgctgggatcacaggcgtgagccactgtgcctggcctggaagttatattattcctacattattctgagaattctagctgcccaggctttttaccagtatggaaagtgatctccagagacactttcctgtttctctcatttctaatctttgctcacatccatatcaattgatattcctgggaagcagaagtatcttagatagatggagatacggcttctctcagaaaagtctaaaaagataggtgttgagatgaaatgaatattataagtagttatcactgggtatatcttctggaaacagtggctttctcatgggtgaaaacctactttggtaatcatatacacggttagagctgacatagttgcagctatcgtatgtagggcatcatgacaggtaggtattggagggggtgttattgcccctattttacatggagaatttactaaaaaaatgttgtctaaaatcacagagtaggtagagtgaggatttgaattcacatggtctgattctggaattcatgctctttttttaatcatcccacatttgcaccatcagggagtctagcccacaccttccttttaaatggtaggaaattcttttagaatctttagtgcacctgaaagtcatttgcgttttaaatcttttattctataaaaaaatcctataaatccttttcaagatatgaatttggtgactttaggtcatcaaatgacattcatattataaacttaagttgtttgtaatattctctctttatcctttattttccgcagaaatgtagtgatatccttttgccttcccagtattaaaaattttttctttttcatttgttttgttaatattttcaatagaccattgtttcacttcctctaaaatttttctgtttttgttttctctgattaatatctgttaactttcctatatccttccttctagattgtatgaggagtcaggtaaaaacttagctcattgattttagacctcacttcctttcaaatataagaatttaaaactaggatggaactggagatcattatgttaagtgaaataatccagacatggaaagacagacatcacatgttatgattatttgtgggatctaaaaatcaaaacaattgaactcatggacatagagagtagaaggatggttaccagaggctggaaagggtagtgggagagtgagggggaggtggggatggtcaatggggaaaaaaagtagaataaatgagacctactatttgatagcacaatggggttactatagtcaataataacttaattgtatattttaaaataaagagtgtaattggattgtttgtaactcaaaggacaaatgcttgaggggacgggtatcccattctccatgatgtgcttatttcactgtgcatgcctgaatcaaaacatctcatgtaccccataaatatttctatctactatgtacccacaaaaataaaaaataataattaaaagagaatttaaaactataaactctaaaaagcaatactttagctgcatcccacaaaatttcacaagtatttttatcattcaatttaaaatataatctcatttttaattatttctcctttaaccaatggattatttagaactatgttgtttaattttcaattatttgggatttttccttgatatcttattgttatttaatcctagtttaattccactgtggttagagagcattctgaataatgccattccttttacatttgttaaaacctgtttcatagcccaacctaaggtctatcttagtgaatgtacaacatgtgctggaaaagaatgtgtatttttcagttgtagggtatagtgttctatacatatcaattaggttagggtgggtcatatattgctcagatcttttatgtttctacagattttcttcgtctcatcatactaccacttcctgaggcagtggagttgttactgcaaagggatcccattctggaccccaagagagggttcttggatcttgtgcaagaaagaatttggggccattccataaagcaaagtgaaatcaagctttaaaagtaaaggaataacgaatggctactccataggcagaacagcagcttgggctgctggactaaggacacttatagttatttcttgtttatatgctaaacaaggtgtggattgttcatgagttttctgggaaaggggtgggcatttcctggaactgagggctcctcctcttttagaccatacagggtaacttactcattgccacggcatttgtaaatggtcatggcacttgtgggagtgtcttttagcatgctaatacattataattagcatataatgagcagtgaggatgatcagaggtcactttaattgccatcttggttttggtggaatttggagggcttctttatcgccacccattttgttaataaggtctttatgacctgtatcttgtgctgatctgctatgtcatcctgtgccttagagtgcctaacctcctgggagtgcaacccagtaggtctcagcctcattttactcagcccctattgaagatggagtcactctggttcaaatgcttctgacagaattaatttctccaattatgactgtagaattgtttattgatttctttaaacctgagaaagaaaaaattgcagatgaagaaatgacatcaagggaagttaagtcactcttgcaggttatatatctagcaaataggagagtcagccattaaacaaggcaggttgactccctggtccatgcttttaagcaccatgttatatcactccttgtatgtcttatctaactcacagggtgaaaacacttcaaaatgctatgtaaacataaggtggtagtcaaggggctagtttagttcaaacttgtccctgctactcacaagaaaacccagatgacttcatgtttagtaccagcttatttccccaaatagatggcacaaaaccatgccctatgtattgtagttgcttaataactacatgtagaataaatgagtttgtgatgactgagtacaggagtctaagacaaaaataaaaacagtggctttcatagcttccaaagttagtctgaaccactaagtaaatgtgataagggggtatggtgtctccatggcccactcctctaattggaatgcaatgcccctggagtctcattagcaagcctcaaggtacttttactaaaaatgaatgtgctataactcttaaagcagtggcactcaaatttagtgatggctttggctggggtgataccacatgagcttccttgaaccccttgtgcttaacaattcactgcaactctctagttatcttgtcaggcttcttgactttggttgctcactggaggagggtggagctcactaaggtcagttctcatgtaggcttggtcttttggggactctatctagaataaacctgaactgaccagggaaccttgtagaaaacagatgtcttcacttgctttgctctgtccctgttctgttctcagtgcccacatggaagtcctgctgcacagtatttgagtattcctcaagatcctgcttgggggtttgacatctgatttgatttttttttcttcagattgccaaggtatcactagaattcttctccttaaccattttcttaaccattactcattagttgctgagaacatggcctcttggtgatcaggtggtcccacttccttggtcaggagtattgtatggcgactaagaggatagcattaacgccctggacactgggttacatttcctgctctaacccttaccactgtgtgaatttgacccagtcactcagtcatttgaatccttacgtccctcatctgaaaaatagaaacaatcatagtagcttcctcgaagtgatgttgagtggattaagtgagatgaggcatttaaagtggtctgcacaagtccaggcacacagtaagtgttcaataagtacaagcaaatattacgctgctgtggttactggtctttctactcatggtcaggttaaagctcagaaagtagtttcacatgtatttattctttagaggcttgctagatggatgcccagaccatgactgggagctgctgaaggcataggactgcagcgaaggatgtgtacttagagtagaggggtcagagtttacagaccaaggaatgggctgccctggcatgtggtccctgatggcacattaactttttgcaaattagagcaattgagagtgtattttctttgaggtgtagtcttagaacactttctccaaagcccagacccacccagcaaggagctttttcatgtaaatgagttctttgaatacttgaagcttaaaaggcatttagaagactttttacattttaatcttttaaggtagaaatgtttctaaattgcattacaaatttcttttgtatttcaaaacaatgtatttgaaaactggggagaggacaaattcagtgtaatgtgaatctcaatcccctaccagttcccaggaaaagtagtgaagggaattagtaaagatgtaaagcaacttacttgcttcctagctattcttaaattcatcaaatactaattcatcattaaagtcatcaatatcagtgaaattgattttgggggggatatttctatttttccagcttagaatcacagcacttagtctaaccttcatctttttgttgatgctgacttgtttgtgtaaagtcaagtccaatgttcatgtctctaaagtttttcagtggtgtgagactggagagagtagaagggtctcacaccagaaggttgtagcaaataagcattggttttggaatcaggcagatttgctttcaattcctattatatggtacttgctatgtctcacctagagcaagtcatttaaagctaaacttctggagtttccttctcttcatttgtatagtgaggatgttgttagttatctttaagaattgtgataagtgtgaactaggatagtgggttaagctcatgaacagtgcctgacccacaccatctccacaatgatggtggcagcctgaggtataagaagtgggaaatctttttttgtgctatactcagtcttgttcaggtattcacagactacaaggttcaaggggaagtttatggtttaaggataacgtgaggattttggagagtatgagaaaaggaaatggatagaaatgagtccctgaaggagcagttgaaggtgctggaagacctttaggcccaagaagggtagtctgagttgggagctaatgatcattgttttattagtgtcttctttaattcccagaatagcaaatgacattgtttttacattgtattgagattctatctggatcctaataaagttcatgccctccacctcaaccttcccaatttaaggaatcaatcttaggaaaaactaccagagagctacacagtgagggcatttactatagtctaaaattgagagtcactcaaaagctcatatacagataaatagttaaataaattatgggactttttaataatgcaccattaaaaacatcttttgaagaatatcatctgtggaaatgcttaaagtgttaagggaaaaagtctgaatataaaactatgtatatacttgattcaaaatttgtaactcagattctgctaaccaacattttactctgtttccataagttcaattttttaagattccacatataagtgggatcatgctgtatttgtctttctgtgcttggcttaccacagtactctccagattcatccatgttgttgtaaatgacaggatttccttttttataaaggtggaatggtattttattgtgtatatataccacatttcctttatccattcattcattgatgggcatttaggttgcatctgtatcctggctattgtgaaaaatgctgcaatgaatatagaagtgcagatacctctttggcatactgatttcttatcttttgtatatacatccagtagtggaattactggatcatatggtagttctattaattcattttttatttttaattttagtgggtacatatttagtgtatctatttatgggttacatgagatattttgatgcagacatgcaatgtgtaataatcacatcagggtaaatggggtatccatcaccttaagcatttatcctttgtgttacaaacaatccacttacactcttttagttattttaatatgtacaataaattatttttgactatagtcatcctgttgtgctagaaaatactaggtcttgtttattcgattttttttggcactcattcaccatgaatcagtatttgatgaatttaagaataactagaaagcaagtaagtagctttacatggttggcagcttccttgccaatctccactactcttcttagcctctggtaaccatcattctatgctctactttcattgaatctcaatcagttcaattgttttaatttttagctcccacatataagtgaaaatatacgaagtttgtctttctgtgcctggcctatttcacttaatataatgttctccagttccatccatgttgttgcaaatgacaggatctaattctttttatggctggatagtacttcattgggtgtatatatcacattgtctttatccatttttctgttggtggacacttaatttgtttccaaatggtggctattgtgaatagtgtgcaataaacatgggagcacagctaactatttgatatgctgagttccgttcttctgattgtatacctaggagtgaaattgatggatcacatggtagctctatttttagtttttgaaggaggctcaaaactgtttttcatagtagttatactaatttacattcccaccaagagtctacaagagttcccttttctccatatccttgccagcatttgttactgcctgtcttttggatataagccatttaaactggggtaagataatatctcattgtagtttttatatgcatttctctggtgatcaataaagttgagcaccttttcatatatctgtttgccatttgcatgtctttttttagacatgtcttttgcccattttaaaatcaggttattaaattttttcctacagagttgtttgagctacttatatattctggttattaatcctttgtcagatagagagtttgcaaatattttctcccattctgtgggttgtctcttaactttgttgattgtttccttcacagtgcagaagctttttaacttgatgtgattttatttgtccatttttgctttggttgcctgtgcttatggggtgttactcaagaaatctttgcccagtccaatgtcctggagttttcccaatgcttcttgtagtagtttttatagtttgaggtcttaggtttaggcctttgatcttctttgatttgatttttgtatatggtgagagataggagtctagttttattctttctgcacatgaatatccagttttccaagcaccatttattgaagaaactgtcctttccccaatgtatgttcttggcaccattgtaaaaaatcaattcactctagatgtatgggtttatttcctggttctctattctgatccactggtctgtgcattggtttttatgccagcagcatgccattttggttactatagctctgtagtataatttgaagtgaggtaatgcaattcctccagttttgttctttttcccaagatagctttggctattctgggtcttttgtgattccatataaattttagagttgttttttctatttatgtgaaacatgtcattggtattttgatagagattgtattgaatttgtagattgttatgggtagtataaacattttaacaatattgattcttctaatccacaaaaatggaatatattcctatattttctgtatcctcttcaatgtcttgaatcaatgttttatagttttaattgtagagacctttcacttctttggtgatgttaattcctaagtatttaattttatttgtagttattgtaaatgggattattttcttgatttctttttcagactgtttgctgttggcatactgacttttgtatgttgatattgtatcctgcaactttattgaatttgtttatcatttctaatagttttttgctggagtctttagttttttccaaatacaagattatatctgcaaataagtgtaatttgaccccttcctttccaatatggaggccctttatttatttggtctgattgctctagctcaaacttccagtactatgttgaatgactgtggtgaaagtgggcatcgttattgtattgcagatcttagacgaaaggctttcagtttttcctcattcagtacaatattacatatgggtctgtcatatatggcttttgttatattgaagtatgttccttccatacccagttttttgaaggtttttatgatgaagagatgttgagctttatcaaatgctttttcagcttcagttgaaatgatcaaataatatccttcattctgttcatatgatgtatcacattaattgatttttgtgtgttaacccaaacttgcatccctgggataaatcccacttgatcatgataaatgatcttctaaacgtattgttgaattcagtttgccagtattttgttgaggatatttgcatcaatattcatcaatgatattagctggtagttttcttttaatgatgtgtctttgtctggttttggtatcagggtaatactagccttgtagaatgaattcagaagtattctcccctcctctattttccagagtagtttgaatagaattggtattagttcttctttaacctatttcctgtttgccttgagaatagtgtgctggcaaagagctgcacttttattttctaaatgggaaatgggttaaatgtttggtagaattcagcagtgaagccatggggtcccaggcttttcttcgctgggagatttttaaatgatggcttcaatcttgttatttgttatcagtctgtttaggtttttgatttctccatggatcaatcttggtagattatatgtgtctaggaatttatccatttttgctaaaatgtctaatttatttgcatgtagttgctcatggtagccactaatgatcctttgaatttctgcggtatcagttgtaatatctcctttttaatctctgattttatttattcaggtctttactctttttttcttagttattctgactaaatgtttgtcagttttgtttatcttttcaaaaaattagctttttgtttcattgatcttttgtatttttttatttcattttcatttatctttgctctgattattgtttctcttctactaattttgagtttgtttgctcttgattttctagttctttaagatgcattgttaggttgtttgtttgaaaattttcttcttttttgatataggtacttatagctataaacttccctgttagtactgcttttgctatatcccataggttttggtatgtcatgtttacattatcatttgtttcaaggaatttttcaattttactcttattttctttattgacccactggtcattcaggagcatatgtttaattctcatgtgtttgtatagtttccaacattcctcttactatttatttctagttttagtctaaatgctgaatattatttcaatttttttgatgttttcagatttgttttgtgacctaacatatccttgagaatgatccatgtgctaaggaaaagtatgtttattctacagccactggattaaatgttctgtaaatatctgttaggtctatttctattagttctatggtgcagattaagtctgatgtttctttgttgatttttctgtctggaaaacctgtccaatgctcaaagtagggttattgaagtctccagctattacagtattgggtcgcttgctcttttcagctctaataatatttgctttatatatgtggctgctccagtgttgggtgcatatatatttacaattgttacattcctttgctaaactgacttttttgtcattataaaatgaacttcattgtctcttcttatagttttgtcttgaaatctattttatctgatacaagtatagctactcctgctcttttttgttttttattgtcatggaatatctttttccattcattcattttcagtccatgtgtgtctttataggtgaagtgtgtttcttgtaggtagtagatcattgggtcctgttatttatccattcagccactctatgtcttttgattggagattttagtatatttacattcaatgtcattattgataggtgatattttctggtggtatgatttaatttcttgctattggttttgtgtgtatatgttgtatgtttttagtttttaggttattataaggctatcttataaccattttttaagcgaaaacaacttaccactgcttgtctgaacaaacaaacaaacaagcaaaaagagtactaataaaaacactaaacattaactttgttccttactttttaactttttgtcatttttatttatatctttttgtactgactgtgccttgaaagttgtagttcttatttttgattggttcacattttagccttcctacttacttaagataatttacagctgggcacagtggctcacacctgtaatcccagcactttgggaggctgaggtgggtggatcatgaggtcagaagatcgagaccatcctggccaacatggtgaaaccctgtctgtactaaaaatacaaaaattagctgggtgtggtggcacatgcctataatcccagttactcaggaggctggggcaggagaattgcttgaaccagggagtcggaggttgcagtgagctgagactgtgccactgcactccagcctggtgacagagcgagactccatctcaaaaaaaaaaaaaaaaaaaagaagatagtttacacaacaccacagtcacagtgttatttaatataatattctgtgtacttactattatcagtgagtttttaacattcagatgatttctttttaaaaattaattaatttatttcaatagtttttgaggaacatgtggttttttgttacatggataagttattttagtggtaatttctgagattttagtgcatccatcatccaagcagtgtacactgtacccaatgtgtagttttttatcactcaccccaccatctttcccctgcattcccaaagtccattacatcattcttatgcctttgtgtcctcataactgagctcccacttacaagtgagaacctatgatatttgatttttcacttctgagttacttcacttagaataatggtctccaactccatccaggctgtttcaaatgccattatttaatcctctttatgggtgggtagtattccatgatgtatatatgacatattttctttatccactcattgattgatgggcatttgggcttgatccatatttttgcaattgtgaattgtgatgctataaatatgcatgtgcaagtgtctttcatttaataactttctctaggtaaatacccagtagtgggattgctgggtcaatagtagttctacttttagttctttagggagtctccatactgttttatgtagcggttgtactagtttacattatcaccagcagtgtaaaattgttcccttttcaccacatccacaccaacatctattattttaaattttttgattaagggcattcttgcaggagtaaagtggtattgcattatcattttgatttgcatttccctgataattaatgatattgagcatattttcatgtttattggccatttgcatatcttcatttgagaattatccattcatgtccttagcccacttattgattggattatttgctttttcttgctgatttgagtgtctcgcagattctggatattagccctttgtcagatgcaaagtttacaaatattttttcccattctatgggttgtctgtttactctgtggattatttcttctgctgtgcagaagctttttagttgaattaagtcccatctacttatttttgtttttgttgcatttgcttttgggttcttggtcgtgaactctttgcctaagcctacatctagaagagttttactgatgttatcttctagaattttttatggttttaggccttagatttaagtctctgatccatcttgagttgatttttgtgtaaggtcacagatgaggatccagttatattcttctacatgtggcttgccagttatctcagcaccatttgttgaatagggtgtcctttccccactttatgtttttgtttgctttggtgaagatcagttggtggcaagtatttggctttatttcttggttctctattctgttccattggtctacatgactatttttataccagcaccatgctgctttggtaactatagccttgtagtatagtttgaaattaggtaatgtgatgcctccagatttgtcccttttgctttgtcttgctttgactatgtggggtcttttcagttccatatgaattttagaattttttttgtagttctgtgaaaaatgataataaatactttgataggaattgcattgaatctgtagatcggttttggccgtatggtcattttcactatattcattctacccatccgtaaggaagggatgtgttcccatttgtatcattgatttctttcagccgtgtcttgtagttttccttgtagaggtctttcatgtccttggtaaggtatattcctaagtattttatattattttattttttgcagctgttgttaaaaaagattgagttcttcatttgtttctcagctttgtcattgtaggtgtatagcagtgctactgatttatgtacattgattttgtatgctgaaactttactgaactcatttgtcaaatctaggagtgtttggttgaatcttcagggttttttaagtatacaatcatatcattggtgaacagcaacagtttgacaacctctttactgatttggatgcctttcatttctttctctagtctgattgctgtggctaggagttccagtactatgttgaataaaagtggtgtaagtgggcatccttgctttgttccagttctcaggggaatactttcaacttttccccattcagtataatgtgggctgtgggttagtcatagatggcttttattaccctgaggtatgtcccttctatgctgattttgctgagggttttaatcataaagggatgctggattttgtcaaatgcttttttctccatctattgagatgatcatacgatttctgtgtttaattttgtttatgtgatgtatcacatttactgacttgtgcatgttaaatcattcgtgcataccagttatgaaactcacttgatcatggtgtattatctttttgatatgttgttggatttggttagctagtattttgttgaggatttttgcatttatgttaatcagggatattggtctttatttttttttccattatgtcctttcctaattttggaattaggttgatattggcttcatagaatgatttagggagatttccctctctctgtcttttggaatagtattaaagttggtaccaattgttctttaaatgtctgatagaattcatctgtgaattcatctggtcttggactttttttgttggcttttgttttactactgttaatattgctgcttgttattgatgtgttcagagttttctatttccttctgatttaatttgggagggttatatatttccttgaattaatccatctcctctaggttttctagtttgtgtgagtaaaggtgttcatagtagccttgaatgatctttagtatttctgtggtatcagttgtaatatctcctgttttatttctaattgagcttatttggattttttcctcttcttttcttggttattcccactaatggtctatcagttttgtttatcttttcaaaaaataagcttatttcatttatcttttgaattattattttttggtttcaatttcatttagttgtgctctgatctttgttatatcttttcttctgctgggttttggtttggtttgttcttttttctctagtttcttgaggtgtgactgtagatccttgaggtatgtctatttgtgctctttcagactttttgatataggcatttaatgctatgaactttcctcttagcactgcttttgctgtatcccagaggttttggtaagttgtgtcactattatcattcagctcaaagaattttaaaattttgatcttgatttcattgttgacccaatgatcattcaagagcagatattttaatttccatgtatttgtatagcttttgatgtttcttttggagtaaatttccagttttatttcactgtggtcttggatacttgatataattttgattttcttaaattgatagagacttgttttagtggcctatcatatggtctatattggagaatgttccatgtgctgatgcaaagaatgtatattctgcagttgttgggcagaatgtgctgtaaatatctgttaagtccatttgtttcaagccatagtttaagtccgttgtttctttgttgactttatgtcttggtaacctttctagtgctgtcagtggagtattgaagtcctttgctattattgtgttgccatctatctcacttcttaggccaagtagtaattgttttataaatttgagagctccagtgttaggtgcatatatatttagaattttcctattggactataccttttatcattatataataatgatttttttgtgtttttaaactgttattgctttaaactctattttgcctgatttaagcatagctactccacttgcttttggtttccacttgtgttgaacttgtttttggtttccacttgggttgaaccccctcctgttcatcttaagtttatgtgaattcttataggttaggcgagtctcttgaagacagcaaatacttggttgctggatttttatccattctgtcattctgtatattttaagtggagcatttaggccatgtacattcaatgttactattgagatgtgaggtactgttctgttcatcattttagttgttgttgccttaatactttttttctttccattgtgctattgttttgtagactctgagagttgtaatttaaggggtctctattttggtgtatttcaaggttttgtttcaagatttataactccttttagcatttattttattttattttatttttattttactttaggtttcaaaatacatgtgtagaacatgcaagtttgttatatagttacacttgtgccatggtggtttgctgtacctatcaacttgtcatctaggtcttaagcctcacctgcattaggtgtttgttctaatgctttccctccccttccccccaacccctgataggccacagtgtgtgtcattcccctcccagagtccatgtgctctcattgttcaactcccatttatgaatgagaatctgtggtgtttggttttctgttcctgtattagtttgctgaggatgatggcttccagcttcatccatgtccctgcaaaggacataaacttcttttttatggctgcatagtatttgctggggtataggtaccacattttctttatacagtctataactgataggcatttgggttggttccatgtctttgctattctaaatagtgctgcaataaatatgtgtgcatgtgtctttacagtagaatgatttatattcctttgggtatatacccaggaattggattgctgggtcaactggtatttctggttctagatccttgagaaatcaccacactgtcttccacaatggttgaactaatttacattctcaccaacagtgtaaaagtgttcctatttctccgcagcctcaccagcatctattggttcttgcctttttaataattgccattctgactggtgtgaaatggtatctcattgtggttttgatttgcatttctctaatgatcagagatgttgagctatttttcatgtttgttggccacataaatgtcttcttttgagaggcatctattcatatcctttgcccactttttgaggggcttgtttatttttttcttgtaaatttgtttaatttcctcatatattctggatattagccctttgtcagatgggtaaattgcaaaatttttctcccattctgtaggttgtctgttcactctgatgctagtttttttcccctttggaggagttctttagtttaattgatccattttgtcaatttttgcttttgttgcaaatgcttttggtgttttagtcatgaagtttttgcccatgcgtatgtcctgaatggtattgcctaggttttcttctagggtttttatgatttggggttttacatttaagtctttaatccatctttagttaatttttgtataaggtgtaaggaaggggtccagtttcagttttcttcatatggctagccagttttcccagcaccatttattaaatagagaatcttttccaaattgcttgtttttgccatgtttgttgaggatcgcatgtagtgttatttctgaggtctctgttctgtttcattgctctatgtgtctgttttggtaccagtatcatgctgtttttgttactgtagccttgtagtatagttggaagtcaggtactgtgatgcctccagctttgttcttttttcttaggaacatcttggctatatgggctcttttttggttccatatgaaatttagttttttctaattctgtgaaaagtgtcaatggtagtttgatggaaatagcattgaatctataaattactttgggcagtatggccattttcacaatattgattctttctatccgtgagaataaatgtttttccatttgttgtgtcctctcttattttcctgggcagtggtttgtagttctccttgaagaggttcttcatgccccttgttatctgtattcctaggtttttaattctctttgcagcaattgtgaatgggagttcacacatgatttggctctctgcttgtccattattggtttatagtaatgcttgtgattttcgaacattgattttgtatcctgagactttgctgaagttacttatcagcttaaagagtttttgggctgagatgatggggttttctaaatacagaatcatgtcatctgcaagcagaggcaatttgacttcctgtcttcgtatttgaatacactttatttatttctcctgcctgattgtgctggccagaacttccaacactatgtcacacaggagtggtgagagagggcatccttgtattgtgctgcttttcaaagggaatgcttccagttttggcctattcaatatgatattggctatgggtttgtcataaatagctcttattattttgcgatatattccaacaatacctagtttattgagagtttttaacataaagggatgttgaattttatcaaagggctttctcacatctattgatataattatgtggtttttgtcattagttctgtttctgtaatggattatgtttattgacttgcatatgttgaatgagccttgcatcccaggaatgaagccaacttgttcatggtggataagtgttctgatgtgctgctggatttagtttgccagtattttattgaggattttcaatccatgttcaccagggatattggcctgaggttatttttattttttattttattattctttcagttttagggtacatgtgcacaacgtgcatgtttgttacgtatgtatacatgtgccatattgatgtgctgcacccattaactcgtcatttaacattaggtatatctcctaatgctatcccgcctcactccccccaccccacaacaggccacagtgtgtgatgttctccttcccgtgtccatgcattctcattgttcaattcccaccaatgagcgagaacatgcagtgtttggttttttgtccttgtgatagtatgctgagaatgatggtttccagcttcatccaagtccctataaaggacatgaactcatcattttttatggctgcatagtattccatggtgtatatgggccacattttcttaatccaatctatcattgttggacatttgggttggttccaagtctttgctattgtgaatagtgccacaaaaaacatacatgtgcatgtgtctttatagcagcatgatttataatcctttgggtatatacccagtaatgggattgctgggtcaaatggtatttctagttctagatccctgaggaatcgccacgctgacttccacaatagttaaactagtttaccatcctaccaacaatgtaaaagtatttctatatgtatacatcctctccagcatctgttgtttcctgactttttaatgatcaccattctaactggtgtgagatggtatctcattgtggttttgatttacatttctctgatggccagtgatgatgagcattttttcatgtgtcttttggctgcataaatgtcctcttttgagaagtgtctgttcacttcctttgtccactttttgatggggttgtttttttcttgtaaatttgtttgagttcattgtagattctggatattagccctttgtcagatgagtaggttgcaaaatttttctcccattctgtaggttgcctgttcactctgatggtagtttcgtttgctgtgcagaagctctttagtttaattagatcccatttgtctattttggcttttgttgccattgcttttggtgttttagacatgaagtccttgcccatgcctatgtcctgaatggtattgcctaggttttcttctagggtttttatggttttaggtctaacatttaaatctttaatccatcttgaattaatttttgtataaggtgtaaggaagggatccagtttcagctctctacttatggctagccagttttcccagcaccatttattaaatagggaatcctttccccatcgcttgtttttctcaggtttgtcaaagatcagatagctgtagataagcagcattatttctgagggctctgttctgttccattggtctatatctctgttttggtaccagtaccatgctcttttggttactgtagccttgtagtatagtttgaagtcaggtagcctgatgcctccagatttgttcttttggcttaggattgacttggcaatgcaggctcttttttggttccatatgaactttaaagtagttttttccaattctgtgaagaaagtcattggtagcttgatggggatggcattgaatctataaattaccttgggcagtatggccattttcacgatattgattcttcctacccatgagcgtggaatgttcttccatttgtttctatcctcttttatttccttgagcagtggtttgtagttctccttgaagaggtccttcacatcccttgtaagttggattcctaggtattttattctctttgaaacaattgtgagtgggagttcaatcatgattttgttctctgtttgtctcttattggtgtataagaatgcttgtgatttttgcacattgattttgtatcctgagactttgctgaagttgcttatcagcttaagaagattttgcgctgagacaatggagttttctagatatacaatcatgtcatctgcaaacagggacaatttgacttcctcttttcctaattgtgtacactttatttccttctcctgcctgattaccctggccagaacttccaacactatgttgaataggagtggtgagagacggcatccctgtcttgtgccagttttcaaaaggaatgcttccagtatttgcccattcaatatgatattggctgtgggtttgtcatagatagctcttattattttgagatacttcccatcagtacttaatttattgagagtttttagcatgaatgttgttgaattttgtcaaaggccttttctgcatctattgagataatcatgtggtttttgtctttggttctgtttatatgctggaacatgtttattgattttcatatgttgaaccagccttgcatcctggggatgaaacccacttgatcatggtggataagcttttggtgtgctgctggattcggtttgccagtatcttattgaggatttttgcatcaatgttcatcatggatattggtctaaaattctcttttttggttgtgtctctgccaggctgtggtatcaggatgatgttggcctcataaaatgagttagggaggactccctctttttctattgattggaatagtttcagaaggaatggtaccagctcttccttgtacctctggtagaattcagctgtgaatccatctggtccttgaatttttttggttggtcagctattaattatgcctcaatttcagagtctgttattgttttattcagatattcaacttttccttgtttagacttgggaggaatatgtgttgaggaatttatccatttcttctagattttctagtttatttgtgtagaggtgtttatagtattctctgatgtagtttgtatttctgtgggatcagtggtgatatcccctttatcattttttattgcatctatttgattcttttctcttttcttctttattagtcttgctggcagtctatcaattttgttgatcttttgaagaaaccactcatggattcattgattttttgaagggttttttgtgtctctatttccttcagttctgctctgatcttagttatttcttgccttctgctagcttttgaatgtgtttgctcttgcttctctagttcttttaattgtgatgttagggtgtcaattttggatctttcctgctttctcttgtgggcatttagtgctataaatttccctctacacactgctttgaatgtgtcccagagattctggtatgttgtgtctttgttttcattggtttcaaagaacatctttatttctgccttcttttcgttatgtacccagtagtcattcaggagcaggtttttcagtttccatgtagttgagaagttttgagtgagtttcttaatcctgagttctagtttgattgcactgtggtctgagagacagtttgttataatttctattcttttacatttgctgaggagtgctttacttccgactatatggtcaattttggaataggcatggtgtggtgctgagaagaatgtatattctgttgacttggggtggagagatctgtagacatctattaggtccacttggagcagagctgaattcaattcctccatatccttgttaactttctgtcttgttgatctgtctaatgttgacagtggggtgttaaaatctcccaccattattgtgtgggagttgaagtctctttgtaggtcactcaggacttgctttatgaatctgggtgctcctgtattgggtgcatatatatttaggatagttagctcttcttgttgaattgatccatttaccattatgtaatggcctttgtctcttttgatctttgttggtttaaagtctattttatcagagactaggattgcaacccctgactttttttgttttccatttgcttggtagatcttcctccatccctttattttgagcctatgtgtgtctctacacgtgagatgggtttcctgaatacagcacagtgatgggtcttgactctgtatccaatttgccagtctgtgtcttttaattggagcatttagcccatttacacttgaggttaatattgttttgtgtgaatttgttcctgtcattatgatgttagctggataatttgttcattagtttatgcagtttcttaaaaaaagtgagtgaaggatatgaacagacacttctcaaaagaagaaatttatgcagccaaaaaacacatgaaaaaatccttgtcatcgctggccatcagagaaatgcaaatcaaaaccacaattagataccatcttacaccagtaagaatggcaatcattgaaaaatcaggaaacaacaggtgttggagaagatgtggaaaaataggaacacttttacactgttggtgggactgtaaactagttaaatgattgtggaagtcagtgtggagattcctcagggatctagaagtaaacatatcatttgacccagtcatcccattactgggtatatacccataggattataaatcatgcttctataaagacacatgcacacatatgtttattgtagcactattcacaatagcaaagacttggaaccaacccaaatgttgagcaatgatagactgtattaagaaaatgtggcccatatacaccatataatactatgcagacataaaaaatgatgagttcctgtcctttgtagggacatggacgaagctggaaactatcattctcagcaaactatcacaaggacaaaaaaccaaacaccacatgttctcactcataggtgggaattgaacaatgagaacacgtggacacaggaaggggaacatcgcacactggggactgttgtggggttgggggagggatagcattaggaaatataaatgacgagttaatgggtgccgcacaccaacatggcacatgtatatatatgtaacaaacctgcatgttgtgcacatgtaccctaaaacttaaggtataataataataaaattaaaaaaagaattatgtgtaaaacaaggtaaaaacaaccaggacattaaaaaagatgtaaataaagttataaaaataaaaaggtattttttgaggtaaaaaggcttaacgggaaataatatataagaaggaatcttatatggtaaatgtagtcctaaaataaaataactgattgcttaaaaaggagggatgttggggagaaaccagaaagtctgagcatgtcaggtatgctcagtgtaagtcacaagaagagtatttatgtttaaaaaacccgaaaccttttatgtaatccagttgtcatattatcattaagctttggcttgcctaggaaaagaaactgaaacaaaaaattttttaaaattaaggttatttcatccatatatcttgcttcatgtgcttttaaagtccttgtgacattgagttacaaagctttaactcctgggtctaaaaaggacaccaagtcctgctaaatcttaaatactgacagcaactaaagtcccatcttagggttctgtagaagatgccaataaaaaaaaactgcattcctgagacacagggcaagaaattaaagctattcaactcctcaaggcccagggactgtcatggaagaggtgggcatgtaaggctgttagggccaattttgaaagataaaagcagtttagtttctctatagatttatcattaatatcaaaggcacactgatgcaaaaccaatgtatggatccttgtgtcagattaacaaggtgttcttgaagtattaaccaacagcttaataatggttataaaaggctcatgactgcctcatattatgtgtacacagtcctggtacagggtttctgacctgtggtaagtaaagaatgtcactttcttacaggtgtagaagcccttgtttcttggaggatacaagttaaggacgaaaggaggagaggaaattcacccaactcataggtatttgatggcataaatccatggctgggctcagctttaaaaatgtcttatctgagattcctcctatggaacaaggttccatgatagccaattgaaaagcctgggtaaaaaacaattattcttgctgcactgtatacaaataattaggtcaaatataataagcgaactagtcctatcatgatttgtcttgcctaacttttttttttttactccaattcttattattttctatgtttgaactgaattctaatttttcttggctatgggtctttaaaataaaattttcatttttttccttctttttgttccatttttcctaaattggagtcactgaaaactaagccatgctttcctaaaaaccctgcaaactgaagccagacaacttaaacttcagaagaaaataacagcaaccagaggggtggagctaagatggccaaataggaacagctccggtctacaactcccagcataagcaatgcagaagaaaggtgatttctgcatttccagctgaggtaccgggttcatctcactagggagtgccagacagtgggtgcaggacaggggtgcagtgcaccgtgtgtgtgtgagccgaagcagggtgaggcattgcctcacttgggaagtggaaggggtcagggagttccctttcctcatcaaagaaaggggtgacagacggcacctggaaaattgggtcactcccaccccaatactgcacttttccaatgggcttaaaaaacggcacacaaggagattatatcccgcacatggctcggagggtcctatgccagcggagtgtcactgattgctagcacagcagtctgagatcaaactgcaaggtggcagcgaggctgggggaggggcgcccgccattgcccaggcttgcttaggtaaacaaagcaggtgggaagctcgaactgagtggagcccaccacagctcaaggagggcttcctgcctctgtaggctccacctctgggggcagggcacagacaaacaaaaagacagcagtaacctcggcagacttaaatgtccctgtctgacagctttgaagagagtagtggttctcccagcacacagcttgagatctcagaacaggcagactgcctcctcaagtgggtccctgacccctgagcagcctaactgggaggcaccccccagtaggggcaggctgacacctcacacagctgggtactcctctgagacaaaacttccagcggaccgatcaggcaacagcatttgtggttcatggtaatctgctgttctgcagccactgctgctgatacccaggcaaacagggtctggtgtggacctctagcaaactccaacagacctgcagctgagggttctgtctgttagaaggaaaactaacaaacaggaaggacatccacaccaaaaatccatctgtacatcaccagcatcaaagaccaaaagtagataaaaccacaaagatggggaaaacacagagcagaaaaactggaaactctaaaaagcagagtgtctgtcctcctccaaaggaatgcagttcctcaccagcaacggaacaaagctggagggagaatgactttgacgagttgagagaaggcttcagatgatcaaactattccgagctacaggaggaaattcacaccaatggcaaaggagttaaaaactttgaaaaaaaattagacgaatggataactagaataaccaatgcagagaagtgcttaaaggagctgatggacctgaaagccaaggctcaagaactacatgaagaatgcagaagcctcaggagctgatgcaatcaactggaagaaggagtatcagtgatggaagatgaaatgaatgaaatgaagtgagaagggaagtttagagaaaaaagaataaaaagaaacgagcaaagtctccaagaaatatgggactatgtgaaaagaccaaatctacctctgattggtgcacctgaaagtgacagggagaatggaagcaagttggaaaacactctgcaggatattatccaggagaacttccccaatctagcaaggcaggccaacattcagattcaggaaatacagagaatgccacaaagatactcctcgagaagagcaactccaagaaacataattgtcagattcaccaaacttgaaatgaaggaaaaaatgttaagggcagccagagagaaaggttagtttacccacaaagggaagcccatcatactaacagcagatgtctcggcagaaactctacacgccagaagagagtgggggccaatattcaacattcttaaagaaaagaattttcaacccagaatttcatatccagccaaactaagcttcataagtgaaggagaaataaaatactttaaagacaagcaaatgctgagagattttgtcaccaccaggcctgccctaaaagagctcctgaaggaaacactaaacgtggaaaggaacaaccggtatcagccactgcaaaaacatgccaaattgtaaagaccatcaaggctaggaagaaactgcatcaactaacgagcaaaataaccagctaacatcataatgacaggatcaaattcacacataacaatattaactttaaatgtaaatggactaaatgctccaattaaaagacacagactggcaaattggataaagagtcaagacccatcactgtgctgtattcaggaaacccatctcatgtgcagagacacacataggctcaaaataaagggatggaagaagatctaccaagcaaatggaaaacaaaaaaagtcaggggttgcaatcctagtctctgataaaacagactttaaacaaacaaagatcaaaagagacaaaggccattacataatggtaaatggatcaataaaacaagaagagctaactatcctaaatatatatgcacccaatacaggagcacccagattcataaagcaagtcctgagtgacctacaaagagacttcaactcccacacaataataatgggagactttaaaaccccactgtgaacattagacagatcagtgagacagaaagttaacaaggatacccaggaattgaactcagctctgcactatgcggacctaatagacatctacaaaactctccaccccaaatcaacagaatatacatttttttcagtaccacaacacagctattccaaattgagcacatagttggaagtaaagcactcctcggcaaatgtaaaagaatagaaattataacaaactgtctctcagaccacagtgcaatcaaactagaactcaggattaagaaattcactcaaaacttctcaactacatggaaactgaaaaacctgctcctgaattgctacggggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagagaagcaagagcaaacacattcaaaagctagcagaaggcaagaaataactaaaatcagagcagaactgaaggaaatagagacacaaaaaaacccttcaaaaaattaatgaatccaggagctggtttcttgaaaggatcaacaaaattgatagaccactagcaagtctatcaaagaaaaaaagagagaagtatcaaatagacacaataaaaaatgataaaggggatatcaccaccaatcccacagaaatacaatctaccatcagagaatactacaaacacctctatgcaaataaactagaaaatctagaagaaatggataaattcctcgacacatacactgtcccaagactaaaccactaagaagttgaatctctgaatagaccaaaaacaggagctgaatttgtggcaataatcaatagttcaccaacgaaaaagagtcccagaccagatggattcacagcagaattctaccagaggtataaggaggaactggtaccattccttctgaaactattccaatcaatagaaaaagagggaatcctccctaactcattttatgaggccagtatcatcctgataccaaaaccgggcagagacacaaccaaaaaagagaattttagaccaatatccctgatgaacatcgacgccaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaacctcatgattatctcaatagatgcagaaaaagcctttgacaaaattcaacaacccttcatgctaaaaactcaataaattaggtattgatgggacgtatttcaaaataataagagctatctatgacaaacccacagccaatatcatactgaatgggcaaaaactggaaccattccctttgaaaactggcacaagacagggatgccctctctcaccactcctattcaacatagtgttggaagttctggccagggcatttaggcaggagaaggaaataaagggtattcaattaggaaaagaagaagtcaaattgtccctgttcgcagatgacatgattgtatatctagaaaacctcattgtctcagcccaaaatctccttaagctgataagcaacttcagcaaagtctcaggatacaaaatcaatgtacaaaaatcacaagcattcttatacaccgacaacagacaaacagagagccaaatcatgagtgaactcacattcacaattgcttcaaagaggataaaatacctaggaatccaacttacaagggatgtgaaggacctcttcaaggagaactacaaaccactgctcaaggaaataaaagaggatagaaacaaatggaagaacattccatgctcatgggtaggaagaatcaatatcgtgaaaatggccatactgcccaaggtaatttacagattcaatgccatccccttcaagctaccaatgactttcttcacagaattggaaaatctactttaaagttcatatggaaccaaagaagagcctgcattgccaagtcaatcctaagccaaaagaacaaatctggaggcatcacgctacctgacttcaaactatactacaaggctacagtaaccaaaacagcatggtactgctaccaaaacagagatatagatcaatgtaacagaacagagccctcagaaataacactgcatatctacaactatgtgatctttgacaaacctgagaaaaacaagcgatggggaaaggattccctatttaataaatggtgctgggaaaactgggtagccatatctagaaagctgaaactggatctcttccttacaccttatacaaaaatcaattcaagatggattaaagacttaaacgttagacctaaaaccataaaaaccctagaagaaaacctaggcattacaattcaggacataggcatgggcaaggacttcatgtctaaaacaccaaaagcaatggcaacaaaagctaaaatagacaaatgggatctaattaaactaaagagcttctgcacagcaaaagaaactaccatcagagtgaacatgcaacctacaaaatgccagaaagttttcgcaaccttctcatctgacaaagggctaatatccagaatctacaatgaactcaaacaaatttacaggtaaaaaacaaacaaccccatcaaaaagtgggcaaaggacatgaacagacacttctcaaaagaagacatttatgcagccaaaaaacacatggcaaaataaactttctaaattaactaagaccagtctgagattttctgggttcacaatttgaaagccttgtcttcaagctctgaagttcttttttctagttgttatagtttattgttgaaacttagcactgcattttgtatctccctaaatgtgtctttcgttcccagaagttgtgatttttttctttatgatatctctttctctagagaatttttcatccttaacttgtatttttaaaaaatttctttgagttggttttcacctttctctggtatctccttgagtagcttgataatcaagattctgaattccttatctggcaattcagagatttcttcttgatttggatccattgccagggagttggtcttttggggttgttatagaatcctgtttgtcatattaccagaattattttctgggggttccttttcatttggatgactatttctgtggagagttctgaaactcaaggcctgctgttcagattttcttgtcccatggggtgaccccttgatgtagtgccctcccccttaccctagggatggggcttcctgagagttggacagcagtgattgttattgttcttctggatttagccatccatcggggctaccaggctctgggctggtgctgggggttgtctgcaaagggttctgtgatgtgatccatcttcaggtctcccagctgtggataccagcatctgctctgatagagattgcagagaagtgaaatgaactctatgaaagtcttttgttgtaaatatgtttagtgtgctggctttcttgaatgctggttatgctagcagtgaagttgtcatgtggacatcctcaggacctctggttagccaggatgttgccagcagtgggaacaggtgttgtcttcttgggttcaaggttattctttcatgagttgctgtaatggcctgagttgcttgtcatcaaaccaggaggtggtgcttttaagagagcaccagctgtggtagtagttgggggctctaagcttgccataagatggccagagtaagtattttggtttctcaggtgattgatgagaaaccataaagcttccaagagtttctgtgttttgtgttcagctgccagggtggatagggagaaaccaccaggtgtgtgcaggattaggcaggcatgggcccagactttccttgggaggggcttgccatgatcactgtctgggatgggcgagttgttctcaggccaatggggttattttccagaggggatcttggctgcctctgctgtgttttatagcttgccagggaagtggaagatagccagtagcaagaggcattacctagctcccatgcatttgctgaggctggtctggttcctgcagtgcctcctctgatcagaccttgccgcaggccatgagctaccccactgagaaagcaagctttctgatctcattcctccccatctgccctctctgtaggcagcagctcctgtgctcctgtgcttgctcacagcagctcctgcttgtccttcagaccctgctcaagaaaacttgtgcccagacaaaaccactaccaatttcagttgggaactttctttgccccatgacccctccccagtttcactggctgttttccccaaaggccctgtgagacatagtcaaggatggcgtcccagggctcaagctggagactgggagtacattcgagcacttcctgctgttacttgtacttttatattttttgtgactccctaaacccgtttcatatctaggtaaggttaaatcctactcctgtgatctggattttcagattccccagtggggatgcatgttcagaggtaggttttctccctgtcacactttgagaactcacagttttttgcttgttttgtggaatttgcagcggtgtgccacttgtttcaaaggatttgtgaattcttttggctttcctggtatattcgtgcagtggttcttggagcaaaagatcatgatatggatctctacatgctgctctgatttgtctatgtgggagctagatgttagccctgtctcctgtttgctatcttcccctccagaagatttctaattgctcattaatgtccttttctttctgattgaagtacttcctttagcattttttgcaggacaggtctagtcttgatgaaattcctcagcttttgtttgcctgggaaactctttacttctccttcatgtttgaaggatattttcaccagatatactttctagggcaagagttctttttttttcccttcagcactttacatatatcatgctactgtctcctggcctgtaaggtttccactgaaaagtctgctgccagatatattggaactccattttatgttatgttattttattatttttttcttgctgcttttaggatcctttctttatccttgacctttgggagtttgagtttaaatgtcttgaggtagtctcctttaagttaaatctgctagatgttctataaccttcttgtgtttggatattgatatctttctctaggtttgggaagttctctgttattatccttttgaataaacttttacctctatatctttctctacctcctctttaaggccagtaaattaaatttgtccatttgaggctgttttctaaatattttagaaatgctctattcttttttattcttgtctcttctatttgtgttttcaaatagcctgtctccaatgtcacaacttctttttttgcattatcaattctgctattagagattctaatgcattcttcagtatgtcagttgtatttttcaaccccaggatttctccatgaatctttttaattatttcagtatttttgttaaatgttctgatagaattctgaattccttctctgtattatcttgaatttctttgagtttcctctaatctgccaggactgtgtcattcccctcaaggcaatatgttcccccctgccccagggtatgtctagaaatgtcacctgggaactagggcctggaatggggtccttattactgtgattgatgccttatcctattgtggttgggtgatatccaagatgtgagacaaaagtcctctttatctttctctcctctcctaaagtggacagaagggtcacttttggagtcacaagctgtgctgcctgaattttgggaaaaggtggcacaagcattttcatagcagcccaggcaagtgtcttactagtttgtgtgcccttaagtccacggactctgagcccagcttagcactaggaattgcaatccttgttgtccagactgcctttcaagtgtatttagggccccaaaacactttagcccatagtagccgaaggaacattttttttgaggaacatccatgctattgtccataatggacagaactaatttacattctcaccaactgtgtgtaaggtcccccccctttttttaaaacatccttgcaacacttgctattttttgtctttttggtaatagtcattttaacagtgtgaggtgatagctcattgtggttttaattttcattttttgatgattagtgatgttgagccttttatcatttatctgctggccatttgaatatcttcttttgataaatgtctgttcagatcctctacccattttaaaattgtttatttgctttctaatattaatttgtttgaatttattttatattttgtatattaacctcatcagatttattgtttgcaaatatattctgtaggttgtctcttcactctgttgttttcttggctgtgcagaagcttttgtttaatgcaattccgtttgtctatttttgctttttttctctgtgttcttggggtcgtattcaaaaaaatgatcgctcagaccaatgtcatggaggttttcccccacatttttctcctagtagttttatagtttcaggttttacttttaagtttttaatctgttttgagttgatttttgttgtgtctcttcctggctttgttatcaggatgatgctggcctcataaaatgagttagggaggattccctctttttctattgattagaatagtttcagaaggaatggtaccagctcctccttgtacctctggtagaatttggctgtgaatccatctggtcttggactctttttcgttggtgaactattgattattgccacaaattcagctcctgtttttggtctattcagagattcaacttcttagtggtttagtcttgggacagtgtatgtgtcgaggaatttatccatttcttctagattttctagtttatttgcgtagaggtgtttgtagtattctctgatggtagattgtatttctgtgggattggtggtgatatcccctttatcattttttattgtgtctatttgatacttctctctttttttctttgatagacttgctagtggtctatcaattttgttgatcctttcaagaaaccagctcctggattcattaattttttgaagggtttttttgtgtctctatttccttcagttctgctctgattttagttatttcttgccttctgctagcttttgaatgtgtttgctcttgcttctctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtaccccgtagcaattcaggagcaggtttttcagtttccatgtagttgagaggttttgagtgaatttcttaatcctgagttctagtttgattgcactgtggtctgagagacagtttgttataatttctcttcttttacatttgcagaggagagctttacttccaactatgtatgtggtgtaagatgagaatctaatttaattattctgcatttggatatccagttttcacagcaccatttattgaagagattgtcttttccttattgtgtgtttatggcatttttgtcaaaatcaattggactgtaaatgtgtggatttatttctgggctctctattctgttccattggtccatatgtctgtctttatgtgccagtaccatgctattttgatgactacaaattagtagtagattttgaaatcacatagtgtgttgctcccagtgttattcataattacttaggtcttctgggtcttttgaagttgtatatgaattttaagatttctttctgtgtttgtgaaaaatgtcattagacttttgatagggatttaattgaacctgtagattgattttgacactatgaacattttaacaatgttaattcttccagtccatgaacatgggacatatttccatttattaatgtcttcttcaatttattttaccaatgttttataattttccatgtgcacatcttccaactttttggttaaatttattccaattattatctttttcatagtgattctaaacagaattgttttcctgactttttgggatagtttattgttaatgtatagaaatactactaacttttgaatggtaattttggatattacaactttactaaatttgtttattagttctaacagcttttttagggggagagactttaggatttctgtatcacacatctgtaaacagagaaaatttaatttcttcctttctacttttgatgacttgtacttcattttattgcttaattacttagggtaagagttccagtatgatgttgaatagaagtggtgagagtagaaattcttgtcttattcccaatcttagaggaaaagctttcaactttttgccattgaatctgatgttagttgtgggcttgtcacatatggtctttattgtgttgagaattacattctttctgtaattaatttgttgagagtttttatcataaaatgatgttgaattttgtcagtttttcttcatccattgagatgataatatagttttggtcctcaattctcttaatgtagtatttgcatatattgaaccatccttgtatctcagagataaatcccacttgatcaaagcagattatccttttaatgtgttgttgaatttggtttgctaggattttattaaggaattttgcatctatgttcatcagggatattggcctgtagtcttcttttctattagtttcctagggtggctttggtattagggtaatgttgtcctcataaaatgagtttggaaatattccctcctcttcattttgttttggaagagtttgagaaggattggcattagttctttaaatgtttggtagagtttagtagtaatccgttcctgggattttctttgatggaaaacttttattatttgttcattctctttgttcattattggtttggtcatatattctatttcttcataattcagtcttgttagattgtatgtggccaggaatttatctgtttcttttgggttattcaatttgtaagtctataattgttcatagtagtcttttgtgattcttcatatttctgtggtatgagttgtaatgtctcttctttcatttctcattttatttataagtcttctctcttttttatttgatttttaatgtattttcaatatctgtgttaaatttctcattttggttttttactatgttcctgattttttaaaaatgatttctctgtattttcctttacttcatgaagctttaaaagcaattatgttgaattatttttcagcctgtttacatacctccatttctttggggtcagcaacttggaaattattgtgttcttttggtggtatgatttcttggtgtttcattgtttcttgttaccctcttattgatgtctgcacatttggtggagtagtcatctcttgcaaatttcattggctaatttcagtgtggaaagattttctcttatggggcatgatggtgctttgcaatccttgtggcccagactgacacaagcatataatgggatggactgagtgggtgggatggattggttttggcaccagtgggatgtggctttatagtctttgtgtggccctgttagctgacgtcaatgttgacccagatttgagggatcctcagtggccaaattcttggatgtttgcagtgacagcaagggttttcaggctcgttgctggtagtggctgctaaggtcttccttatttaattttctcccactggggaagttgtggcttagggaaccatttgacatggttctggtatgtgtgcttcctcttgatgttggtggcacaggtgtattttgggtggcacctattgtgcagccatgtaactgaggcttgggtcatgggcacacctgaaggaactatggttctgggatctggaatgataatgacactggtgcttagggtgaagacactcctgccaccacataggtaacagtgctagaggtgtgaatgctttgaagcagccagggagccaagaatgggagcatagatatatgtagagttacaatggctctggagttggggtagggactaactttctgtggagggtgaactggtgcccaaagtgtgggcatgcccagagagaccttgactccagggcccagagcttgctctagtgatggcccagtgtctgatacatgggtgggtgcagtgcagtcccagaccctgggtctgagtgtgagctctcaaggggcagctgcagtttggggtttgcatggtgttggggaggtggcagctccttttccaaagtagctcaatagcatctgcttcttgcaggtggaggcagtacagttgtgtctccctctctagggtttcctggtgggaatggctcttggttatctcagtggcataaatgctagcgttctctgcaaagcagggatcttgatgactaccaccacatggctgatactaattgcctcaacctttcctgtttgttcctaaccatctcctggcatctcaagtatgcagatatcactagaaatccttcgtgtgcggctattctccatgtttttgctcctctgtattgctgcagattctttaatgggcccttgaaccctcgcagacctattttggtttgtggatagctgtctctctctcgctctagagatatatatataagatatacatatttatatattatatatttaagatatatatatttatatattatagatttatatatattattatatataatataaattatatattatatatataatatatattataatatatattatatattatatatatataatatatattattatatataatatataatttatatatatatataataatatattatatatattatatatgtattttttgtgatggggatgaaggctagtatctttcttactccataatcttggtggtatctcagaaaactttcttatgtctcataatttatgtctttgcagagccagccagccactttgtcggtcatcagggcagataatccatgggtgccaagaacaatgtgactgagtttgttttatttggcctttttgagagcagagagatgcagcatacatgctttgtggtattcttcctctttcatgtgctcactgtcctggggaaccttctggtcatcatcaccatcaatgctagaaagaccctgaagtctcccatgtatttcttcctgagccagttgtcttttgctgacatatgttatccatccactaccatacccaagatgattgctgacacttttgtggagcataagatcatctccttcaatggctgcatgacccagctcttttctgcccacttctttggtggcactgagatcttcctccttacagccatggcctatgaccgctatgtggccatctgtaggcccctgcactacacagccatcatggattgccggaagtgtggcctgctagcgggggcctcctggttagctggcttcctgcattccatcctgcagaccctcctcacggttcagctgcctttttgtgggcccaatgagatagacaacttcttctgtgatgttcatcccctgctcaagttggcctgtgcagacacctacatggtaggtctcatcgtggtggccaacagcggtatgatttctttagcatccttttttatccttatcatttcctatgttatcatcttactgaacctaagaagccagtcatctgaggaccggcgtaaggctgtctccacatgtggctcacacgtaatcactgtccttttggttctcatgccccccatgttcatgtacattcgtccctccaccaccctggctgctgacaaacttatcatcctctttaacattgtgatgccacctttgctgaaccctttgatctatacactaaggaacaacgatgtgaaaaatgccatgaggaagctgtttagggtcaagaggagcttaggggagaagtgacattccagagaatctcaatccagctaggaaattgggagactttccatcttgtagcatctaacacagcctttttatttccagtctgatgtttgcaatggcaattatcctcctagctcttgttgttataataattccacatattctttcaatcctttattcattaaatatttattggatgtttacagtgagtgagaatacaaataaaagtaagatataatctttccctcaaggagagtacagtccaggatgcttttagtgcgatatttaagagctcattcaggaaacgtgtgagggcctgtgaatgagggagtgtcttggaagtccagatatctcattgataaatgaataaaatcactacataattcctttgtgttggctaacacagtgctcaatggaattcattcttttcttttaagagtaaagagccactttactcttaccctttcatgctctcagcaggcagataaataaataaataagtaaataaataatgtggagaggtcaagggatttactaaaagttacactttaactccagagcagggtgaggactagaacacaggtccctaagtcagctttcagagcttttcctcaggacctcttgataaagtgtgactaaatggacaccaagcaggaatgaccaagaacttttgaaagaccaggaatgatggtgatgatgacttgggatgatgaagagaacaaccaggaagaacaagttgtcagcacttctttcagtggtgctgattcctctctccagcagaacagctgactgctgccctctttaacccctgttgctttgctccattttgccgctagagggagccaagtttgtacagaatgcaattaaacgagccggattaggtatctcttaaacattcgtgggtcatgtaacctcattgggcctcaatttccacatttacagaaggagatattgacaataccagcttcagaaggctgtgagaggacctataagactttgtaaagacctaaatcaaagtctgttgttcaatggtggctgctagctgttttaacataatatcttcgattcccctttctcttcctattcacccctctatcctttccctcaaagcccttgtaaccaaactatctgattatttcatttactccaaaaatgtttattgaacacttagcatttgctgggtgatattcctggggctagaagtacagcacaaaagaaagcaggcaaaactctttgttctcatggagtttatatttcagtgtgtggtaaaagctgacccttactgaattcttccaatctgcagacactcttctaaatattttaattgtattaacttttttgatcctttcaacaacttcatgaatgagatataatcatcaggaatgtgatgagagttgggtgagagtggtggtagtaaagaagactcattagtaccatctgatgctgaacaaacacaaatgcaaacgttgatcttgattatgaaaaaatagtagcaataaaatagcagttgacaccttgaaagcataatattctcagaagttttcatacaccagcttaatctgtgttggataaataatccccttataaaactccttggaacaatgtgggagcatgcatgaatggttattcaggtttaaaggtaagtggccgggcgcagtggctcacgcctgtaatcccagcactttgggaagccaaggcgggcggatcacgaggtcaggagactgaggccatcctggctaacacggtgaaaccccgtctctactaaaaataccaaaaattagccgggcgtgatggcgggcgcctgtagtcccagctactcgggaggctgaggcaggagaatggcgtgaacccgggaggtggagcttgcagtgagccaagatcgcgccactgcactctagcctgggcgacagagtgagactccatctcaaaaaaaaagaaaaaaagataagtggagatacagacaggctaaactatgtacataggccacacacagacttctgattgctagtttagtgctctttcactactgctttcatacagtattttaaagtagagtgatagtggtatgtatgtcttacatatatattcaggcatgcatgtatgtatatatatatattcatgaagatgaagacaggtatataaggcgcaatctcagctcactgcaacctccacctcccaggctcaagtaattctcatgcctcagcctccctagtagctgggactgcagcacatgccacgaacgtcctgctaatttttgtatttttagtagagacggggtttcaccatgttggccaggctgtttctgaactcctgacctcaagtgatctgcctgcctcggcctcccaaaatggtggtattacaggcgtgaaccaccatgcctggcctctactcttttctttgaggaaattgaagcacttacatcatggatttgtcagatcagaggtgactggaaagcaatcactcaggaatcccactctttgcctagacttctatttacagaagattgaccaactcaggagccattttaaggtgtgaaatcataggtgtgcttgatatggcagatgtttctttctgcttcatgctgggttgagggaagagggggaaattgggttggaggaagtagatcatgtacttcaggggaaaaaagtcatctgagtttcagctacaagtgagaagactggataagtactacaggaggagctgcataaggtatgagaacttggcattaagagaagagactgctgtatgatacagtggaaattacactagatggaaagtcaggaaacagggttccagttgcagagccatccccacctccatccaagttctcagggctcccatttcctgatgtatacaattaaggagattggttcgaatctctaaggaccttcagctcagatatcctatgattccattttgttcaggaatatagactacatgaaatctgggtcaatcttatttttttctcattttattcacatatttccttagaattatttttaggtgattttataaaaagaaaatattgcatacagttcccatagatttatggacttgacataattatcacaagagggaaaaatatcaaattaagaagatttaattgtgtttttcactactcttcctctctaagagacaactccattttaatgttcctactacaggtattctgaaagttactagtagatgaagctcattgactggtcactcagctactctgtcagtacatttacccttcagtactgagttttccgggaggacttcttagttataaatacaaacaagatgtaattgttattataaatttacttattctgctgtggttggagagagagcagagaaagaatgtggtggtaggtatggtattgggaagggactatgaacttctccttcttggaaggtgaaagtgtccacagtgaaggcagaaaaggaaggtaggctagaggtgagaaggcgccccatggctgatttctttcgtaaaagattggaaaatattattacttaaacatatttgatacaaataatgtatgtattatttaatatatgtaatatgtaatacataataaaattatatattaatgttataaagcataattaataatcatctatgaacttgttatcaacttaagaacaatcctaatagcttgtgtcatatgtgtcttctctattctatttctttgccttcacagtgataaccaatattctcgtttggttgatgacttccttactttatgaaaatagatttaacatatgtgtatatacacctaaccaatatgttgtttaatttttcttatttttaattttataaaaatagtgttacacatttgtagtcttctgacttgcttttttcgcttaacatagtatttcaaaaattcatccttgttgttgaatgtaattgtatttcatcgtttttactattgcacaagatgtcattgggtgaatatgccataattattttactattctttttaaaatataccttggttgtttccatatttctcagctatctgagtgctgttatgaacattcttgtatgtgtggaaaagttttcctggggcatatacctagggattgaattgctatgttgaagggtatgcaaatgtttcaactttaccgaaaaaatgtcaatttgcttttgaaagtggtcgtaccaatattcactccctacagcaatgtataagagattctgatgatgtacattcttgccaacacatggcatggtcaaaacactttaacagttttgccaatcttgagggtactcatagtataccctatgtcttagtcccctttggttgctataagaaaaatgttatacactgggtggctcaaacaacaaacagttacttctcacagttctagagactccaaattaagtcccagattcaagcactggcagctttgatatctggtgagctggggacctgcttcctggtttatagatggccgtcttctttctgtgtcctcacatggtggtaggggtgagggtgctctctacagtcttttttaaaggaggattaatcccatttatgacagctccataaaaagaaagatattttttaaacaagcacaaaaagcactaacaatggaaaatttaaaactaactacattgaaaataaaagtgtttagcacagaataaaatgaaaagataagccacaagttaatcttataactgatacgtaactgacaaaggattagtccaaatatacacaaaactcttagaaatctattttttaattcaaataaatcaatagaataataggcaaaagatatgataggcaatttacagaaaaggaagcacatatgagaagatgcatatgagttatctcataaaatacaagtaatgggatacctttgatttggttaggtgttactaggcaaaaagtcttttgaaaatctaaaggcatagatttctgtggaagtaacttattaaagaaatgttcttaggataaactggaaaggggatactggaagcaagacagagtagtggagaaatctaaacaaggatgcagtttcaagtaattttcagcacaggatcactttagccttatcttgcagggaaatgctggagtgtaaatgatgccaagagttgttttgatttgagttaaggatgtagctttcatatgcccacaccattcagacgttatttaagggcttctctggggctggagtggggcgaaagtcccaggtacttttgtttgtccattaatatggggaaaatggactccagtggcccaaaggcagcaggtggtagctgttgaaaattgttatggtttgaatatccccatctacaactcatattgaaatttaattgctattgcaacagtactaaaatgtggggcctgtaagaggtgattgggggattaggtctatttaagaatggattaatgtccttatcccaggagtgggttagttattccaggagtgggctactgataagaaagatgaatttggccaaatttcctctctccgtcttgcatccttcctcaccatgtaatgcattctgtcacgtcttcatgtctgacatgtctgaagacatgtcatcatgtcttcagatgctggcactatgcttttggacttctcagcctccagaactatgagtcaaaaaaacttctattgcttataaattacatggtctgcaatggagaaaaatagagaacccagaaataagactgcactgctgcaaccatctgatctttgacaaacctgacaaaaacaagcattgggaaaggattccctatttaataagtggtgctgggagaactggctagccatatgcagaaaattgaaactggacccttcccttacaccacatacaaaaattaactcaaggtggattagagtcttaaatataaaactccaaactataaaaactctagaagaaaatctaggcaataccattcaggacataggcatgggcaaagactttatgatgaaaacacaaaaagcaattgcaacaaagacaaaaattgacaattgggatctaattaaattaaagagcctctgcagagcaaaagaaactgtcattagagtgaacagacaacctacagaatgggagaacagttttgcaatctctccatctgacaaaggtctaatatccaaagtctgtaaggaacttaaacaaatttacaagaaaaaaacaaacaaacaaccccattaaaaagtgggcaaaggccatgaacagacacttctcaaaaaaataaatttatgtggctaacaaacatatgaaaaaaagctctacattactgatcattagagaaattccaatcaaaatcacaaggagataccatttcatgccagtcagaatggctatgattaaaaagtcaaaaaacaacagatgctggtgaggttgcagagaaaaaggaatgcttttacactgttggtgggagtgtaaattagttcaactactgtggaagacagggtggtgattcctcaaagctctagaggcagaaataccatttgacccaaaaatcccgttactggctaaatacccagaggaatattaatcattctattataagggtatatgtacacttatgttcactgcagcacaattcataatagcaaagacacggactcaacataaatgtttatcaatgatagactggataaagaaaatatggtatatatacaccatggaatactatgcagccatgaaaaggaacaagatcatgccctttgcaggcacatgaatggagctggaagctgttatcctcagcaaactaacacaggaacagaaaaccaaacactgcatgttctcacttataagtgggaactggatgataagaacacatggacacatagtggtgggggaacaacacatgctggggcctgttgggggtggggctggtgggagggagagcatcaggaagaatagctaatggatgctgggctcaacacctgggtaatggattgatctgggcagcaagccaccatggcacatgtttacctatgtaatgaacctgcacatcctggacatgtaccccaggacttaaaataaaaatttaagaaaaaaatatatcatgccagtctcttctggcctgtaaattttccactgaaaagtatgctgccaggtgtattagagctctattgtatgttatctgttttttgtttcttgctgctttaagtatcttttctttattcttgaccttcgggagcttgatttaagatgacttgtggtagtttttaggataaatctgcttggtgttctataaccttcttgcacttagatattgatctctttctctaggtttcggaagttctctattattatcccttcgagtaaagttcctacccctgtctccttctctacctcctctttaaggcaaatgattcttagatttgcccttttcaggctattttctagatcctgaagttgtgcttcattattttttatccctttttcttttgtctccccgactatattttcagatagcctctctttaagctccacaattctttcttctccttgatcagtcctgctattagaagactctgatgcattcttcagtatgccaattgcgtttttccactctagaatttctacttgattctttttaattacttcaatctctttgctaaacttacttgatagaactctgaattctttttctgttttatattgaatttcctcgaattcatccacatagctaatatgaagtctctgtataaagggtcgtgtatctctgtttctccaggtttggtccctggtgccttatttagttcatttggtgaggtcatattttcctggagtcccttgatgcttgtagatatttgtctatgtctaggcactgaagagttaaatatttattgtagtcttgtgggtctggatttgtttgtactcatctttcttgggaaggctttccagatattcacaaggacttgggtgttgtgatctaaactgtacctgctttacagggtaccaaagcccagtaatcctctgtttcttgaggacttgttgaggtaccaccttgatggttttgaacaagatccagaggaattctctggattactaggcggagactcttgttttcttcccatactttctcccagatgaagaagtctctttctgctccaagccagctggagctgcgggtggaatgacacaaaccctgctattgccaccacttgtgggactgtgctgagtcagactggaagccagcacaacactgggtcttgcccaaggcatgctataaccactccctggctaccacttttgtttgctgaaagccatggggctctataatcagcaggtggcaaagccagctgggcttatgtcctttccttcagggtagtgagttccctcaggccctgggcaggtgcacaggtgctgtccaggagccagagacaagagtcaaaaatcttagaagtccacttggtgttctattatgctgtggctgacgtgacactcaaaccataagatgcagtccttccactcttccctttcctttccaaaggtagaagagtctcaccccatgacctccaacacctctggcccacagggagtatagccagactgctgccaatgttcccttaaagcccaagggctcttcagtcaacttgtggtgaatgctgcctggcctgggactcacccttcagagagggggctcccctatggcccagggtcttgtcctgtagccaccactttaggaatatgctgagtctcacttgagaccagctagtctcagtgtctcagccaaggcccttgatgtactacctttgtattactgatagttattcagggcccaagggctcttcagttagcaggtgatgaacactataaggattgggtcattcctttcaaggcagcaggttttcttctgaccaagagtatgtctagaaatgtccaagggctaggcctggaaagggccctcatgcctctgactggttccctatcctgcttggctgagctggtatccaagatgcaaaacaaaatcattcccactcttccatctcttttcagctggtaggaagagatctcttttggagcctcaagctgtgcagcctggagttatgggaggagtgatgccagcactctcagagccaccctggctagtgtctcagtaggtcatatgaccccccaagtccactgtctctggactcagttcagcactgggactcacttaaatgttgcagtccttgtggctagtcagcctttccagtttatttggagccccagaacaatttagcccatagtggttaggcttgtgggaactcaagttccaaccaccaggattggcaactcccctctggctagggctggtttaaatgcaccctccatgggtgggtgccagttgagtttggtctgcttttgctctgtgctataacaaggggaggactgagttcaatgccttacaattactggctatccctctcctcagggcacagaaacactctgcaccacactgccctgccagaggatgggggaacagtggtgttggtgatacaagactgtttttcctgcctcttctgtgtctcttttagcaatatgaagttgaaactaagtactgtgggtgttcacctgatttttggttcctatgaacgttctttttttgtgtaggtagctgttaaaatggtgtccttgccagggggatgattggtggaacctagttcaccattttgctccaccccaaccaacaagaatctcaagacagtctcttccatacatgttgttggaaaaactgggatatccacatgcagaagaatgaaactggacccttctctcacaccataaacaaaaaagagcaactcaaaatgaataaaggtttaaatgtaagagctgaaaccgtaaaactagaagaaaatgggaggagcaatgatttcttggatatgatcctgaaagcacgggcaacaaaacaaaaaatagacaaacgggattacatcaaactagaaagcttctgcacaggaaaggaaacaattagggtggagattcaactcacagattgggagaaaatatttgcaaacaataatctgatggtttgcaaatcataatatattttggttacatccaaaatatattaggaactttaataacttaatagcaaaaaaattgatgtgattaaaaaatggacaaagtatctaaatagacatttctcaaaacaagacatacaaatggcctataggtatatgaaaaaatgatcaatatttttaatctttaggaaaatgtaaattaaaaccgcaatgagatactgccacacacctgttacaatggctgtcataaaaaagatgaaagataacaagtgttggtgaggatatggagaaaagggaaccctagtacactgtttatgggaatgtaaattagtatggtcattaagggaaatagtaaggagtttcctcaaaaaactaaaaaaatagaaccaccgcatgatcccaaatcccacttctggtagtgtttttaaaggaaataatgccagcatgttgaagagatatctgtactcccatgtttattgcagcattattcacaatagccaagatatgaaatcaatctaagtatttatcagtgaatgagtggataaaggaaatgtggtatatatacacaatacaacatgatatggcattacaagagaaggaaattctgtcatttgcaaagacttgggtgaacatggaggacattatgttaaatgaaataagccaggcatagaaagacaaatactacatgatctcatgtacgtgtggaatctaaataatcacactcaaactcatagaagtagagagttgaattttggtaactagaggatggggacagtggctagacaagggagaagttgatcaaagagtacaaaatttcaattcgccacaggaataagttttaaagatctgttgcacaacatggtgactatagttaataatatatatttcaaaatcgctaagagagtagatttttaaacgttctcactacaaaaaataagtcggtgatgtgatagatatgttaattagcttcatttgttcatttcacagtatgcacatatatcaaatatcacattgtacaaataaataaataaatatatatgtttatagtatcatttgtaaagcaaaaaaatcaaggcaaaatgtttgaattatgaaatggaacaccaatatagccacaaatcaggtcaagaagtagaagattgctagcccttcctcgacccaatatttctcttcccagtcacacctctatcatacctctcaaagccaacactaacgtggcttttttgataaaacttctttgcttttctttatacttttatacatttaccacctaagtgcacacccttagttttgcttatttttaaagtttaaatcaagcaataatacagtgtgtaatcatttgcatttggagtctttgactcaacattgggtttgtaagatttgttcatgttgttatctgtgcctgtaactcattattttcattgccatattagctcgttatatgaatataccatcaatttttaaatccattctattattgatgaacatttggcttgttaccaattttgtgctgttacaaataatgctttattaacactctttatgatgtgtcttccaatgtacaagtgcacacttttgttttggatttctacctaaaagtggagtctgagtcatggcatgcatatatatatatatatatatatatattcaacattagtagataacatccaatagttttccaacatacacttaaaaaacaaatatacatttctaccagtgggcatgagtgatcccactcctctatattgacagcaaatactgggtattgacagtctttaattttagccatgcagagagcattgccatggtattttgttgtggttttacatatttttttcagataactaagaggtgaaccacctcccaactttcttacatgtttactttccatcttttctgaagtgcttgtttaagtctcacatggtagtctgtctttattttgtttatcttataaggtatttccttatatattctgtatcagtcctggttctctgagaagcagatgctaatttggaaatactatgcagctactaagataaatatgcaagagatttattggggaaaaactagtgaaggatggtgggagaagctaccaggaataattcaggtgtaactcctatgaaggagagagggaggggaaaaaaaaggtaggttccagattacaatgtatctctaagtaaattttgtcaagactgacagggagtctttgagttaaaggtgtagagtggagattgcaggttggggaagggaattttgaagaaattgagaaaggttgtacatggttcttgagagttgggaactcgtgtcgactaaagcaatatactaggattgctgagcaatattgatgtgccttttgaagttggtgacacaaatttatacaaactaaatcttccctattttgtgactttctggatgctttcagaaaggtctggtgaaggcttagaataaaattcatctagtgtgggagaattgcagggtgcatgtggcaatacagacaagggtatcggaaatgtaaaaggttacaaatgtttacaaacataaattgttacaaagtttgttgcatatatgataagtattaaacatgtctatccctcttactcaacaattctattgtataacatgtgggactatatctgttggattaattcctaaaagtgggattgttgggcttaggcaggaaggtaaagcaatgccgcctttttggagagaaattttcaacatttatcaatgaaactgaaaagttaatttgattaggtcttcctgccttgcttccttttggttgtttgctttttgttattgtttttcctttttccataaagctgaaggccaggatagttgaaaagagtacaagagtttatagaaaacttggtagagttccaatttagtagatgtttcctactttgtagataacattcataggtcactgtagcaatggttgtttcagttgtttttcaggaacttgggtcagctcctgtccatttcaaaccagtgagaccactgacccttgaattggacctgcacagtactggagaggtgtcattttgacatcggaggccaaacacctccaccttcagattaggctaacgttacaattttctgtacatatgtcctatgaaatgccctgaaccctgactatgcttcctcagagcaaccccattacttcattttcccccactgccagtcacctttctccatgctttagaccaccccacttccctaacccataaatacccctaagccttatctttggggaggcaggtttgagagctgctcctcctgcctgcttgctttgcaaataaatcttttctccttgacaaaacccgagttgcagtgattgatttactgtaggtgggcagaatggacctggacctggccagtaatgtcggcattaaaaatatttatacaatttacccagcaattccttatatttgattttgtaattattctatttgtttagtttttcttcctgttttggttggcaggtggccactgccccttttagaatataaactccatgctgctgggagccaggttcatcatattcaccatgatattcctggcatttagcaaagtgttgtcttttattagctagggcctgagtaataaatactgaatgatcaaaatggtggaagtgtaattccaattcagattgttctgactgtagttcccttgatattttagcatgctacatagtagaggtgtggataatggacagtgattcttctctctttgctttgaaggggggagacaaaagagaagatggatgtgagagggcctaggaccatgcctagaatgcaagagatgctcaataagtgctgctgattttgttgttgttcagtcagtgatttccttataaacactgacccttcaatatcaggttctgaaatatcctagtttccttccttctggataatttgtgaactctccctagagactagaaggacatttggtacttttagaaggaagaatgcaagttatttccttgtgagaccaaaactctattcaaggggactaattaaatgatggcatcaatgttgttctcacctgtgaacaaggctcattctgacaccacttcagcaagagatcctgtgagggagaatttgtctcccttggagaggcggaaagcatacagtactaataatccctatgttctcatttctaccttataaataataagcctttgcggtggagggagaaagattttctgagactgtgctggtgaatattcttagcagaaagcagagttaacaagtcagctattccttctgtgaggcttttctcttgaattttagtggcagtgctttttgacttgtcaaagcctggggagtaaaagtggaaggtggtggctgtattgggaaggggacagtctgggtgatgagccacccaggttccagctgtgtctctgtcacctattactcatgtgactttagataaactgcatttcatctttctgagtctcaaagctgagtcaccaatcactcatgtgactttagataaactgcacttaatttttctgagtctcagatccaccatttacatggaggccattgaaaagagtttgaaatgtcataggattcttcagcaaataaaagggaagtaagatgctactcttggaggaaactgggtgaagggctcctgagattgactctatcaactatttttgcatcttcttgtaagcctacattatttcaaaataaaaagttgaaaaaaagaaaatgaaatataaactttttcagatatgcaaaaactaaaagaattcatcaccagcacacctgctcaagaaatattaaaagaagcgcttcaggcagaggcaaaaataatacctaagcaaaggaataaaaagcaccagaaatggtaaatatgtgggtaaatacaaaaaaaaaaaaaaaaagggaaatggatgatggaacaaattcccagctgcttataaataaatgacccccttttgggattttacctagtacaattctaagagactctcagcttagctgagtttctgtaatcaatagcaacttcctagcctgtgctttgcctcaatgtaaaaagcaatttgaatctctccaggaatttaaaaacatgaactattgaaattcaggatcatacgcttggagttggccttgatgacattttaaacactcttccaggtacatcattccatgatgttcgaatgtagaaaaaaaaatctgaagacctgttagtctgttggtgtccccagatccagtcaatgtaagttttctataatgtatttttacaataaaatgcaagaaaaatgcaacccaaataaaaatacaatggaattaacttactagaattctcattattttccacaaaataattttatttttcatggataattcaaacaggagactttctttctttactaatttttaacaagtactttatctgacattcccacaaatttgaatcacagagatgaatcagcttatcattttcatttctgggcatataaatccattatttgtctacattgtataccactcacactgattacattttctctaccactgctgtgttctgcatgaggatcagtattagagcatttttcatatttataatgaaactatacccatattaatacctgcttagtcctgaatgtatacatttaagtttttgtctccttaagccatatgaagaatttattgcccgggatgacgacgatggtcatagagactccatgtattgaatgtttactgtacaaatgcttgatatacattgctttttatgtctctctgcagcctcagggtgttgctgtactcttatcttcattttacagataagaacattgagtctcaagaagttgttcatagtaacacagccaataaaatggcagagaaggggagggattcaaacccgatgtgtttaagtgacagtatggtactgtgaagcccacaaactctgtggcaagactgcctcagtacaagccccagttctgtcactgattagttaagcatttcttactttcttcctctgaaaatgaggataaaaacagtaatctacttcatgggaatgatgtgaggattaaacaagctgacctatgtaagtgtttggatagtgcttggcaaaggctaaattctatgtaggtgtttcctctcatcactgttgtctgtgtttttggccataatgttctaccttcaaaaagtccccatcagacttgtcacttgcaggagctatatttaccttcttgcaatgaagtgtagagagagaaaaaggtagcagtttcatgatcagtatatgaattttctctccagtgtttctatatatctgggtacctctttcttcttctgacacttgatggttctcctttaattcttgtcatactgagcattaaatctgcagcaagttggaggattcaactactttaagaagacctatgtttccaggaaaaggatagggtggtggagagggttagtgacagtttcaaaatttaagataggcacaggtgttaccaaagtgccaggggttttgtctaggtcctgctgttggccacacagaaagccaattactgagatgagtattcctggggaaaaaggctttaattgggtattgcagttggaaggtagattagtctcaaatcagtctcctcaaccaactgaaattaggggtttatatagcagggaggaaacgttaactgttaaaacaggagttagagacaggtaaggaagaggagttggacaataagaagtaggtggtcggttaggaaaacagggagggctaaggaagcaattatgataaatatggagtctgatatcttattgcctgaatacagtgatttggtgagttttagttttttgatagtttttgggatgtctgagggtgaatgttttgaggagggaattcagataagagaaatgtaaattttaagaccagaagagcaatttttaagtccctccaacaaaccccacaactatctactggactattaggtctatttcataggcatttccttagtatcattaggggaataaagggtgagtaggaatattctgccacataaggttataactgatagctggttaagacagagcatctgttccctccgcccttgtagcttcccttatgtagttataggcagataatcatctactagtacctttcactgatactcccctttttttaaattttgttttttactttgagtcctccccgtagattgcagggggactagtagtccttaactagaaggattacaccaaggtcagagaaagcaaaactcagaagtatgtaaaaatgtacaaaacaagggggaggagaaagctaagttgtcttcctaggcatgatgctattcacagtatgcagatgcagcaaatgagaaagtagagaagtagagaatttggtaagtttctagccacaaccaagtcagtttcttccaatcctgctttagtttgttttatatcaatttgtattagcattggaaaaaccaacaaaaagtgtaaccaacctcattgcaaaccccaagaagaaagtttaattcaaagtatggaccatacatgcagagatttcaggagatttcaggaggtcttaactctacatggttttctcaagtgtgatctaatctatgttgaaagtgatcagagatttactccagtttgaaatggaaaataaatgtctgataaatgttcaatcccagcagccacaaaaatgcaaatttagataattaagttattattttcatctaataactgagatatgtggtgcccagtgatgctaaagttaacagacattttgtggtcagaagattaaatttgtataagaattttggaacagaagagggttaagaggaacaaaggatatattaaaggaaaacttgcaatgtttttcccccatgcaattagttctattacttatgtttctccttgtctttataggcaatactgcacctgcattctcagtgaccttggaatctatggacataccacaaaatatcacagaatttttcatgctggggctctcacagaactcagaggtacagagagttctctttgtggtctttttgctgatctatgtggtcacggtttgtggcaacatgctcattgtggtcactatcacctccagccccacgctggcttcccctgtgtattttttcctggccaacctatcctttattgacaccttttattcttcttctatggctcctaaactcattgctgactcattgtatgaggggagaaccatctcttatgagtgctgcatggctcagctctttggagctcattttttgggaggtgttgagatcattctgctcacagtgatggcttatgaccgctatgtggccatctgtaagcccctgcacaatactaccatcatgaccaggcatctctgtgccatgcttgtaggggtggcttggcttgggggcttcctgcattcattggttcagctcctcctggtcctttggttgcccttctgtgggcccaatgtgatcaatcactttgcctgtgacttgtaccctttgctggaagttgcctgcaccaatacgtatgtcattggtctgctggtggttgccaacagtggtttaatctgcctgttgaacttcctcatgctggctgcctcctacattgtcatcctgtactccttgaggtcccacagtgcagatgggagatgcaaagccctctccacctgtggagcccacttcattgttgttgccttgttctttgtgccctgtatatttacttatgtgcatccattttctactttacctatagacaaaaatatggcattattttatggtattctgacacctatgttgaatccactcatttataccctgagaaatgaagaggtaaaaaatgccatgagaaagctctttacatggtaagaaattgcaggtggaaaatgagtggtaaagcaggaaataaaaatgactttatttttgtaagtgaaacaaaccaagccttactttttttgtatcatgtatagttgtattccatcttaagcataatttcatcttcactgacttttttttttttgagacggagtctcacttcaacacccaggctggagtgcagtggcacgatctcagctcactgcaaccttcgcctcccaggtttaagtgattcttgtgctacagcctcctatgtagctgaggttacaggcacccatcaccatgcccagctaatttttgtatttttagtagagatggagtttttccatgttggccaggctggtctagaactcctggcctcaagtgatctgcccactgaggccttccaaagtgctgggattacaggcatgagccaccacgcccagccttcactgacttttattgtttatttagtattttcacttgaattgcataatttgattataaaacaactatatgaaatatacatggtacgaatgattattattcctattttagaaatgaggaagctctgtttactgatgtagttggtcaattaatcaagattatcaatttttgaagtgactaaaccaaagcttaaaatgagttatttttgatccatcatccagatctttaagtagcaatccatgttgacatcatttgagtctgtgtgataattaattgagttgtagaaacacgaggcaaaatgttacttaacacttagccatatatagcaggcttttctgcatccaggcctggcttctatttcttctcgtcacattgtgtgacatcagcaataccgctgctacactatagcagagaggttaggagtttggctctggagatagagcaatctgagtttgaatcttattttctttcttttttttttttttgagacagagtctcgctctgtcgcccatgctggagtgcagtggtgtgatctcagctcactgcaagctctgcctcctgggctcatgccattctcctgcctcagcctcccgagtagctgggactacaggcacccaccaccgtgcccggccaactttttgtattttttagtagagatggggtttcaccattcacaggatggtctcgatctcctgaccttgtgatctgctcaccttggcctcccaaagtgctgggattacaggcatgagccaccgtgcccagccctttctttaatttttttaaaagttccagggtacatgtgcaggatgtgcaggcttgttacataggtaaacgtgtgccatggtgatttgctgcacctatcaactcatcacctagatattaagcccagcatacattagctcttttctctaatgctctccctccccaccctcccctgacaggctctagggagtgttgttcccctccctgtgtccacgtgttctcattgttcagctcccacccataagtgagaacatgcagtgtttggttttctgttcctgccttagtttgctgaagataatggcttccagctccatctatgttcctgcaaaggacatgatctcattcctttttatggttgcatagtattgaagcttattttctatgcttgctagtggcatgatcttgagtaaaatgatgagatttctagaaacctctgatgcctgtctttaaagtaaaagtaaagatattttagattacaagtataagtgaggtcatgcagtatttgtctatctgtgtctgacttatttcacttagcataatgtcttccaggtccgtataccttgctgcaaatgacagaacttctttcttttttaaggtgtcacctatatacctcaataaagctggggaaataaaagataatgagaatacatgtctcaaagtgttattgtgacaattagattaatctctctaaagttcttaaagcagtttctggaatgtggtgaactcccaatatgcttatttgatattatcatgtctacctctattgggggaaccagcccccaatatttcaacataggttcttttctattttccctaagtgttggccagtctgagaaagaaagagtacaaagagagaaattttacagctgggcctctgggggtgccatcacatattggtaggactgtgatggcgaccccaagccacaaaaccagcaagtttttattcgggatttcaaaaggggaggggtgtatgaatagggagtgggtcacagagatcacatgcttcaaagggcaataaaagatcacaaggcaaaagggcagagcaagatcataaggcaagggtgaaattagaattactgatgagggtccatgtcccactgggcccacattgtcttgataaacatcttaacaggaaacagggtttgagagcagacaactggtctgactagaattcaccaggctggaatttcctaatcctagtaagcctgagggcactgcaggagaccggggcatatttcatctcttatcttaaccgcataagacagacactcccagagtggtcatctataggcctacacctggccttccccagggttatcaattattaatattctttgctgggaaaagaattcagtgatatttctcctactcacacatccatttataggctccctgcaataagaaaaatatggctttattctgcctgaccccacaggcagtcagaccttatggttatctttccttgttccctgaaaatcgctgttattctgttctttttcagggtgtcctgatttcatattgttcaaacacccatgttgtacaatcagatttcatattgttcaaacacatgtttcacaaacaatttatacagttaacgcaatcatcacagggtcctgaggcgacatacatcctcaccttatgaagatgatgggattaagagattaaagtaaagacaggcataggaaattataagagtattgattggggaagtgataaatgtccatgaaatcttcaccatttatgttcagagactgcagtaaagacaggcataagaaattataaaagtattaattttgggaactaataaatgtccatgaaatcttcacaattcatgttcttctgctgtggcttcagctggtccctccattcagggtccctgacttcccgcaacatacctcaaccctttcctaaccttctataaagaaatcgctttcttttgtttttctcttttaggcttgaaatacatgctgcctttagagtaattttttttttgttgctgagtaatacaacatggcgtttctttttattttaccttagtcttctcatttcaaactctggaatctaaaacgtaggtccaccttcattccatcttttccctggttttacaaactctcacaatatcccttccaaagcttcaccttttaagattgtaggctcccataatttatattaaacttaccctctgttggacaaacagtctgtaattcctcatgttacaacatattcactttttacactaggaaaaaacaacctagaaattcatatgaaaagaaatttctctgttataggaagaaatattcaaaattaatctctaagaggccatcatcctaagtgaactaacgcaggaacagaaaatcaaaaccacacgttctcacttataaattggagctaaacactgaattcacatggccacaaaagagggaacaacaaacaccaaggcctactagaaggtagagggtggaaggaaggtgaggattgaaaaactatgccatgcttattacctgggtgacgaaataatctgtacaccaaacccccatgatacctatttaacaaacctgcacatgtacccctgaatctaaaataaaagttaaaaaagtcacaaaaagtgcaaaattagtctccaagaaattagtgtccaccacatttgggagattatcaggaaatatttcttgttttatccccataactctgtctaataaaaatgacaattgcagaatttttggcaaaagaaatattgccttctttcactttgtcacattttgggaagctaattaataattggtagctataattgagaccttgaattctgtacccattcatttctgctgttagatgataaaagtattatttaattaattaagaaatatgaaatcatgacgaggatcgctaaaaaatagcctgtcttttggccagcttgctacgatttcatctcaaaagactttttagaaaagcacacttattttattttattttatttattttttattttattattattatactttaagttttagggtacatgtgcacaagtgcaggttagttacatatgtatacatgtgccatgctggtgtgctgcacccattaactcgtcatttagcattaggtatatctcctaatgctatccctccccccttcccccaccccacaacagtcccaagagtgtgatgttccccttcctgtgtccatgtgttctcgttgttcaattcccacctatgagtgagaacatgtggtgtttggttttttgtcattgcgatagtttactgagaatgatgatttccaatttcatccatttccctacaaaggacatgaactcatcattttttatggctgcatagtactccatggtgtatatatgccacattttcttaatccagtctatcattgttggacatttgggctggttccaagtctttgctattgtgaatagtgccacaataaacatatgtgaaaagcagacttattttagttgtaatttaaagtaccctgattttcagtacagttaaaatatctaatagaaagactaataccagtgtacccctatttttattgtccaaattatgatgaacaacattcccattaacttataaatattgcttactttcgaaaaatttcaacttgctagattaaatacatgggtaaatattctgagtagttttctagtaattaaaattattactaatcttgtttgcaaagatagttgtatctttattttagagaccatgtaaaatgtctttccttcataatccatatttgttttagcaaatttagaaaataagaaaataaagatggtcaatatacttcctccaacacacttgtataaatccacctattagcccattacctagagataatcactatcaacattttggtagatactcttccagtcctcatcatcttttcttctccttttcctccccttctttctcctcttcctcccttttcttctctatttccctctccctctctttatatacagtatatcatatgataggtgtatgacataaatatgtgatatgtaatatatgggataatattttatttccatactgatttgtttaatctgagtttcatatttcaattaatgcccaatacatatctgcataatgtaaattttttctgtgactcaatatggatgactgtttagtatttattatatagctttactaaatttatttaactgaacccctattaatgaatttagattggttctagtttttgctattataaagagtactgcaacaaatattcttttaggcaaatatttttacacatctaagagtgcacctttagggaaaaagaaaaacaaacctagtagagtagagtcagagttagtcaggaacaaaagtagaaaagaacattctcattctagaggaataagctcattcataagttagaggcatgagaagacacagtagggtgatcatcaattaaggggtatttcagaatcaagagtagaatcttggcatgcaaatgaatgacttcacaatgtgatgaatgcaacaatagtgtatgagccaggtatagtcaggagatgagtgaagggttttcaacactgagtggatcaaggagtattacatgcaagaggctatatttcactggatgttgaagtatgagtaaaaggagtcagatgaatcaactaaaaatgtgaggaatgaaaagggaattacagttacagaatcagcatgtgctttcaggacacagtgtatttggcctcagtcctgtaagaaaatgtgaagccacttgaaggttttaacataaaattaggttcctactttacatgactatgaaaataaattccagatgaaaaaaatcctaaactcaagtatttctttttaaaaattaatagaagatattatttgagaatatattcatgatctaggccagagaaggctttctgaaatgagagataaaattcggatcaataaatgtggccatgtaataaataaattgcttttgaattataagaagacaccatagacagagtcagaagaccagtcactgcctggcagaaggtatttgcaacatgtataatagccaaagaatcagaatatataaagcactgctagagtataagaagaaaaagttaaacaaccaatatataaataggtaagagtataaacaaaaaatttactgtttatacaaatattttaaagatgcccaactttggtggtaatcagggaaatgccaattatagtaacaataagaatcaattttcacatatttcacatattggcaaagactaaatcacttgacaatatcaagtgtggccagagatgggaagtggcagctctgtcgtatgctgatggtggcacagtcagcatggaaagctctttgatggtatttgttaaaataagtactaaccatttgattcattcgtaggtatctatttagagaacaacaaagttagatattcttgatacctaagaatttcatgaatgtgtacatggaaacgtgtacaaggattttcaccacagaattgtttgtaataaaacatagaagtaatcaactaggggattgcttaggcaaccatggtgtatgatggattactgtacagcagttaaaagaaatcaattgtatttttacttgttaatacagatcaatctgaaaaacaacgttgagtgcaaagtaagttaaaaatgatgcatttagtatgataacgttaatagaaaataaaccactaaacatcaaaaatattttctctgtgtgtgcatgtgtatgtatttgtgtgtgtgaaggcagagaatagtatttttatgtcatgagaagtagaagagcagaggagtcttttacttctactttttatatcctaatttaataagcacaatatatcagcacatgactttgtgtaattaaaaatggaaagaaacctcataaaacagatatgttagactttgttttaagtatactttaagttttagggtacatgtgcacaacatgcaggttagttacatatgtatacatgtgccatgttggtgtgctgcacccagtaactcgtcatttaacattaggtatgtctcttaatgctatctctcccccctccccaccccacaacaggccccggtatgtgatgttccccttcctgtgtccatgtgttttcattgttcaattcccacctataagtgagaacatgcggtgtttggttttttgtccctgtgttagtttgctgagaatgatggtttccagcttcatccatgtccctacaaaggacatgaactcatgtttatggctgcgtagtattccatggttaaaatagtagcttattgattataagaaaacggcacttgttttttctcttctttgtatttttatgtattttttaaacctaaaaatcagacaatttagatttttctttagatgaagtcaaaataaagatattgtgttggtgcccctcccctgatcccatgaattccctgtgcccttacttacgccaacaattattctgacttatcctcctactcaaggccagtcttttcactgatccccatgactgcctcccatcacattacctccaagaccgcttcagtcctcaattattgcttttttgtcataacttcagcttactctatacccttggttaagcctctgccaacctgaaaggtggaaactacactttagggctaagttatttatttgttcagcttacaaatcatcttaggcaaataaacttatctgatacttagtttcctcaactataaatggacattttattccttaggtcatgcctttgtaagaggaaagtgtgtatgaagacaagtgttgggcaggtgataggagcctgataaatgttagtttccttccttgctggtgagaacagggtaacagaagaataaaggttagaagtaatgtaatcctctgaattttaagtactgtggaaaatatactggtcgagtaaaaagagaagacctgtgtttgagatttttattctgcaactgatcgttatgcggccactggcaaacaactttaaaaaatcatttttttcacttctgttgaacccctttccctcaagtggaattttgtttttaatgaacaacagcaaaatgaatgcatactcatataaaaatatttgctattttttcttgtgttatttatcagaggaaagtagcactgtataagttatgggctgttccttcatgtacaaagtggtgcaggtggagaaaaagacagttaatttcaaacaagtttcctgatatgtgtgaatcaaaacatttatggaattataaattactgacaagtcactagctggttctttgcagacacaaaattttcagcctgatctgtctttgaaaactagttcatctgcaaattagttcaaaaagtgatatacacaataaaatttatttaaaaaaatgaaggccaaagagtttcaagaagacaatttcaatgtaaatataagacatttaagacaactaacttgtttatttatattaagtggaagcagaatagaatttggcaaagcatgaggggtttgggttggacaggcttggacccaaattctatctaagccaagttttagctacttaccttgaacaccataattaatctttctgtctcttggtttcctaatttatgaaatgggaatatcaaggttatcatgtttattgagtggcattgagaattattaacaaataacagaaagaatataaagtactttgcacatagtaaacactcaaataaattaaaaatagccatcataattataaatacaatatcattattttgttggtactgacagtttcctgtgagtagggtcacaattatattcaaataatgaaatattttagacaggtaaattctatgctttgaggcttaaaaaggtaagcacagaaataacttaaggtcacaaattgctgccttcatggtgtaggtcaaaggacataaaatttcagttagatcggaggaataagtgcaagagatctgttgtacagcatggtgactgtagtaaataacgatatcttgtattcttaaaaaatgctaagagggtagattttaagtgttttcaccacaaaaaggataactatgtgaggtaatgcatatgttaattagcttgatttaaccattctgatgcaggcaaaccccaaaattggggctttgaccagttgtgtcatggctggggttgtgactcgtgcttggaacacaagtcctgctgatctacctcattttcccctcagagattatatactcctccttaatttttaagagttgcagaagggtggaagtccttgagcttgcagttcaactaactctgaattgttaacataagaacaacaggtgtggtttattactgcacatacttttccttgtcatgctacttatctgtgtgtttgtcaaacaacagctttaaatcttcttggggttcacaagtgtaggtggtgttcttctcttgcacctgcaggcactcatgagaaaataagtttaatgctatacaggtgtacccagctagtgactccctgaagtttcacagcagcacgggtatttaacaacacctgatagggggctttttgttttggttgtaatagatccttggggaagcctcccttctttccaggtttttagtaagactaagtctccggattaaagaggggacatattcttttcctttgtgggaaagggaaatgctttatttccatattcttgaaaggcctttcgaaactggcctaagttgataatatgaatgagcgttctagttgtctcctcatcaaacaggaaatctgaagttaaaaagggcttcccataggttatttcaaatggactaagttttagggttcctcttggagccctccttatgcacaagagggctgtggattggagaaaaactcaggcctcccaggtttcccaacagagttttactaatgtccttttaaaaacatggttggctctttctaccttaccagaggattgaagcctccaggaggaatgaagatgacaggtaatgcccaaggctgaggaaacctgaggggtcaccttacctatgaaggagggtccattaccactttgcaagccttttggtaatccaaacctcgggatgaaattctttaagtaagaatttggacacttccaatactttttctgtccttgtgggaaaagtttctatccacctggtgaaaatggctgtaagtactagcaaatattgttgtcctctgtaaggcagtctgagtgaaatctatttgccagtcttccccagggtatgttccttgatgttataaaggtttgagtaggtggcttcctgggttattatgggcacagagttcacaggtcctggtgacccctttttcagtctggaatagtcccttctccaagaatatttgggaaaccaatttgaagagagaattccatcccaaatgtgaggagttatggaaatgcttaattattttccattgcttagccttggggagaaagtttattgctttctagcaactaccatgagggactcttttgtaagcctttctgttctgttcatttgatttcctcaggtgtatagtatgattctgctgacatgggtggagtatcaggcattagtgcagtggccagtagtactgatcttcttgtagcagtgaccttggctgctctgtctgccagagcatttcctctgataatagacatgtctccctttttgtgtcccctgcaatgaataactgctatttcttttgggagttggacagtatctaaaagttccaaggtctcagtgatgttttatgggggaccccttagatgttagtagtcctctttctttctacaaggcagcatgagcatggagcatcaggaacccatatttagattgagtaaatatattgattcttttcccagttggagggtccttattagagcaattaattccactttttgagcagaagtctggggcggtaaagctttggccttaataacttcttgttggctaaccatggcattacctgccttctttactactcctttatgaataaagctactcctgtctgtagaccacaagacatcaaagctatcaggggctcatctttaaggtcagacctgctagagtaggtctgctccatggttttcatataggagtggatgaattggggatctgtttcttgggatgtggagtctgggaacagggtagcagggtttaaaacttaatataccttaagggtaacatctgggggtgtcaagcagaagggcctgacatttaagtaactggcttcctattagccattgatgtccttttgcctctagaacctcctgtacttgatggggaggtcataacatctaaatggtgcaccaaggtaaacttactggctgtttctatcaatagagtgatggtggccatagcttgcaagaatcctggccgtccagccaccatctgttccagctgtttagagaagccatttgtctaggattattcctgagccttggagttagaacacccaaaattgtcccttgtttttcagccatatagagggtgaaaagtcccaaagcaggggctgttcccatcttttcttttaaggttagaaatgcctgttggcaggttccatcccagttcaaaggctcatgatcattcccttttagaccttcatagagtggttttgctatgagccccaactcaggaatccaaatccagcacaattcagtcattcccacaaaggttcttgactatttcttagtctgaaggggctggagtgccaggatggtctcttttctttctgggctagggtccttgtcccaggagagaacatgtatcccaactatttaacattttgaacagaaatctgggccttgtgcttggggaggatacacgatacccttgttttctcccagaattaaggacctgaattgtatttttattagagtattctgtagtagggctggaaattaataggtcatctacatattgtaaaatggatccattctttaactataattcccttaattattttgtcaatgcattcccaaagagatgaggactgtccctatgaccttggaggaaagacagtccaggtaaactgagatatagcatgagggtctggatcagtccattcaaaagcagaaatatactgagaggtctgggtgtaaaggtatgtaaataaagcatcatttaaatctaatactgtgaaccaatttgcatcttcagggacttgggtcaatattgtgtaagggttaggaactattgggtaggcagggactactatctcattaactgtcctcaggtctcaaatctgtattccccattttctttctttacagacaggatggggctattacatggggacttccagggttgtagtagtccatactttagaaactttgttatcaggggttgtatgcctgattgtgcttcaggtctcatggatattgtttcctccatgggtaaccaacattgggcttcaaggtaacctggactgggggtacattaacagctctaccagcaacttctatttcccagaggggtctacttgagaagtaatatgcagtggaagggaggtcttttatttatctgtctgtactaaggtatgcacttagagcccttcctggcctattgccttatcataaggctcctcaaattgaactgtggattgtaattaggaatgtaagtctcttcccagtaaagacatagggcactcaggtttaaaacttatggtcccacacattgcaaccaaggcagtgggtgaatctcctaattcttggatatcaatctctgctatggtataagagcaggaagacactggccctgagaaatgggtcagcactcttacccaataagaactcagtcttcttacctaccacatcaagggttagccaaggctcccctgtggagatggcaagatgtccagtgggaaccatggaggacttcaggccccttcgatcctctgttctctctgccattatgagtgtgggtggcccaggctttctccagagcctgaggaagtccctttcccaatggccctcttgcttacagaaaacacactggcccaggggacagcaagtcagagactctcacctgggtatcccagaggctgattttatgacactttctcagaatgggtaaccctgaggtggcacagagtttaagacagccactaacaattgtgctttttggctatttctttggattttcttcaccttctctgccctgtccctattgttgttaactccaaaggccgtgttggagttggatcttgggtgtttgaggtcccatttctgccttttgtagtttcctactaagtcaagggcagatcaagtaataaaatgcatacctaggagaggttgcccttcccaggagtctgggtctgcattagtatatttcttgagtgcctcagccatactgtctgtcctgaaacagagcaggatgttcttccttcccctgagttactcctgtaaccttgtcataactggcttaactatacacttttccataccttctattaaataagttaccatgtgatttctgcatttgaaatcttgggaacccctctggcaatcccactgaggtccaagtctggaactgcatctccctccacatgataaatggcatggcttttgtttcaagcagctactccatctgcatatttgtgggcagtatccagaatcctttgtttctgtcttatggtacagcaggtggacaataatatttgcttgtcttgtcaagataagtcaaagtatatggtcaacttaacaaattcctctataaacttccctggatcctccaaaaatgggccaaatttctccttgcataaagtcaaatcagacacagaaagaggcacatgtactctgattgttcccctatttctgtcagctacctcttgcaatggacacaggttcagttttaggggctgatatggggcctcactcctggtggtactggttgggcttatttcctcaagcagcagggggtataggttgggcctaattggctaaaggggagggatgtctgatgaccttagggtgaaatcctgcactggagaactagtgggactcccctcagaaaccgggaactgaggaggctccaggggccatggaggcctcctagggagagcagctagcagggtatcatctaggaagtgcatattcttggtatctggaagtaacatgagctagacacatcctacagctctcccttaagtgagggttctggtaaagggccgtaaacacctgtacataagggaactctgtccattttccttccttttcacagaataagtccaactgtaaaatagtattataatgtaaagaaccatttttaggccaaatttcttggtcttccaatttgttttggacccaaatcatattgcagtaggaaatgaatttctttctcttgaagctgtctaacttgaatttgctccatttgcctaaaaggcaccctagtggtgagtccttcaggatgc

SEQ ID NO: 199 - DNA, 156431 bp, Homo sapiens
aagtgtcggctgggcacggtggctcacgcctgtaatcccagcactttgggaggccgaggcaggcgaatcacaaggtcaggtgatcgagaccatcctggctaacatggtgaaaccctgcctctactaaaaatacaaaaaaagtagccgggcctggtggtgggcacctgtagtcccagctactcgggagactgaggcaggagaatggtgtgaacctggtagacggagcttgcagtgagccaaaattgcaccactgcactcctgcctgggcgacagagcaagactccgcctcaaaaaaaaaaaaaaaagtaaagtgtgaaagaagacatttacaatagatataatgcttcatattgcttgttactgaaataggaaaagcctgaaataactagcaccatcactgtacatgggtgcataatgtaagttatagaaacacttaagaaaagtccattctgacctgcatactgcctcttgcttccaagatcaatgacagtattctcatctcctttatcaaggaactggacttcattctcctgcaaaagctgcttgatcttgacctgttgctgtttgacccgggtctcaagcaggcgcacctgggctctgagccgcatctgctcctgggcacagtcctcgagcgcctgcaaaacaggtgagatgagatgagtatgcacctcattttcatggaaaacaagtgctttttaaacatttggataaatcagtgattccattttgtctccagttcccatttcagaatattattccaaagagaaagtggcttgaaaagttctaatactgcctactatttgaagaattggaaattatggcttatgcgaaaactcctggactcaaaagatcaaataatataaaataattggaatcgctatgctaggagctttatagttgtctcctttgatcctcataacaattccatgcggtaggaaagggctcagtcttgatgcccagtgggtaagcggaggtgggattcaaattcagttcaaggactgtgctctcaatctctatatgacattgcttatgtgttttctaaacagtaatgtggtttatagaagttaattgtactgttggcatgtaaatctccataataaatgaggtttttgaatggctgtctggtataaatacttttaaatatgtatatttaatgtatattatatattatatatattatatatgcatataaataatatataatatatataatatataatatattaaacaatatataatatatagtatataatatattaaacaatatataatatatcatatataatatattaaataatatataatatatatcatatataatatattaaataatatataatatatctcatatataatatattaaataatatataatatatctcatatataatatattaaataatatataatatatatcatatataatatattaaatatataatatatatcatatgtaatatattaaatatataatatatatcatatgtaatatattaaatatataatatatatcatatgtaatatattaaatatataatatatatcatatgtaatatattaaataatatatatcatatataatatattaaataatatataatatatatcatatataatatattaaataatatataatatatatcatatataatatattaaataatatataatatatatcatatataatatattaaataatatataatatatatcatatataatatattaaataatatatcatatatatcatatataatatattaaataacatataataatatataatatattaaataatatataatataataataatatataatatataaaataatatacaatataataataatatataatatatattacaaaatatataatatgaatatatatgaatataaatgaatagatattatataatatataaatataaataatatataatatattaaatatatttatatataatataatgtaatataattgtatttattatattatagtctactttatataatatattatatttatacataatatacgtatatataaaattacataatggatttatatagtatatattatatcaaatacatatgcatatataatacatttatatttatatagtctataatatatatatattttttatatatatatatatgtagtacatctcccctccctcccatctctaggtccaagtcatggaacctctcccagccatttttctaggatggtttctcccttttccttccccttcccctttcccttcctcttcccttacgtttcctttctcagaacctctcccagatatcttttctaggatgatttctttctcctcttttctttttcttttcttttgttcttttcctctctttctccttccctccttccctcccttccttccttcctttcttttctttcctttcttcccatccctaggtccaagtcacagaacctctcccagccatttttctaaaatgatttctttctcctcttctttttcttttcttttgttcttttcctttctttctccttccctccctccctcccttccttcttttcttttctttctttcctttcttcccatccctaggtccaagtcacagaacctctcccagccatttttctaggatgattccttctctctctctctctctttctttcaacagagtcttgctctgttgcccaggctggagtgcagtggtgcgatctcggctccctgcaacctctgcctctctggttcaagcgattcttgtgcttcatcctggcaagtagctgggactatacaggttgtgtgccataacacccagctaatttttgtatttttagtagagatggggttttgccatgttgcccagtctggtctcaaacttctggcttcaagcgatccacccacctcggcccctcaaagtgctgggattacaggcgtgagccactgcaccaggcctctctaggattacttcttatttgttcttgttactctatccctaacactcagatttatcccttctgagatagttatttgcttagcaccttgagtcacataggctaaaaaatgaacagcaagaacattttatggtgtctgggtcctgagttgttttacaacagtgggggatcggttgtgatattgttaaacatagtgcactatgcaattttaaaataattgaagacatcacaggtcaagtatgcccaatctttatgagattgcatacgcatatttagtaagcttatttaaaacctaggagttttctttctccaagaactttgaatgaatgttttgtcttttttattcacaaatgaaggacaacacaagttcgatgtaattactttcaaataatctggttagttttacacttttcaatattgaaaagctcaaggttaattttaattactatggacagtttcaaatttctaatattccaaccaaataactccagtgaatttttaaaaattacttatttattatgaatactttttatttaaaaaaatgtaaagcactttttttttttttgagatggagtctcactctgtcgcccaggctggagtgaagtggcatgatctcagttcactgcaatctccgcctcctgggttcaagggattctcctgcctcagcctcacgagtagctaggactacagatgcgtgccatcacgcccggctaattttttgtattttttttagtaaagatggggtttcaccatattggccaggctggttgcgaactcctgaccttgtgatccacccatctcggcctcccctgcaaaaatgtaaagcgctttaaagtgctgctttactatgtgtccagtatttctaccagcctctttgcttttcccacatagttaagttttttcaatgacaagtcactataggtttaatgcaaaatgaaagaaaattcagataaaagcaggcattataaatatgacaatagttttcccaagaagcttaccgaaatttccctgcccattgtcagagcggtggtaacaaggatgaaactgaacacctttgccatgttcccccttgaaaaaactgcaagaacaaaaagaattttataaatgtatcaaccttgaatttttcatgagaccagagttcagacttcagtagctccaggaagtcggatgcagccgcaggccatccctaatcttagagtcgccgaggaaattctcccagactttcccagcctctcaccacacagaatgacactgagtgttaactagaattgaatctgtttcatcacaaaaacagaggaaggactctggttcttttcgctatcctaatgtgctgtttgtgttatgctgtggaaaggcacaggagcattttaatcagttatttaatgttacacatcaaggaagtggcgtagtcaaaatctgcacgctggtctctgcttatggagcttgtgtctttttctccctatgttgtgaggctggtctcaaactcctgggcttgagtgatcctcccgccttggcctcccaaagtgctgggattacaggcgtgagccactgcctagagtaagatttttgaaagcaaaggtcacaccttgctaattttggtatccctagcatttaattcttgtggtgaccccaataactgttgttgcttctacggaattattcctcaggaggcaaaatcgttctcagagggaaaaatgtaatttccttgctttaaactacagtctgtttatactgacatactttcctcttttactggaaaacaatgggctaagtatagttttgaaggtaagagttaagaaggagttggggacttttggtttgattgaacacatgaatttaattttttccttctcacaaagcccactagaaaatgagtgaagaaaaagtttaaaagatgcgaactgacaaagtcaaagagaaagggaaagaacagctagtgtgcaatgtcagcaagttggtagatgataaaaaggcatgtggggggcctggtgcggtggctcacgcctgtaatcccagcactttgggaggtcgaggtgggcagatcactcgaggtcaggagctcgagaccagcctggtcaacatggcgaaaccctgtctctactaaaaatacaaaaattagccaggcgtggtggtgggcgcctgtactcccagccactcgggaggctgaggcaggagaattgcttgaacccgggagatggaggttgcagtgagccgagatcgtgccaatgcactccagcctgggtgacagagtgagtccctgtctagaaagaaacgaaatgagaggagaagagaggagaggagaggagaggagaggagagaagagaagtaggggaattggcaaagcagcagtagagaggagcaccatgagaagcgagagaagtcacagtgtagcaccctaggggattctggattggaggcactgctagcttggaagtgaaggtagaggcaaatgggctaacagtcagatcctcatctaaatcctgtgcagccaggtgaatgctgcttctcgtaccctttcagaatatggaagatttactttctattaagattgcccagagatgctccaggtgacatgacagcagaagtgctggaggggaggagagagaccctgttcaaaaagggtgaggctttcccaggcttcttctcttgcagccaggcaaccggctctacactcttcctaccactttccaggccaaagaacataggattcctcgctggaggaacagcagagcttcaccgaaaagatcttcagagactgacattggaggattctccatcaaaggaggcttttccttgactgatcgctctccaaagaatcccaccagttgggaagcctccttcatgcacctgggagaggtataaaaggtataggcacactattctgcttatttctttcaacgtaagtcttctttctgaagagaggcatattttacatttcattctctgtccacatcaaatggtctaaagagaaacaccaaatttctgtattacaacactgggcagaaattcatatgatagcaattagtcatgacttaaccctttcacccaacactgtgaacaaaataaccaagatgggccgggcgtgttggctcacacctgtaatcccagcacttcgagaggccgaggcgggcggatcactgaggccagcatggccaacatagtgaaaccctgtctctataaaaatacaaaaaattagctaggtgtggtggtgggtgcctgtaatcccagcaaattgggaggctgaggcaggagaattgcttgaacctgggaggtggaggttgcagtgagccgagatcacgccactgcactccagcccaggtgacagtgcgagactccatctcaaaaaaaaaaaaaagtatctctagacccatttttccattaaagttatccttttaaacatatgatataatttgtagcaacaatttataagaactctggcatttcactctttattttatcttagtaaatattttttctttaaaattcaattgtatattgagtatgtacctatcttaggcccagtgatagaaatagtagtcttaggcccagtgatagaaatagtaatcttaggcccagtaatagaaatagtagatgtttttatatgtaatgtattaaatataattgattatattaaaatatttgcttatgttaaaaatagagaaaattaactttctgatatttaaaacatttaccaatgtgaaaaagagacaccctctgtgtatttttataaaagataaaatggggtgagaataggattgcaaaggaacagaagtcgtgaccaaattagaagaaaagatgattaggtttgctatcaattaatattcgctaattaatataataagcttggaattatttaaggaacacttttctaggtcacatttattattgtcatgaaaggtaaaatcattttctttaagataaaaacattgactgcactaaagagtcatcatttgcaatgcagtagtgtcctaaatctcttattcccagatgtcaagattatgtctacaaattaagaaaatttcaagttgaaataagtattctaaaccgaagacatctgatgttaggagcaaatacattttcattccgatcctgggggtagtttcatgttttcttttgtttttctttttttgtctgagggtccttgggaacactccttattcattgtggctgaattttttcaacatcagcattgaatactacaaaggattgtatcagatataaatcaatagtcaataattttattaagaagtaaaaaccatccatttaaactgaattacagtgggaaaatatatttgtaaagaaggcttagaaaataaacaataacaataaactagaatgagattatttcaagcatatattttctaactattcgtaggtaaagttttaaaaattgaatggattctagtcctctaatccctgtcactagaaaatgactgacctacagcatgctttagtatcttttcttcacaataagagaataatattttaataatgacacacaataattgctaaacaggcttgatgggacagtaagcgtagttccacaaagatgccaagcagcctgcgtggcctggggcattatataaaaatgagctagccattcaagtagaatgtacctctgcaaggctgcaatattacttacattaaagggcccatcatcaaggggacaagggctatttccccaagtctaacgtggattggaaaaataaggaatactcatctgaaaccatattgtgtttgtgtttgggcatcactaaacactctgccgaactttggctgggcgtggtggcttacgcctgtaatctcagcactttgggaggacgaagtgggaggatcgccagaggccaggagttcaagaccagcctggccaacatgataaaactccatcgctactaaaaatacaaaaattagccaggtgtggtggtgcacacctgtaatcccagctactcgggaggctgaagcatgagaatcacttgaacctgggaggcggaggttgcagtgagctgagattgtctcactgtagttaagcctgggtgacagagcgacactccacctcaaacaacaacaacactatcaaaacactatcaaattttaattggccattttattttatttcattagcctcacagtgaaaataagaaaacaagcacaaggatgcttatgatttctccaggaccattcagcctctggggatatcccctgggaatatctcccaaatctcctgaacctctttctttattgcctggttaatcctttcttactgtattatgttgaactataagaaatggcagatgtttgaacatttctgacttagaaaaatggcaatttcattgtttcaaattaatgcatattgtttagataggaagaacacacttgaaaatcattataaccatttatactacaatgaataccaaaaaaataggttcaaaatatactgtttgcagcttacttgatcagagagagaacaaattggcaagaacctgtttttatatcaatgctgcctcccatgttaatacattaatgtgtgccatttaaaatatgtttacaaaattgctaatacatcatcaacacatgaaatctcacgatgtctttagaagacacattatgtttactttttactaaaggaagctcaaatagtgaagcaaagtaactttcctaaggaaagactctacgttcaaaatttatacaacatccaatcatttctcaccacctctattgctaatgtctggcccaagctaccaatggaagattccaaacaattttttagaattacaatgagacaacattctatactgagcctttcctgggcaaaccgggatatttggtcattcaccgacaaagctttacataatctgtgagcatccacctcctcaacacatctcttttcccatcatttttgcctgttctggctacattggcctctttggcatttttggaaaaccctgaaatacacagacttctcagggcgattgcacttgctgttctctctacctggaatgctcttctgaaaatctctgtggtttgctccatgacatccttcaggtctttgctcaggtattcccttcccagagataccttccctgactaccacatataaaataacagctgtcccctactgtcttagtccattctcattttataaatttacccagtaaagatctgcctgagactgggtaatttataaaggaaaaaggtttaattgactcacagtttgccatgactggggaggccccaggaaacttacagtcgtggtggaaggggaagcaaacatgtccttcttcacatgatggcaggaaggggaagagccaagcaaaagccccttataaaaccatcagatctcaggagaactcactatcacgaaaacagcagcatgggggtagctgcccccatgattcaattaccttccactgggtccatcccataacatgtgggattacgagaactacaattcaagatgagatttgggtggagacacacgcaaacaacatcacccacacacttcatatctctatcacaatggattcagtttctccttagcacttatcaccaaatataatgaaatattataatatatgtgtttattgtctacctactccaaccgccctgtacaatgtaagcacgaagaggtgagtggctacatctattatgtatactgccctaatgctaggtggatagttaggtactgtactagtttcttgaggccaccataacaaattaccataaactgagtggcctaaaacaacaggagtttattatctcacagttctggaggatacaagtccaaaatcaagaagaacagggccatacttccttcaaaggctctaagagaaaatcctttctggactcttctagcatttggtggttgccagcaattcttgacatcctttgacttgtggcagtatcactctattctctgataccatcttcacatagctgtctttcctctgtgtgtctctgtgtctaatttccctcttcatataaggacatcggtcattggattagggtctgccctaatccagtatgacctcatcttaactcagttacatgtacaaagaccctatttgcaaatgagatcacattcacaggtaataaaagttaggaatgtacatgttttgggggcacagctgaacctagcacaggtactcgacaaaatatctactgaatagatgagaagaaaacttgtaaacctgaattagaattgtagaacttcccaggatctgttattgtaatttcacagttgcttatgggagatcaaattcttttgtgtctgttgaatttataagatgtctttatcagattccctccatcttcacccttccagcaacaacaaaaataactactcttaatgaattatgcttttcataaacttttttgtgatttgcaaatatgtcatgtcaatatgtaacagcttattttggttttaaaagagacatttggatttataaaatcccaaaagaaaatatatacctgaaaacataatacctaagatatttgaaagttggctctctcactgggccaaggtcattaccatagctatctcataataagtttttagtttgactcgtgttttcagttggcaataaatatgttttttgagcaaaattataatagctatgttgctttttaaatttgtacccttgtgtctttaactatctaattttaaaatttatcacaaaactcaagtagcataaaggaaaaaaataaatgcccttatgcaaatggcaatttcttaaacataaacaattgcatagtcacagacatacagtcataaagtatttttcatgttacagaaaataagaaacaaaaacattttattataaggaagcaaaagaaaataaagatggaaaacaaaatatttaaaaaatataaagagattttagaaatagccttgttccccgagactagaacatgcagagaaaatataattagaggaagtgacatcattcagtcaaatatcatcaacactagaggctcagagagggaaaattgtttgcctaaagaaataaaagagactttcactaagtatatttacactagtctgggaaatcagcataacgacatgacataaataccatttatttgtgactccaactcaaattgttcttctgactgaaaataaccaatgtatttaatagattactgattaggatttttccttgataaatgaaactgctaaggattagtagtaaaaataatgtcctctttttttatgtgacaggaaacaaattttcattattttaatccgctcccagataatattcaggagtcaaaaattaaaaatcatgaaatgtctgtatcttctagactttgctttaatgttatttgttgaaaaatttttttatttgattaaagttttcttatgcatttgtgggatcaagtactttatttcagaagtgaataaattagcttaaaaagttagagcttagccaggcgtggtggctcatgcctgtaatcccagcacgttgagaggctgaggcaggcagatcacttgggtcaggagtttgagaccagcatggccaacatggcaaaaccccgtccctactaaaaatacaaagaaattagccaggtgtggtggcacacaccttttatcccagctactgtgttggttgaggcatgagaattgcttgaacctgggagacagaggttgcagtgagccaagatcacaccactgcactccagcctgggtgacagagtgagactccatctcaaaaaacaaacaaacaaacaacaacaacaaaaaacacctagagcttaaaaaagaaattttctcattccaatgtttgattctggctcttgcataaatggaagtatgttttgaaaatgctctgaatgatgcacctatatatcatataattttacctacgcacactgtatatatacgtatatgtatgaacataacattattatacataatatgtatatattatagattatattatatatacattatataaggtatataaatattgcttagcattagatttagtaaaaaataaagggctaatgaaatttttttgacaggcctctgtctcttgatgtcctgaaatgtttatctcactaccattaagataatccaataatcaaaaaggcaccccctagtctggtagcatataaacaataaagcatttcaaaatgtaattatttacatttagaaagtcattatattactttgattagctttagaataattcctgagaatatcttaagttctctaaaattttccattttcctcctttgcaattctaaccaacattctctgtaatattgaagaaatgctaagcattaagaaacttgctttgaaattctggtctccatcattcattatagtaaaccattatttcttctgcacatctggcttacagtaaagttgtatcaaattattctgttcatttattgcacaattagttgtatttcttttataatatttttgccttaggcagtatcaaaacttttaattattataaaattaaaattgttatcaaatggctgttctttggtggactatattattttacataattttaatgctataaattctaattccttccccactatatttaaaaaaaatttaattaattacgctgcattaaatttaaagatgaagacattaaatttgtaaatgaaaagttctaaaaataatatataatttttaaaaacaattacaaaacagaagtacattagtagcatgcaaacatttcaaaactggtatgttttaagcaagcattgtaaaaggatatataaaagaaataaaaaggaaggaaaaagttattgaacgaagtatgtttaataagttagcattcacaaacgctataggactataatgcttaggactataacctaagtcagtgagttaaaaatgtacccataaacacaagcttagagactccttttaagctatttccttccaaattttttcctctttctgaaaatggaatataactgtgcttttgtatttttcttaagaatccatactcactgaaagccttacaaagctaaatatagttgatccctcaagaaatgcaataaagaaaaatgtttctgaagttttttgacttctgaagtgaaaattgtcatatagtccattttatttttaattttttatactgaaactgtaaacctatcatttacgtcaaactcccatgcaattcattcaaaatgtaaaggaaattatacaaagtgagactccatctcaaaaaaccaacaaacaaacgacaacaacaaaaaacgcctagagcttaaaaaagaaattttcttattccaatgtttgattctggctcttgcataaatggaagtatgttttgaaaatgctctgggtgatgcacctatatatcatataattttacctgcgcacactgtatatatatgtatatgtatgtacgtaacattattatacataattatgtatatattatagattatatatacattatataaggtatataaatattgcttagcattagatttagtaaaaaataaagggctaatgaaatttttttgacaggcctctgtctcttgatgtcctgaaatgttcatctcattaccattaagataatccaataatcaaaaaggcaccccctagtctggtagcatataaacaataaagcatttcaaaatgtaattatacatatttagaaagtcattatattactttgattagctttagaataattcctgagaatatcttaagttctctaaaattttccattttcctcatttgtaattctaacataccttatttgtatatctgtatatttgtatatctgtatatctgtaacaaaagatacataattctaaatctcttctccaagtagcagaagcagactccttgctagtcaacctgacttcttgcaaaagctaatggttgttacctgagttttggttactatcatacctgtgaaataaattagcattattacaagcatgtcaaaaatgcagagacattaaataacttgcctaaagtcagaagtgagtcagagacccagctcaggttccatccagacactctgcttcccaggatcctgtaactgcattgggaatttgtaattatttctccattatttgattagaaatagggacaatgttgattctggcttcaatccagaaacaaacatgtggacacaggtttaactgaaagaaagctaaaagagaagattcaaggacaaatcccaatactctgatatttttcttttttccccacttgtatgactttttgtgaaagatccaataatatatctttataaagatatatatattttacaacttattattatgttcattcagagaatttttgtactgtaacttcaataatgttccattgaagattaagtaaaaacgaagtccagctgaaactttgctttgtattaagggtaataacattttacccacaaaaatatgaattaatatgtcatctcaactaaaatatggagataagccaaatttttcctagttataaaaaacaaggcaggttaataattgccaaggtgaaatggtcagtttatttgctctctaagaaaaacaaaagtattccctgaggtgcaaaattgtgaaatttaactggaagcatcgattatactctggacaagttgttccttttgttttaaaatcctctagaagattttctaatgtgtaataggcacttgttagctccattaatcgtattgtgtaacagtttcttactggaaatctgggttcatcatttcttctttccttctgatgtaactcaagcagttgtttgccatttgtcctgtggtccctatttattcactcagattccagtaaaataccaaagttttgttttctttctgttctttgttatctactggacttgagcactgacgatgtttggtcttcccattaaacatcttcctgtccttcacgtggacattttgaagattattaagggaaaggtaatcctgttgatttactggaaaaaagaaggaaaaaaaaagccagttagactgaagtgatttgcacacacacagaagaagtggaaattatacattcataattgtagagaattcaagctgctaatgttaaatttcaaaagcaaaaatatgggattattcggctaattcaataatgatctctgtggtaaaatgacatattttgaaatacaaacttatctttccttcttgtatgcctttagctttgtccccattcaagcaataatttagccttgtgttcatttcctcactggagggacataacattaacagcagctaacatgtggtatacttatcatgtgctaaacatggtaattttatcaactcactcagccacacagccctataagtaggtactgttaatgatctccatttcacaaatgacgaaactgagacacagaggtttaagtgacttgcacgaggtcacacagctaacaagaggtatagctgggctcaaaggcaatcctgctcagaatctgtcctcttttctactaaaggtagactatgctgtctttcggaaacttggctagcatcattacctcaggagaaacttgcaaaagttaatcaggcagtaaggactactctagggccaatactttgtggaggaattccaaaagccaaattttcttggagtaacattattccatggatgtactgccataacatggtggaagaactatcatcaggaaaggtcaaaattatggccaggtgcggtggctcacgcctgtaatcccaacgctttgggaggctgaggcaggtggatcacctgaggtcaggagttcgagaccagcctggccaaaatggcaaaaccccatgtatttttagtttctactaaaactacaaaaattatccaggtgtggtggtgggcgtctgtggtaccagctacacaggaggctgaggaggagaattacttgaacccaggaggcagagattgcagtgagccgagatcgcgccactgcactgcagcctgggtgacagagcaagaccctgtcaaaaaaaaagaaaaagaaaaaaagcaagaaagaagagttgtgaccttgcacaactgcaccaaagctatgaaatgagaatgagacctgagatcactggctgaaaaaagtacaagaaaagcatgatataataggacaacaagtacagtcccaccaagatcaggctgattaggctctcaaacacattaaacggacactgtcaattcttttttccttttccttttggaagacctttttcagagaactcttcaattaatacatcagttacagcacaattttcatccaaaccctctggaccctgtattgtgcctgccagattgaacacctgtccattatttgatacttgacccagtcaccgtgggaaggtttaattccagatcttgccgcctccagtccactcaagcttgcagcgaggaacatgtctacttaaggctgcatgaggaactagactcagacaaatgatcttatatccttgactgtattctaccagcataaatttctgatggttatattttccaaacttgactcccagttcaggaggcacccttttatgggacttataaaactccatgctctgattacaatgataacattttaaacttcaaatgtgccctttattaaaatatttagaacggagcgtattgtagatatcaaggaaaggggttgttaagaacagtcttcgttccacacaactagcagagcttcctcaggtggaggtaatcaaattccttcctgaaatgctggtttcaatgtcatctcaggcagagtcctgaaaaactagaaagtttatttgcacataacgtaggtctcagaaatttcaatggagaagcattttaaaattaataaaactaaaacagttttactagtgagttatcctaagtattcccattattgatgtaactagcagaaagtttacattaatagatgatcaataaatagttccaccttcacacacactttctgggaaagattctgacaatatgaactagaaaaataagggtaaaggtggataaagaaaaagaggaagaaaagaaaaattgaggtgctttgtaatgtgtcaacttgggtaggccgaactacagttcccagaattccttttgccttatgttttccattaggagcagttggcaggcagaaaggaagtggcagccatctttgcagctctcccatgctgtaacgtatctcgttggccttaagatagtggctaagcctccagctgtttcacttccctttggatataatttggagcctcgtttagcacattacaaatgggtctggcttctgtaggacacccacatcaaccaaggtcagaggcaacaagaactgacacaggtttcagtccgtcctcatagattccagctcctgcttctattacgctcatctactctctcgcttaactgcagttcgtacttcaagctccaacatcatccctggagacagctgcctttcaaagagtacttaaccagctcccacagttgcattaagtcaaatcccttatatatcctagaagctctgcttctatgattgaactctgcctgtaactctgaggctcctggacaggaaagtcgaatgcctcagaaggaattttgtcactgcaccattatttcttcctcccagagctctctgttcttttgctcacatctggattgctctccctctaggcctgctacatgaggcatgtaaaaagtaatactgatagacatttggcagatactcccaaatgtgtagcttcaggttccacacaacctatgtcctcccctgcatactagttaagataaaatgaaacgcttattcactactcatcttttcagagctttctcacctatgtgtttggatttttttcccctctgattctcaaactaattttagattggttccctagcaggaagagtacaaagatgttttctttttttttttctgccacaaaaaataaaaagtgttcttgctgaggaatatgtttgtttttctttctgtgtgtttgcaaggactgtggactggcatttattttatgcttctgaataataacatctttcttattaaagaagaatctccccagaaggtcacatgtcattaaaaaaacaattttaaccaaatacacgtaaattctaatagaaaacagattttttacccgtaacacatgaagaagaaatttagctatattgtataaaaatatgtagggaaaaaagaacacaagagctcgtgttaagtaaaaccacattttaaaatacgcctttaggaacacggaagatggaaggtatcagaagatacttgctttcattctactcctcggtgatgatgtatctgcttttttttttttttttttggatgaatttgcagtgtatcttttcatcctgatgcctaaatccagtctctatatgtacctcttttctccagtttttagacttttaaaatattatcttttcatgaagaattcaactaattggaaaatgcgtgattcctaccactatgacaatatctgaaagtagaatcctcagggttgcaagctattctgacaaaatttctgaactctagcagaaaatgtaaaaatatacatttgacaaaaatatatttgcccatttgaatttaaattttgtcttttttttactcagtttttatttcttagaaaaaggaagacaatctaaatataattccctgagatatagtttcctttcacttcaaaataactgtacattaggttgagagacaaaaaaattcattgtctacaattacacatactttctgattaatctgttggttagcccacatttagttcatcaggcacaacttatttttctgcatgtgcatttgggacaataaccgggcatatgaaacctttaaaatttacatttaaaaatttatatttgcacttggataactttgccaataactagaactccctcaaaaacaaaggctaggtccctgactcctataggcatgaccaagagtatactacaaaatgattcctctgagactgaaatgtttttttcctgcttccccctcagagacacattgtggaaaaattctagaacttttagaatagacattgtgtgcttgactccagcgatcaaagattctgaaatattgaggccctatttgagagtcatacacttatactagttttatttgttgttgttgtttataatctgaagaaatgaacttcagccatctagaacaaaaataattggatttgttggagggttacggactgaggtaagtagtacaatcagtgacagactgatacaagccaagggaaggcagaataaggaaagctccaaaaatctctcaaagatgtgttcttggatttattctgtagtatgcagcccttaaaatgttttaatttcagtggaattctggcctctgtgtctgtccatacaaatctcacatccctaagagggagaatccaattagcccagtcatcggtatttctttctgtttttttctttttctttctttcttccttccttccttccttcctttcctttcctttctttctttctttttctttctttctttcttctttctttctttcttttttttttttttgagacagagtctcactctgttgcctggctggaggatagtggtgcaatctcagctcactgcaacctccacctcccgggttccagcaattctcctgcgtcagcatcccacgtagctgggacttgggcatgcaccaccatgcccagctaatttttgtatttttagtagagatggggttttaccatgttggccaggaggtctcgatctcttgacctcatgatccgcccacctcggcctaccaaagtgctgggattacaggcgtgagctaccacacccagccatctgtgtatttcagtgtacacctagatatatggcacccacacactgaggccacacctttactccctggccccaaaatttttgtcaaatgtggctgctgggtgatctgttgtgagcaagaaaagctccatagtatgtgccattctcctactacaaaattaggaaatttcaagagaaatgaaaggtggggatctgtccagtttaatggaagattgcctggctcaataaagatgctcggcaagcctaagactgcatctccaatgactctttcaccaatgaattaaccataatacatgtacccttttctattgctgtgatgtatatagttgttacctttttatttgcctattctaatttctatgtaccctctctgaatgaaataagtcttaattagccaccagcccttctcctagcccatccaccaaggctagatgttctcctatgtatttacttctcttatatcacacatcactatattgtgtactggagcttctcttttcattccagggagatcaggggcttgttttttcttatttcaatatccacagcacccagcatatgcacaccacacaatagaagctcagaaatatttattatgcatggaatagtaatatcacctatttgtattagcatataatgtaaatattcaaaattggtaacgattaaacttgataacttacatgaagtgcttatgacaatgcctgatagaaaatatgcgataaattttcgtttccttctgtcttgaaacaatgtcatgattgtttaattcgttctgtaaagaaggaggcagcaggctggctcctgggattggtggcttacacctgtaatcccagcactttaggaggccaagacgtgtggatcatctgaggtcaggagtttgagaccagtctggccaacatggtgaaatcccatctctactaaaaatacaaaaacagccagctgtggtggcaggtgcctgtaatcccaactactagggaggctgaggcaggaggatcacttgaacctgggaggtggaggcaagatcacaccattgcactccagcctgggcaacagagtaagaccctgtctcaaaaaaaagagtgaggcagcaatgtacaaccaaagataatacatcatttcatgaagataattccaatgttagattaggaagctaccatgtccagcctgctgcatcattctttacagaacgaatgaaagagtcatgatgttattcttaataatgtagaactatttgtgaaatgtggatgcagtgaacgttgatgcagacaatacaatgcccctaaactcattttactaagattcccaaatttactcatgctttagcacaagaattttacatttcagttaagaaaggtgaaagaaacttctttaatctgtaatggaagaccttgtagcagaacaaaattgctaccaagaaagttgaaaagtagatatatataagaaaaatgtttttgtgacctggattcacaaagtctgggataatgttcttgctcaacaactatttaaattgggattccctgaaagcagagcctgagacaaagatttggatacaagtagtttatttgggaggtgattccagggagcataaacaagggtgtggtcaaatgaaatagaacagggaggaaagccaaaaagtacctaatgagtgggggtacactcatagacaactgaggctccaacctactgaaacctctgagagccccacatcagaattttcctctcaggtggcaggagaccaagagtaggtatatatccaccaaccccaggtccttgttgcttgagggttgcttctgtggtattgattccacctgttgtactatgatccttccacgtgtgctttaatccccagctcctcatttcttctctagagctaggttgattaccttcctctttttcactattgacttcaccctttccttccacagttgtttcccctttttactctatgaacaagcccaagtctattaaaccctagaaaattaaaatctctcttactcctgcctctagtaactttcctatttttctctccatttcaactatgcttattttttaagaagacagtccacactcactgattccacggtctctctttccatgaactcctcaattaaagccagtgacttctgactcctttactgcaattgcggctgcttacaagatgccacaacactcctcatggcagtttctcgctgaattctcaggctgctccttcttcctcaaaagttcttcttccacaggcttttataaaacccatccctcttagttctctgggcatcctccaagttttccatctttcctttatggagtattctttcctttttggtccattgaatgttagtgtttaacaactcccaaatatttcattccagctattacttctctctgtaactccagaagtgtttgtccagtagcctgttagctcagactaaatttattatagtctcttctcttcctcttccctccccttgggaagaaaggcttgccttcgaaagaagatagtgagttggcaaaaccagcatttactcacttcatttacccacttcaaaatcttgggattatcagagaacattcctcctcctcatcctgcatttccagttagtcaataagttctgctgattctaccttctaaatggtaaattctctccatcagcgccattgctgctgtcaccttaattcatgtgttcatcaccttggcataatctactggtatctcttagttgatcaatctgctcccagtttcttcctcatgcagaccatctgctacagagtataaaacattatcttgatgcaaaaaaagaccacattacttctctacttaaaaaggcttagaagttctccatcaagtcaacaatcaacaagctaaaatctgatttcttttatgtggtgatctagctagtcccagtgtcagtatccagaagccgctcaggtggtcccaatggctaaagccatcatgagccagccaacctggcatgtgtgggtgctttgaaatcaatggttaaaatctgagtgtgggaatggatcctgagaccttgtagccctaagtcagtattggcacagagccttctctgtaaacttaaattaagtgtcaacatttagaagtcacttactatgagccaggtactctctgaacacttcctatgtactaattcatgtaatctccagagtagccctttgagatatgtattattatttttaattcccattttcccagtgaggtgactgagacataaagagagcaagcaacttgcttaacatcatatatgccacgatttgacttgaagtagactgttctagaagcagggtcttatccatttgctatgggctttgttagctttacacagaggctgtggggttcccaggcttagaacataattccagcctgtgcagggatctagatgaatcagaggtgaagagtggaagaaagaagcagagtggaagcccaagccactgatggcaatctgaacttggagcgtaacatcaccaggagaatctttatctccacatcttcccaatcctctatagttctgtcatccaacacacacacagatacagacatacacacgcacacatagacacacacacaatccatgagaagctttcaccagatcagaagtggaattattgctgcagaaggtaatgatggatggccccagaccacatgagaatgtttttaaaaatgacaaaatattgggaatataacaaacaagcaaaaaaatgggacccatctagagagccacatgtggtctctaattcctccctgcactgtgggtttggaatgaacactggcccctaagaaccgagttagccatgccctgttcttctcttgaatataatgggaggggatgtcagggaaatggagatgtctcttctcacaatatctgctaatcaggattgttcagggccttgtgcaattaattttagctttcaaaaaagaaataatttctcagaactccatggtgaggaaataggtcatactcattagcatagtcatagaggaagaacagtgtttaataataggcctggctgaaataggctagcagtgaaactagaagggcaaaattattctgttaatgaagaattaatgaagattttcgagtttccttaggtaacccaagaagaaaggtgtgaaaaaggaaggagtgaatgagataagaatggggaggaggatgtgaggaaggaatacatcaagatgccagggagctgagcaagaggcagccagggagaagttctgggctatggccaaggatctttaaagagcaaggatctttaaatagtcagttttaagatgtttggtgcagcctaaattcctcttcctcttcccctgcctgaatcttccgtaagaatctactacacagagatgccttgtatctgcagcattttgagaagagggaaagaggctgttgctttgggaatgatgcagagtggagaaaaagaacagccaaaagaggctagacttgagagaaattacagtaattcagtaaaagcaggaaataatagaaaaacattgactccaaagatcctggaaggtgccagcaagtgaggttaggtttcccactgtagatgtaatggaaacatggtttccccaccaacttcgaggcttgagagcattcaggtaactgatacttgttctatgttagtaaagcggatatgtgtcttttgacaatttacatgtgaaataactgcagctgttttctaattgaatttcaaggctccattccatgggctcagagaaatctgattctctactgctttcagcatgatatcagacaatttagagtttctctccagtctgggggttgcatatgatttctggggtttggggtggtgtgaagttggtataatatcactacaactgtctattcttgctctagtcactgggacctcagcctgagggactacacagattgctgccgcaaatccccccgcttccttttcagcaatgcaagggaaaacatcacattcttttgatttcccaccaattcatcctctttccaccccggcaaattgtgggagtgggagcttctctgattttaatcttttttcatctgttgtttctaatattgctggctgtgacaatccgcagaggaaatgcatgcctacctctagtctgaatggggaaaaacaaaatccagtatataagaaaatatatggtacagtggctgtgcatggtggctcatgcctgtaatctcagcgctttgggaggccaaggtgggtggatcacaaggtcaagatatcgagacaatcatggccaacatagtgaaaccctgtctctactaaaaatacaaaaattagctgggcgtggtggtgcatgcctgtagtcccagctacttgggaggctgaggcaggagaatcacttggatctgggaggtggaggttgcagtgagccatgattgtgccattgcactccagcctggtgacaaagtgagactttgtctcaaaaaaaaaaaaaaaaagaaagaaaatatatggtacaaactaatacctacaaatatcattcggttacattggctttataccctctctttctattagttcaaaatagtactcataaaataaccatcctgtaaagtaatgaaactgaattttcttccattgctaatttctcctctgacctaacattaattatctaagaacttaagtgtttagtgctctacatcagaggtcaacaaactattgtatcgcccacagtctaaactcgacccatggtccatttttatatatttaagtagttgaaaaaaatcacaaatagatcgatatcctgtgacctgtgaaaattatatgaaatctaaatttcagtgtctacaaataaagttttattggaatataggcatgctcatttgtttatatactgtctgtagctgctttcattctataaccacagagttgagaagttgcaacagaatgtatagcatacaatgctgaaaatatttaatatctggtcttttacagaaaaagtttggtcaaccttgtaggggaaccagcccgctataccacccgcgggttctccccttcccagtggagacgagggaatgagaaaagaaataaagacaaacacacaaagttcaagagttaacaaaagtgggtccaggggtccatcgcaatgtggaaactgcgacagccctgagctctggattccactgatatttactgagtacagttcctttgatcctataggctgagggtgggcagatggtggggtgatcacagggtgaccatggggagaggtggcagagggggtagcatgcgtcatcagcaagttaatattatttactgttccactgtataagctaatactctatgtttaacttacagataatccttaaagtccaactaattggttaacagaacaggacgtgaaagcagacagcccgtcagaccacaggcctgtgcatcaaaggagcggtccactccaagcaccatcagcagggcagcagagctctctgcctctgggaacgagcgagagatagaagactttccccttatcctcagaggacttctcctcttttacaagcaacctcctgctgttcccttctggggaatggagcaggggtcgcttcccttcccacaagacctttgttcagggactcaagtgggaggttgagcaataagcaagctttcttgcttagaggctccgcacacttcctgtggttgtttgttccaccctgcagttaggcaagcaagctcaccgcctgattcttatattgtcggactaagcagaagctattcttatgattcatgactatattaataaagcactattctaaagcatattttgttaatccttaaacaggcacaccataggccagccctcaaccacctcggcccacatccaagcccctgttttgacccacatttcccccattttttaaatttaaaacagccatctcaatcataacttgcttgtggttttgattttctttcaggagctgccttccgcatctgcagactaaaaacagacaacataagcagacacaaattaaaacaaaattagcaatggcagagcttcccagagttttaatccatttgatagaattgagctccgagagcctatctgcagctccagcaagcatttctgctccaggcaacaaatttaagtgagcctgcgatgctgcaaaaatctgttcttttaatttagttatatccagggttagattatcttctcttccttgtaagtggcatcagaccttttcccactgatgttcagtaacattataagaataaggagtaatacaaaaagcagatgtattccaatcacattgcatttgcatacgatgctctaaatgcataaaacgatctcttatccaggtgactgtttgcctcaaatcattaatttgattggccaacttctgatcaatttttgcctgagaattccataatctggtggaatttttctgccaggcattaacataatgagcagtttgaatggaagaatgcaaggcaacacctgccacagccgcggtggtggtgacagcaatcaagcccataatcacagcaattaaagtaaaaataaatcttattgtacgattaagaatcccttttaaaactccagttattacatgaatagagggaaaagtctcccaaggcctattaagagtaactggaatccaaacgccctctcgtgctcggaccagcaaaatgctattcctcatatcaaaagtagaatgaatacaagtaaacagatggcaattgtcacaagtaatggtttgagagtcaggtaaaatgataagttttccaacaactaacatgtaaggaggtttaacacaactttgaagagaaatagactgattagactgaagaagcatggtaaacagtagcttattacctcttgttccccatgatgcttcccctttccacactctcattccggaggtagccataagcaacttccacaattctggatgttccagacccatgactggactaattatctttggccagggaggagcagtacctttatcttcccatttcaatggatatagtgattccaatcttctaactaaagtggggggattattgggactttctctataatctatcatgaaggaatcctcagcgcacccagcattttgtccagtgcaatttctggcaaaggatcctttgggggcccaatctataattattccataagaatccttttgcaaaactactgcaccatctgctacacagttgtcccaagcaagaatctctagtttttctgaccattttggatttcttttaggacaagccagtccttgagatttgtaattttttacttttaaatttgaccgaaaataaccatccccataagtttttacagtcatgataggttggaaagacattccactcactacgtgataactgggttgggaacgattatgaggaggtacatagattatccaactatgtatttgcaatggtaaacatcaaggagcaattcctaaacaaattggagggtattcataccagttacattcatcaacataccctccttctcaggctgtgcaggacagccatcatcaatcggcccaggcatccaaaatactatcatttgtataaacttcaataggggaatccatccaagtaactggcctaattaaaggaggaaatggaacagaagccagtatgtaaaattttcttcagtccagacagcagggagacttaccgccgcggtaattaccatcaaggcagccaagatcatattacccgggataattgccagttgtttctcctttaggctgccctctgccatttgagtcagcttctttatctgttctcatgtcggtggtgtagcctggcgggtcttctccgtcttctgttgtttctctgagacgctcagcttcgtcatctttctcagctcccgaaaggacaggtcggagggaccagtcttcttcctctttggattcttccctttcttctgtccggtcggtgtagggttcattgcagaatttcaaatgtctattgggtatctaaatgggtgtttgattgtctcctggtgaaacacaagcaaaagcccttccccgcgtcataatttttcttaattcccaagttttagttctggtatccttccaccagaccgtttttccttcatgtaaattaactttctgtccagaaaagtgttgttccgctgctgtggagacctgatctctggaaatgttcaaaaaatttagagtcaaaagggctaattgtaactgcctatggggcgtggtatactccttactgcttccccctttcttttgtttttccaattgtgtcttaagagtccgaatggccctttctactgtggcctgaccttgcaaattatagggtattcctgtagtgtgtacaaatttccattgctgaacaaaactttcaaaagttttactgcaatatccttgtccgttgtccgttttcattttctgtggcacactcatgactgcaaaacaagataataaatgtcgttttacatgagctgtactttctccagtttagcacgtagcccagataaaccaagagaaattatcaacagtaacatgcacaagagaaagttttcccagtgatgggacatgagtcacattcatttgccaaagagcatttggtttaagccccctaggattaactccaggttcttgagtaggtagctgtagcacctggcattgcggacaatgttgcactatatttttagcttgtttccaggtaaatgaatatttattttttaatccagcagcatttacatgagttaatgaatggaattcttgaggctctgttaaaacaagtgtcactaataaatctgcttgattatttaattgggttaaaggtcctggtaaatttgtgtgagctagaatatgtgtaatataaacaggaaaatttcaaactctaactgcttgttgaagtgaactaaacaaaaaatttagctgatcatcagaaatatattttattaaagctgtttttaccattgttgtcgcctgaaccacataggcagagtcagagacaatataaacaggttgatcaaaatcttccaatacaaatataactgcttgtagcttagctctttgtggagaatgaaactgggtttgaataaccttttcttctggtcctgtataagctgcttttccattctgagagccatcagtaaagacagttacagccccctccaagaggatagaactggttattttaggtaaaatccaggtagccaattttaggaactgaaaaatttttgttttagggtaatgattatctatatggccaacaaaaccagctaaattagactgccattctgataaatgtataaaggcttgttgaacctgtgctttgtttaaaggaactacaattttatctggatctgtgccagtgaatctaactattcttaattgggcttggcctataagaatagctatttgatctaagtaaattgaaaaagtcctagttgtactgtggggtaaaaaagaccattcaaccaagtcaacatcttgaataatcactcctgtaagagaatggagagtaggaacaccaagagctgtaagggaacactaggatctattctactgacttgagcactttgaattttttcctcaattattcttaacagctgaagctgttgcaggcgtcagagttcttttgctatgtaaatttggatcccctctcagcaaagcaaacaagtcagacctcgcataagtggcaattcctaaggtgggccttatccaattaacgtctcctaataatttttgaaaatcatttaaagtttttaaggacttcttacgaatttctaccttttgaggcataactgttctctcctccaccttcattcctaggtaatgatagggtgtagtagtttgaattttatttggcgctatagcgagaactgtaagccccaccatttcttgtaacatagaaaaacatttgataagtctatccctacttgtagcagcacataaaatgtcatcaacataatgaataatattaacaatcaggaaactgatcctggacgggctgaatgaccttcccaacgaaagtttgacgaattgtaggactatttaacattccttggggtaaaactttccactgatacctagtagctggttccttattatttatagcagatattgtaaatgcaaatttttcaaagtcctggggatccaaaggaatggtgaaaaaaccatctttcgaatcaaatttttttttttgagatggagtgtcactctgtcgcccaggctggaatgcagtggcgcgatctcgctcactgcaagctccgcctgccgggttcacgccattctcctgcctcagcctccggagtagctgggactacaggcacccgctaccacacccggctaattttttgtatttttaggagagatggggtttccccgtgttagccaggatggtcttgatctcctgacctcgtgatcctcccgcctcggcctcccaaaatgctgggattataggcgtgagccaccgcgcccgacccaaatcaattattaccaccggccattctcttggaatcatgactggggatggcaaccccggttggagagcccacatcggttgaatgactgcattaaccgctcgtaggttggtcaacatgcgccatctaccggattttttctgaattacaaaaaccggggaattccacggtgagaaagaaggttcaatatgtcctttgtctaattgctcttttgctagtcaatgtaatgcctccagtttttgctgaggaggcggctactgatcaacccacacaggtttttgagttttccatttcaatgggatgggctttggaggctcaacagtggccgcccctaaaaagagtacccaattccttttcggtcaagtttaactgaagcttcaattggctgagttattccatcctcattctttcctaatgtttttccaggagtataccccaacttagtcatcatgctttgactctctgaactgtaaatcatagagggaatggtgatttccgtaccccactgttgtaacaaatcttttccccacaaattaatgggaatggcagtaattataggttggatggtgccttcctgtccatctggtactaaacagtgtaaaattgtaacactctgataaacttcagatgccatgcctattccaattaaacccatagaagctctctgtttgggccatgtttttggccactgatccagggctgtaacagaaatattagcgcctgtatcgacaagtccttcaaagagttttccctgaatcgttattgtgcacacaggtctattttcagaaacttgacttacccaataagttgcttttcctttgctatcagtgctgccgaaaccaccttctctttttactgtactttctcctacttaggtaataacaacaattaggtaataaggtaataacaacaattgagcaattctctctgcctggcttgcactccaaggaatactagaactaataaccaattgaatttctcccacaaaatcggaatctatcactccagtataaatttgaactccttttaaatttagactaaatctccctaaaacaagtccaactgttacctcaggtaaagggccaaatactccagagggcaccttttgaggtggttcccctggaagcagagacacagctctggtgcaacataaatctaaagcagcgccccctgttgtaactggcgccaattatgttactgtggtggtcacttgagggattaagggcactggtgcccactgacggacaaactgctggagagggaatgccccagtttggagtggggcctgaggctggcccctcttcccatttcccaattgcgcctgcaagggttggccattttcatcaaatttggagtgacaccgtttagcccaacatttacccttctggcacctgggacataagccaggtggctcctttgtttgattagatctggattgtttgtttgatttgttcttatattccttttttgtatttccaaattgcccacagttataacaattgcctgaaaagtttttcactggatctcccacctttgatcctgccatgttttgagccattatcatagccttatgcatgattccaccaatctatcacatgccctgatatactcattgattacatcaactcccaccagaacctttcctttcacagagcgaataggtgattgacagtcagggttggcattttcataagccaagaattctataatcaccttcctggcactttcatcagtgagagccttctgagctgcatcttgaagaggagcaataaaatcaggatacggttcttttgagccttgtctgacagaattaaaagagggataagtagttcccgggtcctgaattttttcccatgccctcaagcaacaattgcgaatttgctcaacggcatcatcctgaagcactaattgttgtacagttcctcattggcccccaactcccaacagttgttcaagtgaaatggcaacaacaggattagcagcacggtttttttgatcttgattttgagcctcatcggtccaccaacttttaaattgaagaaattgggagggcgaaagagtagcttttgctaaaatctcccaatcgtccggggccaatcgcttgtcctgagttactgagtgtaatagtgactggacagaaggcgaattgggaccttactgaccaacagctgctttgagatctttaagcagcttaaaagaaaatggttcccataccgcctgatgggcaccaccctgctgctgtgggagttccaaaactactggaaactgccaggcatcgggatctccagctaacctagcctgccgaataaccatttgaaatggtgattcattgacattaggtggcagtgcagccctatgctgtactggtgctgcaaaacgtgttcttgattcctgagcccctaatttatccattcgtgaaacagggcaaattggagattcaaacctccaaggctccaggttacgttgccttattggaggtggccactccggatgatcccaatgaggagccaaagattcctcaaggcccttctttgttttaaacatattggcataaatagcttctctattttaggagcagctggaggtcccacatgctcctcaaaagaaattaagtcatctccaggtttgtctgtactttcctcaaaatcttcttcactatcctctcctccttcaacttcctttatatttatattggcggcagcaccgccttcctccgctggaattctttctgccggaggataaacctcgttttccatttgaaacggttccaaggctgctttaaccatagcccagtctgaccagaccgttagaagaataagttttccttccttatgaacttgttttaaggcaattccaacctgctcccaatcttttaaatccatggtaccttattcaggaaaccaagggcaatactgctctactgtttgaaacagagtaatcaagttttctgtgctagcctttattacccccctctttaagaggagtttgataaagtgtaagtaagcagagtgcttacttcccgattgtcccatggtgtccctggaatactccgagcacacaagcttaccgcaaggccgaccacacgttcttgggagtccctcgacagactggtctccgcaatgaccatgctcaggtgtaactccacctgggtacaaggagcccacactgggtgccaaagatgtaggggaaccagcccgctacaccacatgcgtgttctccccttcccggtggaaatgaaggaatgagaaaagaaataaagacacaaagttcaagagttaacaaaagtgggtccagggttccatcacaacacggaaactgcgaaggccttgagctctggattccactgatgtttattgagtacaattcctttgatcctatgggctgagggtgggcagatggttgggtgatcatagagtgaccatggggagaggtggcagaggggcttaacagaacaggatgtgaaagcagatagcccgtcagaccacaggcctgtgcatcaaaggagtggtccactccaagcaccatcagcagagcagcagagctctccgcctctgggaacgagcgagagatagaagacttcctcctcatctctaccgcagaggacttctcctcttttacaagcagcctcctgctgttcccttctggggaatggagcaggggtcgcttcccttcccacgagacctttgttcagggactcaagtgggaggttgagcaataagcaagctttcttgcttagaggctccgcacacttcctgcggttgtttgttccactctgtggtcagtcaagcaagctcaccgcctgattcttatattgttggactaagcacaagctattcttatgattcatgactatattaataaagcactattctaaagcatatattgttaatccttaaacaggcacactgtacgctggccctcgactacctcggcccacatccaagcccctgttttgacccacaaacctctcctctataccagtgtgtttcacccgctatcagagttttacttgtttccttatctagattggggagagtcttggatagaccggcctgccatccaacgtccttggtttttagccctggaaattatttagttcttctggtaaggagagggcattttctcttacctggttaatctgaattcacgtgtgttttgctagttctcccctgactttgggatctttctcatggaaggagaaatgcaatgtggaagcctttttacggtaaaataaaaaattataaggccaaggtgggtggatcacaaggtcaggagatcgagaccaccctggctaacacgttgaaactccatctctgctaaaaatacaaaaaattagccaagcgtggtggcgggtgcctgtagtcccagctacttgggaggctgaggcaggagaatggcttgaacccgggaggcgcaggttgtagtgagctgaaatcgtgccactgcactccagcgtgggcgacagagcgagactctgtctcaaaaaaaaaaaaaattataatatatacagctgtagctttcctacataatgccgtgaatttaacatgaatcattgtaaccccaatcatgccacatactcctctgctagtccgtatggatgcatattacaaatctagttgtcacctgcagatctctttatttctgtgaataaaaacttatttgacccagaaaccaacttttataaaatcactccagattattccttataaccatgataattttgagtccttatttcatatcattttgttttgattaacagcttttttaaagtgaaagctgaggtttaattttcatgcctttctaacatttttcctatgaattaggaaacaaaatctgtatcagcccatatttccatatttttggaactccctcacctaattatccaatttttctacttaattaccaacatatatctagttacatagttctggtttaactgttttggtatagtgctggtgggaaacaaggaaaaagatgtggattattttccttgtagttttaaaaaatggttactcatatctctccgtttaaacctctccaacttggtgtgtcttgggaaggaagcaatttactcaagattttactacatgattgcagctttgaccacattttcagtgaatagagaagatgacgtaaaaacatacatacaagaaaaatacaggaagaatcatgtagtaatcacaactctgtagaagtaaagccatgtgaaaactgatgaaatgcaactatagatgaaattgtcagaatcacgaaggttacatccattaaatgagtgatttttgaaagaaaagaacataaattggttatgaaggaagaggcagttcagaccgttacaaacgttaatattgtatgtcgacggcagtaattaggtattttcaaatctaataataaagaatcaaaactaggcagtaatgagagatgttctgataattagatctggggaaaacagagcaaagtaaaaagagccttgaaacattacttacgcatgtggatttgatagaattcgttgacataattatataatggctggttgattagattatatacatcaacttttaagtttttgagcaaaagagttatgggagaaaaatctccctccccaaactcccgaggatgcttggcaatcaatgtcaggagacatttttggtttttacaatggacaggggtttgctctaggtatacagtgggtagaggccagggatgttgcggaacctcccggaacgcacagaaccgccccacaacaagaatcacccagcccaaactgtcaatagtatcaaggttaagaaactctgggctagattaaaaggtagagaagttaaccgtgctacaatttaaccaaaaggtgtaagaactaggtcagaggcctccaattagtcctttgtttggcatgaccagtctcttcttccattaagttacccagaaagccaagttatatttttcaggaatattcaaaaattaattttacgttctgctcttaataaatttggggtttatacccattaaaatggatgagtcgcagaaacacaatgttgaatgaaaaaagcaagtaaagcaaaaatacattcagtatgatatcatttatataaagcttgaaaacaagcaaaataaaacatattatttagggatatccatagttacatgaataaaatgaaggaattcaataacattgaattccggatagtatttatgtctgcaaagaggaaagagtttgaagaaaatgtggcagggagcagtccttaaacatcttaagttcttttttttttttttgtttttttgacagagtcttgctctgtcaccaggctggagtgcagtggcacaatctcggttcactgcaacctctgcctcccgggctcaagtgatattgtcctgcctcaacctacctgggattacaggctcgcaccaccacgtctggctaatttttgtagttgtagtagcagcggggtttcgccacgttgccttgtctcaaactcctgacctcaaatgatccaactgcctcgggctcccaaagtgctgggattacaggcataagccactgtacccagacacgttttgattaaattctattttcaaagttaggttgtgggttcttgagtgtttcgctcgttattgtactttatgtatgcatgtatgtatgtatgtagaaacagtttccttaagttcctcaggctggtctggagctcctggcctcaagtgatcttccagcttcagcctcccaagtagctgagattacaggcatataatgcgcccagttgtcagtattgtactatagagtttacatgtatgttatatattcttttgggtgtatcaaaaaatcacataataaaaacaaataacatgcagttataaagtagtggatttgtccctgaagatttttcctttaagttctgtcaccatctgcaggttaaaactaggtattgcagaaaacttgtttttcaaagattaaaaagtacaaacggctggatttctgttacagacatgcttacaatccatctgtggataaggagcatacagaatacattaaagagataaacattatagcaccaagtgttttgttttttttttgagacagagtctcgctcaggctggaatgcaatggtgtgacctgggctcactgcaacctccacctcctaggttcaagcaattctcctgcctcagcctcctgagtagctgggattatagtcacatgccatcacacccggctaatttttgtatttttagtagagacggggtttcactatgttggtcaggctggtctcgaactcctgacatcatgatccacgcgcctcggcctcccaaagtgctgggattacaggcatgagccaccgtgcccggctgtgttatcttataagtaccacctggttagtgtcctaccaaatatcaagaaacagaaatagtattttcacatcataacaactgatttagtttatgtgaataaaaatttaaatcccttactttattcatcctgctactaccttaggccaagccttcattacttcatgacaggttggcacctgttctccttgtcttcttttcctagtctttacaaaacattgccactagattgaagtcttcaaataaccatttcattacagcattgacctcttccaaagtctcaaatggtttcacactaactgaagaacaaagtccacactctttagataagtagttgactttctatagtttggccccaacctggtaataaaccttgccttctcccacctccccatcacttaccatatataaatcctctacttcagccagtctgttttttgtccattgcttactctggatgtgtgatctgtgttcttggtatatcccacttccttgaacatcattctgcaatttggaacttccaccccctgcatatttaatacatgtgttaggttgttctcttgaatgtggaaaactgaaaggcagtttcaatgtttatctcttagaggccattcttctgtttcctatctacatttccacagactgctgcccctaatttcatcctacctataaatcctagagctatcattatctctgagacaaaacatccctattttaaaaatctaaattaccacagcaatcagtgtctacatcatttgtttggcatagtgacggactattaacactaagtcgattcattctgataaagtttgtttctaaaaatagatgttaaatttctgaaagccaggtataattttatcgcttcttgttttttttctttccttcttcccttacaaagatcagtaatgctcatatttgagtttgagatccccttttcaatgtaaatatttctcaaattcctcttacctcccaacaaacaatagtattgacattctggggcttcataaattcagaaaacatcatgactagtagatattataatttcatgcttttgaatttattagaattgttttaatgataacagcttctacatttcaatgtaaatatttctcaaattcctcctacctcctaataaacaatagtattgacattctggagcttcataaattcagaaaacataatgactagtacgtattataatttcacgcttttgaatttattagaattgttttaatgataacagcttctacatacgtttaataataatacatatgtataaagcaaaataatgatgatagctaatatttcgggcctcaacatatactagtgtttttatatgcgttgtatttaattaaaaaaaatcttaaaggaatcacatagacctccgtttaaatttaggctctaccacttgcagctgctacaagtttgatttatataatctttcattgccaaaacgggtcagattcagaaccagcctcttcagggtaactgtgaggatcaagaaaatcacaacagccgaagtgctttacagtgtgcctggcataaaacaaactctgagaacattttttaaaaaatcctttcaaggtaggcagtatcattccttccccctcatttcatagatggggcaattaaggctcagaaaggcacgtcgcttgtccaggatcttggagtggtggaattaggatagggcattctggactacaataaacacctgagcgtttagctgctgtgttctgagctcccacagcactttttcttacaacacaaactttatttacatcacactccacttccgcatccttcactaaaatatgagctcttcaagggcagggactatatttttgctaccgcagtagttagcgatacacacacagaatatgaggaaaaagtgtctgaccaacgatcaatgcactcacgactgaacctacggtggcagattgcagtgggatagaagagctttatgtgaattgcgtactgagatgcagacctactattttgggaacaatttgtttttgttgttgaaacccagaatgcaattcttctttttacctttattttgcttaaaaagttattccataattataaactgcgtaaaactagaagaatgcccttgcactcaactaaaactgacaggtgttttacctttccagtcaggcacattgaaggccttgtgactttattgatttttgttttttaaagggaggacctgccaatttattaatcttaatagagctgtaacaggagagtataaataaaaagatagttcagagaaaatttactgaaattaagtttggattaaaatcatctggctcttttaaggaaaagggacattaaccaaaagtggcgttaactatcaacaatatttatgattctctcactcagtagatacataatgacgtctggcaaattgtttaacttccgtggaacaatcccctcatatgtaaaatcaggaggttggactacattgtaagtgtccttttgtttccacctcttcgtgaccgaatgtggggtgaggaaggggcaaaaaagcgatcccggtcttggctccttcttccggcacgggccggagctgacacccccacggaaaaccgcacagcgcctccgctctttctccacgggctgagggatcaatgcacttccgcataggcctagggccccacgctccgcgatcagcgccggaagcgcacggcatgctgggatttgtagtcctccacctgtggccggcaggcgtttagaacgcgaggtctagttggcattctgggatacatagttcctgggcgggtgggggcggattcgttggtgtaatctcttttcggcttaaagagccagaagcgacaccacagactccggcgggtcacatgactccagtctagctcgcattgcggctcccgcccgggcgagttctcgcccccgcgcggccgttgccgaggagacggcgcatgtcccgccgcgcgttgccccctctgcagtacccccgcccctcttctcccaccacaatgagatcctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggtaatgcctgcgcgtccccagcccttggcaacctagggcggcgcgccccagaggcgggagagtaacggctccgggacactcggccctgttgggtctggccacgggcccacgcctcctctgtaggttcccgggtcttcctgccccgggcttcccgtgccctaggcggtcagtccgcccgctccctcaggactgatcgccgggatccccgggtgagcacctcgcgacgcgttggtgattgcaggactcccttcttgcctcctcgcccctcctgctggccctgtcggggaggctgttctgcgtcccggtggctccggctataccccttgcgggcggaggaagcggagcggggactctggtttgggtgctaggggcactgggtcgagttcttagagaaacaggccttggtggccatagttcttccccgcgttccctctgtggaactctcggtgtccagagtttggggtgtagaagggcggatgaggagcgacgcgactctgaagagttgcagttgggctgtgagctgcaggatttccgccgtctctggtgctgtgggagccgatgggccgggggaggcgttcctgggaaggttaatggagtaattattgccccttctttctcccttcctacctatctagttagaattgggcctagaaccgggaaagactaaatgccaagtgggactgggggaaacgttgtttggtttacagaaactggcgtttggggattaggccccgccagggaggctgggcgcgccaactttgcatccctcagcctactccccaggaactcgcctggtttaattttttttgttttgttttgtttttttgagcgagttgaggtctgtattgtgtgtcttacgggtgacggttcgtgtttgggcgctggaaggagcgggctttctgggcgcccctaccacccccgccccataaccgctttccagactccgcctgctggtgttctctggttaccggagtgggtgttgcagagcctcgggtgcacctgctcctttctttccctagcaccttcctggtgaggacccctgaacaccaatataatacagagtttttgaattgaaggtaaacctggtatttatgtagtgacgaggttattttattatgaagtacagtagcttttaaatgagcaaacatttttaaaatcatcggatatacgaggttgttacatagtttgagtaacaggaagctcgatcaatcagaggagtaaactttggcatagactattaaaggatagttagggctaaccatctttgttacactgttccgaaatagatatcactttgctgtttggtaagatttcagaagtttaggggatttaagcatttatgcatatcacactattttccaaaagaattgaggtaacttaaatttaaaatatgaataagttatatttttccccttcttttgatctttctaaacatactttagaccaaaactgaagtattttttattctgtatttcatagcgtaagtaatttacttaagtgatacatatttttaatcctaattaggaaacagctttgaagtgtggagcgggaaaggagcagtttctgagctgcaaaaactagtttctaaacaggtaatttgacattattatctgtattatcctttgtattagagttggagaagactttatggtggacactgctgtcacagttacagtgcatgactgaggatcctctctgcttagtaaacaaactttctgggttcaccgccctgtttgctctgcttttcggcgtgctgctttggcctgccggtatatctttgttcggaaaggccctgtcattcctaattattaattactagaatggtttatgcagtaccgtttgaaatttatttgtcttcacagaattttttcaacctgtttgaatttgtcctataactggatagcctctctttccaaatccatttaatctcaagttctctcctacaacattcctattaattggctgttcatgaactctacttgtcgaacttgttataccttgaccgaaatttagttgtctaaaattactttattattattttttgtacttcgatctccctttcctggtataaagttacttgaaacattacttttagcgcatagtacattgtcacatgcaagtgacataaaggtattctctgtccagcagaataaagtcagtgttgtagaatgtaagttcactaggagaagttcaataattgtttgcaaagggcagtttggaaaaatggctaaaagataattagaagtttgttaaaagctttttagaaataattgctcttcagaaaaaaacctcagaaataaataacctaaatttaattctactcttaaaattttaagaaagttcattttgaaagttttgtagaaattggctgggcgcagtggctcacgcctgtaatcccagcactttgggaggccgaggtgggcggatgacgaggtcaggagatcaagaccatccggctaacatggtgaaaccccatctctactaaaaatacaaaaaagattagccaggcgtggtggcgggcacctgtagtcccagctactctggaggcagaggcaggagaatggcgtgaacctgggagcaggaggttgcagtgagccaagattgtgccactgcaccccagcctaggcaacagagtgtgactccgtctcaaaaaaaaagaaacttttgtagaaatcaatatatattcttgctttctacaaaagcagacagatttttattttatagctctcctatgaggacctgaaatgagactgtcatgagaaaatacgaataggtagttgatgtatatcttaattataattctcagtgggtttttttttttttaaactggaagactaacaaaacagggcaagaaaaatggaactcaagggaaaggtcacatgtgaatgtgtgtgttagagttgttaatactacagtgattgctgtatggtgggctttagtaaaataaacaataattacaaaattagttataagattttccttttagcacattggggaagatgatggataagacgaataaaaataaagggtaattgagttaacttaaattggaagacctgggttttttcaataggagatttggccatttttttctgaaggaggaaagtggatttgagacttggagaaactagtaaggctgtgagattcacagtacagaactaagaagacaaccagaaatacctatcagtactttcatttttacggatttgagtgctaggcaacgtgctatgtaatgactactacagataaaacagtgtgcaaaacagacagggtgcctttcttcatggagtaaatttacattttaaaagtatctatgtgtatgtagagtgtagtatatcttaatagtgatcacaggcaatgccattttatgatcatttccccactttttgacagcttgagaatagtagcagagaaaacagacagtggagtttagccagaattgagtcgacacagtacgcaagtaggtgaggaagtgaaggatgctagctagcaaggcatttttgcaatgacttagttgggtttgggtttgagtaaagaatcaagggattgatggatttagggagagagaaacgatcaaggggctggtagtattcaggaaggctaagagcagtttcagcaggaatcaagtgagagaagtagaatgcaaaaacttatgatcagaaagaggaacttcagaagttcaggatcctgaacaaattatcagttcagtattggaatagagaagatgagatggatattggaattgaggccagagtcctagaaaagtcattgcaagtgtttagttcatgcaagcagggaatgaagtagaaagtgaaaccatgcgccagttactgtcaggaaaagtacaggcatatcttggatattttcagaggtgattatgagtaatttaatgccatttgagaaaaaaataatttttttcgttactgatcactttgatttttttttttttttttttggagacagagtcttgctctgttgtccaggctggagtgcagtggcattatcttggcttactgcatccctctcctcccgagttcaagcaattgattctccttactcagcctaccaaacagctgggattacaggaacgccccaccacacgtggctaatatttgcgtttttagtagaggcggagtttcgccatgttgaccaggcgaatcaagtgatccgcctgcctcagcttcccaaagtggtgggatcacaagtgtgagccactgcacccagcctgattatttgattactttgaatttcttctttaccttatattcttatttcaaaggtaaactgtagtcataggtattttcatggtaattaatactgtgatattctactgtaatatgtctctatagttagaatcctgcaacgggatgttcttttttttggcgatggagtcttgctctggcacccactggagtgcagcagcgcagtcttggctcactgcaacctctgcctcccaggttcaagtgattctcctgcctcagcctccctagtagctgggattacagacgcgtgccaccacgtccgactaatttttgtatttttaatatagatggggttttaacatgttgatcaggctagtcttcaactcctgacctcgtgatccgcccgcctcagcttccctaagtcctgggattacaagcgtgagccaccgcgcccagcctaacaggattttcttaaaaaaaaaaaaaaaaaaaagtcattgaaagtagcttaaaattgccatagtatattttcatttttgtgtctttgtaaaaaaaaaaaaaaaaccactaaggctgttaaaaatagctaaatgaaacttgaaagtaacagtttcaacttcgtttagtaaggcatagcatgagtagaagtgcgtgtttaaagtagaaggattttatttttatccccgttcagctacccgtagtactgtcatcaatcacttctaccaattgttttcctacagtttcaactttcttatcttactgtctttctgtttaacttgcatggcaaaatttcaaccttgggtggattcagtggagtgtttatattgagggatatgagcactgctggaaaaaaatatctgtagtatgtgttatatgagtgaatagtctctcgtttccctgagtccgtagtgctgcccacggtcattctccattccctacttttctacgctctctcagacactgctgtctcaccctcacatttaatgtacagtccttcctacttcacaacacttaggaacacctttggtttcctaccaccacatctgctaagcagcctccaacccattccatcctttcttggtttttttcaattaaagagatgttcttcttcctctctaaagctaatcatttgtcttttgctctagaccccaatggcccccgctttctcagagcccacatgctagttgcttatctcctttctcttctgcatttttagtatctccctcttttttttttttttttttttttttttttaaagtgaggcggagtttctctcttgttgcccaggctgagtgcaatggcactatctccgctcactgtaacctctgcctcccgggttcaaacgattctcctgcctcagcctctcttgtagctgggattacaggcatgtgccaccatacctggctaatttttgtatttttagtggaaacagggtttcgcagtttggaacaggctggtctcaaactcctgaccttagatgactcacccacctcagcctcccacagtgctggtattacaggcgtgagccaccgcacccgaccagtatctccctccttaccaacaaattgtaaacgtactcaagatacttctattttaataaaactttccttatgaccgtctgtgcttgcttctcatcataggctgattccttaaaaatattagctaatgactttctttattttttccctcttccttccaataatacattccagttatggaattgaccctcactacccctgctgaaatttctcaccaaagtcaacagtaaccttgttgctaaatctaggaggatacttctcagtacttctcttatctggcaaggtaactgtttggtttcttatcacattctacttgatacacttttccccttttggcaggctctcctggtttccctcctgtctttctgtaccttattagtgtattagcgtgtccttttcctctgcctctctatttaataccagtgtatttaagatctggtcttctcttactctttatcgtctccctgagtcctctgtcccactttttgagtggatgactctccagcccagatttctctgttgagagatagatcgctatttgtcaaccggacaattttattgggtgtattataggcacatcaaactctccatttctaaaacttgaactcatcatcatcctctctcaacaaagaaaacttgtttcttttctgatcagtttaactgtgtgtcacatacccagtttctagcaacctttatcctttatcttttaactctactatcctttaactcttctgcttctttatcgcccgtgttgtaatacagtagtctgccctattctgtgtgggataccttccagagacccccagtgcatgcctgaaactgtgggtagtaccaaactctatgtgtatgttatttcctgtatgtatgtaactgtgataaagtttaatttatagattaggctcagtaagagattaacaataactaataagacagaatagtcacaacagtatactgtaataaaagttacaagaatgtggtctctgtcgctcaaaataacgtactttactcaccagtttcctgaccatggttgactatggggaactataatcctgtaacacaaaactgcagataaggtggggactatagtcaccaactcctattgatcctgcacagcagttttgcttgaattggtattctgtacatccttagtcttttcgttattggaatacttccttttttttttttttttttttgagacagagtctcgctcttccgcccaggccggagtgcagtggtgttatctgggttcactacaagctccgcctcctgggttcacaccattctgcctcagcctcccgagtagctgggactacaggtgcccgccaccacgcctggctaattttttgtatttttagtagaggtgacagggtttcaccgtgttagccaggatggtctcgatctcctgacctcgtgatccgcctgccttggcctcccaaaatgctgggattacaggcgtgagccactgcgcctgaccgttactggaatactttctgtacttgtaagtactagtttatattaatgtgtttacagaataaaatttagaaggcagagattctgtatttgtaatggtgacatttaggtggttaaagaggttgacatgaagagaaataacatgccattactcttatgagggagatacttagtatttttgggaaatgttgtgaatgtggccgggtgcggtggctcacgcctgtaatcccagcactttgggaggccgaggcgggcggatcacgaggtcaggagatggagaccatcctggctaacatggtgaaaccctgtctctactaaagatacaacaaaaattagccaggcgtggtggcgggtgcctgtagtcccagctattggggaggctgaggcaggagaatgacgtgaacctgggaggcggagcttgtagtgagcccagatggcgccactgcactccagcctgggtgacagagcaagactctgtctccaaaaaaaaaaaagaattcatccatatgcaattatttctttagcttcatactaatagttttactttttaaaggcatactaatgctgtgccttttaaacacatttggtgtcatcattaagttacaaagtattctaccccctatggcaatcacagtgtaacagtggatgaaattgttcattttgccaacctgatagattagactttagtaaattttgttttaaaaaatactaaaaaaatcatctgtttttcccaaactaattagagtgtacagttttaaaattgttttagaaacttattttagtagtgttcaaagtcgttagccagaaataggtctttggaacaagctctgcattttagggggaatttattgtgatagggaaatagaatgcgtaaaacattctttctccagatatattcttttttttttttgagatggagtcttgctcttgcccaggctggagtgcagtggcgtgatctcagcacactgcaacctctgcctcccgggttcaattgattcttctgcttcagcctcctgagtaactaggactacaggcgtgtgccaccatggctggctagtttttgtatttttagtagagataggatttcgttatgttggccaggctggtattgaattcctgaccttgtggtaacgccgaccttggcccagatatattcttaatacatttatcttactttactattacttcattattctattaatagaaagtattgctaacatactcttttaagataaaaatgatatgtaataattttgacttaaatatcttaattttcccttccaatttacgtttcaaaacaattgcttttagtacttttaaatatggcatcacttctgttgcctggctgttttattcttcagtattacaaattatgtcagtatatgtagaatacagtagttgcaaaatgttttatttaaatgagtcattttggttcactggatatacttctatgggtattattttttaaagttttaaaatatatttctagtataaataattacgtaaactgttcctgaaaatatgagacagaaaaaaagaagaaaaatcaccagtgcctaccctgtaaccaataattgcttttgtgaaagcactttaataaagtttcttagcttttgtttaaaaaaatttatgtataatttttcatactgcttttttacttttttatattactttttccatgatacaccgacaggttatattgtccaggcttcataattacatattttgaagggtacttagtattctacccagcaagtgtagtacagtttgcctaatagcattgattttgtcatttgacatttagtgttgttttttaatttatcacaattatagcgtaataaacaacttcattatagttctttccaccatatttaaggttgttttcttagattgcatatagagaggtagaattactgcgtcaaaaattcagttttagttcttgatacagtattgccaaaatgctttccagaaatgttatactggtttatattctcaatgtagtgtctgagaattccattttccttttactgtcattaggattagataatatgtaatttatatgaaagttagcaaatttaatagtttcttattttaatttgcagctggactttatatattcgtatttttttttgcaaactacttgttttgcttatatttctccggttttatttttttaaaacaaattctctgtataacaaaggtattaactatacttagtatttctttgagatttttttttctcccaagctctcatttactattctcagcacacttaggaatttacttttatgtgaataaaatctgttgaactttttattttttatttctttgtgttctaaatttagtaagttctctgtttttaaaaaccattcaattttcttgtctttttaaaatcttaattgatgtttaaaattctgttttaatctttgactattttgatagtatgatataaggcagcctttctcagttgggagagaattaagctccaataccctaaggcatctgttgtttactgtgaattaactttttttctgtgtgtctgggatggatggtactggatatgtaccatccttgggagaattgagaaagtagtgactcaaacgatttttcccctcttctatgattgaggtgaagaataccacttaaggaagactgttaaagctctaaatgtatctttttcaaatctgttagcaaattgttgtatcagtgctcactcctacatcatagaattgttgtgaggctttaatgacataatggacgtgaaatattttagcatggtgtttggcatgtggtaagcaaaataaaatgcgttagctgttactagtttttcttactacatttttctgattacatgtatttgagggtttttgttcctgagctagtactgatttaaccatatagacagcattgttgaaaccatatagacagctaatttggattagcattctaacctcctgacctctgttgctatccttgcttttattttacagatggtaacttttttttccgatatgtttattcttccagataaattttagaattattttgtcaagttctaaggagaatcccagtgggatcttaactggaattacattaagccaatctacatttagaaaaagtggttggttgtaatatttagtatcccatcatggaagatagtttttctacttattcacattttttctcccatattgttttatagagtttaatagtgcttcttgacatagagccaaattattactcctagttattttatatatttgtcactattataagtagcatcgtttaagtggtattggtgatattttgacgttctctagatttttaaaaaatacctactctttaagaataccaccttttctcttttcagtggtaatatttctgtttcatatttgtctgcttgatagaatttctgaaagaatgccaagtaactgatatgtagcattcttattttggtctttattggagatgtccttcatgtcttattttaagcataatgttgactgcttgtttatacttactttcaactctttagagaattattaaagtaatatatgctcattaaaaaaagagtgaaatataacaggaagggtcaatgtatttgtgatttttaagatttttaaaattaatacttcgttgaattttatcatttttattttgagataaaatttaatttgctatataatttgttaaagtaatatgttattctaatagatattctagcatcaaaacatctgtgggacaaattctactttttcagagttgataatccttttgatattttttctctagtgaatgggatgagttagggtcttagaattaaagcaacttggatttttatcattattactatttatttaatttttaatcttttttttttttgagatggttttttgctagtcacccaggctggagtgcagtggtgcagtctcggctcactgcaaccttggcttcctctgttgaagccatactcctgcctcagcctcccgagtagctgggattacaggcacctgccaccacacccggctaattttgtatttttagtagagatggggttttaccatgttggccaggctggtcttgaactcctgacctcaagtgatccgcttacctcagcttctcaaagtgctgggattacaggcgtgagccactgcacccagcctattaatatttttttattgccatttttagctgaatgaccttggccaaactgtctcttttgaatgtcagtgcttttgtgtgtagtttaatgacttttcatgtcccttgaattttagataaaattatctcaacctctcctctttcagctagcaccctttcaacctgtacaattccacagctagtggaaatccaaagtcttctgcaagattatgcagaaatcttactttctgatgatcatctctgcctttgaacctctacttccaccattgctgctgctttttctcatctctttgacccaggtaggaaattcagtccctttcttgattttcacatgtacaagcaaaaaccccatttttatggggaggattagagtttggtagtctttaccaagatttagagaaagcactaatacaaattaaactagggtagtaagcatcactattcttaaaatgtcttctagccactgcacttttggatgttttggccctagtcctgcttctctttccctaccttcttatcatcttgctattgtaccttcctgttaaaaccaaaattttcttcttgtttcttgcagagcagttctcccgtctttgactctttggcatacaactaatgcctgtgttttcagggtatcatcttcatcccaagtccattgtcagaacagagatactttctttcctgggagaagttctgggtctagctgtttatgacacttttcctactttattgttctaccctttggaactgtgttgaattaagtaagtaatcttcaagcatgcagactggtgctcacaaggtatattcaggggttttcctttccttctctgtcattccaactacctagctcattttaatcataatatgcctgtcacagctaaatcaatttgtctgtgatgtggttgacagtgcctcattttagttcataaaaatcagtgcttcaaagattgtattgctaaacttcatggaatgatttgaaaattgaatttgtttttatgtgttataaagctcagttcttaacttgtttcgcagagagttaattgttaaatccagtatggccacaggaggaggtccctttgaagatggcatgaatgatcaggatttaccaaactggagtaatgagaatgttgatgacaggctcaacaatatggtatgattccttactcttcatggtgtgttgttggctattaatgttaaaatgcagttttccccctgaccaaatttaactcactgatgctctttgtatacacttgctggccaagacattaagggaccctgggccgtttattatattaattgaagacacaaatcaaattgagtttttaagccccaaagcagatttactgttacataaagatgtaaaagtgttttttttatggaaaccatgtttaagacatgcagctgggttttaggaagggatttggagaaggaattgggaaattatcaagaattacgttttcaccaccctaactctgcttttgagtgcatctgcctaacacacctttctctttacagaccagttttctctcctctggtccatgtgatatactgtggctgtcccattgttctaaaccttttagttatgggtgcagttatgtactgactagttacctcttagttccaatttgaaattttgtagtatgattatcctaatttggattagatatgtgtttcttttttcagtcttctgtggcgagggtggggtgaggtgtaagtagtgtaacaggttggcaggaatattcactcatagattgggtggaaggacagttcataaagaagggggttttgttaaaataaggaaaatatcccaagtggtttactatactagtactaaaagaattttccagttggataaagtgggaatttacagacctttttgttaatgaattaggttatgtgagtttaactaagtaaataaaaatgttttctatttgaaactataagcactttttgtaattccatattagctgttaccatgtacatttttacctataaaaataatagctgtctttattgcttactaaatgctaggtactaattagttttaatcctattttgaaggtgacactattttagagattaggaaactgagactataggaagcaaaataaatagcctagggtcacacagtggagtgttttttcagaaaacagtaattaggtttagaacctaggttgatttgatttcagatctctttttgatacgtactgactttataggagatcggtaaaggtatctgtaatttatttcactatttataatagaaaatcacaatgtaaaaaaatcctcttggaaatattcagattgattttagggttggcatttgaggatttgtatttgttagtgatcttgataagaaaataatctcttttcagaaggatgggctataaaattaaggtagatgtaatgaggggaaaatgggttaatagaagtaaatatttgtctctaggagtataagtctgtcaaaaatgtcttgtcttttttaattttaaaactgaccaaaactttttaattataccaatctattttcctggtttgatacaggccatgttaatttttgcttttacttttttaaaggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcaggtttgtgaattatttttaaaaatgaagctattactgtgagaaatacttgaaatggattaaataatttgtcttaggaataaaaaattgagctgtttatgtaatttttaaaaaaagtttctgtgcctatggaaagaattttaatcactggggatggtcctgtcttctttagaaggaaatgaagtcccatttctaaacttgctaaagacatgcatttctggactttatactatgttatatgactaactcaagtgattttactatacaactaaattttgcattttggtaactgaataaaatggtattaagtaatggaaagttccagtttagtatatatatcattggctaagtgtgggatgtgctgggttacctcaagtttagaatgaaactattttctgtttataatcaccaaaataaagtttagatctaaaaacaagtagaaatgataataaattcttgagagatattttactcttagatctatatgtcatagagacacacacatttccaaaaatgtagaaaggtagattcaagtctgataatgatgttggtaatgatcatgtatcatttatttatatctatttatcaattattgaacacttaactgtatatcaggcactgagctgaatactttttcagacagttcttcatgtagacacaactttaattacattgattcattgggtccaaagcgtataaaaatactataagcaagtaataaaaagcaatatgagttaaagtgtgatccatggtcctaggacacgttgagcatccctaatacgaaaatccgaaatgctccaaaatccaaaactttttaagtgccaacatgagtggaaaatttaacacctgaccttgtgtgatggtctgcagtgaaaacgcgtcaaaactttgtttcgtgcacaaaattattaaaaatattgtataagattaccttcagattatgtgtataaggtgcacatgaaacataaatgaattttatgtttagactccggtctctttcctaagatatatctcatgtttatgcatatattccaaaatttgaaaaaaaatgaaactcctaacacttcttgtctgaaatattttggataaggggtactcaagctgtacttcatttagacttaccttgttcatattcgtcagttgaattgtctcagcaaagtgaagtctagaaaatgctaatcaaattttcatattgtagtgaaagactgttacagagccaaagctctttcaggtcttagtgcaaagctctttgtgtgcaccttctgaatcaatatctgatggcgaaactaagaacattggggttaaaacaaaattttgtcataaggttaatgtttgtgtgatttgatttctttttcatatatagagaagcattggaagtgattcccaaggtagagcaacagctgctaacaacaaacgtcagcttagtgaaaaccgaaagcccttcaactttttgcctatgcagattaatactaacaagagcaaagatgcatctacaaaccccccaaacagagaaacgattggatcagcacagtgtaaagagttgtttgcttctgctttaagtaatgacctcttgcaaaactgtcaggtgtctgaagaagatgggaggggagaacctgcaatggagagcagccaggtgataacgtttgtttcttttgctcattctttacacaaacctcaaaataccaacagtaaggtttagaaaattaggttacgcacacaggaattttagttgggtggaattaaagtgcttcactgacctcctttgttaatctgccagatttacttaaaatagagtaaatttctgtttatccaaaaatattttagaaatggcatattcaggttagttaaaggcttctgtttatttacaaaatagcatattgccagtttttagtaaagggggattggaaggaaagtgattaatagatttttgtaggaattttttaaaatggcaaatattcttttgaaaagttgtaaaactataatacatttaattaatttataaacattaggaaaatttatataaaaaattgtatgcagttgtagaagtaaaatttttcagatactgtagattaaaattttgaaatgtatttttgaattgacagtgattggagtttttagtattaccaattatgtcttgattaaaatctaagctggattcagattttttgcatgtgttaattcacacaataatccaagtgtctttggttatcttcgaaataaaaatttgtaaaactgttgctattgaactaattatccttagttttatatattgtgtactttcatgctttttttaaaaaaaatatttcccctgcagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgtaagtattcgacttttaaaataacatattatttttgtagtatctcagtgtgtatttactgatgacattctgatgccaccccagaggagttaacatattttcaaaaaatcatgccatccattataacaatttattgcccattttaatagttgtatgatttataccgctaaaatatttcaggctagagaaaatgaggaggaggatgttcggactatagattcagctgtgggatctggttctgtagctgagagcacatcgctaaacatagatgtgcagtctgaggcttcagataccacggtaagcggctttttggtaattaaagtgctggaaatgaaggtttaaatttttctcccagttttcaagatgttatttttataggcgttccttaatgaaaagtgtattccagggaagaacccctcaaattgttaatgctgtatgtgttcttctgtatttaaacacggaagttaagttttatttattaacactaaaaatagttttaatggttaatttgaaaatgtaatttttgatcttcagtttatagaaacattgtttttgtagtttgttttgttaagcaaagcttcactaattttaagaagcatcgaggaagttaaaatggatggtggaattaagggcaataggcaacattagtgattacttagcatgtagtcttttggaaataaccaagttcatttgtcactgaggacacgttaaggatattagaatttttcattttttgggctctatcctagtactggagcaaaaccagatgactgaaaaatcgagagaaagactagtaaatgggacaggatagcatttacattgtgacttattcacaatgagaaaaatgctgtaattgctgacttggcaaaatggaatttgttgaagtactgtttttctgaagaatagtaatttacagaactttgaggaaagatttctaaaacttagtgtggttcaatgctagggtgtttttaggcattttaaacaggcgtgcctataaccatgcattattaagcttttaacacctattacaggctagtaaagcttttgttttgagaggataagcatatatctcttcgggttttgaggtgttcaaaatgccattcagcattaggaatttgaaggtttgtttcctattagtattgacctgcataattcttacctgcctcctttctcttcccggaccttcctaatttgaagaggtgatttggatttcttttctctacattattttcaacaggagatacttagagagcctgatccaaacagttgttgaagaatggattttactgtggggaaattctttttctatttacagtggtgcgaggcataatttcttccttaggttccagcagaaatggaagggttaggacgatgtgggtaaaggaattctgttggggaggagtgggaacttgtatagatttattgtaatttatataaagtattcattgtgatggcaatttctttcataatataaaatgacggtatgaaagttgactaataacatgtagcagagtaaatgttaaaaatgtgctttaacaactgtgtggtatggtaattccgcaggatgtggtacttgcttagttacagtaagcaacagtctagtctacagaaaacttaaaagactaaatatactgctgcttggagggggatgtggattgatttttgtttttttttttttttaaaaaaaaggtggactggtactttttaaattgttttacaaggctggcttatatgttaaacaggagtttgtgttaagaatttaatatgctacactatttaataaaggaggaggcatcttttattctgagaattcggccgtgcattgaggacaaactagggaattcagcttcacaagaacaggtttcagacattgacgttactacaagtccaaaagggaaaggtgacagacctcagaatgacagggaactgaggcctaataggaaatatagccaaaaacgtggatttccctcaaaggtatactttacaatattaacttgggaagtctctaaatgagcacttcttctgttcatatttcctcttctttatttgcttttctgttgttgctattactcttacatattaattgttaatatagttgtcatactgtaatttgctttagtaaaattctgtcccttactgttttttttctactttgttatatacctctccatggattatagcttacagctgtttttaatttatattaacaaaggttttgaaatgtaatttattcccttttttataaattgcgagtataatttataacacgttcttaaaccttgaccatcagtcagttgccctttgtttctgatatttgtgtttattaatttagatggggccaggcgtggtaattctagcactttggaagactgaggtgggcggatcacctgaggtcaggggtttgggaccatcctggccaacatggcgaaaccctgtctctactaaaaatacaaaaattagctgggcacggtggcgcacgcctgtaatcccagctactcaggaggctgaggcaggagaatcgcttcaacctaggaggtgtaggttgccgtgagccactgcactccagcatgggtgacagagtgagactgcgtctcaaaaaaaaaataatgaaataaaaataaataaatttagatggtagtttgtcagattttttggtttatatttttatttttggaaacccctttcatttgctttttttagaaaaattatccagttgacttggttgcctctttttttgctggttttttctgcagtgtttaattggttttttaattttccatgatttgcataatggcattccagatagagttaaagacaactatttgtagttccacataaaaagagtttgaataggccgggcacggtggctcacgcctgtaatcccagcactttgggaggccgaggcaggcggatcacgaggtcaggagatcgagaccagtctggccaacatagtgaaaccctgtctttactaaaaatacacgaaaaattagccaggtgtggtagtatgcacctgtaatctcagctactcaggaggctgaggcaggagaattgcttgaaccctggaggcggaggttgcagcgagccgagatcctgccactgtactccagcttgggtgacagaacgagactctgtctcaaaaaaaaaaaaaaaagagtttgaataaaaataccatttataaaagtgcatgtatctgttggcaggagcaaagtactattttagtaattgagtataggtaagactaatttcatatgttttattactggtttattacctaggactacactttcccattttgtggctattttatgggtttgttgtattttttttttttttttggtgtgtgtggctatttacaaatggtaaaacttcacctctagtattttggcagtttttttattttttctggttcctacaagaatttgagagcacagtttgaaattagttatgggaatcttattatatcaaatatcaagtaaaatgtgccccagttcaccagtagagtgaataaagtagctgattattttaaaaactagtggcattggagaagagcaaataaacatgaagcataataggtaaccattggaattttattctctttaatccttctgaatagtgacaagcgaaatttaagagttaacagttaatgcagtatctgccagttctttttttcttaaggcattacatataatttaaaaaccactttgctgtttttaggtttctttgaataatatccttataagtgattattattcttttttgaattctcttcttggcatttatttcattttgactttcttgattcttaaggctgtctcgttgttctgttagtattctatttgtaaaaacattttaatttcttcaggggaaaaaatcttaattctcaccacctgtgtttatttttttctctactctgcaggaactgtcattcttaccaccccacccctgtttcctccttagaatcttttcaaaatgtagtattctgttagaatagtggaaaacacagttgagggtcttacatgcgattcaaggttgaaagcaaccttgagacttaacgcatgatatgaaatgattgatattctagagctgcctaccaagggcacattccactttatgaaatattttaagacatgatgacatcttgtataagatgtcagaagaaggcaaaagaaagccttctacgagtagccatgcgttcattgttttcctatactcatggcccccaacttaatctcacctcttaaaatttataagctttctttgtaccttgtacctgtgttttgccattattttcatcattgctagttatttcgtgtgagattgccctgtcttttaaaccagctatggttcttcagacatgatgtcttatacttctgtatttagaacccagcacataatttggagcagatagtatgacgtaaagaagactagagcctaagaacctgatttcccttaactgtgacactggataagtcacaactttatcttctctaggcttatagttcctcaaccttcacatgaagaaattgaagtacataattatctgaagctgtcaaaatacattaggatccattaataattactaggagaacctcagttgagtagaggaaaggaagattgagggttctctgaaattggactactacatatttacaactcagggtttgatgcctaagttatttttttaatctgtaaactaaaaatatagttggtgaaagtgactttttcaaaaaaagtttaaagaaaaatatgtgtttgaagaattaatatacacctagcatcctttttggatttctattccaggtgccatcttcctggtatgttattactcctacctagatatttttattttctcccttctgtatatttcatcataggctgtactcccatcttttggctcagtttttttgagcatcagtctgaaatgttgtttatatgaatgtgaaagttattaagtagtaatatttcactaattttgaaaattgagaattcatttttagattagtgagaaatctgaagataattgtgtttaatagcttagaattctttatgattaggttatcacagttttgtgactaataaggattaaagaactttttagaaagtacgcttttttctcatttgcatatttttttctcctaattataatttatgctttgctagaggagtatttgatcaacctagagagattttgttttaccccttccattgatatctgtacctatttgatttggttttacattttaccgttgactttgatgaaatcattataaaattatttttgctgcattctgagagggctagctattgataattatccctacccttcaaagttgtttttttcctaatgatgtaaactgtctggaaataagccagactaggatgaatttccacggaaatggatgtaaatatttacaaggtaactccccttatataggataggagagaactgagtaaacagtacttaatttgttaaaagtttcagtttattagaggttcaagacaacagaaaaacctctaataaatattggcttaccaagatccaggtaggctatttgtttcccatgctcatgaagtctagagatagtctaggatagagaggcactgactaggcacctctgatgtttacatgaaataatctaattatagccaacttcctatttgatcataactttcttgaatatttaactctttgccatgtacttatttgtttacttattaattttatggatttccaagtcacagtgtaaaatattaccacagttactcatgctcattcacaatactgatgagttctacttggggaggtaaagaaatttttatatagtattgtaaaggatgtcacccagaagggagtttctcttgagcccatctgcatgctccataatttctctgggaatcaaatgtacatagcaagtgtagatcagtgcatttttactttcaaaagaaatctttgaacttctttgctctctttagtcatttatttgaaatttacataacccgacaaaaatttgttagcagtacaaatttaaaattgactaagtgaaacaaaagtgaaatattttatgtaaatattaggtaaaatcgttcaacttttaaaataaaagactttttaaaaggtaaatcggtgatgaaaaatacaattacggtatacgtttcgatgtataatttagcttgtaatatattgtttccaggttgtatttaaatttgtctctgctttgcttttccattttcttgttggattacattttgaatagttttaagattaacacttaaaatttcatcattttttgtaagtgccacttatttaatccatccctctacttttagactagatgataacctcctagcattttcggggaatttggaagtagttacttccattttatgtcatcagactcagatgaatgagcataatttaagaggaaaataatgatgcctttgatgacgaatataaaattcgttattttcttagatgtctgataatatgatgtgattaaatgaaaatctttttacataagattatcaaataaaaaatgtatttttaaaatttcagtcctttgttagaaatagtaggtgtgcctactttctaggttttgttgttgtttttaaatattacttctagtcttttttttttccttttttcttttttctttgagacggggtctcgctctgtcacccaggctggagtgcaatggtgcagtctcagctcactgcaatctctacctcctgagttcaagcgattctcttgcctcagcctcctgagtagctgggataacaggcgcacaccgccacacccggctaatttttgtatttttagtagagatggggtttcatatgttggtcaggctggtctcaaactcctgaccttgtgatctgcccacctcggcctcccgaagtgctaggattacaagactttcaggtcattaacccagtataatgtgctccttttctgtaggggcctagattcttcagtgtgtgtgtgtgtgtgtgtgtgtgtgtgtgtgtgtgtgtccatgtgtccgtgtccctcttggccttttatgttttgtatatctttttcttttccttttgttcattcctcttcctgctgagccattgattatgtagctttttactgtgaaattacctcttaagtggcaggctatatatatatctctgtgtcatcattctgttcttactcttttttcttgatgtctactaaaactatatttagggttgtatatttaataatttgttatcaatgtgtatactttgccattgataattgaaaccgcaacatggattttaatagtcagatacaagtattgttggtcttattttccaggccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctggtatgtcacagtctgagaatattctttttgtaaggaagactcatacataattgtattgcagggtggatgctgattattacataatcagatcttgattgttgtctagtttagaaaccttcatatgaggcttatactttcctgtgcttttctctggttatgcagaaaaggttgcagggacaactggccatcatactataccatgcagatagccagatctctctccttttcatcagagagtacccttaagaggtaaaagagacaggctgtagttctgtttttgtacctcagactgataaggctcatgatgcgtttatttcctttttttctattttattcagctaggattgtcattctttgcttgcctcccaagaaagggttaaaaccttaagtgaggcagtgagtaaatttataaagtgtctttaaccttcaaggttagtagtagctagtagctgttattttaattaggtatccttttgtatatgctagctccttggaactatatttatagtgtatacattcttcgtaagactcagaaattttcttcctcctttcctcatagccatgtgtgaattagatgaaagttgtgttgaatttcttagtattgagtctaattttgtacgtttatcatcaccttcaaacttattttagtttctcgttaaattgcaaaaaaagatgattagttattaaaagtcaacaaaactaagttatgttttctaatagtctatcccccactgtctgcttttagtaataatttctcttctttgagcgctttgtttttgcgagtgagttaggttctcactgaggctaccctgttgtgaatcagtttattctgctgtccaaacctagcccactggctcacctgtctaatccctgttatacctaatttaagtttgcattttcacaaggaacgttatgactttcaaataacctctttttttttttttttttttttttttttggagacagagttttgctctgttgcccaggctggagtgcaatggcatgttctcggctcactgcaacctctgcctcccaggttcaagtgattctcctgcctcagcctcctgagtagctgggattacaggtgcgcaccaccatgcctggctaatttttgtatttttagtagagtcggggtttcaccatattggtcaggctggtcttgaactcctgaccttgtgatctgcccgccttggcctcccaaagtgctgggattacaggcgtcagccaccgtgcctggtcaataacttactcttttgtagtaatgatatagctgtatagagtactgtatacagtaataattacaaagatttttgtccccatttctccattgtaaaatttaaagtaccattagcttttatatttaggaaacagataatttaggaaaagataattaaaatgctttaacataatgactagtactagtttggttaatgactaaccttttaaatatttttcgagtttggaatatcagatttaaaagctttcctttggtagttaatattaatctctaaacttgcataatctcctttgatcatcagagatttctaggttagtcagagctttaattcttatttctgttttatagagaaggaactctacagagtttgtggcttgcctagatttatatagaattttagcagaattacatttcttgaattgtaggtcaggggtcttgtttctttttctgaatatgaacttttgaaagtaagcagataatttctttttaaaaaatactattatgagtcagagaataggagtataatgcacatgagtttgaacttcatactatttcaaaaagaattttagcttagtaattttaaaacaaatttagtcttgtatttatgagattttgcaggggcatgctaatgaaaagccatggaaagctacaattacagtatttaatctagtatatgagacattatcttgggataattatgttacctcaaagagtgtccctttcaccatttaactaacaagttacatataattactgtaatttctttcttctcagcatagagttttgactagacatataggattctatatagccttgaaattctcagttctcagtggaaaaaaggtagtgttttcctttaaaacagaagcaatttataactaattgtcttttttctttatcttttttttttttttgagacaggatcttgctctgtcacccaggctggaatacagtgggcgtgatcttggctcactgcagcctctgcctcgcaggttcaagtgattctctcaccccagcctcctgaatagctaggaatacaggcgtgctgtaccacgccgggctaatttttgtagttttgtagagatggggtctcactgtggtgcccaggctggtcttgaactcctgcgctcaagtgatctgcccaccttggccttccaaagtgttggaattacaggtgtgagacactgtacctggccaccaatgtctgttttagagttggagagttagaagtcaggttaaggatggagttatttgttagtagaacagtgactatcatgaaaattgttgtcacaaaactgctttatgaatatgggggcattttttttaaattaagaagataaaaaccacagtcttttagtatgacttgtatcacaaacagccacttcaataaattatccattttactgcaggggtcagcaaactatggtcagctgagtttggctcattgcctgaaataaagttttagggaacacagccatgcccttttgtttacattgtctgtggttgcttttaccttgtaaaagcagagttgggtggtcgagacaaaaactgtatttcccacaaagtttaacatatttactatttcaacctttaagcaaagtttgccagcccctctaccggagaattgattctattcaagaacatggagattgaaacctgtcagaatcagctgtgcttttttacactatcactttccctttcactcctcactgatcttagacctgctccactgagtcactactattaattggaatgtaatagtaaccctccttgtatgttgggacaggaaaagatgaaccactttaccagagttttgtgagcatccctttatttttaagttaggtggtaacttctaataaaatgattgttggcagatagatcggattgttaactagtttcaagttacgtatgtgagctttttaaattctttttttaaatttatttttagcttctcagagattaaaaaaggtgtttgattatttacattaatcagtagttactaatttctttccagttgttgcagaaactgcaggtagcttatctggcgtcagtatcacatctgaactaaatgaagaattgaatgacttaattcagcgttttcataatcagcttcgtgattctcaggtaacctagatgttttagtatagttgagtttaaaaaatcacattaattagaacagtgattcagaaacttcagtgagcatacatatcacctggcatgattgttgagcagtgtaggtttctgattggtggggtcccccccaccttcaaaattacgattcatggatttggggtgggcttctccacgtctcagtccaatgctggtggcctggggactatactttaagaatcactaaattagaggagagtttactttgaaggaagtgattaatgaagtttttctttgtatgctactggatgacgtattcttttttcctctaaaagacttaatggtcacaacgattaagactttgctttaaatctgtgtccttcgactagatacatgggattctatacagccttggaattctcatttgaaggaatattttactaacaattttaagaaagttcttaatttgagagttagcaagtgttataatttgatgcactttgtaagtgatataaatgcagattttcaatatgggggccttgggtaagaaaggatgaattaatgcctctccattggaagtgagtatgattgaagatgcagtgtctcttgtcttcttgctgaccaagtgaaaatgagagaatatggcccaaccactttggagagttatatagcagtacctagtaaatttcttctggtagacctggggcctactttagagaaactctcacatgttcagaaggaggtagatggaagaatattcatggcaactctgtgttaatagcaaataaccagaaacagcccaaatgtccatcaacagaaatgggctaatgaattcttacatagagtgaaattctttatagcagttacagtaaataagccattgctaatgaatacaaaattcaagtttaagaaggatcccacttaccttattttaaaaaaagtctacatttttaatgtatgtatacataggcattagaaaataaaaacatgtagagaatggtagatgcctgattccaggttggggttacctttggagtgggtaatgacattggaaagggtacaaacagagctttagttaaatctgtaatgttatatttttcttaaaataattgatgcaaatatgggaaaatcttaaaatttgactaagcataatgggagatattcattatatgatttcctaagccctagtggattcttgcaaagtttcataattaaaaaaaatttaaaaaaaggccaggtgcggtggcttatgcctgtaatcccagcactttgggaggccgaggcgggtggatcacttgaggtcaggtgtttgagaccagcctggccaacatggtgaaaccctgtctcaactaaaaatgcaaaaatgagccaggtgtggaggcatgcacctgtaatctcagctgcttgagaggctgaggcaggagaatcgcttgaacccaggaggcggaggtttcagtgagttgagatcacgccactgcactctagcctgggccacagagtgagactttgtctcaaaaataaataaataaataaataaataaataaaaaataaaggaacatgagagagaagtggtgggaaaaattgataggttaagaagttaaagtttacagtggtagttctagaaagaaggcaagagagagaatgagatttttgaaggtttattttatgtaacgtggcattgttattacttttgattcaattactgatgtctagtgaatccaagacctctgtgtggtcatgtgtctctaaaactatgtagagtcagctctcagtatctgtgggttccacatccatggattcaaccaaccatggatcaggaatattttggggggagaaataacacaacaatttttaaaatgcaaatttaaaaatataacagctatttacatagtgtttatattgtattaggtattataagtagtctagagctgatctgaagtatataggaggatgtgtgtagattatgtgcagatactacaccattttatataagggatttgggtatctgttgtttttggtgtccccaggggtccttgaaccaatccctcatggatactgagggatgacttcatatgttaatagtggcatatcaggaaaccgtatttaatttgggaatagtaagggtatatacttacctaccagcacagcctagcaaatatttctttctctttataaagaatatttatgcatttaaaaaatgagaatgcatttaattgcgttagtcttaattcttcttttttgttgtttttttttaataagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatgtgagtaaatctggttcagcagtattgggtataagacacacaagtatatatactgtcacataataaatttagtatttggtgaatgaacacatagctcctcaaaaatatttgtagggacttaagacttgcatatgaaaagtttctaagttgcaagccaatatatatgaaagccaaataggtgataaatcagttttataattcagaaaagggaaagaataaagttggaccttgaaaaattagtaggattttaataagggaaaggtagaagagaaggcaactgtttgatacgtggacatattaatactttgtttcttaacattcaaaattttcccttaaagaaaagttaatccagttagtactttgatttaaaaacccaaaactgtgaaacatagtgtgtattaaaaaaaacaaaaaacaaaactatgaaaaacttttatatatggtttagtctagagagcccagaacttccaactgctggatttatattcatttttaaaaaatatataaataatcatctcaagcaggtataactgcgggagttatcttttttgctccacacgtgtttaaccttctttgtctaaatcagatctagtcttcagttcctatcctaataccttttcaaacatggcccctgtctcatatccaaatagtaatagaggctcaagcattagaaattgaagtcagtagggacaacttccaactagtctttaaacattctagctgctgtctaattaaagaaaagatgagggatttaaaaataacaaaaccattgtctctggagcctctggtccttattctccacctatctccttttccttttccacccacaaaagaaccttaatattcctgtcctaaaacatactcctttcttttctctgacttctgctagtctctttctcctctagagtataatcccagtttttatcctttacaaacacatgaatacaactaagatgtgtggctgggtgtggtggctcacgcctgtaatcccagcaccttgggaggctgaggcgggtggatcacctgaggtcgggagttcgagaccagcctgaccaacatggagaaaccccgtctctactaaaagtacaaaagtagccaggtgtggtggtacatgcctgtaatctcagctactccggaggctgaggtaggagaatcgcttgaatctgggaggcggaggttgtggtgagccaagatcgtgccattgcactccagcctgggcaacaaaagtgaaactccatctcaaaaaaaaaaaaaaagaaaagaaaaaaacaacttaacatgtgaaagttgcgcttaagtccttgtcgtcagttttgtatgcataaagtagcactccgtatactgatgactcttaaagcctatttttttcctcactgggaagcagtgtgagagcagcagcaaaaggtagactcgtcaaggaatagaatgaggagactgctggaaaccacctacaggaattgtggtactaaagtgagcaacaaataatgatggttcctttgagaaagatactggtaaatgacagcacctttgaaatggtaggaggtagagaagtgcaaagattcttaatctttaattcctcttgaaagcatgatttatatttgatagtaacagaagttaaatagaaagtaattaaatttagttcaaggaccatagaggattagccattatctaaatagcaggtttttattgctgtttaatatttcatggtttgaggtaccacagtcacttttaacacttttctttctctcctggagcaagaaaagttccttcttggtgtccagatgtgacatccccctgatctgtgggtatgaaaaactgatgaagacctaatcagctacagctaccctgtaaagattacagattgagtactgcacatgattcatagtggccctgtttaacttaacctagaaccaagtttatcaagttagttaccaagtttactcgttagttaaaactaactagagtacttctctagttagttttccaaggtagaatatcattattcttgtcaatttccatcttttttctttcctttctgttttaacccagtggttatattgtaaaggtgatagaacctgtggaagaaagaggtaaacaagtctttgtacattttgatgtgtttaattgtggagtaagttaataaacaattttctgaaatttaaatctgcagaaattaagttgttaatttttactttttagttttcaatatccaagccaactgtatgtgtttgtttatggtaactggtgattaaaaaaaattttttgttgttgtgccttcttcagcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagtaaaacatttataatcattgtttacatgaagttaaataatagggataaattctgtttttttttttatgttgaaaattctgcaaaacgagatttatttaatattgttgtaaacattcttaagggataggtagaagaggcgtgtgtgtgttgtgtgggcataatttgagttgtctaagagatgtgatgtaacatagtttctgtgaactgatgttactttcttgtttttcaaataaaggatcaaaaataagattacagttaaaatatttctatattcagatggtttagagaccaggctgtagaatcagacagccctgaaattgtatcacacaaggctgtgttaccctgtacaaataacttagccttactaagcctgtatttcctcatctgcaaaatagggatgataatatacctgttgataaatatgttttcattaaaaaacgttggcgcagttcctggcacttacagtaagaactcagctaacttaatttttatttttggtaaacgtagtatgtagtgtatagatctcatatgtgcagacaaatcaagaaccttccatacatgctcagtaatgtctgtatacctgattttcctgagaggtagtatttagtagtacttcacacttttgatacttgagaaactagaaatctttttgacatcaggttttctgctattaacatttacacctgcttaaaatgaacaattaaattgaaattggttttcttacacttttgtccctaaaacagcataagaaaataatgtgagattttgagtaagctgtacttggcattaacctcattattttacagtcataccccctggagagttcactaggtggatattccattaggtctaaattttgtttctgttagctgctatgatatgaaaataatgtctgtattattttgctaaaatgggtgtaaatcgtatacataaattttttgtttatcaggaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcggtaagaacttttctggggatgtttttccagcatattcattctgtcttgatacttataatgtgggaacaaaaatacttcgttgtagtatttactatttgccttttatttaagctttctactattttggtcagtgtaatcatctctgccctgtgaagaaagatgaatagggaagtatggagtacaatagttcagtaaatttgccctttgttagactgaattcgagtaaatcatgagatgtatctaacttagcattttgctgtctttttctttttaggcgtaattttcattttttcagatgtttttctacttaaatagcacatatgcagaagttaatgaaaagcaggagtcgattattcaatttgaatttaaatggaatagccaacaatgtgcttggtttggtgttattttattagcagttctaaacttggatttctttctctctttttttgtgccttaaatgacttcaggctgttttctttcttctagaaatccacaagtagcttccacttggaatgaagtaaatagtcatagtaatgcacagtgtgtttctaataatagagatgggcgaacagttaattctaattgtgaaattaacaacagatctgctgccaacataagggctctaaacatgcctccttctttaggtatgactgactgtatttacatataattttgctgtgttattcttacaaagtgggttttcgttcatgtgtgctctttcctttaaaagttactggttttaattatacatgttttcagcagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggtaaatattgcttggtcttttaaaaacctatttgtcaaatagtacagtcttaagtaaaatttgtgtatgataattactttggtttaattatactaatacacatttatgtatcatatgtgaggtttaaatttttagcactttacatgctgtatgtcagaggtcagcaacctttttaaattaagagtgagttggttagatagttgcggctttgtggcgatatagtatctgtcacaatttcacaatgcaaaagcagccatacataatacataaatgagaatgattatttgccaatatagctttattttattataaacaatatagctgtttttatttacaaaaacagaagaggttttgttgtttttgttgttttgctgacaactctggccttatattatgtacaacttgcagcatctcaatgaggtagacattaaataggttaaagagatcttaattgccgaagtttatatgactgtccaatccagaattcagacttcctgataccagagcctgcgatcttaacctactgtatataaaagaaaaaccatatgttatcttattcagtaaggttaaagttagaactattaatcataaattttaaaaagcagtttatacatattttgtattatagttacacaattaactataatgtacaattgtatatttatacaaatgtaaaaatatacaattatagttacataactattaacacaaaatatgcctacacttataattgtataaatatgtaattaactataattgtattaccgtgtaactattaacacatttataaaggtgttgtgtatatatatataaaaatcatataaaatggtttttgtgagtgaaaaacctcaagttttattaacagtttcttttgaaatgctatgtactttgaattactcaagtaaaaggtgagcgtgctctctcggttcaaaaaaagtacgtatttgtatttatttattttttggggacaaggtcttgctctgtcacccaggttggagtgcagtggcatgattttggctcactgcaagctccatctcccgggttcaagcgattcttctgcctcagcctcccgagtagctggaattacagatgtgtaccaccacacctggctaatgtttgtatttttagtacagatggggtttcaccatattggccaggctggtcttgaactcctggcctcaggcagttcacccaccttggcttcccaaagtgctcagattgcaggcacaaaaagtacatattactaataaactctgtctttacctccattaataatcctattcttcttcactgaagttgctaggccttttctctgcagttaggtacatcactatgcacctatttttaaaaaaatacatgacgttttgtggtatgtttctttgtttttacaaactgtatatataatacactaagtattattttatagctttccttttttccccactccacattgtctcagagaactttcatgtcagtatagttctatataattataagtaattaagaaacacaaatatgataattataaaatataaataatactgcatatatatatatacacacagtacatagttatttgtagctgcagtacagttttcagtatatcgatggactttagttaatgtataatagcatccagttactatatacttgttttcaatctttcgctatttagaaacaatgcaccaaagaatatacttgcacaagcttttgtgcatttgtgttttttaagaaggatttggagaagtggaactactatgtcagttggtgtacattttaaaggacacaacttaattggtctctagagagcaattttctatatgtatttccgtatgtatttatatttctatatgtatagaatttttgatatgtattcatatttttctatatgtattttttatattttaagcagtggtatgtgagagttcgtttctccacacccttgattgtgttttattttattgatataccgtagcttgtttaaccattactggaattggccttttccaaatttcccaattataagaagagttattgaggtgagataaacatgtatgcaaatacaaacgtgtgtaaacaaatatatattgaacacgtgtacacatgtatacaaacgtgctttctttactgctttaatctttttatgtaaattttacagactagtggtatttactaaggtatgaattggataatgtcttgaggtatcaagattgttttaatgtaatgatgctctttcaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaaggtatgttaagcttttggccttcatttaatataataaaaatttagtgcctgttttggagaaggtgctcagctaggtactgtgttatgttgtgcctaatgcttcatcacattttattggagtccataaatataatgtcaatttaattgtagagagaaattttatgaggctaaactacagcagcaacagagagagctaaaacaattgcaggaagaaagaaagaaactgattgacattcaggagaaaattcaagcattgcaaacggcatgccctgacttacaggtaattatgaaatttatttctaattgtctgaaaaaagatgtttaaaaccttaggtcaactgaaagtactcttttttgtttttgtttttctttttttttgaggcagagtctcactctgttgcccaggctgaagtgcagtggcgtgatcttggctcactgcaagctctgcctcttaggttcacgccattcttctgcctcagcctcctgagtagctgggacttcaggcacccgccaccatgcctggctaattttttgtatttttggtagagacagggtttcacagtgttagccaggatggtttcgatctcctgacctcgtgattcgcccgtctcagcctcccaaagtgctgggattacaggcgcgagaaactactcttttttttctagtattaaggtgacagaattatatctagtaattttgtgattaatgaagtggatgaactaatgaagagttggggttatacgtttacagtgtaaaagacagcacataggaattgactcattattttcattcttactgggctggctggccatagattcagaacatgtgtactcataactgtttattatgttaaaatattctgatttgacttttgcagttatggaccagcatttccatcttttactggcctgaaataatataataaaatctttaagccaccataagatatctaaggaaaataactgtatgtggtttaaagagtaagttgtatatacttttgcttattaactaggatcttatacatgggtcttgagattgaacagaaaataagatatctttggtgatatcaaataatcagttaataatatgggaaggggataataattccttctgatattttcccagagtttattggctagcttttttttttttttttttttttttgagacggagtctcgctctgtggcccaggtgggagtgcagtggtgcaatctcggctcactgcaagctccacctcctgggttcacgccattctcctgcctcagcctcccgagtagctgggactacaggtgcccgccaccacgcccggctaatttttttgtatttttagtagagacggggtttcaccgtgttagccaagatggtctcagtctcctgccgtcgtgatccgcccgcctcggcctcctgaagtgttgggattacaggcgtgagccaccgctcccggcctattggctagctttatcttcagttaggttgtgttttcaaagaaaggaaaacagggcaactgtgttcattttctaaacccttgcctttcctactgtatctaatcctttttctctccttatctccaatctaaataatgtctagagaaatatgttgcaaaggtgggttaagtatacaaaattttccattatgttttatccctgttgtttctgttgtttctgagggcttgtgtttgttaacctcagcttgtgttttcatctttgttttcttatttcatgttatcttcggatgatgatggaagtcagggtctgatagcagattaaatatggcactagagccttagtgccatatttaaagtaactgcttttatgaaattaatataattgctttaattcctcataacgttttttgtgaattcctttttagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgaggtattgtaaattgtactctcttgttcctgagttagtcttttgttttcctttttttttcttcaataaggcacatctcaagaaaggaaactgaatatccttgaaacatgtttgtaaatagtagtctgctttgtgccttttttagtagacacaaaaatgtaatagattataataatataagaaagataaaacattttaatttttaaactttaattgaaaagttttaaataattttttctaaaaagtaattatcttttaaaaatatccatgttctttgttagtaaatatttggcagaaatatataggggggtagttgcagcaaatagtaatcatttcagttagaaagacctatcctttgacattttatttatatgtggtttgtagaaaatataatttttcctaaataatttctgaagtatatttgagttctacttgtttctattaataggccatgtgcggtgactcacacctataatcccagcactttgggaggctgaggtgggcagatcatgaggtcaggtattcaagaccagcctggtcaacgtggtgaaaccctatctctactaaaaaatacaaaaaaaattagctaggtgtagtggtgggcgcctgtaatcccagctactcaggaggctgaggcaggataatcacttgaacctgggaggcagaggttgcagtgagccgagatcacaccactgcactccagcccagatgacagagtgagactctgtctcaaaaaaaaaaaaaaattggctgatttttttgtaatcataactatattattattttaaccttcatggacatgttagtgtgaaaaggagagaatgagaatagaaacctttgttgatactgacaatactagtagtcttttactcttttaggctacagcaaatccaaatatttatttaactctggtttcttaaaaaaaatagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaagtaagagagctgcataaatcacttttctaaaaatgtcacctgccgaagattgacctgtaggctaggcagccacatttctcctctacatcacagcacaaatctgctatttcagtgaggctactgtttaactaccacctttgtgacccagtttaattgaatccagccactttctgttctgacttctcgtagcatcagctttctcttttgtcttaaattactatggcacttgatcaaatggtgatacagattttcttatgtgtataagccttattagttaagtttataaaaagaaaatgcttgatattttgtagtgcttttctgtcaggccagaaataggcccttttttgcttaaattgagtatctgctgtttgtaaggttcttaaggatcttaaaacattttattataatcatttagtttttaggatttcagtttaaaatgtccatatttagaatatttctaaaagagttggtcatctataagatcagtgaattatttagctatatagtagtaaccatatcaaaaattttgaaatatagatttgtttatgaccttcccttttgatatcctcagatggcatttctggaatttctggagttttgcaccaagccctactctcttctcagatgaacttctattcttggggtcccaatatgcattttactgatcagactatatctacaatattttattctgttctgggtactacacgtctgttcttctacagagttcttcagatagttttgatgagcatctggtttcagaatcattggtctggatttttgctgtccagtatggcagccactagatataggtggttatttaaatttcaatcaaatgaaattaaaaatttattttctcagtcatattagctgcattttaagtgctcagtagccatgtgtacctagtgtctactgtattggatagcacagatacagatgattgccgtaattatagaaagttctgctgaactgcactgatcttgaaaactccctcaagcaaatgttaagggtagtttagctttgggaagtagtcccaggggatatgatgattatttaaatgtatttgaagaattgttttgaggaaggcaaactaaacatattctgtatataacagcaatagggagagtgccacccgtagcatagttattgtgattaaatgaaattttatatacagacatgtatatgtatgtttgaaacaatgtctggcacatagtaggtggcagagtatttaacttatctccagaatgacatctgttttatgtctcttaatcactagaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatggaaaggaaactaaaaataggttagtttcagtattttaattttgtgcttaatttaagaggctcaggtctttttgactgacagcaagcacttctgcagttctccaagccaactgaatgtcctacaactcaattcaatttttacactaactactcagagttagtgcagacccctcaagttaaggggctcagttcagtaagactgccctcacctcagacttcaatttcaactgcttggtccccacgttacccacacttctgtgcaacatggctagaaatttgggagttcttacaatccccttcaggtttatttgctagaacaactcacgaaatacaggaaaagacttacttacgtttcctcatttcttataaaggattctgaactgccaaatggaagaggtgtgttaggacagtgtgtgggttggggaggtgtgcagagcttccatggtttcctctgtgtgtcccaccctccccagcactttgatgtgttcagtgacccagaagctgcctgaattctgtttacggttttttaggagatttcattgcttaagcgcaattgataaaattgttgactgttggtgattgttctcattagcaaaaattcacatctggttgaaaggggcttgttacggataacaaaagacattatcacttgggagattccaagggttttaggagctctgtgctaggaaccaggcacaaagaacagatagatattttattataccacaagaatgttgttccagtagatccaggtaaactggatcagtcttcactcctgctgttgagaattaagcaaaaataacaaattgtagatagtgaaaagagtctgccaacaaagatgttattacattgttactaataattataactgaaaatttcttcatgaataacagatggtgaagtagatacagtagctccacttgatgaaatactatgtggttgaacttaaagcgtgaagaatggaaaactacttgtgacataataaatatttttattttgcagaatacttaattatatggacactgctgtgtaaaaacatacatgaaaaagactggagactaatgaaaactaataattgtacaaagctaaagatctggacttctcccccctctatattttttaatactttgtatgttcttttaatttaaaacagaatattggcccataggcctgagtatcagagtttattgctgtattttaaaaaccaaattattatgtatgatgacttaatgctttcaatcttgtgttaggtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcaggtaaaatttgctatgaaagtatatttttcgtctatttttataacttctgaagcaatacaaatttttctcaagtcatcagtaactattaacaaacattttctttcaatagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggtaatctgtttcttagaagtattgagactgtataagagctaacattgagcagaggttttacagttagcttctgggagaaaagagcaagaccaaattgcatatttggacattctctttcccttgagaattttataagtggtgatttacctaatgtttccttttaataccatggatttctgtttttataaatttatgttattgaattttacttatattttggcagattttatggtgtgtaaattgtaccacagtgaagctataaacaaacaaaaaagtgattttcttacagttttaccgactgtcggacagaagtactaagttcatttcttgttccagagggaaagttattgaattaagccttatagagcaagcacgtatttgttacagtatcagagcagtttgtctgcatgcttttgaatcatttttttacatgtattcttcctgaatgtactttatatatatggcaatataactgattcttagattactgacttaaatctttgtaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtaggtgacttaacctaaagagaaaataaataaaagcaaagtgtttggaacaacgtaatttgtctattgcctagatgttttaacattttcttttggagtggggtaggaaatgtttgcaaagaaagttacaaactcttttttttttttttctttttgaggcggagttttactcttcttgtccaggctggaatgcagtgacatgatcttggctcacggcagcctccacctcccaggttcaagggattctcctgcctcagcttcctaagtagctgggattacaggcatgtgccaccgtgcccagctaattttgtatttttagtagagatggggtttctccatgttggtcaggctggtctccaactcccgacctcaggtgatccacctgccttggcctcccatggtgctgggattacaggcatgagccaccgtgcccagcctacgttgttccttttaaaccaaactttaataatacggttgctaatgaaattaagtaaactacttaggaatgattgcttcaactatttattaagaggaaagagaacctgttcaatggctgctgtatactaggcactgtgtaaaacgctgggagagtaaagatgaataagacagtgctctcctaaaggagtaccatgtcttgttagggggatgctaatagactaaaggagagcacatttagcttaagcttttctttggatggttttttctgcactcattatgtaccagacactatgtaagttactgggatctaaagatgagtgacactgatcctttaaggaattcagggtctagtgaggatgctgttaatgaatgcttatagtacagtgccacgggtgccataacagtagtgcaaatgctgggaagtgtcagcaaatcagttccgccgccaaaaaaaaaaaaaagagttgatatttaagctaaagaatgaatagaatttatttccagagagattagaaatgaaagggctttctaatagaaccacttagagttataaagcaatgaaatagtacatcactcagggaatttagaggtatttaagtgtggctagtatttaggggaagagtaattgatgtggttgaagagtggcagagagattttatgatgtgcaaacaagcttaggttttatattgcagacgagggtgccattgaaggactttgagcaagggataacatgaaatttatattttagaaagattacactggtgaaagtgttcgggagaagttggaggaaaggagtgaagatttagctggtgaacagaaggctgtcataataatatggaaagaatgatagcttggccttaggccttgtcagtagggatcaagaaaaaggagtaactgaaagacattatagtgatagagtgaataagttaagtgaccgattatatgaggtgaatcatgaggaggagttaaaggtgttggcagggaatataggaggagaaaaaaggttgagagggctttgtgaatatatatatatataatcacaatatatatgtactcaatacttcttacatacatatattacagtgttatgcccagcaatgtgtatatatatggatgtatatatgtgtgtgtgtgtgtgtgtgtgtgtgtgtgtgtatatatatatatatacacaccacagtgttttttctttataggattttcaagacagtggcataaaaaatttaagagactttttagttcttgggtgtcaattaatattggcagcaaacatcacatgagtagacttttaagtaataagaaattgcaaatgctcttcctttttactaaaatatacttcatacccacaccaactctatataaaggctcttcattcttcttaacagtacaatttttgtgaaaccttcccagtctctttccccacacgttgttagtagcctcttgcaaatagctctgatacataacagtatttggtaagtatttaattatattctactttcccaataaaaatagagtagaaacaacataagcgtaggagtcatacagacctgagatctaatcatctttttcatttattagacgtttgatttctaaccgtatttgctcactggtaaaatgaatgcagtatctattttataagttacttggttttaagtattaaaccaagtaacatgtaaagtgcctgcagtagagtgtgtcacccagtaattgataaatgtcaggtaccattatttctaacttttagctcttaagggagtggggattattaattgtctttgaccaatgcctaaaacatagtggcctaagctgtgaacagtgattggataaatattagcttttttttttaattaacagttttttgttttggtggatttgaatgacatgtttaattaaaactgtcttttaatttcattttaaagctaaagacatttatttatttttctcttacccattgcttttactgattaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggtactgattgtaaacagtcttttattgcttaaacattcacttttgtgattacatctaattatgtgtaatttgaaaacacaactagggaggacgtttgtgatgatttggcttgatgatgttggaaatatgaaactttgacgtatcagtagatgagatgccagatacttcctggtaaccctggtacattaaaagttgtttggaaggatgtggcgtaactcataggatttgttttgtctctaatttgatacctgtctttacggttaaagcagtttgctgttcaatgacttagggctggaaactaatattaactgctagaagatagttgttaagtgatgatccctttttttgattcctagctcttgattagaatcacttcctaaagcctattcaaatataatgttgagtactattagattataaaaacaacttttgtctcataagttttgaggatgcatggtattaatgatatttaggatttcttctgaaacagagtttttgactcagtgtgaaaggttggctccgttgaacctagtctgtcagatgtatctctctgattgtctttcctactccataaaaatatatataattcacattatatttctctttagctatgtgattaggaaggtctcaggctcttatattagcattttgacactgtttaattactgagtcattaactgggatttttttttttttttactcgattaaccaataactctgagaattccaactttgtattcaccactaggagtgctatgattaacatccgttactttgttgactccttttttttggttgttctatctttttcctgttaaatctcatgttgctctataaaggtattctgttgtcagaagcctaacacagtgttagttcacagttgccattcagaaatgattgttgaatgaatatccatcacgagcagtaaacatttattcaaagcttcggtgaatagactttcctattagaatgtccctacttcattattttcatataattgatagtaaaaaattactctggttttaaattatttatatcatttttaggatggatctgaatgtctaatattattttagatatttggcctacttcagattagacctcatttcccaaaatctcaactattgtaatttcatggaattaaatgactagagataaaaagtcagataaaatcctgtagtcttattcaggggtcagaaaacttttcctataaaagactagatagtattttaggccttgctggccatatagtgtttatcatagccattcatctgtgacagttttgcacaagagcaaccataggcaatatgtaaacatgagtatggctgtgttctgcaataacactttatttatgggcacagaaattttattttcatataattttcatttgtcacaaacttttaactttttttcttccaactatttaagaatataaaagccattcttagctctcaggtcatatggaaacaggcagcaggctgaatttggtctgtaagttacaggtttctaacccttgtcttgagttaaatcctgtaggtcactgtctcccagactattaggagcagtgttgttgttcacgctaggttctgtgataaagttttggacttgttgcccactaccacttttaagagatttataaagcacattggcatattaaaagttgtgagatattttacagacctgtttaactttgttttatgtgttttctccccaacctagacgaccgatgagtacctattaaatattaagggatgctagtgttcagcagataaaatttgagaaatgacagtagactaatagaactacggacttaaggagtggagaaataaattgctaattgaatgaccaattgtattcaccaaattcttgttctacttgaactgctttaggtgaacacaaatccatgtatgttcccaagccctctgctatagctctttttgagccattcttccaacttttgggtcttgtatatcccatcctcccttgatttttctttttgttgttttttctagaggcagggtctcactttgttacccaggcaggagtacagttgataacgatcatagctcactgcctccttgaattcctgggctcaagggatcctcctgcctcagccccctgagtgtctaggactggaggcacatgccactgtgcctggctcatttttaaaattttttttagagacggggtctcaccaacttgtctgggctggtcttgaactcctgggctcaagcattcctcctgcctccgccttccaaagtgctggagttacaggcatgagccactgcagctagcctgatttttctttcccactgttttccattgctaatgctagatctttgataaggaacttttgccagtaaaagtggtttagtgagatgggtccagaattaaaactaatttactaccttagcttatgtgatatttgcatatttaatgtgtatttttgtgaaaacatttttatagcctgttgacaattttattcacctaaatctactcgagtagactataaattcagtgtatttggagtttttgtaaactatagttgttaacttataaaaacttgttttcattggtaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcagtaagtgttgaaatttgttgaatgttgatcagtgtaaattttggtaatcttactttgacatgttgacatagatatagtttcagtaaggctagatgtgcaggtgctgttctagacttagttgaacagtcatttttagttacctttatatatataatttttttttacaaaataatattcgaaatagggtttaattttctggattaatgttgtaaaacatggcatttattttttgtacttcttaaagcttcagttttgtagattattgaaaaattgccaaatgcccacgtttactattttttttcttttgctattgtatcagatcctgcatccaactctttggtcatgacttttagatggattcttgattgattagtttaaagaatagtgggcttctaaatacattgcagtttttgaatatcatatgataaaaccagttttaaaacaggctggcttaagtccttctggaagtaaactcatattttactcagtcttgccattgaatgtcatattaaagttgtttaaaaaatttttttaaaattttctttatggtgttagtcatacctcttacaaaaataggttttctgtgatttttgaattatttactgaagtgtagtactaggttaaaaatagtttcattagctaaaatctgcagtgttacagctgaaggatattctttttatgtttgcaaaggatgggctatggccttgaaaggttgttctgagtttaaggagatagtatttggtgcctaaggctagttgcggtggctcatgcctgtaatcccagcactttgggaggctgaggcaggtggatcacctgagagcaggagtttgagaccagcctgaccaacatggtgaaaccccatctctactaaaagtacaaaaattagccgggcatggtgggcgtgcctgtaatccagctactaaggaggctgagacacaagaatcgcttgaacctgggaggcagaggttgcagtgagccaacatcatgccactgtactcccagcctgcgtgacagagcaagtctctgtcagaaaaaaaaaaaaaaaattggtgtttaagaacaaagtattctaggcttataatcaggaaagtttgaaatgcattgcacactgctaactccctttcttggaagttcacaacacatacaagtatagtaaatgccctgagaaatcctgtagtaagaaaatacacttgtaaactttggcaaccttcatcttaatcacttttggataatgaaaccttagaaaaatctaatgaaaaccacagatacaagagaatattggcacatttttaaaaatttcagtaattcatctatccttgaagtccttggctcctaccttgaaccccatgtgaagaatctgacggatggtttaaaaagcaagtttgaacaggagtgaaagaggtgacatttttcttagcatacacattatcagccttgaagtaattttctggttataaaggtttaggagaagctggtttatttagtaaattaattggtaatctgaagctattcagaaagttactgcgcttttccaagattactgttggtgctaccagagaagatttaagtagataatggccatttagagacagggccgttaggcaactcagaactttctatttcctagtgctttgccctcacagagatgctctttgtcatataaataaatgaagaaaagctgacattttaaatttcagcattgtctcattcagatagttaatttgaatctgatagggcaatacttcataaacttgagtttcacatgaatctccttaggaatacagttttaagtgcagattctgattcatttgacttggaagggacttgagagtctgccttcctaacagactctcttgtgttgccagtattggtctgtggactacacttcaagtagcagattttacaggaaccttagctaatttatggctatgaccacctaaccctagaaatattggtatgttttaatttttctgaaacccctttattctcgggaattacttttccaaatatataattcagccttttaacttcaagacaaagattgacattctgatctttgtgctcttgtccttcatattgaagtataaaaatacctgctgtttgaaatgtacagtcacatttgctcaacaagcattcaagaccatctgtcagtgagtgccccactttaaggcacacacacacacacacacacacacacacacacacaaataaaaggcttgatagcagaatcaaactatacatagcagagccgaagtaatatggggtaaaatcaaattagctcaatccttgctattcaaactctgaactgtggacaagcagcattacatcatctgggatattattagaaatgcgtgcttttgggcctcaccttatgccaactaaatcagtatgtatttttcttcagtatgcattttggcaagatttttggtatgaagatatgtacgtgaaagtctgaaaagtactgaactagaacactggtttatgtggtttttgttccttttgtgctataggaatggtcaagatttgttagaaaaaaggatttttactgtatctttaacctccacctcccgggttcaaacaattctcctgtctcatcctcccgagtagctgggattacaggcatgtgccaccacacccggctaattttgtatttttagtagagacggggtttctccacgttggtcaggctagtcttgaactcccgatctcaggtgatccacccccattggcctccggaagtggtgggattacaggtgtgagccacagcgcccgaccaatttttattatatcttaaaggaagtggtaaatagaggtgggtggggaaaagtttagaaagcctttcaaattgttactacagtaagaaaagtatagagtggggaacaagcaggatgagaggaattgggaacggatatgacagatatttcagcatagtgggaattacactgctgtcttgagagatatggtacagccagttatactgtcccatacttactagactgatccaaatatatatgtgttttttgtgcatgttgacattctttcagaagtagcttgataaatctcatataactttgtttcccatgatggtaatgtgttttaatccttagaaggtctttatatatgaaaatagatattgcatatgaggtaagaatatataaattatgtaataatcgtattttaaacttgagttcagacttagaccttatgagttgaaggtgatttcctgccttactgagtttttctgttatcagacctataatttgtttacactatactcttctgatattattagtagtagccaagattttcttcactcttttcttggaaaattggatagaactgttaaggtacagccttctgggttcttactgtccttgaatcttttcatttcttccttcctccctttcctgttgcacactaatgaagatggacatgaaatggacgtgaaacattaggcaaggcaaggcctgacagatttggctggtaaacaactagtcaactttttgaatttagacagttattaattacttaggcagagaaaaaagtagtccaaggtgccatttctctgtgccccttgtctcacacttgaaaagagtgacaccgaaataaaaggggctagctaacgattgtcccttgaatggtgggacaccctgttgctgaggaatcattgttatactgcagctaagcctgtttagtctgcaaatgtaccctacaaggttgaggaagaaaggtctcatgtttcattagaacctgagaggagatgggaaactctcctgacagaagcatcctggggcaagagagaggtgagtggaaaacgtccatccatatagcaacttctcacaagcctctcttgtccatgttccaggatgattccatggccttctgccaagacagcttgcactgtgattcagaccttaacctctctgcgctctttggacatgtgcaaggtctccagagtgccatggctgatctctttcccttcagtggaggctcaagtagaagtactgtttcttctactaatgtcaccccctcatgctgagaaaaacagaatgagaaagggaaagagtggtgaagtggcataggcgataacatccttatctctcatcagtcacacattagtaccttaactttggaaatctagcctttgatgtttttaatttgggactcatatataaaaccagttttttttttttctcttttcgtagcatcttaataattatagcctacttctcttcacagtttcagctattttggaggatgactgtatgtattcctttttaaagtacctattgggactccccactgagaatttcgtatatgccacattaagtgcattttaattttgattaaaatttattcatcacttttcatgtgatacagtaacagcatttaaatgtttaatttcacttatataaatgttcatgttagaataacatacttaaaatctttttctttagatcattgtatgttattaaatgagcaatagtactaccagtcatgtcattttacatattgcttttggcactcatactctttattgctggttttatattaagatcaataataatcaagaggtctctcttttcagtaaatttcatgcagactcggtggcagaggctaaactttagtttgagagaccagtgaaaaaacctggaacctaaagttgagatgatgaagtcttacataatggccttggaaatagagagggagggctgaatctagatgggatatcacagataataaattgacaatatttgggaaaattatttgttgttagtagacctgtgcggtgatctggaagatgcaagcaaggctttagggtctgctggctttttcctagagtgtcaggagcatggtcagatctccatgattcttggagaaagctatgttggaggagatccttgcaattcctcctgttattaacccttccccttacccccaagagtagcagtgttttgctactgcaagctactagttggcagaaaggttattgagtaagtaggtggcagtcttccttaaccctgtacatgggagagcattagtctttgcagctgaagagactaagcagtagagaagattcctctcattgtcttgatgagggactgacagcttgctagcgaaaatgttgcttgaccacaggaatgagacttccatgcaccctcatcttgccattattaaagctatccagcatttgggtccagccttaagagaaggtgagagtcatgactaggccagtgaatataacagtgcatataaaagggacctagttaccagggagaaaacagaagtagaccactgaaagaggcaaaacctagtgaaaatagaattattgaacaaaatattgaacaaatacacttgaacaaaataataagggcacataagcagattgaattataacaaattctttagagctagaaaaaaatgacattaagttttaatgtttagattatttaaaaaagaggacacgtgctattaagttccaaattacaggcctagaaaatcagggggaagaattatgtcattaaatggaatgaaagtactaacagataaaatcaagagaagacgattagagacttacaagaagttctgaaggggaaaataaaaaaccaggtggacaagcaataactaaataatagatgggatgaagaaagacttgagactgcagatcagaacagctggctgttgtctagccaggagagaagtgagggaaacacacaaacacctatgcagagtctggcaaaatccctgaattccaaggaaaaagtaaaaatcctctaagcttccatatgaaagaccaagttgcatacaaagaaaaagaaccaaaccgacaccaggcaatcttccttaccacacaagcagaagtagaaaaaagtggaatgacgctacacagttgacaaagaactgcaactcaggaaccttgtactcagccaaaggaccctccacatgtcagaatgaaaaggagatactagtttatcctatctgaggaaaactaaagaaacaacctgtgaatcaaaatagagacctttatacaggggaagataaagaagacagagaacagtttaataaagaaaacagtagatcagtctcactaatataaattcaaaagtaaaaataaaatattagcaaattgaatctgccattgtatcaaaagaattctagactatcaacactagagtttatttcagacatgtaatgatgatttgttaccaggaaatctgtcaacataatttattctatcaaagggacaaataatcatagaagctattctcatgagaatttgaagtaaaatgggtataagaaggcagttatgcctgtaatcccagcactttgggagggcgaggcagttggattgcttgagcctggtaggtggagtttgcaatgagccaagactgtgtcactgtacttgagcctgggcaacagaatgagactcagtctcaaaagaaaagaaaaaaaaaaaaaaagcagttatttgagtgtaataaagactgttagccagtgtacatcattgtaaatgaaagtactccagagatatttctatctcagttaggaactaaacagggattccttctgtcccaccatcattatttaccattatttgggaagcattaggtcaaataattggaattataatggtagtaaatattggaaaaggaaggaagcaagttttatgtgttcttttctagtggcatttttgtatactaagaaagcccaagagatactggaaagtagctcctagagttacaaggtaaactgttaaagtggctggttatggaataagtgtgtgaatatttttctctgttgtaatatccagtagcatgaaagtggagaggaacgctcttctcatagtagtactctaagtgtttgagtggggggtatgaaatgtaaggaacaaatttaacaaggaaagtactaggtctataaaaagctataaagtatttttgaagaacatcagaaagattgaacaaatataaaaacataaccatgttcttaagatggaaaagatggaaatgcataagattattaaataccatttctcctgagattaatacatacttttaatttgattccattttgagtccccagagattgtttttaaaattaaaaacaaaaaacaacaaagcttatgtggaaggacagatgcccaagaatagtcaagaaaaaagtgaagctagtgggacttgccttagcagatatttgatcatcctgtataacttgtgtttctaaatgaataaaaatggcattggaatagctaagttgaacacataaatgtccaaaagtaaaaccccaaatattggaatttaatatattgaccgatgtgtattttaattcagtggaaagagggtaggtatagccacctatccatgtggaacaaaaaaaaaaaaggaatttctaccttgtatatataccaaaatattttaaaaacttgaaaattttatagaatatatgtataacctatcagtgggtaagaccttttaaaccaagtcatgtcacataaaagataacaataagaaaggcaaatgtatttgactactctccctctataatggatatttgtatatatcggatgtgattcttatgtctcctaatattaaaaattgctaacttggaattctagtagagatttggggtcatgtaaggtctgccatatacttcgaattggaatatactcattaagatgagtatcaaagaacagtgaaggttagatttattactgttagctcatgcttccaaagggtattgcaaagatacctccaagacatatttactgttttgtattctatttataccaggccttcctagcattgtaaattgagttacctgtactgttacacaatggaaaccgatttcccttttagtttgagttagttgcaactgataacagttgtcactttttttactcaagggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcaggtatgttcttttttggtttgcattaatataaggaggttttcagcttagatttgaaaagctataataaagcaggtgttaaaattggtgtttcacacgtatctatcatgtggaaggttttatagtggaaattatagtacacattccttgatactgaaaaataaaaactgaaaatattttgtgttatactatttaatagttttggacacattttaataaaattctaaacaaaggatagttacaattgtggaactcttcaaattctgaaaatcttatctgattaagaattagatatgaaatcatgtcatctcctgcttcaatcctttggcttactgtgcctacaggataaagtctgaatgccttcatggaacgtacatggccatcagggatttggttccttcctgcctctccagactcatttctcaacacactctgccttgaacttttttctttctgtggcactgaactggagtttttgtatagctatcacattctttcttaccttggtagctgtttttctatctcaagtcctttctgccttttttgtaagttcgtttctctgctggactcttaatacaattttaattctgaaactccattctaatccaagctaggatagtttcccctttctcctgttttccttgtagcttgtgtaaacctattttgttgccttaatcacattattatagtatttccctgtttgtcacttttttgagtcccttggcagcagataaaagcaccagtagtttcctaatttgtaaagagcatctcaaagaaatatggagagagagaggcaataacatgacattagactatagtggatagaccttaatctagtagctttcattgacattagtataaaatgcatgcgttttttgtttaaaaatgataacagcagctatcttttgtaccatgctccattattttcaaattaccaacaaatctcatttgagcctcataatgctgagttggttttatttccatttttcggaggaaacatggtcaaagagggaacttttttttgttttgtttttcagtactcataaaggctcagtaatgtaaactggtacaactttcctggaaagcttcagaagtcatgcccttaatccagtaattgtacttgtagtaatccatcctaagaagacaaaaggggaaaaaaaaaaaagacattaagatttagtgttgtctcaacagtatggtttcaactatgtataaacaaaaatttgaaagcaaaaaggccggaagaaaatgcatcaaaatgttaatagtggttttatcatctttaaactcataatgagcatttatcattttgtaatcagaaaagaaacatcacatttgtttgcattttgaaatgaatttctcaagcttacattgctaggaaatggtaaagctgaacttagaagctgggcttctgttaagtctgtgttcctttctgcaaaaatatcaatcctattcttctgaacccagaattttactaaaattttataattttcatctccttttactctctaccaaatagtgatatcttcaaaaaataaacagtccggtagaggtcgaagaaggacactaaactgaaagtcttaataaactgagtatcaattacttaaataataattggacatagtacttcaggccctattactgttacttagtgaaatataatgattgaattttggtgaattaaaaaatgtttgaatatataaatatacacaagtttacatatttacattctgaaaagattaaaaaaaaaatttttttttgagaccgagtctcgctctgtcatccaggctggagtgcagtggtgcgacctcggctcactgcaacctctgcctcccgggttcgagcgattctcctgcctcagcccactgagtagctgggactacaggtgcgtgccaccacgcccggctaattttttgtatttttagtagagacagggtttcactgtgttagccaggatggtctcaatctcctgacctcgtgatccgcccgcctcggcctcccaaagtgctgggattgcaggcatgagccaccatgcccagccctgaaaagatttatttttagttttaatcattaccctaaaattccttatagcatgtaaggcatgttactttttgtaactgtactcataacatatgattattagagtatagcataataggactgctagtattaaattacgcagtcttcttctcccgtgggtgttgtgggaggttcaccttgatgtgtatgcttctaaaaatgaatgatagaagtttattatgatagtcatcatcggtcgccttaatatacgtttatagcaaaccttttgagattttttttcttgagattatttttaagtagagcgtaagccttagttcaggcaaacaattttaaagaaattcgcttatttctttttttcattcacttattcatgttatagaccctgtctttactactcatacacattttatgttcatccttatgtctgccctttcctacagcacatgctaggagaatactacagcagtctaacagaaatgcatgcaatgaagcgccaggtaacaatctgcgtagttttggtgtccactttttgttaattttttcccattggtcctaaaggttttattgtcctgatttttttcttttttaaatttagctgagagtatatatgttatgtgactattgtaaaagataatttatattcataaaattctgaacccattcatttataattcttggtaaaatttgctgcttttgttttcatattctgttagtgtatgtaacctaacacattcataagggtaacagaaaccttttttacggtttagtacttgatttgaggttattttgtacttcttcaaagcattagtatttcttagacctagaaatatagttacttttatagtttatctttccatttcagtcagcatcttagaaaagtcatcaaacaaaacaatgattacatgcaaagacgtgataaataaagatcatggaaattacaaagattcccaaatactattttagtctctaatataagtattctcattaaatgtggttctttgtgatttagagttgtaaatatttttttaactcctcttgcagctttacatgaatgaaaagtaaaagccagtttgaatggaacctttaggggaatctaaagatacaaaacaaggatccagaactgacaaagctgaatatatcagtggcactttgaaaataaggaactctgaaaataggatataaaaacaagatggaattagagaaacctgattaagattagggatttttccagccaaagctaataaatttcagttcaggaggagaaactggcataaactttccacctcttgactgcagaagtggtgggggaatgaagcttgtgtttaaatggcatattcattatttgagaataatttaatttttaatgatacgcaatttagattgataattttatcacatacagaggtattaaatatgtcattaaacagttatagctttgaaatgaattttttaaattaagtatgattaaactgcaatatagtatataagataaaagtttgcatatcaaaattctttttacctggatttttcccattagaagagattgcttacagagataattttggttcctgcttattataataagtgtcatttttgtgatagttcataccttaaaactacgagaactttagtgtatcacttgattttatacctgtaactgaggcaaaatagggaagttgcatatttattgttacatataattaatatatttttctattgatatcttatattagtaatgttattatttcatgcttgtggaaattgagacctgaagatattaaattattagccaagtagtggaaaatttttctattagagcacattctttttccattttcttattcctctcacaaaaatgagtttttatgatcttgtatacttctttgaaagcgcaatgtattaagatactcaacattttaaatggatacctttgagtgtaataattttgtgttatcaacaagtaaatttagccgaattgtagctaaataatagagtgatgcctagattctgtgaaactgaaaacttcagttggatcacttgcctgctccaatatacactgagtatgtaaataagacacaatggtgaaattgacctattatgttaggttacagatttggttactcatcatcacagcacttttctgtgtgatgtatgagatttgataattagtagactatactggatagaccttaatctagtagctttcattggcagcattcagtttattctttttaacattaacaaaatatacaaacttccttttctgtaatgaagtccatattagcaaaagcaaaaaagaaattagcacttagcttatttctaagtgttgaaagattttcactgatttttcctataaaatgtataatattttctgtatattttatatgatcagaaataaacatggttcttagtaatgctaggtaatgttattcattaaagtttcatttttagtataaaatgcatatcttgatattttaagattttatttatcttggtaatattaagcttcttttctactttaaaagctctgaaatagaattgtctaaaatagaatttttagataatttaaagctgagagtaatgatactagctaataaaagttgtcatgaaggtacttcatcaatattaactttctggtcttttatgtattccagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggtatctggtacctaacataatttttcctaccctattatcaccttcttcatgattatctctggttgctgtcttagactgaagcatgtgccatatgaattttcatctgttctctatgtgctttcttgacattttatttaaaatttttgtatagcttaagtagcattaaagtattttttttgagtactttttcagtgttttgtctacttcctcacacttaacctgtgagggtagaaacagtacatttttccttccatctgcttttatttttgaatctgtaatataaatgaatgattaagcatgtatgttttatataaatgatgatcttattttcttatttaggacatagtatccagacatatttctgagagccatgaaaaaggagaaaatgtaaagtcagtaaactctggtacttggatagcatcaaactcagaacttactcctagtgagagccttgctactactgatgatgtaagctgataatgattagtgaattgtagatataattttagtatgcagtaaataaaagttaaatagattattgtcaaattgtaggtagacctaatatatttgattttcagctttttttaaaacttgggtataatgtgttattttattttgagggcgagatataatatgcaatcaaaatatggtagcaaacaccaaaaattatgtatgtatgatagattatgaggtctgagatagccatatttatgttgttattacccagtataggggctgactcttaaaagacatttacaaatgtatgttgtatttatttaagacattcagtaaaacaggtatcagattacagtaaaaacacttgaatgaataaatacaggataaatcaggtctttgggttaaaaaaaaaaaaaaaagcctagacaaaagtcttccaggaaaaaaattgtaatttaatgtattctaattcatggagaaaattttgaatagagtaaaaaggacctggaaatggagaagagtgctaaggagaatggtataaattcagtaagctgtgtcctccaaatagcacttagcacatcgttgattgaataacagtgacagaactgctagtatattgaggagataatgtgctaggtgtttgggaatcacctatttcaaggttcaggccttgattttattgtaaaatatttcatgtggtcgtgggatagcaaatacattcctttttttatgacaactctagcacctagagatacatgggtaagagtttcgtagttgattagcaaatatcagctataggtagagagttggaatttactgtttctgccttttgttgaagtgttaatactaagttttttctgaagccagtgttttctcaaaggattgtctttccttttcagatacagtaatttctgagtttttctgaatttttgctctttaacttctactcgtgtttaaaataataacttccccagctcatcttttctgtttaaaatgttttcccactggactctgactcctttagtactataacataaacctgtgtctaaaaactacatggttttaattaactttgcaatgtgaaatgtaaattagtgtcagtcagtgtttgctcctttggattgttataactaattgaaaattgtgtattcctttttgtgggaaatgaaatgcgacctgcttgaatacattaaaaatagatgttaaattatattaaggtttattgggcactgaaacaacttgagagagaatgaacagtctccattcctagacgtatttttcaataattttatatccttaattccagtgctttcacttttatccaagtttcatacaggcagcattacttccatttattttaagagattggagcacattggtttgcaccatcgatagcacattttgaaagttgagctacagtttaggataaagttaacctaagaaggttttaaagttaaatgaaatttaaagatgctgtactacttgatacgtaaggacttgggatagtaattgtatttagtattacttttaattaagtaactaaatcagttctttgatatttcttccaaaacttaaattcagcattaaggtcaacatcttccctttactaatgccatttaatcagcagcaccacaatatccagtgttgatactcacagatctgaagcagcagtgtccagtagaactttctatagtgatggaattgttttatgtctgcattgtctaatgctgtagccattagctacatgtggctagcaagtacttgaagtatagctattgtaactgaggaactaaattttaaattttatttaaatagccatatggtgttttttgtattggacagattcagagcctcattctctagatgcttctatgcttcttgagcttcatttttggagcttttacaaacgtatattaagatgtgtaagagatacctctcttgcctagggaagagagaaatgaaagtgaaactgggaatctgggagctgtaagtcaaggaggatggagtggagacactgaggtttaggaagaagaaaacacactttgtgtctcctgctcccgatgataataaaatggtaaaagcacatctgtcttgaagacttgaagcacatcaagtcttacttgaaacagtaaaaaaaatggtttccctattcctaaaatacgttccttaatgtctaaatttcctttaatcagggacaaatgtttgatttcataattgaagataggaaactttaaaaagatcattagttaagggaaagaacacaactgtaaaatgtcataatcaaagtgtaagtgagacaccctaccaccatcacactatacacaaaattaatttgaaatgacctaaagtcgtgtaaaagccaacactattaaaacttttaaaagaaaatgggaaaaaattatgaccttgacataggctaagttttcttaggacagagaaagcactaactataaaagaaaaaattaagaaattagacttaacaaaaataggaattttctgcttttcaaaagatactgttatgggaaaataatcccagtatatatatctgacaactgtctgatatatagactgtataaagcttacaactcagttgtaagacaactcagtaaaaactgggcaagagatttgaacaggcacttaatgaaagaagatatatgaatggctaatatgcaaattaaagccacagaaaataccacttcacatcaagaatggctaaaatgaaaagattgacaataagaagtgttggtgagaatgtggaacagttggaactctcacagtccttatgagaatgtaaaattgcacaaccacttggaaagcagtttggcagttgcttataaacataaacgtggcatgtgacccagcaatttctcttctaggtattcatccaagagaaatgaaaatatgcatcacaaaaacacttgcacattaatgttcatagcatctttagtcatgatagcctcaaactgaagcatcaagagataaatggataaacaaactgtggtatatctatacagtggaatactgtgcagccattaaaaaataatttctgaacttctgaaacacaaaacatggattcatttcagaaacatactaagtgaaaagtcagacaatgaagagtgtatattggctggttccatttgtatgaagttctacaaccagcagaactgatctacagtgatagaaatcatgagtagggtgtggtggagattgactgtagagggttgtgaagaaacgtcctgggccagtggaaatggtctttatctttagggaatctggttacatgagtgtatacatttgtcaaaactcatcaaactgtacatttaaagtgagtgcattgtatattaattatatttcaataaagtttattttttaaaaatgcaaatgatgttgtgatgttttcttttctgatgtgagacaaccaggtagagtaagctactagacattgttagcatttggagataggagaatgtccctgagagtatagaaataatgtaaaatgttaactttgccaaattagaatttaatcagtagctgtctttgtgtgtgtttatctacataataaatattctgcaaggctacttatatcactgttctctgtgactctgtattcagcgtttaataactttggttatattatcatcttgtttggacagaatactgaggaaacttatgaatatcttttaagtgtacaattttatgtaaatacttagttatctctgttagattattaatatgaaattcttagaagtattagtgatttttgtttgttttactgtaacttaggaaacttttgagaagaactttgaaagagaaacccataaaataagtgagcaaaatgatgctgataatgctagtgtcctgtctgtatcatcaaattttgagccttttgcaacagatgatctaggtaagcagaattgtttataatcttagaaacaactttaagttgatctggtccagtctttgaattggcgttgataaggaaacaagtctagaaaggcgaagtgtgtgtggttgaaagaatgtggacttaattatctatcagtctaaaatcaagaatcttctgactcttaaccctgtgagcaaatcatccaacatttttgactctgcatatactaaggaaatgggaattttaacctaccttgctatgttcttgtgaaaatataatgtaacttacttgcttgagttcagaaaatgttaatttccttttccttaaaggaaaggtcatcgtttaaggtcatctagttaattcatgggaacaattcaggcctcatctaatcatatttttaataaaaatattaactttgtaatttgagttaagcagtcagttttcttaaataacctgtagtgaaaacctcaagtaattctcaggcatagcaaatggttttggttgtttttttttgtttgtttgggtttttttttttttccccctctcccatcagctgtaaaacaaaagaggtttagagggttgcctggctgcagtggagaaaaaattcgagtcctagacttggaaaggaaatttaaggaaaagaaaaatatgtagatacttgatacgtttctagactgtggccaatcaaaagagaacctgagaattcagtcatttgccatccagggtgcttagttgataaaataatgtaatgtcctgttactctagtgtttgttcacgtgatgaagagaagacttagattatttcaaaggtatttttccactataaagaaaaggacttagccttgccctatcattacattcctactgttcgccaaaacaaaagtcttccttttgcttattgtaattattgaggactcagccttagctgacctctaagtaaatgcttatttgggtctgcattgagttcatcccattacagagaaaaattactgtgtggcctgccaaccctcaccccttaggttgtccctctctttctgagttgccagaatacttcgactcctacgtattttctttcatttactggtatttttttttttttcttacaaacctgcaccagtagctgtgtctgaagtagacatagaattgggaaatttcattgataggcctttttcttacctaatttgcttgttttaggttgcgttgttttcatcagaatttgcatgacattttggaattcacttgtattgtttaaatgaaacaacaaaatgaaataaatatgggcttcagagtttgataactaagtttaaatccttgttcctacattgaactgtctgtgaaagcttgagcaagttacttaaattttctgcaaatgaaagtaatgtcatctactatataggattattttaaggattaaataagtgtgacaatgtatatgaagtgctcaagtagtatagtgtgtagaacttgttaaagctaattttcctcccttttgtttggacatttttttattaatgcattttgaggaatatatgaaaaagttcacttttacatactcaaaaaatatttttgttccaaatgtaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaaggtatatatttttgttttcggtaggtttttggagaacaggtggtgtttggttacatgaataagttctttagtggtgatttctgagattttggtgcacccatcgcctgagcagtatacactgtacccagtgtgtattgtttgatccctcacccccttcccaccctttcccctgaaaccccaaagtccactgtatcctgcttatgtctttgcatactcatagcttagctaccacttatgagtgagaacatgcaacgtttggttttccattcctaagttacatcacttagattaacggtctccaactctacccagatggctgcaaatgccattactttgttcctttttatggctaagtagtatgctgtggtgtataaataaataaacaaatatatctgtctatctacacatatatacatataccacattttctttatccgctcgttgattgatggacatttggactggttccatattttgcaactgcagattgtgctgctataaacatgcacgtgcaagtatctttttcatataatgacttcttttcttctgggcagatacctagtagtgagattgttggatcaaatggtggatctactttcagttgtttaaggaatcttcatactgttttccatagtggttgtactagttagtttacatgcccaccagcagtgtaaaattgttccctttttaccacatccacactaacatctattattttttgatttttaaattacggccattcttgcaggagtaggatggtatcacattgtagtttgtgctttgatttgcattttcctgataattagtgatgttagagcattttttcactcaacatcaccaaaaagttttttggccatttgtgtgtcttcttttgagaggagttgtctatatccttagcctactactactacttttttttttttttttttttaatttgagcacagtcttgctctgttgcccaggctgcaatgcagtggcacaatctcagctcactgcatcctctgcctgccaggctcaagtgattctcatgcctcagcctcccgagtagcaggcattgtaggcatgtgccaccatgtccagctaagttttgtatttttagtagagatgggatttcagcatattgtccaggctggccttgaactcctggtctcaagtgatctgcccacctcagcctcccaatgtgctgggattacaactgtgagacaccacacttggccttagcccactttttgatggttttttttttttttttttcctgatttgtttgagttctttgtagattctgggtattagtcctttgtcagatgcgtagtttacaaagactttctcacactctgtgggttgtctgtttactcagatgattatttcttttgccgtgcagaaactttttagtttaagttccatctgtttatctttgtttttgttgcatttgcttttgggttcttggtcatgaagtctttgcctaagccagtgtctataagggtgtctccaatgttatcttctagaatttttgtggtttcaggtattagattttgaaggtatattttttattgattacaagtaataataattctatgtaaaaaatttaaatatgtgatatctaatggtggttttattactactttattttaattgataggggtgcttaaactacaaacatgtttctttgtattatgttagcataaaatcatcaaatttaatatttttcaaatttcaacataaaggcatatatgtatatataataggctttgttaggctaatgtattttctttttaaaaattagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggtaagcaattattttaaaaaataaacgaaaccttctatgttttgttttttaattcatacagaagaccttattgtgataaagttcaacggtataggtaaacaacaacaaaaaaactatcacccataattttttcaccctaccaacattctctgaacctttcagtaatattttatacacatgtgcatattctgcctttttcatttactatatcataaacttctttctagatcattatttttctgctgcattttttcaggatttatcacctttatttttagttttagtttttgtgagtgtatagtaggtgtgtatatttatggggtacatgaaatagtttgatacaggcatgcaatatgtaataatcacatcatggtaaatggggtatccatcccctcaagcatttaacctttgtgttacaaacaatccagttatactcttttagttattttaaaatgtataattaaattattgactgtagtcaccctgttgtgctgttaaataatagatcttattcattcattctgactactttttgtacccattaaccatcttccctattccctactacctttcatagcctctggtaaccatccttatacagtttatctccatgagttaaattgttttaatttttagctcccacaagtaagtgagaacatatgaagtttgtctttctgtgcctggctaacttcacttaacataatgacctccagttccatccatgttgttgcagatgacaaggtctcattattttttatggctgaatagtactccattgtgtgtctgtaccacattttctttatctgttcatctgttgatggacacttaggttgcttccaaatcttggttgttgtgaacagtactgcaacaaacatgagtgtgcagatagccctttaatacactgatgtcttttcttttctgtatatacccagcagtgggattgctggatcatatggtagctcttgctgtattttcagttttttgagcaacttccaaactgttctccagaggggttgtactaatttacattcccaccagcagtgtatgaaagttcccttttctccacatcctcgccagcatttattattgcctgtctttgggataagtgccattttaacagaggtgagatgatttctcgttgtagttttgattgtcatttccgtgatcatgttgagcaccttttatgtgcctgtttgccatttgtatgtcgtcttttgagaagtgtgtcttcagatcttctgcacattttaaaattagattattagattttttcctatagagtttgaactctttatatatgctggttattaatcccttgtcggatggtttgcacatattttctctcattctgtgggttgtctcttcactttgttgtttgtttcttttcttgtgcagaagctttttaacttgatgtgatcccatttgtctgcttttgctttggttgccagtgcttgtggggtatcactcaagaaatttttgcccagaccaatgtcctgcagagtttccccactgttttcatataatagtttcatagtatgaggtcttagatttatgtctttaatccattttgatttgacttttgtatatggtgagagatagaggtctagtttcattcctctgcatatggatatccagttaccccagcaccatttattgtgaagagactgtcttttccccactgtatgttcttggcacctttgttgaaaatgagtttattgtaggtatgtggatttgtttctgggttctctgttctgttctatcggtctgtgtttctgggttctctgttctgttctgtcggtctgtgtttctgttgtttgtatgccagtaccacgctgttttggttactatagctctgtggtataatttgaaggcaggttaatgtgattcttccagttttgttctttttgctcaagatagctttggctgttctgagctttttttgtggttcctataaattttaggattcttttttctctgtgaagaatgtcattggtattttgatcacaattgtattgaatctgtagattgcttcggggagtacagacattttaacaatattgatttttccaatccatgaacatggaatatctttccctttttgtgtctttttaaatttctttcatcagtgttttatagttttcattgtagagatctttcacttatttggttaattcttaggtatttaattttatttgtgtctgttgtaaatgagattactggtggcatatagaaatgctactgatttttgtgtgttgactttgtatcctgcaactttactgaatttgttgatcagttctaatagtattcttgtggagtctttaggcttttccaagtataagattatatatatatcatatacaaacaaggataatttgattcttcctttccagtttggatcccctctatttctttctcttgtctgattactctagctaggacttccagtactatgttgaataacagtggtgaaagtggacatccttgttgtgttccagatcacaaaggaatggctttcagtgtttccccatttagtatgatactagctgtgggtctgttgtatatggcttctagtatgttgaggtatgtttcttctatacccagttttttgagggcttttatcatgaaaggatgttgaattttatcaaatggtttttcagcatcagttaaaatgatcatatgggttttgtccttcattctgttgatatgatgtattacattgattgatttacctatgttgaaccatccttgcatccctgggataaatcccacttggtcacgatggatcatctttttaatgtgttgttgaattccgaggtatcggttgtaatgtctcctttttcatctctgatattatttgggttttttgtctttttttcttagtctggttaatggtttgccaattttatgtatcttttaaaataccaactttttgtttcgttgctcttttgtattttatttcaatttcatttatttctgctttgatctttattatttcttctattttgggtttggtttgctcatgcttttcttgttttttaacatccattgttttcgtatctgttatatgtatgtttttggatttcaggttaccatgaggattgcaaatactgtcttataactcagtattttaaaccgataacactgattgcataaacaaacaagcaaacaaaatgaaaacttatgcaaatgttaactttgtttccctgctttttaactctttgttgtttctctttatatcttactgtaccatgtcttgaaaagttgttgtagctactatttttggttggttcatcattttgtctttccacttaagagtagtttacacaccacaattacagtgttataatattctgtgtactttctattactggtgaattttgtaccttcagacgatatcttactgctcattaatgtcttcttttagatggaaataaagtatttagtatttcttgtcagacaggtctggtgttgatgaaatccctcagcttttgtctgggaaagtatttctccttcgtgtttgaaggatatttttgctggatgtactattctagggtaaaagttttcttccttcagcacttgaaacatgtcatgacactctctcctgacctgtaaggattctagtgacaagtctactgccagatatattggaaccccattatatgttatttgtttcttttctcttgctgcttttagggtcctttctttatccttgatgtttggcagtttgattattaaatgccttgagatagtcttatttggattaaactatcctggttttctgtaaccttcttgtacttgaatgttgttaagcttactacctctgtctctctctaccccctctttaaggccaataacttagatttgtcctgttgaggttattttgcagatcctgtaggtgtgctttattgtgttttactttttttttcttttgtctcctcaagttgtgtgttttcaaagagcctgtcttcaagctaattctttagcttgatcaattctattgagagattgatgcattctttagtatgtcagttgcgtttttcaactctagaatttctgcttgattcttttaaattatctcaatctgtttattaaatttatctatgaatatagaattctgaattcccggccaggtgctatggctcacacctgtgatcccagcactttgggaggctggggcgggtgatcacttgaggtcaggagtttgagaccagcctggccaacacggtgaaaccccgcctctactacaacatacaaaaaaaaaaaaaaagtagctggacatggtggtgcgcacctataatgacagctacttgggaggccgaggcaggagaatcgcttgaacccgggaggcggaggttgcagtgagccgagattgtgccaccacactctagcctgggtgacagagcaaggctccgtctgaaaaaaaaaaaaaaaaattctgaattcccttcctgtgttatcttgaatttgtttgagtttcctcaagacagctattttgaattctctgtctgaaaggtcacatatctctctccaggattggccactggtgccttatttggtccctttgttgaggtcatgatttttggtccctttgttgaggtcgtgattttctgtatggtcttgatgtttgtggatgtttgttggtgtctgggcattgaagagttatatataggccttgtatcttgtaggcctcacagtctgggcttgtttgtgcccattcttcttgggaaagctttccaggtattcaaagggacttgggtcccaagcccaaaaacactgtgctttttgcagactcatagcggtataccactttggtgattttggataagatccagaagaattctctgaattaccaggtggagacttctgttctcttcctttactttctttcaaataaatggaatctctgtgttgaaatgcctggagctggatggagatggggtgatggaggcacccctttggtgacttaccactgtgactgtgctgggtcatacctaaagccagcacagcacagcactggggcttgcccaagaccctctgtaaccactacctgactaccgcctaaatttgcctaaattcgctcaaggccctagggttcctactattagcaggtggggaagccagccaggtttgtgtctttcccttcagggcagtgagttcccccaggtccctaatgggtccacagatactgtccttgagcttagaaatctacctggtattctgtcctactgtggctaagctggcctttaaaccacaagacaaagtccttcccacttttacctctgctttccataagcaaaggagtctctcctggtggctaccactgtgaccaccggcccatgagttctgctaatattcatttaaagcccaagggctttttagtcagcttgtggtgaatgctgccaggcctgggactcacccttcagggcagtgggctctcctctggcccagggcaggtccagaaatgctgtccaggagccaggttctcgaattgcggatcccaggagcctgcttggtgctctaccccactgtgatcgctctggtacttaaggtgcaagacaaagtcccctttttcctctacttttctcaagcagaaggaatctttcaccatagccatcacagctcagtatacgttggatctcacctgaagccagaacatctctgagtctcacccaaggcccatggcatactacatgggtatcactgtcagttattcaaggttcaagggctctttagtcagcaggttaagattaagccaagattaatccttccaggactgggtctttccctttaaggcagtgggtttccttctgggccagagtgtatctaaaaatgtcatcttggagctggggcctggaatggcgacctcacgactctgccggtgccctgttgtagctgtggctgagctggtatccaagatacaacacaaagtcctttttactccttgctctcgtctcctcaagcagaaggagtcacttgcattgctgcagtcagtgctgcctggggttgggggaggggtggcgtcagcaattcaagatggtctttcctaccctcagtgtccctttcagcaatacaaagttaaaagcaggtaccatgattgctcacctggtttttattcttataatggtgctttttttgtgtgtagttgttaaaatttggtgttccagaaggggaagatgattggtggaggcttctgttctgccatcttgctccacccctgcctttttttttaatggatccacaacattcattccaaaatatttataaaatgcctacttaatgccaggtttggcagacctagcagtgaacaaggcctttgttctcatggagcttgcatgctagagtgggaatacactctgaaataacataagtaaataaaagacatataagtaactgtttatcagttaatgatacaggccatgctcagaattaaaatttggtgatatgatggtgtctgttttatattggatgatcagggaaagcttctaatgagggaacatttaagtagagatgtgactaaggagccagtgtaaaccaggattgttctagacagtgcactggccttaaggtgagaattagcttcgcgtgttgaaggaactagagggaaagtctatatggttggaggatatttgtatgagactaagttgaaagggaggcaagggctaattgtataaaatattacaggccatggttagaagtttggactttgctcaaagtttgaagggaaactcctagaagattttaagcagagaaaaaaagtctggcttgtttttagaaaattgattataagggggtcaggagtgcagtgagatcagaagagaaatgatagtggcttagataagggtggtgataaagaaatacgtaattgggatatagttaggaaatcagtaggtcctactaatgggtagagtgtcgagagagagagaaaactggctaggaggaaatacgatttaccaaaatgaagaaggcttgggagaagggggagatgaagagctctgttttttttgaggggggtggggtttgagacagaggctcactcttatcacccaggcgggaatgcagtggcgcgatctcggctcactgcaacccttgccttctgggttcaagcgattctcccacctcagcctcccaagtatctgggactacaggtgcctgtcaccatgcctggcttgctttttgtatttttagtagagatggtgtttccctatgttgaccacgctgacctcaagtgatgcacccgcctgggcctcccaaagtgctgggattataggctcgagccactgtgccagccaagagttttattttgtactttaaaattgaactgtcttttagacaatcgtagagaggtcaagtagtcatttggttactcagctaattccaggcacagctggagatagacataaggtagattatagcatatagctgctgcctaaagccagggcatttgatttgagaatagaaaggggccttgcaactgtgatgtgggaccaggtgattcagcatttgtaagttgtacaaaagcggagccagggttgaccaagaaggactgcaaggagttagttatgttgatggctgctatgaggtcaagtagtcataaaatacaattttctattaattattttttcagtccctgttgttaaatatttgtgtttattctggtttcttttccactattacaaacacttattgaatgattgaaggtaatctgtttacttttgtttctctagaaacaatttttagacataaaatttttagttcaaaggtcataaacatttttaaagctttttagacaagctgattgtccttcagagaaactaaccagtttatattcccatcaacattgatagtatcagactggtaagcagtactattaatttcatttaacaacattgatcagggcagatggagacatgtgcaacaaatggaataggaagacaggacttctttctgagatggcattcattacattctaatttaaaatggaagttttaacaattagaagtgaaaagtaattgttttcttttcatctagatatggtaaactacaaaatacattgtcactgggctagtttcttatattgtactcatacttttctttgtaagacatgtaccacagagaattgcttccattgtgctcatatttcttccctcagcagaagtaattgcttttttttggaatgttttgagagaagagagatctttgagaaagcacctgtagaaactgctttctctgtatctgactttacagctgagaggaaaaagtcagctgatcgtgtccagattattccatgtaaaaacagaaacacgtagccttgttctgggcaattgcaacagttcctaaatggccttactatccttttgccgctgcttctaacctttcttttttttttttttttttttttttttttttttttttttttgtggagagatctgttaaattttttttttctttttttttttttcttttttttattatactctaagttatagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagttgacagtcccaccaacagtgtaaaagtgttcctatttctccgcatcctctccagcacctgttgtttcctgactttttaatgattgccattctaactggtgtgagatgatatctcatagtggttttgatttgcatttctctgatggtcagtgatgatgagcatttcttcatgtgttttttggctgcataaatgtcttcttttgagaagtgtctgttcatgtccttcgcccactttttgacctttcaactctcctactagagttgttagcacttctgaggccttggcacttgctaatacttctgcctggaatgctcttccttcacatacctacctgcatggcttgttttcttgaactcaactgtttggtcaaatgttaacttttgctgagtaaacctctgccttatcctttacctgcttagtgcttgcacgccacctttaacctatgtaatatttgtctgcctctccatgctaaaatacaagatccatgacatctgagatgttaatctcttttggtcactgtccaaaaatagtacatgcacattgtagacactcagtaaacattaatgaattaataaatgactggaatcttcaaccctcaactgtagttgagctctttagacgctctaagtgtgaaaacaactggcccataggataaagaccaggttcattgtcactcataaaaccttttacagcttggtctggcctcttaagccttgtgtcctacttgacattattgaaaaaggcacattgcccacattatgtcctttacctagaatgaccttctcctctttctctgtcagtttctcctgtttttcaggagccagcccaaatgttattgcatgtgtttacaggcagaattccttcctctcttcactgttcctgagatactggattcatgccttcattatagcacttatgacaaaggatcataattatttgtatctcccccctagaatagtatctcatagtacctacagccaagaagcacttaagatactggataaaaagaatttgagggataaggcataaatacatcagttttaccaagtgttttgtgaatttatttcctgttacttataaatatatgtatatatttaccttccataaaagaatatacttataaattttaagaatatagattttttatatagatatttatctcagagcttgaaaccattgcctcaagtgaattggtttaaattttcttagttaatgcttgctttcatcttaggcctaaagtattgcctttttgcttttatacttttattttagcattaatagtacaataaatatttgtcaacatgtcttttaaaaactaataggtatgcttgtagtaatatttatttgatatgtacagttactttataagggttaaaaaaaaagcctaaatgatctatccttatgcttagggagtgcagccttcagttaggaaattgattgtttttacttttttgtgtctgatttgatggaagaattatgtaagttacatgctatctgctcagaaactgttatacaataaaatatttaatacttgagcgaaatagaagtcaccttgagtctgtgaaatgtttaaaaagtcttgaatttaaaagaattacattttttaaagtgatttttcttaaatgtctaagatattaggaaatatcaatggtattttagttggctaaagtggctagtgacactcatttaataggttttccatttgaccttttaagcgctactagcatatctagagttacctaaatcacaacacttatcttgtcaccttgtgtaaaatctaaattgttccttctcactttacctgtgtagccctgatttaagtgatttcatttcatgaggaaatgaaataataaatactaatttagcatttcaaaaagtgtctgaggccagtaaagagtagaactaataatctgattttaattatttatgatgtctcatttcacttcagatcttgactttttttgtaggactgtagaacttctttgttaattatgcccaggcagcattacacccagtcacctgagttagacttcttgactctctttatgtcatcactagtgagtcaaaaatgtattctcctccttagagtcatcaatttgacttcactttcttctttctagtagcatgaccttaattcatattcttaccttttgcttagactacctgtcgtaataggcatgaagtgcatttttactaagccgtgtcctacccaaactccttagtcttcaagtggcttcactgctggatctggtgtgctttccccctctagctactctccatctaggtacattcacttcacattattcaacattttccatatctactgttactttttcacgtattagctgtttgtacaagttgtcttgtctatccaagaggtaaaatactttcactcttttctgcctggctgaaatatttcttcagaaatatttgttgttgcctccagtatgctcctacagctccttagagcacctagtgggtgctttttaaaaatatttatttattcagtaagtaatgtctcctgtgagccactgtattttgtgataaataagaatacctgcagttaaaaaagtgttatctaccagacagcacggagcttatagtgattatttatatacgtatctgactcctgcatagtatttgactctctgaagacagggacagttgtgttgttgttgttgtttttttttttttttaaatcgcctgtcttgacacatacattattttaaatgagcttaagtctgagaggggaccttgaacatctagtttggcaccctcattttatagatatgtattggtgggggggactgaactgagaaaaggtttaggatttgcttaaatggatttagtagaataagaaggattagaaccttgagattacttgatatcgatgatttatggactcaacctcagaaagttaaccatgattcatattattttgtagctcacacatgcttctcaaggaagtttaagaagagacacttgactgaagtgatttgttaagaaagttagggggtgatgttaaccctcaagacatttcagaatgtctaaaggtatttttagttgtcgaggtggtgtagggaggaggtgttactggcatctagtgggtagaggccaggatgatgccaaatatcctacaatgcacaggatgtcaataatgtgaaggttgagaaaccctgagttagaaaataatagggaattgggtacaaggtgagtatgcttgtaagagtatttgaaattaactgaatgaaaacagaaagattggcaaaatggaaactagcatgaatagttctccttaaggtacagaaaagtacagaaagaaagtgctgaaaagtactggatcagccagttcttttactggccatcatctgctttcgtgggtcaaaattgccaaacctctcaatacgtatgaataaagtaggagtttggcttttcttatgaatggatatttctaaacagacatctgaaaattgaggagcatctacggcaagaaaattaaaaattaacattttgtattatatggattgattttctttttttaaacaataggtaagtttatattctaaccaactaggatttttctcaggagcacatggatgaagtatgctcctcgcagcttctaacttcagtaaggcgcatggttttgacccttacccagcaaaatgatgagagcaaagagtttgtaaagttctttcataaacaacttggaagtatattacaggtaagagtttatacttgtatgatttaccaatatgtactgtgtggtaaggttttttttcggggggtgggtgaggcattttcttgcattacacaatttattctggtggacatccaatctagcgtccatttgggatgatgttgtaatactttttagttgtcacttggttaaaataatattgtattattaggtcctgtttgtatcttcatttaatttggtcatctctaaggcatgtctcttataagcttttactggtttggtttatcttctcactgaaaacattttgagtttgaaatgtttacaaagtattctgtggctgtttctaaaataattggctaaagtaatttgactaatcagggaaattttggaagccagagaccagctggttgtagagactttttagggtgtaccagtacgcttaaattatagtaagtcagtaactgggagagaatttgccttctaggagacatttagcagtgtctgcagccattttgtttatcacagcaagtagtgtggagaaggtaggagggctgagaggaggacaggtactggcaactaatgggtagagaccaggaagaatcttgataaacatttgacaatacacaggacagtaccccatagcaaagtattatctggccctaaatgtcaacagtgccaaggttgagaaatcccatgttagtgttaataaaattaccttgtttattccatatgacaaacatctttacctttatatttacctgaatgtttttccattgagatagttcagtgatgtgtatttttactccacattaggtgatacatttttcttctcatctttattacagaattttcttatgaaacttggctttgcttcttatttctgtgtttaaactggttttagataatcactattaactttttttaaaccttgggcttgatgcaaatttgtatcactgtaattttccattttgttagtattaggactaaaggacaaattgtcctggccccgttagcagttattagtactaacagataatttctaaggactacaaaacattgatggtgttgtgcattgtaggaaactccattttagaataaggctgaaagagaaattataatttaaatattttttatcaagatccatgtagcccttcctcagttttgccttctatgataattgtggacagatcccaaagcattaatttctaaagacttttttctcagtctaaggtttgactgcttttctttcatcccgttcttgattttttcacaagaggacatacatgaagaatacaagttaatttacgttaaatattgcccagagtattgaaaaatttttatgagctagagcttaaattaccatcttctacatttttccttctgaaacccgttcaagaattgttttttccacaaagcacccagcatatgtacgtttttaccataactgtactagataagatagtcttttggtgggggagaggagcaggcattgaacatcatagttgtttgcctgtttgctaaatagggtagtccatattttagaaggaaaaagaggagtggttttactaaaaatgtatacagtatacttccttatttgaagattctcaacctaaaataatcaaaagggtcagaatctactttaaagagagtttattcaagcacagtgttggagggatagctgcctgggaagcacagattccaaagaatagacatcagaagtttgggatcatttatatcaggggtccccaacccccaggctggtgagcagcaggcgagtgagcaaagcttcatctgtatttacagtccctccccacggctctcattaccgcctgagctccacctcctgtcagatcagcagcagcattagattctcataggagtgtgaaccctactgtgaactgcacgtgtgagggatctaggttacatgctccttatgagaatctaattcctgacctgtcactgtctcccatcacccccatatgagaccatctagttgcaggaaaataagctcagggctcccactgattctacattatggtgagttgtataattatttcactatatgttacagtgtaataaagggcacagtcagtcaatgtaatgtgcttgaatcattccgaaaccttcccccaagctatggttgggggaaaagttgtcttctgtgaaaccaggtcctggtgccagaaaggttggggactgctaatttatgtggacagagtttagagaagcttaacagagtttcagcatctttctatataaggctttaatgcatagttacaacagtctaattagttgaggtgatgtttttgtttcagaaaaggtggaagatgagtcttttctgccccctgatctgacttaggtacaggacagtaaaggaggcagttaatctgtaacaaacatcagtggttgggaggcaggaggtctggtctcttgatctttcctagtcatttacagaacaagaacagtgaggaaaagagttaatgtgttgtctaagaagaagaaatcaccaacgttcaagttgccagggcttaacttcctccttgacataataaatgtagagggtcttgaaatcctattttcttttacatgatcctatatatcaacttgaatagaactaatgtttacttttgaagaaaaatttaaattagaatggttgtcttaagtaaaggaggaagctttaaacatgatcctatatatcaacttgaatagaactaatgtttacttttgaagaaaaatttaaattagaatggttgtcttaagtaaaggtggaagctttaaaagtattctaatggtacatttagaggtggaagattttgtcttttcctttcatagcacttagtatttattactgtagtatatattgtatctcctgtactgtcagggaactttctggtattagaaatccctgtctgaattcatttgtgcccagcagttacatcaaatagggactaaatatagatgaccatatatgttcttcccttgtgtatactctttaagcaggactagcaacattcccacttagtaatatagcagtattctttagtaatactaacaacctatctttccttagtaatcataaacattagttttaagtttttcagtacttaaaagtaatagtattttataattgaagtttactgtctttaaaaattatttggtttatctttgaataggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggtaaataacgttcattttgatttttaggataattgacacataaatacagttcttgatcattattattaactgaaatcacattttacctcagcaaaagtagttgtttttagtaataccagttaatcacattataagtcattacatatgctagtcacttgtggaatttgaggactaacagcagttgctaaagatcaggaatgcgggcaggaattgatgttaaatgtacattgtcagataaccagttcacattattgtcctgtattcaggtcttgaaagatgagagaaggactgggatctgatcctgggccagtgccaggtgcctgccatgtctgttattgatccctgtagattcttcgagaatatgcattacccagaggtcactcccagtcaacacaaatgcttattagttagggctttggttttacctccctgtagtttgttctgccttgtcaaattaattttgatcacaggtgagattggatgactgttctgcctcaagttgaggcataccaggaagccttttccctagatgtgtacccttttcctgaccctcttttatgagaaggaaacaagccaagacccaaacagagatggctcttctttcttagaatctaaagtagacgaagtcaggctgtccatttcacacttttcatgatatttattttctggatataaataaatttcagacgttgctaagagcttgatgaaaataaaacagcatgatactataataaatgattagaaagtaatacaggccaggcttaggtctataatcccagtactttgggaggctgagacatgagaaatgctaaattatgtatctaagtatgttgctaaattctgtgtaattgatttgttttaaaggctaaaaggattcttgaagatcatggctcacctgctggagagattgatgatgaagacaaagtatgtgctaattaatttttgcctaaaaatatggctgggcgcggtggctcacccccgtaatcgcagccctttgggaggccaaggcgggtggatcacgaggtcaagatttccagaccagcctggccaacatggtgaaaccccgtccatactaaaaatacaaaaattagccaggcgtgtgcctatagtcccagctattcaggaggctgagacaggagaattgctagaacctgggaggcagaggtggtattgagccgagatcatgccactgcattccagcctgggcaacagagctagactgtgcctcaaaaaaataaaaagcctacaaataatgcttttgaaacaatataaaattattttaacagctttcaccttaatgtttgaaagcagactgtatcatcaaatgacctttttcctgacacttttttattttaaaaataaaactagactatcaaaaatggttctttgtattttttattagataatgatcattattaatacgatagacttactatataccttttacacatgtactttaaggaattaattactcaaatatttttgtgtctaggacaaggatgaaactgaaacagttaagcagactcaaacatctgaggtgtatgatggtcccaaaaatgtaagatctgatatttctgatcaagaggaagatgaagaaagtgaaggatgtccagtgtctattagtaagtttaaaggctctgtactatctttatactttagttttttgtaggtcatttattggaacagtttggtggagtgtaacaagtataaaattaagtgtcaaagaactctgattttgaatttcactgtgaccctgactaaattatctagactttctgcactgtaagtttttaatacattctgtttgaggatttcagatactgtatataaagcatctgtgccatgcaggaatgcagtaagtggtagctattgttaagattatgtgctgaaatttactaaaaattgtgtattaatcaacttagatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtattcccgtattgactgacacacttccatcagccttattttaactaatcaaacttccatcagccttattttaactaatcaaagtagatccttctaaatattcaggtttcatgaatgcaagcctcattaatatgcttattaaaatctgaaaaaccagtttattttttatgattgttttttagagacagggtcttgctcagtcttctgggctggagtgcagtggtgtaattgtagctcattgctcatagcctcaaactcctgagctcaagcgatcctcccacctcagcctcccaaagttctgggattacagacatgagccaccacacccatccaataatttatacgttttaaattatacactgtttttagtggtgtgattaaatttcacaccggccctctccttcctatttgggttgtgaatcattccattgtccggcatgtctacactgtatacactacctgcttgttaatcacttaatagccatctagggtagcagatagacttgcagtataacagtgttcaaacaacccttatttgacttaatggccccaaagcacaagagaattaattattctattattagttattgttaatctctcactgtgctccatttataaattaaactttatcatagataagtgtgtaggggaaaaacagtataaatggggtttggtgctatccacagttttggaacatacactctatggatgaggcggtgcttttttatatgttattttcctccctggtctagatcttttcttctggagttggatattttactgtgatgtgccttgttggggtcttttttcattatttgcagtggatactcagtgattgttttcaagttggtaaatttttaaattctctttattactgccacaccattttctcttttctctccttctgtaattatcagatattattagtactcatggattgatcttctgattttctcctcttttccttatcttttggttttactttgagagattttctttgactttaacacttgtatgaaattatttttatttcagctgtcatatttttaacttctgaacactttctttttttctgattgttactttttaatagtgccctgttatttcacagaagcattaccttccgttttcaaatgtctgctgaaccttggttctttatattgaacagtgatatatcaaaaagcaagttaaggttcttttgggcttcactgcaggtagggcatttggggagacagccagcatattcctacaaacttctaaatgttagtatctattggtcttttctttgagatggtttagattcttcaaattagggtccttcactgtcgtcctgcctggagtgtatgagcttggctgctgatattctgaagctagattgggaatggggctgaggtcccaccgttatacaggcatgcactagattattctgttttcagtattctatttaggttggtgcaaaagtaattgtggttttggtcattttcaatagcaaaacccacaattacttctacaccagtctgatactttactgtgtcatttgtgtctccacctctactcccagtggccccaggtttggggctcactagtttaatttctctaaaatataatctgccattttctgttgaggtgggaggagagaacctacgtaggcacattttccttaaacagttttaaacaactaccaccaccgtttcatctccagctcctgccccaacatcatcatgtcttcctttctagatctgttacttacagttatgaggtgaatctcagtttttgtttcctctccctgctgaaggcatttagctttgttcatcttcctctcgtcacttcctccttcattcccttcttgtctgcattaagtgtcttttagagtctgaaaaaaaatgaacagtgcagtctgttcgttccagttgtattatactgtgtgtgtgtgtttttaaggcaacaaggaaaccctttaacttagccatcttgaaatcacaaccaaagccgcctccttgaaatagttttagaagatacttttaaatttctttgtatgaaggtcttgggttggacaaaaactacacactagtaatcatctcttttatagtgaccatatatttcaggccctgctattaaaacatttttcccttctaggtcctacaacgtgactttaaaaagacagcagaaagcaaaaatgtcccattggaacgagaagccactagtaaaagtaagaaatctaaataagtctttgattttaagataatttcctttatttgctttaaagctaaaaaaaaaaaaaaaacacacacagaaaacactaaaattcttagtttgaaagtactttggacctgatgtatgtttttcttctccctataaatcctttgtagaaaacataagaatttgtttctataaacaataaagaaaaggtgacaaatatttacctgcacagacaaaaattctgtcaagagcatcgcatctttagatacaaataatggtagatttaaaaaaaaaatctatttgtaggccttattactgaaagtcctaattttttagaaatcaggtggatttcaggaatctgagtcttaaaatgctcccaggtgattttgatcaactaaatttgggaaccattgataaggaaaatttgtagttgccttttctttttggtcttaaatatcttgattgctcttattcaggcgtattgtctttattagtataatagtaaaatttaacattttttgcattacactaatgttaagactttcttttgatgacagatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgtatgtatcatttacatttccaaatatttttacttttcatttctgtgcatatttcttcattttcagattagcattctccacatgtaaaccattttgtgtttaggtttagaacatgttggaacatttttctaattcacactttaactttagcagaagggtaatagtgaattaagatgaccatctcaaaacccacatgctgttttataattttgagaaccaaagggataaaaagatttcatcttaagttcggctctgaagtggtaatgatgcatgaatcctcctttatcctttatactacctattcttctcaactgtttagaatatattgcaaattttcaataaacttaaaggtttacacttgggataggaaataaaacagtttgacaacagaatctttatacagtgaatgataaaaaaaaaaaaaactaggaaatctgtactcatgatagtacttactaaatgaaaattcaagtgaagcccaggtctgaaaaatacttgagcagaggaaagcaaaaacctttaaagtaattaatcttgcttaagctgcaaacataaatgaaacttcacttgggtcatttctgataaatgcttctgttagaaccaaagcttaaccccagcctgtcataagtagccccctaacatatggatatgtgactagggactttctgagaaggtacttgataaaagacaattttgtaattgcaaaccaagcaaataatttattttacttccacattttccaaataaatacttgcctctgatattttgtcagtggaacactaaatctcttttggtctggtgttcccacttcctgaattgcttcttactcaaataaactgtaaaattttattgtgtctcagatttgtcttttacagtttggtgtcagagtaggatttgaaagagaccccctgtggcctctggaagcatcgaggaaccaggcaaaaggtgtccattgtgctcactgctttctcgctgcatctggaggtcctgggtaagtccctctcggatttcaggctccacagtttgtgtcctgagctctctgagtttatctgagtaattttattttgagactgagtctcgctctgtcatccaggctggagtgcagtggcgcgatctcggctcactgcaacctctgcctcctgggttcaggtgattctcctgcctcagcctcccgagtagctgggattacagacgtgtgtcaccacacccggctaattttttgtatttttagtagagacagggtttcaccgtgttagccagaatgatctcgatctcctgacattgtaatccgcctgcctcagcctcccaaagtgctgggattacaggcgtgagccaccgcacccagctgggtaattttattttttactggatccagaggtcgaactagatgtttgacagtaactagactgggtccagttggcagcctcaggtaggtgaggtttagaaagatagggtattatgggttcattaacacctaaagactctgggacccctctttctagaactctagcaaattttatgtttagaaattaggaacatgaaactatgcctttaactatgcctttctggagaaatggttacactttaccagagaagagaagagttaaagttacagtggagaagttttaatctagataaaattgtttatggggacattagaaaagaagggatcctaaatgccttagaaacaatgggaagcagtttttgattgttgtatacaggcttctaaaagacataattccaaaattgccttgctaaaagattccttgctaaaggcaaataagacagatgaaaagcttaagcagtgaattgacaaccaaaataaaatgaattgtatgtagggagtgatttcactctgacctgttactctgcttatcctcctctaattattctgagtccactaacccatttgttcagtcatcttaatccttttgcacaattaccctttcactctggacgatgtgacagaaaggaagttaggctaatgctttgcttagttagaccctcagccaggacaccgaggtctggctcctgtaagtacttttacttctgggtcaaaagctgaactcagagccatagcaaaagattttccaaatcccaaggaaaatccaaaacagtttgctgaggaatgtagatttagaatgaccctgggcttcctgatttctgtcagtttctacgcatgatattagccactggggaagcatgttaatggatgactacggcaggatggcataagcctcagaagagtattgccaaccctttaagagctacttctgtggatagcccaaaagatgctacaaaaacaactggaaaacatctagaagctatccccatggtctttccacaaaagattgactagtccaaaaagttgaatctatttctgattacacggctaaattggaaatctcatttgttaaacattctggtcttaaaatacagcagggagtatttcctgcgggaactgaaatggtttttatggttttattcattaatagtctctgactagagtctggtgacttgattaaaaaacacaagattggatggcaagtcactgatatggctatattagtcaccatagctgaacattttgagagaacattagaactagaaaaaaatcagtttctgtaaagaggccattgaagaaaagagtctccacgcttgaccagtcctctaatggacctacctgtgttgggccagactatttcctcattagatgaagttcccaaggctgggccaggcatggtggttcatgcctgtaatcccagccctttgggaggccaaggcaggcagatcacctgaggtcgggagttcaagaccagcctgaccagcatgaataaaccctgtctctattaaaaatacaaaattagccaggcgtggtgacacatgcctgtaaacccagctacacaggaggctgaggcaggagaatcgtttgaacccagtgggtggaggttgtcgtgagccaaaatggtgccattgcactccagcctgggcaacaagagcaaaactccatctcaaaaaaaaaaagttcccaagggtttgactctgaagacaataatcaacaccaatgggacatcaagggattctctggtatgttactctccataaggcccttaaacaaacatggggaggaaactaagatcagcatcagtgggagtcacgtacagtgttggtggataccttatccactttcaaccccatgctaataaatcagccagtcccttggaggaaagaaaatatttcacgtttccaatcaagttcagagaatcctctgtgaaccagtctaaatgacagttggactaatctcagaaaagcatgccttcctacaatatgacactaaattgagagggcacttaaagttctctctggaaggaaagttaattttagagcttcctgacccttctaaacctgaactgctctgtttcctacaagcaggaattgatcatattgaaactcactcttataccaacctagacctttctgaagtacccagatgtttgtgggcttgtttctcaactgacaaagggaagattaaaagtggtaagcctataaaaatacaaatacattattccaagccattgcctaaattgccctcatgccccctagggtcagaggcaatccaagggctttacccagttatagaggatttaataaaacaattccttgtacttgtctctataatactataatcctacagttaagaaatccatcacacctttaatcccagcactttgggaggccgaggcgggcggatcaggaggtcaagagattgagaccatcctggccaatatggtgaaaccccatctctactgaaaatataaaaattagctgggagtgctgatgtacacctgtagtcctagctactcaggagactgaggcaggagaatcgcttgaacccgggaggtggaggttgcagtgagctgagatcgtgccactgcactccagcctggccacagagccagattccgtctcaaaaaaaaaaaaatatgtatatatatatatgtgtgtgtgtgtgtatatatatatatatatatatatatatacacacacatatacatacacatatatatatataaatatataacatataatatataacaaagttggagatttgttcaagacttaaacatacaataaattgtcaatccaagatttcctgctattccaaatcctaacactttgttatctaatgtgcctacagattctaaatggttcacagtgtaatctttctttcctctgcctttttcagtattccagtaagccagtagttctctgcttatacctggaagaaccagcaatatacttggactgtagtgccacaggggttcgctgaagctctatcttgtttttctcagacattataccaagacctgtcaaccttacaattccatagaaattgtattctgtctatatgtagataatctttcatacttttagcttacaatggacataaggcctcaatggcaaaactttagttctgtagagcggctgtcctcagcctttttggcaccagggactggtttcatggaagacaatttttccatggactggggtaagggggatggtttcaggatgattgaaatgcattacatttttgtatattttatttctattattattacgttatataatgaaattggtatacaactcaccacaatgcagaatcagtgggagacctgagcttgtcttcctgaaactagatggtcatatctggggatgatgagagataatgacacagcatcaggcattagagtctcataaggagcacgcaacctagatctctggcatgagcagttcacaatagggttcaagctcctacaagaatctgttgccgccagtgatctgacaggaggcagagctcaggtgagaatgtgagtgatgggagtaggtttaaataaaggtgaagcttggctcgctggctccccccaccactcacctcctgctatttggcctggttcttaacaggccctggactggtactgggggttgcagatccctgctgtagagtaaaggtccattacataggatgtgatctgactgcagagagaattttcctcttaactgaaataataaaaacaatccaagggttccctaggcccacaactaaggcagttaagggagttcattggtcttatgggatactgcagatcttgagtcccacatttctctgctggcttcccccttgcctgaatttagaaaaatctctgtcccagagctttgccatgggaagataattaggaacaagctttcaataaaataaacctggccttataaccccttcaggttcaggatacccaagttatttaaaacctttcactttgggattatcaaatatgataatccatccttaggagtccttactcagaaacgtggaggaagctactgacccattgcttattatacgttacagttaaatcgagttgtcagagcatatccaaaccatctaaaagcagtgacagcagcagctaaattgataggaactttatctgacctagtattagggaataaatgttacctacaagttacacgtgcagttgaaagctcattaccttccagtcagatccaacatgtcttaataagtagactaacattttatgatatccttctcctgtcaccttctaatctctatctcagatgtcagtctgcttaaccctaccactttgctgcctctgtctgaacaataggaagaccaaaactgtgtgtgtggtatcataactattgactcctcacattgacttatggaaaacttcattaaataattctgaataaatacattttattgatggatcctatgaaaaaactgtagagaagaaatactgagcaagacatgctgtaacaactcagtatgaactaatagaaaagggaattctttctcagtttaagtcaggacaacccgaagaattacgtgatctaagacttaaccatatagcaaaatgccaatcattttccatttatacagataataggtatgcctttggagtgagtgatgattttggaatgttgtggaaacaaagggtttctcacttgtagtggaacccccatcagtactggacctctgccagatgagcttctttcagctattctgctgccctcacaagtagctcttaataaaaatgatgctcatgctcgtaggactgaacctgagtatcaaggaaatgcatgtgtggacttttatggccaagtctgaaattgacaaaatatgcattttgaatgaactccacagaattgaccaagatcaaatcactcaggataatttgttcagtaaacaatgctgtgcacttgagttgaaacaacaaaaatggaatcttaaaggttgcaaatttcatgctcaacaaggactcagtgaaggcccagacagccagctggtccttcctgagtccttcaaactgtcattattattaaaggccctgcactctacaaaccatcatggtgaagaaaaacgtttcagattatgaaaaagattatgaaagcagaaatggcttacagcagtgtggcttgtcaaactcataaagctggaaagacccttaagatttctgccacctgctagaccatatgtaggtctgcagatggatttcattcagttgccaccctcattgaggtatcagtacattcttgcggtagtgtacctgtttgcaagatagattgggacttacccttatagaaaggctgatgccacaacagtagcaaaaaattcttaggaaatgtatttcctttatggggcttttctggagagatctccagtaataagggaactcattttcctgaacaggttatcagataaacaggattttcaaactcggtggcactaccattggccttgtcatcctcggtcttctggaaagcttgaatggacaaattgtatcttgaaactaaaattagctaaattgtcagctggattaccttggccaaaaattttaccactagccctaatggcaattacatcaacccctacagaaaaacacaaatttgaccccttatgaaataactggaagacctatgcctttaataccagaaccccatgtatcacctgtatttgttagctctgaaatgactcaatactctaagaccttaatggattatgcaaaagtctatttctaccagctgaaggaggctttttgtgaactgcctaccagtgatgatctatgactggcttccataacttagaacgtggagattggatcttttggaaacaacagcagagaaaaattgcccttgagcctcattggaaaggactgtagcagacagctcttactactcacaatgcagcaaaacttcagggttttcagccttgggtccatctatctcaagtagagagagcttccttagactcttggacttgacaacctataggtgacttaaagatataaaagggaaagcctttccctaggagcaggtggcatcgtgaagtaaacaacttaccaccacaatgaaacgactacatttaaaacttttctcattaagttttgatttggttttgcattaacacaaaatgttcaaacttttgttgggaacttttcctactcaaacagaatatcctctaaggtctgatgttcaaagaatagccactctcactcaaccaaagcaattgctggccatgtagtcatatagatgaatggaatcacaactaataccgaaatctactcccacacacacttgggtgagcaattggttttatgaaaaggtttggtatccttcccctagcaggttggttgatatttatggttgactgacttcgcactgggaagaagttacagaagcaaaggtatgtcctgtaactactattgattttattgctggtaattttatcactatggacagaaaaccttaatggaactgggcctaatctagccagggttccagtctccctatatgcagtcagactttatgatttaacaccaattagggagactgctctcctatataatgacacatatttaaaatcagaacttcaccatgatacccttgactatattagtagagaacggactgaaactgacattggttcaaaggaaactctagaggcaaatggaatacccctgtagtttcactgtatacaatagggtttttaagatcagtattcagggcatatttgaaaaggaaacaagtcatccttatttggcgatggtacccatgtgtaatacatagaagtgtttttttattcctctttctatttaaatcataaccattctacctggcagtgtgcagatgcagatatgacagagaataaccatgacaatcacatcattcccaattggtgggtaataggatctcctttgcccctttctctcagtaatactggattattcatcttgtatggcaacaaaatatataaatgttttcacctatatggtctggacactgtggtttgggctatttcctacctaaaatgaccagatatgactctttaaatggttgtgaaattcttaatctggggttgtttgtacatgaagtgatcccttacaaaagaactccctgtgatctcccaaactcgaatatatgaaggggttctagattttgttctttggtaagatcgctttttctttagctggcagtctctgaattggaaaaatggcttatggatatttcagcaacccttgaaaaaaagttttaatgatactttcgatactcttcaagcaatacaatctgagatgagtcatttggtctcactggaactccagtagaagtttagctgctcacagggatgagctttgggtgaaacgtattgtttttatgttaattagatattgttgccccaaatttaaaagatcttaataaatcagaattttttttatcagataagcaaggcctcctccattgatttattcagttggttaaattttaggcccctgggaatctttgcttagagggatctttaagttcttgctacagttactgtgttttcttcctttgtgctttatatccccacaaggggttcaaatgctttccagcagccactcacacgtcagatgattgccatcagggaagctaacactgtgtaaacttgatggagggtgcatgactgaatcccaacataacttttgatgataacaactttacctgacttttcatcccaacttctgtgtcagtagtggttacaggataatgctactccatttggccaccctcaagctgagagggcagccaaaaggggggaattgttaaagcaaaattaaaatggagatcaggcctgaaaatacctgaccaaaacccccataaaacaaaggcctttaaaacagccttaatcttccttgaattgcaaacataagtgaaacttaacttgggtcatttccaatcaatgcttttgttggatagaactaaaaggagtttgagagcaacctgggcaacatagtaagaccctgtctctacaaaaaattaaaaattagccaggcgtgagagtgcaggcctgtggtcctagctactcaggaggctgaggcgggaggatcacttgagcccaggagttctagactatggtgaactatgattgcccctgctgcattccagtctgggcaacagagtgaggccctgtgtcttaaaatttcttcttaaatatatatttacagttatgattcataatttcttagaaagggggcttataatctttgaaaaacgttagtacaaagagtaactcttctaactcttttgtttgcctcactacgagtacaattatacatttaaaacttcgaaaattactggttagatttattcttatctgatcattgtctagttgccatagaagacatttaattgaaattaagtcaaaggtagattataaaagctcttgaatttgaattttagtcagggatcctactgaatgtttttgtgcaaggaagtgaaatggtcaaatttatgggctgtgaagattaatctgctgactatagcatatactatcaagctagattgggggatctactattatataagtatgaaatataagctgaacaggagcagggtgagaaacagtgcaagaagaagaaaaacctaagatttctacttggataattggtagaattatgatactattaaaaatcagaagggagaactaggagggaaaaaaatagaattcaagtttaggaaaaacagtttaaggtgatcacaaaagacagttactaaattcatacctcagctttctaacagccccatcagagttgatacactgaaaagtttgtaagtggttacttacattctgctgggtacagctctcgtgttcagtaaacatatgaaaaaacaagagttgtctttctgtttttagtcctggttgtaactatttcttcagcatgtatgaactgcccccctgcctttttttttttttttttttgtgacaaaatggtaacagcttgacagtatgtttcacagctgtgattgtagcttttcctatgaactgcatatttctaaattattcatagagctgaatgtagaagaaaacgaaatgtgatagaattactgagaaaataattcactatttctttacatggatgactggtttggatctagagtatgtatttttttttttcattacattacaggaagcagaatctggtaatataagtcaaaagtctgatgaagaagattttgtaaaagttgaagatttaccactgaaactgacaatatattcagaggtatttagctgtctttaattaaacttgtctttacataacaaatactgttaaaatgaaaaatgatttgtatttttaattttcattccaaaggcagatctaagaaagaaaatggtagaagaagaacagaaaaaccatttatctggtgaaatatgtgaaatgcagaccgaagaattagctggaaattctgagacactaaaagaacctggtaagagttatcaatttaaatcttgccatattgaaaaatcattgaatcttcatactactattgtgttttattttttaaatatgctactactgacctgggagatttaagccaaatactagaaagaaagtgtaattctgtaagaattttagttcaactatttataaaacagtgtcagataatttttttctattcacatctttagttttaaaaaatgtagacatgctggctgggcgcggtggctcacgcctgtaatcccagcactttgggaggccaaggcgggtggatcacgaggtcaggagatggagaccatcctggctaacatggtgaaaccccgtctctactaaaaatacaaaaaatcagccaagcgcggtggcgggcgcctgtagtgccagctactcgggaggctgaggcaggagaatggcgtgaacccaggaggtggggcttgcggtgagctgagatagcgccactgcactccggcctgggtgaaagagcgagactccctctctgaaacaaaaaaaaaaaaaaaaaaaaaaaaaaaaaaaatgtagacatgcccatggtttaagaaaggtacaaaaatattataaatagcaaaaacccacttttttttttttttttgagacagagtctctgccaccgaggctggagtgcagtggtgtgatctcagctcactgcaagctcctccgcctcccaggttcgcgccattcttctgcctcagcctcccaagtagctgggactacaggcgcccgccaccacgcctggctgatttttttgtattttttaagtagagacggggtttcaccaagttactcagatggtctcgatctcctgacctcgtgatccgcctgcctcagcctcccaaagtgctgagattacaggcgtgaaccaccatgcccagcccaaaaacccactttttattattgatttttagttctttaggagactataactctaaatattatgattcttagtttttaagatgcagataatacctcttttctacccgatgacaagtatgtatctagccctacctctctctcctcctcctctcagtgttcatattatttttgtttgttctattttttactttcaattttggttaagtatatgtgcattttgttccatcaactttggtcattatcccttgctgctcctcctctgctttcttcctggttctctgttcagttttacccatattcttacattactaaggctattatatacgcttacattttgttttcgtaatataattaaatggttctataccttctctgaggttgcttctatataaatatcattcattgtagagccaagcgatagtctcagattttctgtatgagtctaataacacagctctggagccactcaatgtttcttgcatcaggatcaaagggttttctttttgttgttctccatcagttcatcagttgatgaaaattgcatgatatctcattgtttttgtttttcctggaaatggagttgaggagaaggaaagacccttcagatatcagaccttcagttaatttctgttttcagcccacttctacctgttagaatatggtacccttctcagttgcagcctcttgcaagtgtttgaactgcagcttcctccactgtcattgggtatgcttccatctgcattgagcattctggtaatttgttgatatcccctcttctgttttctcacaaccagtcttttgttggtgtagatttattctattctatagttgttttcttttcatagtggagtgtttttagagagacacgaagtatctgctcagtctgccttgttgaatcagaaacgcctcacctattctttttttactgtgtgctattagggaattgtattagcaagctaatttaggatttcttttataataacgttatattaaaagtaaaagctttaatgacagagaacaatgttaaattctagtaattcgataagtaatttataaagcatttttattctgtttttcagaaacggtgggagcccagagtatatgagatgtcttcagaggctcatctaactctgtccttacatactcaatgcatatatgaaaacaatactaaataaacatctgatctgtataaaaatgtaaattagtttgacactgcttttttgataggtgtggtcatttctccccatggtagtttaaaacatcagaaactgaattctggacagatttaagccttgacacactgtgtttttttttttttcccccttcttttttgggtcttcatttttttccccattgtgatgtttggtaacgaatttaaaatgtagttttaaataaagtttggacttatctataaagtatcttttttggaaattatattgaattctatacagcaagtcaatgttttatataactttaggctgctcagagaagagcaatggttaagagttagttagagaaatatattatttgttataaagcccatccattaggccagtcttccaactaatgccagtgttgctgctgttgggtctgatgttcttcttttagatacctgcaggtcctattcctgtgcaagaatagggcagattatcaagatatccaggatacctatgaagttattatagaatatttattaatccattgaaattggataataagtttagaacataggttctcagtatctagaacttacatcattatcatctgtttgttaggatttgaaattctggaaaatatttatctacatcgcctcagactaaaagtaaaaaaaataagctttatataattagggagatttctgcacagagaagtaacattgtggttaattttaaatgaaaaacttaactttttcaagtggggataaataatacaactaaatttctgtaatagtaagattctgtatgccttcagataaacttgcctattgagatggtaatttaaagccaaagcatagcagtttcttttgtgtgtagtgaggttgaagcagatttgcaggtgaagtattgaaagtttatgtgactttaagtcagcttttgaaaagtgattgatttgctttttatcccaaactgtccatatacccagtaaggcttcaaaaaaccagtcaacaatgagtaagtcaatcttatagattcttcttcctcgaataaaatacaaagaattagttccaataagtattttaactttgttaacaactgaaataccccataaaaaaagaacttgttgagagtatttctttaaaatggttacttgctgcccaggcaccatggctcactcctgtaatcccagcaccttgggaggccgaggcgggcagatcacgaggtcaagagattgagaccatcctgcccaacatgggggaaaccccgtctctactaaaaataaaaaaattagctgggagaggtggcacgtgcctgtagtcctagctacttgggaggctaaggcaggagaatagcctgaacccgggaggtggaggttgcaggttgcagtgagccgagatcatgccactgcactccagcctggcaacagagcgagactctgtctcaaaaaaaaaaaaaaaaaaaaaaaaaagttaacttgctgtatacctcagtgtaatgtccattcaaggagtattaaatgaggatttccctgcgaggacatttactgtattgctacttaaattatggaagacaatatatcttcaactttaataaaacctattcagaaaattaccaattcagaattcggagttcttatccaggtgctctaactaacttcagggaaattggaacaataagttatgttacatgcacactcaaattctttattttctccactttaagcaggaaagggtaaaaactgttttggtactcaagcccagccttacatactgtgtttctctctctgtctgcatgcatattaaagtggaaaaattgtatttatatcttagttattaccatagtacctatgaaccttatcaaaattgcttatttgactggtgttacagctgctattaatctaagtctattgtttttctattttagtagataatttagttttaaaatacgtagggtttgagagcagatatatttatttaatctgttttctctagtaactattgctgaagggttaggcattcagtattcctatttgtcctaattttgaagttaaaaattttggttacagatagatagagggagaaaagttcaaaatgagtgagagagaactttatgcaggttgagataatgcctaaaataatgagctggccagactgtggaggtactctttgtattttgtaacattgactttgggtaaatgctttttcactgttaataaatatatatcctgtatacaaccctgaattgtattttcttttaaattcacatgctcatttatgttttagaatttgttccacagtggtgacttgacagctttaaatgtcactttgggaggccgaggcaggcggatcacaaggtcaggagatcgagaccatcctggctaacacggtgaaaccccgtctctactaaaaatacaaaaaattagccgggcgtggtggtgtgcacctgtagtcccagctactcaggaggctgaggcaggagaatggcgtgaacccgggaggcggagcttgcagtgggccgagatggtgctactgcactcgagcctgggcgacagagcgagactccatctcaaaaacaaaaacaaaaaaaagtatatgttgaataatggtatgatagaagtcactggccacaggaagaataaacttcaaagaagtaagtttattatactcaaaggcttcagagtggattaccgccagtgcgatggctcacacctgtaatcccagcactttgtgaggccgaggcgggcggattacctgaggtcaggagttcaagaccagtgtggccaacatggcaaacccctgtctctacgaaaaaatacaaaaattagccgggcatagtggcacatgcctgtagtgccacctactcaggaggatgaggcaggagaatcgcttgaacctgggaggtggaggttgcagtgagccaagatcatgcctctgcactccagcctcagtgatacagcgacgctctgtctcaaaggaaaaaagaggttgagttaccacatgctatatagggtcatgggcaaagcaccaaattttggtcacgtggcataagacaggagcaaggagcaagactagctagatccttttttgagatttccttaggaaatgccaggcggggtagagtaaatggtttaagattggctagtttgaataatactggtgggccatagggatggtgtctgattctctgggaccttgtcctaggatgatttaggatggataaatagtggcttagtgtgcaagtattagatgagtgtggttggggctgtagacttgggattgataggtatgtgtatgaaagacctgctcctggctgagccctttgctatctctaagagacctatcgctaagaaagacctttgctatctcaaagaacctttgctatcactaagagacagaccctgaatggggtggttcctctttgatcagcaagcatttaaagatgtcaaagcatcataaaatacagcaaataaaaagcatgaataacatatatactctagagagaacattcttacatttactcaaaaatagactgattcgtttcttgtccaactttttttttttttttttttgaagacagagtctcactccgttgccgagacgggagtgcagtggtgcaatctcagctcactgtaacctccaccttccaggttcaagtgattctcctgcctcagcctcccgagtagctgggactacagacatctgccaccgtgcccggctaattttttttttgtatttttagtagagattgggtttcaccatattggccaggctggtctcaaaactcctgacctcatgagccacccgcctcggcctcccaaagtgctgggattacaggtgtgagccacctcaccaagcctgtccaactttctttaatcagctcatctgtcaaaaagagattgactctagatttcccttatttcactacacaaataaagtttccaagtcaccttgactggaagagccagcatttcccgttgtacaactctaattgttactcttacagtccctgtctttacatgtctggtttcttcctcagattcactggtatcattttctgaaaattaaggaacagaagggagctctgtgcctacaaatgactttgatgcacgcaagcatgcacccacacacgtatacacaaacagattcagtatccattgttagaaatgctccaaaatccacaactttaagtgctgacatgaccttcagaagaaatgtttattggggcatttgggattttggattttcatatctgggatgctcaaccagtaaatataaatattcaaaaattcaaaaaatccaaaatccaaaagacttatttccaagcatttcggatgaacaatattcagcctgtgtatgtgtatgtgtgtgtatatacatatatatgtacacttctaattaccagttcatttcttctttataagcttagaaaaatctgttacaaaataaattttggagcagcaatttaaagagctcttgatttccttgttttaaaaactaatcacagtataaagtttctatgcaacagagttctattatatctcttttacatagtaaatgtatttcttgccttaagacttttccaaagtgtagttagttggctatcccccatatgtaggtttaacaaatcacatgattaattttaaaacaaatcatatagttgcaaatattattttgctaggaatcctcacctttaataaatagcttcctgcctagagcttttctgtggatcagatcacaaaatactttgaaagatgcaaagagctatgtcatttcacactagcagttgtcaacatttgtgttaaaccacttttagtgagactatggacacaaatttagacttatcccatcttcattgctgtttataaaaatttcacttactagtgtgaccatcagctattgtctcacagttacattgagaatttccctagactgggaataggtataggttattctattcaatgaaataatgctcataagaatgttttgagtataagtgctatacaaattacctatgttggagaaaaaagacaactcagtatggattaagttctggatttgggattttttttttctttcagattttggaatatttacattatactggttgagcatctcaaatctagagttcaaaatgcttcagtgagcatttcctttgagcatcaggtcagtactgacaaggttttgcattttggaccatttcagatctttgggtttgggacgctcaatgtggagtggttttgctttgttttcaatgttctaaccaacgtatcattaaatcaatttccagggcagagttttaaatactgattgtccaccagaacccacagttgcttctatgtgtcctttgtgaacatgttctgcctatatacttttttttgtagattttccttttcttaggtgacagagactaaagggccttcattataatggatcttggatcttagatgtgcagtttccccccagtatcagctttgccatttccaatctttctattccctcactcttccctctaccctccaaaatatttaagacagataatgaattttaagttataaaatcagtatttcaaatagctttttggattatgattttcaaatttaccttggattatgtaattttgcctcttttttctgcccttccctacctttctctgtattcccccaccaccagttgtcaaatttatattacacaaatattcaatagagaaatcactaataacttatttttgtggcccatcgaattctgttgaatttgagtatataatagctaaaaaaaaaaaaaaaaagcatatttcaggtggtgttttctagccaaatgagtatatgtattttgtatttcatataattctgaagcttattatctggtagtttcagtggtcagtctcaatttttatgtagaaaacttctatactcttccagggcttatcaggattcaaaagttcaatttatgtaacatcatgtagttcaatttttttcttctatctatattagcagtcatatatacattagatatatgttagaatgcttttggttttaacctacaattccttaccaggaaatatttggacagtattataataaagcaacaaagagatagggtttctatgacatttggaaatgtacaatgcaaaaaaaaacccaaaaaccctgctgttcttcattttcctatctgtgaaatgcaggaagaattatcctagatccaaggatgcttttagtattttcaaaggaagacttacgaaaagaattaaaaatggaaattagtgaatgagcaattatacaaataattatcggtgtttattgaagtcccagcgaataagaaagtgaaaaaccatagtaactctttattttataacaaaaatgggattaaattacaaggattcaggtgaccccaacttttgtccattttctatgacttgggaggcttctggacttctctttggcatggtggcactgcctgaaaaaaaaaaaacagggacttcttgttcctcaagtctttttggggcatgttacttagtcgacaacacagaagaaggatactacaataaactgtttttcttcccactcctaggctttgaaaaactagtcagttattgtagtccattctccaaccttaaacaactaaatgatactttaagttagtttgccacccttggcgttagagtctttctgtatggtaagattcaaaaaattcatatggaagtatgttaaggtttatgttaaggttcacatagatactagatattgacgtgttaaaacggagttgttggttgccccacatctgattgttctagtcttctcatcttagtacgtgccagttccatccttctactttcttaggacaaaccccttgacattgtctgtggctcaactctgtatcccaaacccttcatccaacccttcagtaaatatggtcagctacacctttaaaaagtaagtcgaatccagctggttttcactacctcttccactgccatctttattcaagtcactcttatctcttgcctcgattcctgtagtagcctcctaatggccagacccgtcacttcctagactttctataatctagtctcagcacagcaaccaaagtgatactgttcagatgataccagtagcttcctattttattccaagtaaaagcaaaaatgacttcagaaggccctacaggacaattctctacctcttcctttcttattttccgtgtgcttcagtcacactgacctctttgctgttcagacctgccaggcatcattgcatgcagggccttttgcatttactgttacctctacttagaatgttctttcctcagatatttttatggcagacgtttagtgaatcttctttatgtatccaacctaaaattgcacctccccacagtttatttttatcttcttgccctcagcttatttttctccatattacttatccacagttaacaatattttacttattttatgtctttctccaccccctcagttagaatgtaagctctttaagggtaggaatttttctctgctttgttcactgcaatatttcttgtctttaagcagatcctggaatgtagaaatttttcaatatctgttacataaacaagtaaatttgagtatttcgaagagagattcaaggtcatcagtatgttttactaagaaggattggacatcttatttaactatggcaaatggattcttctccacttcaacagttttaacaaaaacagtggaatattcctataatagtacttttcagagagaaaagtttcagctgaggaaaatgaaatatatgcttatctattccaagtctgctaataggtaagtcatattagttgattgatataatttgaaattaacatgaaatttaagtttaaaatgcagtgaatctaatgataacatacaacaatagattttaaagtaatcattggaaaaccttcagaaaaactaggctgttagtcaaattgaagaatatctcctaagggtttctggaaagagacccctgccctaatttcccactaaaaggtccagaaaaattgatgccacctgtagtttggcaacgtgcactaaaaagttcaaggtaccgtctttggcatagcaatttaattgctagaaatcctaacaataaatatcttaagctctaagaatctttatatatataaaatatatggataatcattctttgtcctacatatttaagctctatcatctattttaagtaatttttttttggtatggtatgaggtaaggatcaggttctatttttctcctatatagaaatccagtgccttcatttgttcaaaggacttttcctactgtcttgttacctttgtggaaatcaattgaccatatatgtgtggctctatgtctggaatttctgttatgttctgttgatttatatgtctattgttacatcagtattacactgtcttgactactatagctttatagtaagtcttgaaattaagaaacgtaagtccttgcttgatgacttgggatacagaaaaaaaaatctcctctgagctgttctaacactcaataaagtttgtcttcatcttgctcccccaaaaaaaaaaaaaaaaaaaaaaaaaaagaaagaaaaagaaacgttaagtcctctaactttgttcttttgcagacatttttggctatgttcttttcattttcatgttttgcattttcaatttcagttttcacaaaccaaaaacctgctgggagttttattagaattgcattgaacttataatttggaggaaatggaaatggaaacaatattgagttttccaatccatgaacattatatagttttttggaaagaagtctgctgtcatttttcttctgtgtgtaatgtgtacttttcagcaatttgaatatgatatgcccgtgtgtatgtggatgtgtgtatcatgcttggggttcactgagcctatgtgagttcgtagtttccatcaaatttgcctcacaccctccagttattctctatcccatcattttctttttttttttcttcctatacttgtcaccatctgaaactatcatgattagtatattcacatctgtctctccttgttaaggagtcaaacttgttcaacactgtatccccagcaaccaaacaaggcctgacacagagttggtggtcagtatttgttagctttgtatattattgcctacaacatttaccagtaggataataactcagtcgtcctaatatttgctgtacatcagctacccacagtattctagcattgcttatttcagtgtcagatactgatatgttaaaagggaaaggattaggtagatttttccaaatgcactgttgttctagaaaaggggtaattgttattaaatcaccaccattattactgcctggtgcttcaatgaacctctagcttaagggaaacaaaaacaacttgatgtcaactcttcaaagcaaatggtttctactctgtctacctctccaaatggccacatatcccaagtgttcacaaaatatttattgttattgaggatcctagatgtgagaggggtatagggcagggccaaccttatcaacactttggcctcaaagatgaatggaaccttgccctcggtatttctctgtaactgcagagtttggttgagtagggcagaggagaaagaacagtattagtgtctgtcatttttgactgtatacaatttgctgatcaaatgggagctcagggaatagcctacaatattatcaaaatgttcagccaccatcgtctgcctacatttccacctaaaacagtgctgtttcctatttgctattttttagagggttagtttcttcgtgtgtgtgtgtgtgtgtgtgtgtgtgtgtgtgtgtgtctgtgtgtatatatatattttggctggggtgggggtggagggcatataaatttttgtcaactttccagcgacactgtatttccaacaaggtttaagtaggacatcagtgactggtcaagccctttgaaggctgtctctatgccaagtaagaagattctttttatgtggaatgcagtatcaaatcagcaaagcagcagacttatcaaggaaaaactatacaaagaagttcgggtagaggaaaaggttaatttgaaatctttctgaacttacattataattactgaaggtctttaatattataatagctggcaataattctgatagtggcttttcaatggaatttaaaaaattctacattctacttccactggaaaatgtcatgtcaacgagtttaattgtaaactaaggataagctcaaaagggtgataacaga

SEQ ID NO: 200 - DNA, 105621 bp, Homo sapiens
ccctatctgacagctcttaagagcagtggttctcccagcatggcatttgagctctgggaacagacagactgcctcctcaagtgggtccctgacccctgtgtagcctaactgggagcacctcccagtaggggtcgactgacacctcatacaggcgggtgctcctctgggatgaagcttccagaggaaggatcaggcagcaatatttgctgttctgcaatatttgctgttctgcagcctctgctggtgatacccaggcaaacagggtctggagtggacctccagcaaactccaacagacctgcagctgagggacctgactgttagaaggacaactaacaaacagaaaggaatagcatcaacattaacaaaaatgatatccacaccaaaaccccatccataggtcaccaacatcaaagaccaaaggtagataaaaccacaaagatggggagaaaacagagcagaaaagctgaaaattctaaaaaccagagtgcctcttctcttccaaaggattgcagctcctcaccagcaatggaaaaaagctggacgaagaatgactttagttgacagaagtaggcttcagaaggttggtaatgacaaacttctctgagctaaaggaggatgttcgaacccatcgcaaggaagacaaaaaccttgaaaaaagattagacaaatggctaactagaataaacagtgtagagaagaccttaaatgacctgatggagctgaaaaccatggcatgagaactacgtgacacatgcacaagcttcagtagctgattcgatcaagtggaagaaagggtatcagtgattgaagatcaaattaatgaaataaagtgagaagagaagtttagagaaaaaagagtaaaaagaaatgaacaaagcctccaagaaatatgggactatgtgaaaagaccaaatctacatttgattggtgtacttgaaagtgatggggagaatgaagccaagttggaaaacactcttcaggatattatccaggagaacttccccaaccttgcaaggcaggccaacattcaaattcaggaaatacagagaacactacaaagatactcctcgagaagagcaaccccaagacacataattgtcagattcaccaaggttgaaatgaaggaaaaaatgttaagggcagccagagagaaaggtcaggttgcccacaaagggaagcccatcagactaacagtggatttctcagcagaaactctacaagccagaagagagtgggggccaatattcaacattcttcaagaaaagaattttcaacccagaatttcatatccagccaaactaagcttcataagtgaaagagaaataaaatcctttacagacaagcaaatgctgagattttgtcaccaccaggcctgccttacaagagctcctggaggaagcactaaacatggaaaggaacaaccggtatcagccaccgcaaaaacatgccaaattgtaaagaccactgttgctaggaagagactgcatcaactaatgggcaaaataaccagctaacatcataatgacaggatcaaattcacacataacaatattaaccttaaatgtaaatggggtaaatgcccaattaaaagacacagactggcagattggataaagagtaagacccatcagtgtgctgtattcaggagacccatctcacgtgcacagacacacataggctcaaaataaagggatggaggaagatctgccaagcaaatggaaagcaaaaaaaagcaggggttgcaatcctagtctctgataaaacagactttaaaccaacgaagatgaaaagagacaaggccattacataatggtaaagggatcaattcaacaagaggaactaactatcctaaatatttgtgcacccaatactggagcacccagattcataaagcaagtccttagagacctaaaaagagacttagactcccacacaatagtaatgggagattttaacaccccactgtcaacattaaacagatcaacgagacagaaggttaacaaggatatccaggatttgaactcagctctgcaccaagccaacctaatagacatctacagaactctccaccacaaatcaacagaatatacattcttctcagcaccacattgcacttattccaaaattgaccacatagttggaagtaaagcactcctcagcaaatgtaaaagaccacaacaaactgtctctcagaccacagtgaaatcaaattagaactcaggattaagaaactcagtgaaaaccacacaactacatggaaactgaacaacctgctcctgaatgactactgggtaaataacgaaatgaaggcagaaataaagatgttctttgaaaccaatgagaacaaagacacaacataccagaatctctgggacacatttaaagcagtgtgtagacggaaatttatagcactaaatgcccacaagagaaagcaggaaagatctaaaatcgacaccctaacatcacaattaaaagaactagagaagcaagagcaaacaaattcaaaagctagcagaaggcaagaaataactaagagcaaaacagaaccgaaggagatagagacacgaaaaacccttcaaaaaatcaatgaatccaggagctggtgttttgaaaagatcaacaaaattgatagaccgctagcaagactaataaagaagaaaagagagaagaatcaaatagacgcaataaaaaatgataaaggggatatcaccaccaatcccacagatatacaaactaccatcagagaatactataaacacctctaagcaaataaactagaaaatctagaagaaatggataaattcctggacacatacaccctcccaagaataaaccaggaagatggtgaatctctgaatagaccaataacaggctctgaaattgaggcaataatcaatagcctaccaaccaaaaaaagtccaggaccagatggattcacagccgaattctacgagaggtacaaagaggagctggtacccttccttctgaaactattccaatcaagagaaaaagagggaatcctccctaactcattttatgatgccatcatcatcctgataccaaagcctggcagagacacaacaacaaaaaagagaattttagaccaatatgcctgatgaacattgatgcgaaaatcctcaataaaatactgacaaaccgaatccagcagcacatcaaaaagcttatccaccatgatcaagtcggattcatccctgggatgcaaggctggttcaacatacacaaatcaagaaacgtaatccatcacataaacagaaccaacgacaaaaaccacatgattatctcaatagatacagaaaagaccttcaacaaaattcaacaacccttcatgctaaaaattctcaataaactaggtattgatgggacgtatctcaaaataataagagctatttatgacaaacccacagccaatatcatactgaatgggcaaaaactggaagcattccctgtgaaaactggcacaagacagggatgccctctctcaccactcctattcaacatagtgttggaagttctggccagggcagtcaggcaagagaaagaagtaaagggtattcaattaggaaaagaggaagtcaaattgtccctgtttgcagatgacatgattgtatatttagaaaaccccatcatctcagcccaaaatctccttaagctgataagcaagttcagcaaagtctcaagatacaaaattaatgtgcaaaaatcacaagcattcctatacaccaataacagacaaacagagagccaaatcatgagtgaactcccattcacaattgctacaaagagaataaaatacctaggaatacaacttacaagggatgtgaaggacctcttcaaggagaactacaaaccactgctctttttttttttttctgagacaatctcgctctgtcatcaaggctggagtgcagtggtgcaatctcagctcactgcaacctctgcctcccgggttcaagcgactctcctgcctcagcctcccaagtggctgggattacaggcgctcaccaccacgcccagctaatttttttatatatatatactttaagttctagggtatgtatgcacaatgtgcaggtttgttacataggtatacatgtgccaagttggtttgctgcacccattaactcatcatttacgtaaggtatttctcctaatgctatccctcccccagccccccaccccatgacaggccctggtgtgtgatgttccctgccctgtgtccaagtgttctcattgttcaattcccacctatgagtgacaatatgtggtgtttggttttctgtctgtgtgatggtttgctcagaataatggtttccagcttcatccatgtgcctgcaaaggacatgaactcatcattttttatggctgcacagtattccatggtgtatatgtgccacattttcttagtccagtctatcattgatggacatttgggttggttccaagtctttgctattgtgaatagtgctgcaataaacatacgtgtgcatgtgtctttacagtagcatgatttataattctttaggtatatacccagtaatgggatcactgggtcaaatggtatttctagttctagatccttgaggaatcgccacactgtcttccacaattgttgaactagtttacactcccaccaacagtgtaaaagcgttcctgtttctccacatcctctccagcatctgttgtttcctgaccttttaatgatcgtcattctaactcgtgtgagatggtatctcattgtggttttgatttgcatttctctgatgaccagtgatgatgagcattttttcatgtgtctgttggctgcataaatgtcttcttttgagaagtgtctattcatatcctttgcccactttttgatggggttgtttttttcttgtaaatttgtttaagttcctcgtagattctggatattaaccctttgtcagatggatagattgcaaaaattttctcccattctgtaggttgcctgttcactctgatggtagtttcttttgctgtgcagaagctcttttggcttttgttgccattgcttttggtgttttagtcatgaagtccttgccgatgcctatgtcctgaatggtattgcctaggctttcttctagggttttcatggttttaggtctaacatttaagtctttaatccatcttgaattaatttttgtgtaaggtataaagaagaaatccagtttcagctttctacatattgctagccagttttcccagcaccatttattaaataaggaatcctttccccatttcttgtttttgtcagatttgtcaaagatctgatggttgtagatgtgtggtattatttatgaggcctgtgttctgttgcattggtctatatctctgttttggtaccagtaccatgctgttttggttactgtagccttgtagtacagtttgaagtcaggtagtgtgatgcctccagctttgttcttttggcttaggattgtcttggaaatgtgggcttttttggctccatatgaactttaaagtagttttttccaattctgtgaagaaagtcattggtagcttgatggggatggcactgaatctataaattaccttgggcagtatggccattttcacgatattgattcttcctatccatgagcatggaatgttcttccatttgtttgtgtcctcctttatttcattgagcagtggtttgtagttctccttgaagaggtccttcacatcccttgtaagttgtattcctaggtattttattctctttgtagcaattgtgaatgggagttcactcatgatttggctctctgtttgtctgttattggtgtataggaatgcttgtgatttttgcacattaattttgtatcttgagactttgctgaacttgcttatcagcttgaggagattttgggctgagatgatggggttttctaaatatacaatcatgtcatctgcaaacagggacaatttgacttcctcttttcctaattgaataccctttacttctttctcttgcctgactgccctggccagaacttccaacactatgttgaataggagtggtgagagagggcatccctgtcttgtgccagttttcacagggaatgcttccagtttttgcccattcagtatgatattggctgtgggtttgtcataaatagctcttattattttgagatacgtcccatcaatacctagtttattgagagtttttagcatgaagggttgttgaattttgttgcaggtacttgaaaggaagaggggctgggacaggagctttatgctgaacaggttggctaaacatacatattctggctaatttttttgtgtatttttagtagagatggggtttcaccatgttagccaggatggtctcgatctcctgacctcgtgatctgcctgcctaggcctcccaaagtgctgggattacaggcgtgagccgccgttctttttttttttttttttttttaagagacagggtctcactatgttgtccaggctggtctcgaactcctgcgctcaagcagtctgcccccctcggcctctgaaagtgttggaattacaggcgtgagccaccgtgcctggcagaaaatatagtttattctttaggtgtaggcgtgtgtgacttaacccttacctgacacggccttaggtcctgattataatttggtatcttattgccataaagagtgcattctgttagtctatgatctctattttaacattgatgctggtcagatgttgtgtctgaactgcaaaagggagggagtataaccaggcatgtctgaccccctgacctgtcatggctggaaactcagtttttaaggtttttctggggtctccttggccaagagggtccattcaattagttagggggcttaggatttgtttttagtttacaggggaaataagcctattaggggtagacagatctgcaaagcatgagtgttggcaggaacttaagcaacaaagagatacggttaaaatgtcgctttctctttctccgtagaaagccagaggaatttgtgttttctccagagagggtgggacagaggagagaatggtggggcaggagggagagttagtgattttggaggaggctagagggtgcagggccagttagaaaacctcagctgggggtgtggaaaggacttctaaaaacttctgaggggccccctccccctcccccgctccctctccccacggtctccctctctttccacggtctccctctcatgcggagccgaagctggactgtactgctgccatctcggctcactgcaacctccctgcctgattctcctgcctcagcctgccgagtgcctgcgattgcaggcacgcgtcgccacgcctgactggttttggtggagacggggtttcgctgtgttggccgggccggtctccagcccctaaccgcgagtgatccgccagcctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcctggccgccaccccgtatgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccggccgccatcacatctaggaagtgaggagcgtctctgcccggccgcccatcgtctgagatgtggggagcgcctctgccccgccgccccatctgggatatgaggagcgcctctgcccggcagcgaccccgtctgggaggtgaagagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaagtgaggagcgtctccgcccggcagccaccccgtccgggagggaggtggggggtcagccccccgcccggccagccgccccgtccgggagggaggtaggggggtcagccccccacccggccagccgccccgtctgggaggtgaggggcgcctctgcccggccgcccctactgggaagtgaggagcccctctgcccggccaccaccccgtctgggaggtgtgcccaacagctcattgagaacgggccaggatgacaatggcgactttgtggaatagaaaggcgggaaaggtggggaaaagattgagaaatcggatggttgccgtgtctgtgtagaaagaagtagacatgggagacttctcattttgttctgcactaagaaaaattcttctgccttgggaaaaaaaaaaaaaaaaaacttctgaggggtgagtttaaactgtttgccatgtatcatatgacctcccccagggcccagagtaccctaatgtctttgtactcgtcaatgttttgtgtgggaagggtgcgggcagtccttagggagagctgagtttcctctccagacttctgaactgtggtacgcaacagcctggcaaaagcagaaacccagaggcagagatatttaggagaatataaatccccagatatttgcaaatatgttaagggagggactctgactttcaccgtccatttttacctcaatctcaaagggcaaggaggttgacatctaagttacaaatataatgcacaagcatttcaaaaagtaggggaaaaaaaagaaaaagaaaaagagaagcagaaagaagggggaaaaaatcactcatccctgccaggcacggtggctcacgcctgtaattccagcactttgggaggctaaggtgggaggataacttgagtccaggagttcaagaccagcctgggcaacatggcaaaaccctgtctctactaaaattacaataattagctgggcgtgtggcgcatgcctgtaatcccagctacttgggaggttgaggcaggataatcgcttgaacccgggaggcggaggttgcagcgggctgagattgcgcaactgcactccagcaggggcgacagagtgaaactgtgtctcaaaaaaaaaaaaaaaaaaaaaaatcactcatccagatagctaggtgtggcctaaggagcttgcggcctacggaaggtgtggccgaaggagaggggaggggtcatctttaatgatgatggaggggaggcattggtcatatacctgagagtcaagctttgttcatcgtcagatgaaagccaacttcttccaccagattgcctcccagctgctaggtagtttcctgtggtacatcttaagcggtaggttgggataataggtcccttccaggtcttaaagatgtggattaataagaacagaattttctacaacaataaggaggatgtcccctattttaggtgaataagcgtattgcataagcacatgggaagaaaggttaagaactctaagaccgtaaatttccagttgtagaagcctcttgaaggcggaaagcccttttttgaaaattataggcgatatgatctcctccagtggacctagcactgggttaagagtctctccagacttgtcactgcaagtcacgtaccttttctaggactaagtttcttcactggaagatgaggaggttgcactagatgacctagaaattcccttccagctttaaattccctcttgtgtcacttgctggacttgttctactggacctggcgctcccctgctcctcccttagctgctacgtccgcatcccgcaccagagggcgccacaggctggcccggggcagcgtgcggtgggcggagaggcagaattaggggagtctccaggaggcgtggtgattggccgccgccgggcggaagggggcgtggggagggaaaggccgagcagcgcggtgacgtctcgctggcgggggcggggccgggccgcggagcgtgtgacgctgcggccgccgcggacctggggattaatgggaaaagttttggcaggagcgggagaattctgcggagcctgcgggacggcggcggtggcgccgtaggcagccgggacaggtcagtccgagacgagagaagcggtcaggcaagtggcggagggaagcgccgggcctgggccgaggcggccagcgggactggggcgcaaggcccggcggcggggaacggggtgcggggagctgccggggtccgcggacagcgtcacggcggcttcctgatgctccggcccgctccggtcagccgtcgtgcgttgccatgtaggcgccccgctgaccctgcgcccccccgcccttggacccccatagctgcttgagtgagtccgaaatacgggcctccttccaccctactctttgccccctcttgggcctggtggcttcgtcttctcccacttgtgagaaccccgtctcaggcccgggggcctctcccattcccctcccctgcctctgacctcttccttcacccgtttctggtgttcctgaatccactgccctatctagcgagagtcttctctgggatcttttcctctgtccccctcgttatccttgtctcctgccttcatcctcccatccttgctctctcaggctttactctctctccccatccctgtccccttcttatctgtggtctgatccctcctagtattatgggtccccatcctcttccccagggtgttcctaggctttttccaactccgtgcctgcagtccctgtctccctaagactctcaccttggttccctgagaggccctgtttttgctcctttttccgatttccttcgtatcaattctgtcccctacattcctgtcgcccacctccttttctctccctgttcctttcccctgcttcagggagaagccttagctccacactctactctactttcacttgacctgcagttgacataaccatggggtgggggtggaggtgttcagaccttgatcgaattaagaggctgattgactaaaggaaataacagattgtgtgggagaatgtacgtgggtgttgcatcagagatgatgtccaatttgtaggccattcttcttatctcagctttaatacttcccctttatggggctgttgacttccaggaacccttgggggagacggcgctgagctggatgtgtgccacgggtagccggaggctttgtccaattcttttccccttccaggaaccggggttttgtgtctttccactctggatgtgtggaatacacttataccatgataccccagcctctctctgccctcactcccaccctccaccctgtgctccatccgaaaggactaagagaattctccagaagctgtgctccagaaaatacttgtggtcctcaaccttttttctgtgtactggctccagaacttttttttttcccgtttgagttttgaaatagattgctggcctgatagccctggggctggcgggcatctgtccccttttattattggtggcttgaaacagctgctgattttctctcatatctctttgacaatctttggccaactgaatgtgcctctgatgttggtcactgaacatgttctcttggagtctcttctccctcttttttctttgttcttttctgaatctagggaatccaaattgtccctctttttccctgggagcttaatttcctctgtatccaggaggaacggcaatcccagagctctgttccctttgcccaggcatagtatgaggtatcagattgataactaccctggtgggctgtggggctgcagtagttagaccttgtcaggaacttgagcagacacatctgcttccagtcacatagatcatcttctctggggcttgagagcccaccaccttccatgtgtgtctggatgtttaaccttaccaagcagaagattctcgtcatatccttcagtttgagctcctttatttggcgttggttctctaaagaagtattcaagaaataacatatcctttgtttctacccagtctgatcttggaggattctgaaagcgtgacccactctcatgtttagaaatgaaggctcattgtttcacctggccccaggtttctaggggctcctcttttgatgattgtgctgtctttgagccagattggacatgggagttggcaacctttaggagctgcggtggagagccaaaggaaccagcttgaccagactttaaagttttgtaatcctcttgtacactgttttctgtgaaagcaataggattgtggatggcctgttgttgagccagtcccttctccactgacccccagaccccctttgcagcacttgcaaagatttgggtagactggaccagagggttttccttgttcctgtgaatagcatctctccagggttttagtggatcattctaaagaggtagaggtcaagtgttggacagatttttagtctagtctctggctttcaaggactcctccttactcttttgagcagtttgttacttctggccgtgcttaccccttagtagtgctctctgctgtggtggcaggtgagagatttgagaacaggtcaaggccagtccttgtggagcagcttgggcaccagcagccctagatggatagcttcttgcagtttgtccactctcattttctgagaaggtagtcatgattgtcaattaccaaattccttccccattcagtgatttttgcagagtctgggtctggattttctttccttctttcttttctgacacaaggttttgttctattgcccaggctggagtgcagtggtgctatcatagtgcactgtaacctcgaactcctgggctcaagggatcttcctgcttcagcctccagagtagcggggactacaggtgcacaccaccacactcagctaattaaaaaacaatttttttgtaaagacaggctctcacaatgtctcgaactcctggcctcaagcagtcctcctcaccttggcctctcagagcactgagattacactgactgctcgttcaggtgcctttctccttgcctcttcaccatggccttcttgtgtgatatatgccttaacccattcaggaagaattgctcctactcagcctttcaacccgacctgtggtcccttagacgccttcccttagggcctggtaagaggatagacagtgtagagcactagcctgggaagccattaggcctctgctttgggcctacagctgtcctgactgttgtgcaagctgtcttcagggcctgcagattctggcacatcctgggatagtgcagctcctctctctcaggagttggacctgtcacttttttttcgttttttttttttttttttttgagatggagtctcgctctgtcgcccaggctggagtgcagtggtgcgatcttggctcactgcaagctccatctcccaggttcacgccattcttctgcctcagcctcctgagtagctgggactacaggcgcccgccaccacgcctggctcatttttttttgtagttttagtagagacagggtttcaccgtgttagtcgagatggtctcgatttcctgacctcgtgatctgcccgcctcagcctcccaaagtgctgggattacaggcgtgagccaccacaaccagcctggacctgtcacttctaagggcttcagctatatcctgtccctgaggcccacctccctgagtgctctctgcaggctgggaagctgaacagtggtgccttgctccagtgcctctgaagggcttggaaattgcaggacacagctttactgctcagcattgcccacactggaaacattctcttcctccctacccaggtctctgtgggctttgtccgttctgccaggcccttgcttatatgatgtcagaagccctgtgcccggtgccattgtcaatgccatgtcccagattacctaatggctgcttcttggagatggtttggtgtccatgcacatttttctctgccgttggagccagggtgaggagctgcttgcaacagctggattccagggtgtcagaggagcccttggagcttgccttgagcctggcagggagaacatggccccttgcatcaggtttcagacatatgggtcttcttccttggcagatggctcctagccttcataactcagcaggctggtgattggcatgtgactccagttcattctgcaggggctttggtgaaggcatcaactatgactcaggacatcttcatttatgagcttctacccagctcccttcttaccttgcctgcgccttctgcgccgacctgataaaatcagcaaagccagtgtctgcttacttgggagtgagcagactccttccaggattggggaaatatttgctgactcaggctcagaatcacatctcagggtggtgtgtaagggaccgacgaggagccagattaccttaggaacactctttgagttacggtgggtataacttattagagttgctttgagggcccctggcacctgtcagctaaagctgttggggttttttctatcctgcagtgttgtacagtgttttgggcatgcacgtgatactcacacagtggcttctgctcaccaacagatgaagacagatgcaccaacgaggtaatcccattttctttactcaggggtctctgaccaccactgacacaggatccagatttaagatcctgaccttgaagatgaaataatttcactagggcttattcccagattccaggttcctgtcacagcatctggtaccagttgcttatgcatagtataggcatttattaagtaattattgaaagtctatggcttacatagttttttcaggagcatggagattcccacctttgcgcccattaaaagataaactccacagggcagggagttgttttgctgcctgttgtgtctaggatagtgcctggcacagaggagataatgaataaatttttgttgaatgagtaaatgaacgaactttcgtctttgcctatatgggtacctagggtgccaggccacaaagatggtgtccatcattctctcttattagggggcaaatatatatatatatatatattttgtttgtttgtttgtttttgagacgaagtcttgctcttgtcccccagactggagtgcaatggcgtgatcttggctcactgccacctccttctcctgggttcaagtgcttctcctgtctcagcctcccaagtagctgggattataggcacctgccaccacgcccggctaatttttgtatttttagtagagatggggtttcaccatgttggccaggctggtctggaactcctgacctcaggtgatccgcccgcctcagcctcccaaagtgctgggattacaggcgtgagccaccgcacctggccttttttttttttttttgagatggagtttcgctcttgttgtccaggctggagtgcaatgccgtgatctcggctcactgcaacctccgcctcttaggttcaagcgattctcctacctcagcctcctgagtagctgagattacaggcatgcgccaccacatctggctaaattttgtatttttagtagagacggggtttcaccatgttagccagactggtctcaaactcctgatgtcagatgatctacccgcctcagcctcccagagtgctgggattacagatgtgagccactgtgcccagccgggaacaaatatttttaagtgccaactatgtgccaggcacttgggaaatgataatagtaaaaaacagatccaatctctgcctcatgggtctgtggtttgctggtatatatgagagctggccataacacacagaattgtttcttccatctctgcaggggtaggaggttctcaccaagagtctgaacaatgctctgggttcccattgctgtttccatgttctcaggatgcctggcaggttttataaactctcagaagtggagctccagggaatacaatgttcattgtcctatttggaaggctgggttgttgtgggtccctgctgggggccggggaaacgtgggcctcctgcctgatttgttttaatctctgaagttcagtggttccagtagctgtttgtgggcttcacttccccttctctgcctttaacaccctgcaggttttcctgttgtcagacagggtggtgagtccctgtgtctctctgtctgtgggggtcaggttgtttgtagatctttcaggaaggtcctgggtggggggccctcctgctttcaaacccataccaagtgctttcctctgaagggaatgtgagggaggaagaaggggggagtttcagagacttctgaggttccccaagagggaagaggtcaaagtacctcctgagcggggagagctactgagttgaactgatttgctttgccatttgctttagcagcagccaggcccagtggcagcaattgtacgtgcatttccaggggtcagttgtccagttcatccctgagccttgagctcccagtcgcaggtaggaacttctcttctcctttctttttttttttttttttgagacggagtctcgctctgtcacccaggctggagtgcagtggcgcgatctaggctcactgcaagctctgcctcctgggttcacaccattctcctgcctaagcctcctgagtagctgggactacaggcgcccgccaccacgcccggctaattttttgtatttttagtagagacggggtttcaccgtgttagccaagatggtctcgatctcctgacctcgtgatccaccggcctcggcctcccaaagtgctgggattacaggcgtgagccaccgcgcccggcctcttctttctttcttgattgggtactgctatatcacctaggaccaggggtgtgtccaatcttttggcatccctgggccacattggaagaagaattattatcttgggctatacataaaatacactaacactaacaatagtgatgagctaaaaataaaaatggcaaaagaatctcatgttttaataaagtttacgtatttgcgttgggatgcattcagagctctcctgggctgcatgcagtcatgggccatgggttggataagcttggcctccctaggcagtcctctcaccacagcctcccaagtagctgggactacaggtgcacaccactgtgcctggctaagttttttttttgtttgtttttgtttttttttaatttaatgggtacatagtagtaggtgtatatttctttttttcttttcttttttgtttttttgagatggaatcttgctcttgtcacccaggctggagagcaatggcacaatcttggctccctgtaacctccacctcctgggttcaagcgattctcctgcctcagcctcccaagtagctcagattacaggcgcccgccaccacgcccagctaatttttgtatttttagtagagatggggttttgtcatgttggccaggctggtctcgaactcctgacctcaagtgatctgcctgcctcagcctcccaaaatgttgggattacaggcatgagctaccacacccggccttgtatgtcttcttttgagaaatgtctattaaaatcttttgcccatccttttattagattattcgtttttttcctatagagttgtttgagctcgttatatattcttgttattaaccccttgtgaaatgggtagtttgcaaatattttctctcattctgtgggttgtctcttcactttgttgattgtttcctttgctgtgcagaaactgtttaatgtgatgtgatcccatttgaccatttttgctttggttgcctgtgcttgcggggtattgctcaagaaatttttgcccagaccagtgtcctggagattttctcctgttttcttgtagtactttcatggtttgaagtctcagatttaagtctttattttgatttggtttttgtggatggcaagaggtaggggtctagtttcattcatctccatatgaatatccagttttccaagcaccatttattgaagagactgtcttttcctcagtgtatgttcttggcacctttgtcaaaagtgagttcactgtagatgtgtggatttgtttctgggttctctattctgttccattggtctatgtgtcttttttttttttttttttttttctctgagacagagttttgctctgttgcccaggatggagtgcagtggcgtggcgtgatgttggctcactgcagcctctgcctcccgtgttcgagcagttctcctgcctcagtctcccaagtagctgggattacaggcatgtgtcaccatgcctggctaattttttgtgtttttagtagagatggggtttcaccatgttggtcaggctggtcttgaactcctgacctcaggtgatctgcccacctcggtctcccaaagtgctgggattacaggcatgagccaccgcgcctgggcgaaagatggcttattttgaagtcaactttagaatattataaaacagcattctcaaactttttggcctcaagatccctttagattctttttttgtttgtttgtttgtttttgttttttgagacggagtctctctctgtcacccaggctggagtgcagtggcacaatctcggcttactgcaagccccgcctcccgggttcatgccattctcctgcctcagcctcccgagtagctgggactacaggtgcccgccaccacgcccagctaattttttgtgtttttagtagagacggggtttcaccatgttagccaggatggtctcaatctcctgacctcgtgattcacccgcgtcggcctcccaaagtgctgggattacagatgtgagccactgcgccagtccctttagattcttaaaaattattgaagaccccaagggcttatgtttaccatgttagaagttataataggccgggcgggtgacattcgttaatatcaccactgatctcatttttaaaaagtctttaagtattgggaagctgtcgggctcacagtggtcaatacacgttttctaaatttgagttttctcttgaaagtttgatttttatcattggtaacatactgttggttcttttgtttgattttgtctgagatagcatctccctcagtcacccaggctggagtgcagtggtgcagtcatagctcacttgcagcctccaacttctgggctcaagtaatcctcctgcctcagcgtccagagtagctaggactacaggtatgtgctaccatgcccagctcattttaaaattttttgtaaagatggtgtcttgtgatcttgctacatcgaccaggctggtcttgaattcctggcctcaagtgatccatctgcctcagcctcccaaattactgggattataggcatgagccaccacacccagccttttttttttttttttttttttttgatatggggtctcactcttgcccaggcttgagtgcggtggcacagtcttggctcactgtatctagccttgacttccaggctcaagtgatcctttcatctcagcctcccaagtagctaagactacatgcatgcaccatcatgcccacctcattttttaacttgttgtagagatcaggtctccctgtgttgtccaggctggtctcaaactcctgagctcgagccattcattcctgccttggcctcccaaagtgctgggattaaaggcatgagccactgtgcccagccagttcttttttgttttgttttgttttgttttgagatgaagtctcactctgtcacccaggctagagtgcagtggtgtgatctcggctcactgcaacctccgcctcgtgggttcaagtgattcttctgcctcagcctcccaagtagctgggaccacaggcgcgcaccccaatgcccggctaatttttgtatttttttagtagagatggggtttcaccatattggtcaggccggtctcgaactcctgacctcatgatctgcccacctcagcctcccagagtgctgggattacaggcgtgagccaccgcgcccggccacaaagaatatttaaaagacagatatcaaaggtggagattttaataaagttagtttttatttattcatctaggacattcttaaattggcattttattgtctttcatggttctgtggattaactgggcccagctgggtggttcttgcttgggatatgtcatgttgctatagtcaaatgaagacggggcaggtgtcatctgaaggctcagctgggctgggtgtccacgctggcttaggcacatgggtggcacttgatgctgttgaatggagtgcgtatacatgacctctctatgtgccttgggcttctcatagcatgagagctgggttctgagcagaagcattcccaaaatgaatgtattgagagattcagaaagaaatgtcaatgtttctcatgtcctagccttggaagttacacagtgccacttcctctattcccttggtctcaggaccagttcagattcaaggagaggactacacaagggtgtgaatactaagaggcgtgattcactgaggagagaaacaggcctccttggagaccagctactacttttcagcatccttatgtgaggtaatgtggtcttgatacttccaagagaaaagcacatcttctcatgattttcattcctggaagctactgttagttaggaaattcctaataggttgatggaggacattgaatgctaggtgaaggaatttgtactctgttctttgggcaatgggggagccatcagtggttttggagcaaggagtggtggtgttaatattgcaaaaaggtagattaggaatggagatagagaggataggtaggggactgcagtggtctaaatgtaaggaaattcttcttcacattaaatctgagttcctctggttgcaatttaagtgtattgattttgatatttcagccacacagattaagcacccagagccagggtggaataacccatccctaccccatatccatttagggctgttgatgcacaggagagattaagagttcacaaactttagaaggcaactaaatttaggttttattgtcaaagcacataaaaagttaagcataaattattcaaaaataaaaagcaagaaaggtgaaacttcatttaacaccactaaccatgtttcaaatacgcttcagtttcagtattatagaagcaaggagtggagccagaggaaggaatggggaggacaaattagagaatggtaggaagagggacaaaagtaggggaagaaaggagtcaggaggggcacacagcagaaagaatttgaaggaggtcagattggagcaactacttgaagctgagagaaggctccgtatggggctaacatgttagcaaagagctggtgccttctgtgtttccctgaggcactggcttctgggttttagcatctggtatcctcaccctttctttaatacagacagtccccaacttatgatggttcaactttacagtgatgtaaaagccatacacggctgggcgcatggctcacgcctgtaatctcagcactttgggaggccgaggtgggaggatcacgaggtcaggagattgagaccatcctggctaacacagtgaaaccctgtctctactaaaaatacaaaaaattagctgggcgtggtggtgggcgcctgtagtcccagctacttgggaggctgaggcaggagaatggcatgaacccgggaggcggagcttgcagtgagccgagtgcatgccactgcattccagcctgggcgacagagcgagactccgtctcaaaaaaaaaaaaaaaaaaaaaagcgatacacattcaacagaagccccatcctttagtactcatacaaccattcttttttttttttttttgagatggcgtctcactcttgcccaggctgcagtgcagtggtgtgatctcggctcacagcaacctctgcctcccgggttaaagtgattctcctgcctcagcctcctgagtagctgggattataggcgactgccaccaggcctggctaatttttgaatttttagtagagataggatttcacaatgttggccaggctggtttctaactcctgaccaggtgacctgcccacctcggcctcccaaagtgctggaattacaggcatgagccaccgtgccccggttctcatacgaccattctgttttttcactttcagtacagtattcaattacatgagatattcaaaattgtaacataagctctgtgttagatgatgttgcccgtaggctcatggaaatgttctggcacatttgcagtaggctatgctaagtaagttatggtgttcggcaggttacatatattacatgcgtttttgacttgtgacgttttcaacatatgatgggtttgtccttataagttgaggaacatttgtagccatttcatcgtctgtgaagaggcctgagtggattttgtgctggagaccggtgtgactcagctccagtgttgactgaccttctaaccatgggcttgtgactgaatgtcctgagccttcattttcttccctgtgaggattaaaatgaacctcaggaaatgctggcttgtcctctttctgtcaagctgggttctgagggggtgagcccaggtaggagtgacttctgaaccagcccagatttacaggcttgggcatagggagcccagcctcagcctgggagcctcatcttccattaaatagctcctggcattcaggggagtgcgttgcagcaccccatttttttttcattgaagtcctgtcttccagccaggcacagtgaatcacttgaggccacgagtttgagaccagcctagccatcatggggaaaccccatctatactaaaaatacaaaaattatctgggcacggtggcgcacacctgtagtcccagcacaccagagttcaagaccagcctgggcaacatggcgaaaccccgtctctacaaaaaatacaaaaattatccaggcgtggtggtacatgcctgtagttcctactccttggggggctgaggtaggagaatcactcaagccgaggaggttgaggctgcagtgagccatatttgtaccactgtactccagcctgggtgacagagtaaggccctgtctgtaaaaaaaaaaaaaaaaaaaaaaaaaagtgctttcttcttcttcttctttttttttttttttttttttttttttttttgagacggagtctcgctttgttgcccaggctggagtgcagtggcgtgatctcggctcactgcaagctccgcctcccaggttcgcgccgttctcctgcctcagcctcccgagtagctgggactacaggcgcccgccaccactcctggctaattttttgtatttttggtagagacagggtttcacggtgttagccaggatggtctcgatctcctgaccttgtgatccgcccgtctcagcctcccaaagtgctgggattacagtcatgagccacgatgcccgacctctttcttatataatttttttttttaatcgggcagccctcagaatcacagcagattcagaaagactccccagaaaagttctttcactcctaacttctacccagcctcatggtcacctcagcagctctcctgagaccgttactaagttctccacagctaatggtaactcagcttggaaagagttctcttgtaggaggatgctgaagggaggttgccaagtggtgtgggaaactgcttcatgcttaagttcacttccatatcatgatactaaaaggtatctaacagctgattttcattgctttcatttgtgatctgctaggaccacttgatccttatcactgcttttggcacactcctcatccaagagttgatcgcagaggcagagttccttgccaccagtccagtggaagtacaagccaactttgctctccaaatggcagcagtagctgagcaggccgccctgcattctctcctcataaacatgctgttctcaagtttgtcagaatccagagctctctactcattacccccttttccaaacaagcaagcaaagcatgctcttcctttgtttcccttaattgcctaaaacatctccatgctcatagctgttgactctctttgcctcctagttcctgttcctctggtgtaggatttctcagccctagcactgtaaacatgttgggctggataatcatctcttgtatgggctgtttgtgcattgtaggatgttgagcagcatccctggcttctacacactaagtgccagtgacactcttctcccctccccagctgtaaaacccaaatgtctgcggacattgccaaatgtctcctagggggcaaaatcacccctggttgagagtcactgctctatcatttattcactaaatactgctggtcagctgggtccactggcgaacctcacatcaataaacctggtaatagaagcatattgttcttacattagaagtttactctcttcagttatctcactgggcccttgagggctttggggaggagtgatgggaaatggtttacaattaacagcatattccaatgaagaaagaaagcatatgatgtctgcacaacagaggagagtgtccacaatgtacagctcttccctggagcagttatgtttctcagggtgtgcttttccaagtcattttgtgtctggttagaagccaccttcccttagcatccagaggtgccatgtagactagggttggtcacagtgtgtagattgccattgacctgcccattcctagtgtttgacctggtggtcatggcactctgaccacatcagttttcctctccaagcccagatgggttctcagaaccctccaccccaagctgcactcatgagaggcggcacttctgccatcctgatctagagcttgttcatgtggtccagaccatttctttgcagccccctctcctgtgtaaaagcctttaggaaagtgcagagatcctgatggattccccttgaccctcagcacgcacatcctggtatgtagtgctcagcactccgttgggggcttcagactggagaagagaaaactgcccttccctttcaaggacatcctccaagggccagaatgctcagttccgtaaaattaactctccactgcctacttttttttttttttttttaagacagtctcactctgtgccccaggctggagcgcagtggtgtgatcttggctcactgcaacctccgcctcccgggttcaagcaattctcctacctcagccttccaagtagctgggattacaggcatgcgccacctcacccagctaatttttgtatttttagtagagacgggatttcactatcttggccaggctggtctcaaactcctgacctctagtgatccacttgcctcggcctcccaaagtgctagtattacagtcatgagccaccatgcctggcctgctgcctatttaaatagcaagcagttacagttaaagaaagaccctggcctggggacgctgccaaggctcctaatctgacacttctttcatgtggaccagggatctgaactgtgtttcttccaaacttttggagcttgcttccttggtggtaagctaaatagtggcccccaaaatatacccctttataacccctgtaacctgtgaatattatatgacataatggactttgcacatgtaattaaattaaggatcttgagatgaggggattatcctagattatctgggtggacccctaaatgcaatcccaagtgtccttatgagtgggggccagagagagagattggacacaggagaaggaggcaatgtgactactgcagcaagatgctacactgctggctttggaggtggaagagaaggccaaaaatgcaacgaacgtagctttggaagctggaaaaggcaaggaaactgttttcccttagaacctctggaggaagtgtggccctgccaacacactgattttagcccagtgaaactaattttgaatttctgacctctagaactgtaagagaataaatgtgttttgttttaagtcgctaagtttgtggtaatgtggtaatttgttacagtgcagtaggaaactaatacagggctcatctgcctccaggtacaagtggtggcttggctgatccctgttcttattttaaggcgtccctctcatggcacaaggagagcataggcccagcattttcctgaaccagtatttgaaacaatctgcactttgggggaacctgttggggagttcttggaagcaagagagaaagcctcatatggtacccgatccttgctttggaactctcccagcaccttcagtgatatcatgaacaaagagttctttcagaccagtgaggatgtaggattattaaaatctgattctaattccatcttcccctctcctcttccatttattcaataaatgtttattgtgtacctcctatgtgctaggcactggggatgaagggataaacaaagcagataaaaaatctcctgctctcgtggtaactgaggtgggggaagtggagggagccagagttaagtcaacagcatgtgagatggcttcagatgctctctagaaaactaagcagaaaggagggtagtggcagttccacatagagggccggggaaggtctcaccacgaaggtgacatttaagtggaaagaggagagtgaactattgtgggaagaatctcgcaggcagagggaaagcaagttccaaggccctgcactgggacacagctgaggtgttcaacgcatagcgaggaggccagcgtggctggacagagggagggaggagaccaggagatgaagttagagacgagattggtggccctgaagtgccataacagcttttactttgcttggcattttgccccttctttctcctctcctccccctcacaccacctcacgagttttaggcccatgttcctcagttcctttccatgggatatttatcccatcatacttagggactaccagcaggcaaacatagtcacttaaaaatattagaagagggggaaaaagcagcctcctctttctgaatgatgaaagcagttccatggcagtgttggcatggcactgtgtatctagcagtgcaggctggccattcaccgcgtagttctgggtggtttctgagaggttcccctccatggccttcttcagcccatgaggaagtccaacccccctggcccgctgtttctttccatttcacccctcttggtctccccagtgggactcccacagctgacttctatccccacctgtgtctaatcccctttccatggctgagccggtagataacctagtaacgatctgagtagaatatggctcccacatgttgaatgcattgtgctgatcactacatatatcactttgattcacacaacaaccctgagaggtaggaaccattgtaccccttttagagatgaggatactgaggctcagactggttaggaaaattgcctaaagttgcacagctaatgaatggcagagctgggatttgaacccaagtgattaaagcccatgtctttgatcactacatagcagggccttctaggaaggatggctggctggatctagttgttccagtttggaaagtacctgcttgactggccagactgctgttggcttcagaaaatagcagtctcttgttggtcactgagaagaggcaaaattttggcaggccttggggcctcctgcagagtctcattccaggtcagtggacagaggaggccctgagaatagtcgtgcatactggctccctggatctgctccaagacagtgagcagcccctagaaccacaagagactggccagccaagctgtgggcccggcctgtagggtggaaggaactcttaagagaaaaaaaaaatctctgctgtgattaatcaacagcttcagtctggtgaagtgaaaagagaaaagttggcccagatgtgcacatagggagagaaataagggagggaaattgcctttattcatgttctcccttaggccagtcgttaccccacggatgagatcaccttccttttacaccagcctgcaagaggtgtgtagtggtagtctcattttacagacaaggtgtaggatcagagaggttaactcgcccaagtcaaacagctaacaagtggtggaattggaatttgagccctgttcttctcagttcagtagccctgctgttcttgctgatgtcacctcagcatgggctctccaggtatgtgcaaatagttatgcaagtgttgcatccacaggcttgtgagcagaggctgaaagggagccagggctcttggtacttgccctctcaacatgggccctgcctaagctagcaggactcactatacccaaaccagcagtggcattatatttttctcttttcttgcaccttgccatccccgatttatttttagagagccttttctatttctgttcccatttcttggcttggatgcaggggctggggtgcagggatggcgctagaaatcagaagaggcaggcatagatggcatctcactggtggccttggctggtctctgggaactgtgcccatctgcctgccctgctggctcctcctcaggccagctgtaggccccagggatcatagagctcgggtagctagaggctgggagggcaggcgagacagagaaacagccacacttctcatttctttggcttctcagagggggatgagcttcctcctggaacagagaagggagtagctcactgcctgtttctcagggttaggttacggacttctagggaatatggggtagtgcttaagagccagactctgtgtggcatgggggtgataactgtagaccctccacctctggggattaaatgagctcatacatgtaaaggcacagaggaggcactcactgaatgatgattgtttcattagtgtctttagaccctcagcacccagcaccataggtggatgccagtcattattggttagaccaaacagaacttcaaggcagctgggcatggtggctcacacctgtaataccagcactttgggaggccaaggtgggagggtcacctgaggtcaggcatttgagatcaacctgggcaacgtagtgagacccagtgtctatttatttaaaaaaataaaataataataaaaaaagaaaaataactttaatgttatttttgtcgtcctcttcatctgaacattggcctgcgtaggtattaacctgagtccagtgattgtttgtggagccccacagggtacttcccagtgacagcagcctggagtgtgctcctgccagcccctgcctgggccctggaaaaggcagggcagtgcagcgaggaatcttctggcctaaggatgcctgtaaccaccaaaccttatgtttagttttacaccttgctgagggtctggcttttggatatgagctctggagtggtaggggtctgtgtcccatggggacaggtggttctgggtgttgggcacgaggtgatggaggaagggcctgccacttgcaagctgtttatctgactagtaataaacagtggatgacacctttaggaaactgtatttgggagctttgaaattaatcagatgccaccaatggcatttttaatttagttaaaaatgttttagttatataaataatgctcattcgttatagatgattagaaaatacagataagcactgaggagaaaaaagtaatatattatcacacataagtggctgctttgatatatgatttttttttcttacctaggttcttttcaaattgtgtatacctagttattttttctgtctttcgaaatgggatgctgtttaacatttagttttgtgacttgcctttcccatttttcaggtggttttgtggtgtctgcttgtcctccgacctcctctcccatttgtgggaaaggcatttggcctggagggaggcacttgggaagaactgtctggttgttccttgatgttattgccagacttgcagagggtagagaggtgcatgaagtcttactctgcctctccccatctgtgtctctccctgtccctgtccagcgccccatctgctctgcctactcaccactcctgccttttttttttttccttccatacaaatccagaaaaggataccacctccagtctgaaggtttctttctatggcttttagggatgaatctctcaggagtttagaaaaaaagatgcacagacagtatataggaagggtaatgccagggctgggggtgggggtcttgggaagagcaactgagaggagggcctgggtccctggtgctgtcttgagtcagtgagaagaagctgcgtgggtgatgggttggggcggggtaggcagcaggtgactgcagggacctctctgaaacagcaagcaagctggccaggaagacgcctggagaataaggggcccagataggggccagacataggggagaagaaaatgtgtctcagtggcacctgctcctccaccctggccccactctttccatgatctttccagagattctctctttttctgcctgatctgcttccctcacctggcagtgcccagccccagtagtttgacacatctggtatatctggctactgtgctctactgacacctgtgtggcagcagctgcacagcttcttggcatctccctgggcagtaggcagggatccgagcatagaggaagatgttccatgcatcagtaactcagattccgttccagaaacgcatctcaaagcaagggagaaaattgaagatggggtattttgtggggaacaagctatgccttcctgtcacttcttacagaataaaatggggtctctggcagtaggcaaggagaaggcctttctgagcactgagggtcagtggcttctcaggtcttttctgggccactttggcctgcacacaggttgggctaggaattcatgcttaaaagcaggctgatttccataggctgtgcgttcctgtgggcctgcctggatcatatctgttctgctgtgatcccaggcctggtgagacccactggcttcctgtacgtcccctcaaagcctgcgccaccgcctctcccttcaccactcccaagctataattaagttcccatgtgaaactgtatccctcagctgacacacgcttgtaactacagccctggccattggacggctcatctggggtgacttctggggctggtgcctcagcctccagacgctctccagtaggtctgagtaggtggtgtggacccaccaggaaagggtggatccagtgaggcgggggccaggccttgcccaagagtcagaaagtgggaagtcacgggggagatgaagggcgagtgagcagctagaaagtgccaggggacacaaaaatgggggagacaggcagccttttggggctggagggcatggacagggtgactgatgcctgagccacaggcagaatgtgagcagtttattttattttatattctacatatttttatagcataaaattaagatatagttcacataaccaaattcaccactttaaagtgtgtactttgatggtttttgtatattaactgtgttttatatattatattaaattaatatatttatatattatattaacggttttatatattattttagctgtgttgtttatatattatattaactgtgttctattaaccactaattccaggacacttctatcacctaaaaaaccctttacctgtcagcagttactccatcccttggctgctaatctacttcccttctctatggctttccctatcctggacatttcatatgaatggaattatataatatgtagccttttgtgtctgaacaatttcacttagcatgttttcgaggttcatccatgttgtagcatataatagtactgtattcctttttgtggctgagtattccattgtgtgtatatattccattttatttattggtaaattggtggacatttgggttgtttccattttttgactgctgtgaacattcatgtacaagcttttgtgtggacatatgctttaggttctcttgggaatatacttagtgaaattgctgggtcatatagtattccatgtttaacttttttttttttttttttttgagacggcatcttgctctgttgcccaggctggagtgcagtggcacgatcttggctcactgcaacctgaacctccctggttcaagcaatttccctgcctcagccacctgagtagctgggattacaggtgcatgccaccacgcctggctaattttttttttgtatttttagtagagacgaggtttcaccgtgttggccagactggtctcaaactcctgacctcaggcaatctccccgccttggcctcccaagtgttactctttgttttttgtttgtttttttttttgagacggggtctcactctgtctggagtgcagtggcgcgatttcgcctcactgcaacctccacctcctgggttcaagtgattcttctgcctcagcctcccgagtagctgggactacaggcgcatgccaccatgcccagctaattttttgtatttttagtagagacggggtttcactgtgttagccaggatggtctcgatctcctgaccttgtgatccacccgcctcggcctcccaaagtggtgggattacaggcgtgagccaccgcgcccggccccaagtgttactcgttaggcagatacctgatacctgtctgctatactcactggtctgcaccttgcttcacttattatatcttggccatctttgcataccagacatgtagagcttccttattcttttttttttttttttttttgagatggagtctcgctctgtcacccaggctggagtgcagtggcgcgatctcagctcactgcaagctccacctcctggttcacaccattctcctgcctcagcctcccgagtagctgggaatacaggtgcttgccaccacacccagctaatttttgtgtgtgtgtgtatttttagtagagacagggtttcaccgtgttagccaggaaggtctcgatctcctgacctcatgatccgcccgcctcggcctcccaaagtcctgggattacaggtgtgagccaccacgcccagcccctcattcttttttttttaacagttggctcatccattgtatggatgtgccagtctcttcttttttttttttagacagatttttgctctgtcacccaggctggagtgcagtggcatgatctcggcttactgcaacctctgcctcctgggtcaagcgattctcccgcctcagcctcctgagtagctgggattacaggcatgtgccatcatgcccagctgatttttgtatttttagtagagacagggtttcactttgttggccaggctggtcctgaactcctgatctcaaatgatttgctcatctcggcctcccaaagtgctaggattacaggcgtgagtcaccatgcacggcctggatgtgccattctcttattcattgatgaatgtgcaggtgacttctagtcttttttggcaatgaataaccttgtcattttacacacagataaacagattgacaatgcttctgtgtgataggtgcagtaatggagatagacactggggaactagggaaggcttccagaggatagttaagaaaggctcagggtgagtgagcgctggtatctgagtgggccttgcaggcctggcagaatttcagcaggctgagatgttgtaggaagggcaaatatgactgaagaaaagaacaacagctcaggtgtgacaggggaaatgaagagtattagttatctattcctgcataacaaattaccccaaaacttagtagcttaaaacactatctcgcagtttctatgggttaggagagatttacacaaatatgtgaataccagaaggtgaggattgttgccagccattttagaaggctgactctaatagcaagttgcagtaaggataggattggccaaggcaacagatggagccatgattgtggacaatcttacatacttagctgagaggttgtcagagattgatctgagaacagtgtgagccatggaaggtctttgagcaggagaataatgtgatagttgctatacaggacaattaatctgatagcatttatgctagaggggtcaaaatggagagagatacacaggcagaggcctagattaggagatggctatagtagtacaggtgagaaattcctggcctgtagtactaaatacttttttttttttttaagacaatctcactctgtcacccaggctggagtgcagtggcatgatctcggctcactgcaacctctgcctcccgggttcaagcaattctagtgcctcagcctccttagtggctgtgactacaggcgtgtaccaccatgcctggctaatttttctatttttagtagaaatggggtttcacggtgttggccaggctggtcttgaactcctggcctcaagtaatccacccactttggcctcccaaagtgctgggattatgggcgtgagccgctgcatccggcctctgtattaaatactttagctgcatattctttcttcgaaatgaccacaaaaagaaggtattactgattaatatgcatatggtcttgcgtatggccagacttatgacttgcgtatggtcataaaggtagtaagttgcagagcagcactcagacctgcctggctttgatgaccgtgccttgatggcactggaagtggaaaggtgggggtgactggggaggtgaggttttgtccgttccctggatgctaaaaggaaatggaggagtgtaagaggttgattctttgaacctggatggctggggcaaagataacactgtaacaggaagaagagaggccggagggaacactgatgtgatgggagaaggtgagtgatttgggaacatggggcatttgttggcagggtccttcccaattatagggcgagtataaatagttcctgtgctttgtgtatgaagaggtacccttggcccaaaaagactctaaatgtggaaaaaggatatggtggtgtggtggtggtttgaacattgggtttgcgcagatagtgatggtaactggcactggcctgcgcttcagactttcacagcccgttcacttctgttgaaactcacacaaccctattcaggttatcatcattccctatctgattgatgaggaaactaaggctcagaaaaatccatttgctcaaggagaaacagtgtttcagttacctactgctgtgtaacaaatcacctgtgaaactcagtagtttaaaacaaccaccatttatcctttctcttgattgtgtgaattgggtccagatgcttggttctgccccacatgatgtcggccaagcttgcccatttgtctgtgtttagctgcactgtaatgtccaaggcagcttctctttgcatggcctctaatccttcaagagtctatcctgaacttcttgcagcatggcatctgggggccaagacagtggaagccagtcgtgttgaggcctgggctcacgtcccagaacatcacctcaatcatgttctattggtcagagctgtcactgggccagcccagattccaggttgggaactagacgccacctcttgatggaaagagtggcaaaaggtttgtagccatatttaatccacagacagccggtagtggatacctggatttgaacccagatctgtgtgactcagactcacagtctgtcatgccatactgcatccctttctgcttctggttccttgggagttgcaaagcttgctggctcttttgtgtggttggagagggctgatttttcttgtggtctcccacagtggaagttgtactagtcatcccccttttcacagatgagcatccaagatcactgtgtcttagggaaccttccaaaataggtttgctctagggatttgctagcttcccccaagcttcagcagtgatagccagacatgcatggaatttccctgtggagtttccctttctgcgcttagtggccttttgatgcacagtgctcactgggtgggattcctgctgcattgtagccagatgtggaggctagccctattttgagttatcccagatggtatccagcccagtgagtcccatacttgactcaactggcatattcaccagggagttttggggaaaatgtagattcctgggccttcctcatgcctattgaattagaattcccagggatggcgtccaggaacctgcctttaaagctccccattgatttgggagtacagcctggttgggaaaccaatgacttccagaggctggcaccctccctcagcccagtcatttcagaaagatgcctttgaagtcactgatcagaggaggccacatgggagagaatgatttgtccagagggcctcacacttcacaaccaggaagtgactcctgaaagtgtccaggaagtttctatttgaatctgctcaaatctttgatgttgttttgcatgctttgatagtatctgagctttatggtggcctctgggtgtttttctttgaaagtgtttgcagagagtagcaagctcttccagcagtcagcagacactccctaaccaggagctacttggtctgatttatttgaaatatgaaattcctttgcttggctgtctggttggtatctttggtgtgaagaatatgacaaccctagagatacctaggttagcacagcagttggacctttctagtcttgtgccttggacatacttaaggtacacttggaaaagtagattttaaaaccctggataatttggtttgccagttaaataaacttctatattttagaatatttggaaaataaagataaatataaggaagaccataaaattacctagaactttcctctcagagaatttccacggttaatgttttgaatggctattcatccttcccctcatgacccttcacaccccctctttttgaaaaccatattgaagtcatattgaatgttactttttagcagttttgttgagatgtaagtcataaagtccacctgttgacagtgtgcaatttgatggtttttagtatttacagagttgtacaaccatcaccacaatctagttttagaacattttcttagtcccaaaaagacatcttataatccattagcgtgcattcccgcctcgatgccccatcccgcccttactccagcccaagactaccactcatctgctttctctacgtacagatttacctgttctggacatttcatataaatgggatcatacaatatgtgatcttttgtgattggcttctgtcactggacataatcatggtactgttttgaaacctgctttaaacatttatatcctagcaatttgaatatagttttcaagaatgcacttttaatagcagagcggtattcattcttatgagaatatctaatcttatttaatcagtcctgccaacagacgtttaggttatttctcatcttttgctcttatagccagtgctctctgcactcagaaattattttgttgatttattggttaattgtccgaatctgtgactagaacaaaagctctttgagaacagtcaccttctctgtctcccctactacttggcatagttcctggcacttggtaggtattcagtttttaaaggatgtgtatgtgtgtatatgtgcaaattttgaatgaatcaaaatgtaaggatattaataaatgttgccatattgccaaattctagaaagttgtactaatttaccctctcactgcagtataagggtacctgactccctgttcctttgaatctgggttaatttgtacaggaagtcctgtgatcttttgaatgatgatattctctgacctgtcaaccagttagtttgggaattgatgctgtctgtgtcctgaccctgtctgtgggccaggaagggtctggctgttgggaaagatggtggtgtgtgggagctctagctgcccgggtcctcattgtggctccgtggtattgtatcgtttcctgttgcccttagaaaggctgcatcgtgttgtctggccacttcctctattgtgtgcaggcatgttggggagtgagtagagttgggtggataaagtatgtgtaagaagatactggttatggctgctgattggagtgccttttgaagtcgtcaggagagatgtcactctggaagttcagtgtcttcaaaaatagaaatgaagaaatgcttccaggaagtctgatgcaactggcccagtctgcccccatctgagggtggtgggcacccacatggctggtaaacgcttcatgagtcacccactggccacagtccctgctcctctccacacacttcctgtctggaaaagcctgctacccgcccatggtgaagagtcaccccagagaacttgccagggatgcagggcaggtcttcccaggtcacagcagcagcctctcgctcatgggtttcacagcagttcttctccccaagatgagttgtggtaactgctttttagataaatatgtggaatggatggttgggattggaaaaaaaaagagcggctagatggcaaggcagctcttgtgtgtagcagggagctcacacgagccccatggtggggcagttaaggccccagaattcaccttctccagcagctggctgctcattcttttcttcttctcgtggttttcccatcacatttcccttggggtttcttccaggccttcccctactcaccccacaccctctcagaagatgctgcctcatgtaacttggccaagctctcaagcattacagatgcctttaccttcttttctttgcatcttagaaatcactcacatgttggtctctctcacataattgctttttattattacttcagcggttgccaagtgcctactctatgcctagtaccttgttagactcgggaatgatgcagaagaaagagactggaccctgccccctaggagggtaaatgtctgttctcccatggcctctgtttcccttcctctctgactgcgcctttgctgccctggttcctcttcctctttccgctgcctgagtgtcaacattcttcaggcttctgccctctctcctctccctccacgcgcttgtcccttcctgtggctgtgaccatctgctcttatagctaccaaatactaaagttcttttctcctgaaaaccaggtccctgtgtccacctgcctgctggagtgtgcagccttaaaagcagagtccatctttgtctctgctctttgcatatcccctttctgttaataatccgtcattctctcagtttcccggagccttactgacagctttaaacctcattcctctgccatgcacaggtcgttcctcccgttcttttgagtgtttctccccactgattttcctgcctgtagtgagttggatggttgcccctccaaaagatatgtccaagtcctaacccctagaacctgtgaacatgaccaccttgtttggaaaaaaactcattgcagagattctttcctatgctgcagacgtacatgaacctgtgctcattgacctcctctctgggcctggccttgttggtctctggcttgaaatagtgactgtacttctagtccacacagtgattacatatttattactctgtttgagctcccctagtccaaaggcaaagttcactgcctgccctttccactaactcctaggtcagacttgctaggttgtgtgcacagcagctacaagtgtggtttctaaggtgggtctgggtttgaatcctggttctgtcatttattagccaagggcctttgacagattgtaacctttctgggcttcagtttcctcttctggaaaatggagctaatggattgttgtgagaattagattgcatagtgtctagcactgtgcctgacactctgagctttatttttatttatttttattttttgagacggagtctcgctctgttgcctaggctggagtggagtggcatgatctcggttcactgcaacctccacctcccaggttcaagccattctcctgcttcagcctcccgagtagctgggtttacaggctcccgccaccatgcccggcaagtttttgtattttttagtagagacggggtttcaccatgttggccaggttagtcttgaactcctgacctcaggtgatctgcccaccttggcttcccaaagtgctgggattacaggtgtgagccaccacgtccagcccactctgagctttataaccagagagatgctgtggctagccaaatcgctcaacctatacttggaggatcccaagcttggatgagtgtaagagctgtgacttaaatccagcctacttgtatgtcattctgccacagttgtctttgtctctccacagtttgtcctggagctgggcatggtgagggctaagacaatggattacagagctacaggtctaggagggcatgtggaattatgcctatatgagatagatgacaaagtgggtaagagcatgtgctctggagttagacctgggttcagattcaggctctatgaccctatctcagtgaccttgggaaacttttctttgcatctctgggtctcagttttctcatctgtaaattgggaataacaatggttcatacctgtcttagtctgtgctgctataacaaaattcctgagatgggtaatttataaacaaaagaaactgatttctcacagttctggaggctgggaagttcaagatcaaggcattggcagacttgatgtctggtgaaggctgctgtccacttccaagatggcaccttgttgctgtgtcctccagaggggatgaatgctgtgtccttacatggcagaagggtgaaagtggcccagctagttccctggagcccttttataagagcactaatccgttcctgagggcagagccttcatgacctaaacacctccaaaggccacacctcttaataccgttgtattggggattaagtttcaacatgaattttggagggttcacaacattcaaaccatagcaatgtcttatagagtaatcgggatgattaaatgaaagaatgcccataaaacattgaacacatgcctgactctttgtaaacaataattattaggtatcgctattatagagaccagcttctgctgtggagagtgttaagtgccttgatgccacaagccactggacacgcagctgcatggatcaatgtacccctgtaattatgtaacaaggggacatggagaaaaaaacatttccaatgttgcctcctctgtaacatgattgtacccctaaactgcacagaggagctttctgttctttgaactccatagctgttggtacgtctcttgtggggtttgccatagtctgtcttatactatgactgttcttcactctacggtacatttctttctttctttgtttctttctttcttttttttttttgagacaaagtctccttgtgtcatccaggctggagtgcagtggtgcaatctcagctcacagcagccctgacctccccaactcaagcaatcctcacacctcagcttcccaagatgctgggactgctggcatgtgccaccacacctggctaattttttttgtattttttgtagaaatgggatttcaccatgttgctcaggctggtcttgaacttctgggctcaagcagtccacccatctcagcctaccaaagtactgggattgcagtgtgagccaccacgcctggcctactgtatgtttcttgaggtcaagattgggcactgggtaactgattacttgaattgaaccttgggattcagccagtgaaagtggtccacctggcagtagtgaacctctggctcctgacctctgctgctggtgaatctgtttctcctatggctgcacagacacagggtttcctgcctccaaagagcttttccactctgtacatgggacctgaaccggctccagaaaccttggagcctggcaccacttttcacatcacccagcaggagcagaacttagatggaccaggcatagatgggaaacatgggtttattgctaaggtcatggttagttctcggcggtggggcgggggggtttagtgggcaattgctttttggatttttgttttgttttagaagtaaaaaatatgggccaggcgcggtggctcatgcctgtaatcccagcactttgggaggccgaggcgggcggatcacaaggtcaggagattgagaccatcctggctaacacggtgaaaccccatctctactaaaaaatataaaaaattagccgggcatggtggcaggcacctgtagtcccagctactcgggaggctgaggcaggagaatggcgtgaacccgggacacagagcttgcagtgagctgagatcgcgcccctgcactccagcctgggcgacagagcgagactctgtctcaaaaaaaaaaaaaaagaaaaggaaaaatatgtacatttttaatagtggtagtaagaattttctgtaactacttacgggacatcttcactgaggggtctccagagctcctaaaactcagcactcccccagtgattcttacattttcctgccagacttgctcttcttcccacaatccccaccttaatggaatcatccacatccccctggtcacctgacagttgccctctatttctttattctcctcagcctcttttaatcagccaccaagtcttgtttgtccttcctccctaatgtcactcctgttttttgccgtgaggtctgatggcactagtgctgcctggggttgctactgcctcatctcttcaacctttttgtgtcacgatgtttaggagtttctttcataaacagaatgtggctggatttaaatcaaatctgacaatctgtcttaagtaatttatgtacatttttgggatttaacttaacgtattactgtattatattttttagtactttccatgtatttccatttttgcctatttttctccttccgagtttttttttttttttttttttttttggagatggagtcttgctctgtcacccaggctggagtgcagtggtgtaatctcagctcagcgcaacctctgcctcccaggttcaagtgattctcctgcctcagcctcccaagtagctgggactacaggcacgtgccaccacacgcggctaatttgtatttttagtagagacagggtttcgccatgttggccaggctggtcttgaactcctgacctcaggtgatccacccacctcggcctcccaaagtgctgggattacaggcatgagccactgctcccggcccggaattttctttatttctatacattttacttccgttgtttttttcttttttgagacagggtctagctcttttgcctaggctgaagtgcagtggtgtgatcacagctcactgtagctttgacctcctgggctcaagcaatcctcccacctcagcctcctaagtagctgagattataggtgcacaccaccatgctcagataatttaaaaaaaaatgttttctagagatgggatgttactgtgttgcccaggctcgtcttgaactcctcactcaagccctcctcccaccttggcctccaaaagtgctgggattacaggtgtgagccaccttacctggcctttatttctgttcttactccaacattttctcatcttttctcccatccttttacttagaaaaatgttaaaattagaggaaatagtacaatgaacatgagtattctctttaatcttattcaattaatatatttctctgtatatgtatatatgcttttgtttggaatcatttgaaattaagtgtggatttgttctccatcttcttgctcaggatttggtgtgctgcttttatctgaggactcatttataaaagaaaaaacaaagaaaaagcctttttactttaaaatgattgtagataaacttagctttacacagagtttctgtattccttcacccagcttcccctaatgttaatctcttacatttaattctttcttaagttctggaaaatttcagccattgcctctttggctttctcgttttctctacagtggcctctggaatgcctcttagacatattgttgagcattttaccaccaaagtctctatatttgttctttctgtgttcctttatctgtttaatcatccaagttttcttgtgtagtttctttgagactgtcttatttctgattcttgggatgctacttctctttttgtgtctgaggcttgcccctcttggtggtttatttccttgtgtggtttgtaactttgggtgtgagttcatctccaggagggattctcttttctggctgagacttgggtcctgaattatgaaagtatacctcagagcagcttgtttgcctctggcggggccatgagtgtttcagtggtcctggctcagtttttgttcactgcttagtgcggcacccctttactaccctagtagtgtaagttcagttttatatccatgggcaggactagcttggtggcttaagaaagggtgacctcccgccgggcatggtggctcacacctgtaatcccagcactttgggaggccgaggcagggggatcatgaggtcaggagattgagaccatcctggctaacgcggtgaaaccccgtctctactaaaaatacaaaaaattagccgggtgaggtggtgggtgcctgtagtcccagctgctgggaaggctgaggcaggagaatggcatgaacccgggaggcagagcttgcagtgagctgagatcacgccactgcactgcagcccgggcgacagagtgagactctgtctcaaaaaaaaaaaaagaaagggtgacctcccacccatacctgacccacagagccttggagaagtgttcagcttcttgttgctttcctttactgggcagccctttgaggctctcttcttgatactggggctcaaagccacaggcaggctttaaaccgcttcatttgtgggtgcgaaagtccacaggccattgtggtgtcagttccactcactgtttatgtttcaattcttctcgcacataggcatttctctttccaatttggctgcatgtctacggacgtcatttgttttattttatctggtatttttctgtgatagtggtggaaaggggaagctctttcacgttaatttagtcccgtatcctactgaaagtttgttcaaatgcttagcgtgtcatatgaagcttttcatgatgcagcccattctacctctcctgcataaacttagctcttaaattttacacttcagcaaattgaactatttgcataccatgtactgtaatgtttaaaagcacaggttttagggtccagctgtttggcttggaacctgtcttttcataaggtatgattttggacaagttacttatcccttccataactcagctttctcatctgtaaaatggcagcgtccggcatgcagtaaccctgatccctgttggctgcctctgtggttgctgcccccagcagttgaggctgccaggcctctgcgcaattgcactgtttattcctttgctggaattgcctgtctcccctcctctccttgatccctcccaggagagcagcctttactccttcagagcttggggtctctgtctgtagtaactatcactctgtgggtcgctgcttgtttacgtatctttttttttttgagacagagtgttgctctgtcgccaggctggagtgcagtggtgcgatcttggctcacggcaacctctgccttctgggttcaggccattctcttgcctcagcctcccacgtagctgggactacaggcgtgcaccaccatgcccagctaatttttgtatttttagtagagacggggtttcaccctgttggccaggatggtctccatctcttgactttgtgatccgcccgcctcggcctcccaaagtgctgggattacaggcatgagctactgcgcctggccacgtatctccttttttcagccgactctgacccccttgagagcagggtcttgtttttcttggtacttgaaactccttacattctacctgtcatttggtgggcattcagtgttggtagtttaattgcattgaatttctctggctgagtagaggcaagtgctgggagtggtatgggacgcagaggcagggaatgacagcaggaaagcttgttttttggcacattttgtgccaagttgatggaaatgtgaatcagtatggctgggacacaaggtaacaattcttagtctagctgaggatgccagagacttaaaacaagccagtggccagaaaaagccactaaatcttgcaaattaaagtggtttccagacttaagaatgcatgccccacattcccttcccaaactcagcgtctctgagtgccaggtggaggaatacaaactaattataatcctagtgggccctgagaatctttaattttagaataaggctgcacttctgaaaggcgcagttgctttaggagtaggtgactctgtatgcccggggcctccgaggagaccaggatgtgaaaactcagtacctggcatttagagctgtgtcacccatcacttctgacctcgttaagatttctaccctactgcgacttaacaactaaaaagggcagatgagataggtccggggcagagcttaatggcctgtgtcattctcctcagctttgcctgaattctctggactcttgagactctatcataggaatattctcagaagagaaggcaatcgaacctttaaagatccccagattatccatcagataacagtctcatgagagtgatgaacaatgacagcaccaactctcaattcccttggctggaatttcaggaatcagcttgaactcagaggtgggcacagggttagggcttggagtaggcgtcttttctttctttttttttttttttttcttttttgagatagcgtctcactcttgttgcccaggctggagtgcaatggctcaatctctgctcactgcaacctacgcctcctggtttcaagcgattctcctgcctcagcctcccgagtagctggggttacaggcatccgccaccacgctcggctaatttttgtatttttagtagagatggggttttaccatgttgcccaggctagtctcgaactcctgaccttgtggtctgcccaccttagcctcccaaagtgctggtattacaggcatgagccaccgcgcctggcttgcagtaggcatctttgcccaacccacgtgaatcccattagttctttcttgacagctctcagtctgtggtcatatattaagcaactatgtgttcagtactgtgctgggtgctattgctgaagatacggaaatagtaatgccacaagtccctcttcttagagaggagagcttgcactctagttggagagaattcctagcacacagaaagctgcaaccagtggtgcccaacagtaatgctgtctgatgccactgcatgcaagtgtgtccctttgacaacttggtgcttttgcccaaaaggagctgttctctttctgaggcttggactattcgtttgttttttctcagatgacttgctggcactgttacagactggtctgaattaactaggactaccttttatctgtttctgaggaatagccccaaatgtgctctctcttggtctttatgaacttttcctttcttccatttctccaaattatgatagattaactttgcagtgtcatctgctaatctccaaggtcttctaggggcacgtcatcagcagttgctgcttttgaggtatcaaggtttgtcctgtggagtctcagatagtttctttacctgttcaatgaatctgattttccatttttctaggagagtgtatctcaaagtgattgctgaatcagaatgtctgggagtgtgacttggaatctattactgaagattagaggaaaatgtagcaaattgtgatctgaagcatttatggatggattgatggattgatggatagggattctgactgagttaggtagtctatagtctcagacagttgtggaagctccattaggtcatgagcaacccagactccttccaattctgtgccctgccattcttagggtgtggctgctgtcctcatggtccaaaatggttgccgtggttccacatctcacagtgagatagaagaagacagaagaatgatgtctcacctcccttctaaggagacttcagcaaagcctgcctctaccactttctgtgactgagggaaagttaattcatactcagagccaattaacctcgtgttttttttttttgtttgttttttttttttttttttttttttttttttgagacaaggtcttactttgtcgcccaggctgtagtgcagtagcacaatctcggctcactgcagcctcgacctttcgggctcaagcagggctcctccctgctcagcctcccgagtagctggaactacaggcacatgcaccacacccggctaatttttaaattttttcgtagagattgggggtcttgttatgttgcccaggttggtctggaactcctgggctcaagtgatcctcctgccctggcctcccaaagtgctgggattacaggagtgagccactgcacccaaccagttacctcatttgtaaaacaggcatggtaacacttagtgcaggagcaagaggatcagggagcacacatacatacaaagtgcttggtgctgatgcccagcctgcagcacctgttctctaaatcatagcagcaattgctgctgcagcacacttctctttctcctctctccaccgctccatctctccagggtctctaccttgcctgtcaggctccactttcctttgctcctgccttttgcatctgttcctctctgcattctcccctcatctcctctcttccgtgcacctcattttcctgctcccctcctgcctctgtccctcatcttcttttcagagacttaaaaccagccagtggccactggcttttcagtgtctcctcctcctccttgaactacctcttccttctagtgcttctgtccttccctcctcctgacctccagtgaacaataattatttgtaacgtaatgacaaattatcgttacgttacaaagaccagaggttagaggtggtgattggccttgtaaactgtaggtcagcgatgagtaatttaagaaaactaaatttaattggtttactcatgagtcagttaggaattctatttggcagctagaacagaaatagcagtggcttaaaccagtagaaattttttctattgtgaaaagaaatctagggggacagtctagggcttgtctctccgctctgccatccttagtgcagggcgtccaaccccaaggttgtatcatggtctaagatggctgcgggagccccaaccatcatgtcaggttctaggaagaaagcaggaagaagagaggaaaggcaaaaagaacacatgctccatcttaaggagctttcctgcaagtcccaccaaatagcttcagcttctcctccttgcctccattagttgcaagggaggctgagacatcatttagctgagcacattgctacctgaggtagaattgggattctgtcaccaagaaagaaggggagaatggatattgtgtaaacaattagcaaggtctgccgccattcattcaacattaatttagcacctacaatctactagttatgaagaacagtcaaggtgccccattccagagggaagacatagataagtaaacaagtacagtacacaggatgggtgaggaagagggggagagtggagaaaggcatgaagtgggtatcttacataccctccaagggcgcattctagagttcgtcatgcagacattcttgcctgtggtttgtttcctcttctgctctctcctttttgtcattgtcgccattgttgttgttggggtttgtttttgcccctccattctgacgtcagcagtagcccctagaaccttaggaaacagaaacagttggcctagtgggaagctctgggatgggagccatgtgtttgaagagccaagtcccagggccattaggcaattagaggcctgtggcaggagagcattcgttcctggacatgccgtggcactgccaggagactttactccaggaatggggtcgttgtcaggaggcatgttctaaccaggcacctggcatcacctatactgtgcttgccataaaatgaaattttggagcagtaaaattctccaggtcccgtgaaatgggtataattgtttcacccacattaatttaaccagaggtcttggtatgctatagtgttaattatgtgtaaaaatacttctacttactataaaatgtattgacagttagacattgatattccttcttagaactcaaaaattctaggaataacttgggagacccacattatctttcattttgatcccaagaacatctattgctgtttcctttgggaagttagagaggcaatgggaagcctgctgcagagattttctaaacaggcatatcccagcccctaaggagtttgaaagtgtcagagaaggctaaaggattaaaagatcgtttgttctggcacagtgcaatccttatgaggttgtactgtgaccctgggcaagttaccatcctatcctcagtttcttcatctgtcaaattttgatcctgtggaccctccccaacagggctgtgatggaaatgaagagacacatgggaagcattcagtatgtgttgttgttattatcatcattattgttatttttattattattagtgctactggtagtgctagcccactagcccactgggcagcgactgcacccgtatcagagtgtggaaagccttggatgccacattaaggagttggattttgtgggcaagggtgtgacaggtcatggctgggcttagaaatgtcactgacaggagtggagaggcagatctaggtgaggagtgggcagggcttgaacctggccagtcaaggaaaggggagaatggatacctgagtggtgagggaggacccactggtgctggagttcagcctgtgtgcccaagggatggtgtcccattgacttgggtgggaagcactagaggtggagcagttggggtggcaggaggggaaagaagcatatggtgatcagctcagcaaacaaatgggtaacttgcgcactcagtgctcggtggtgcccaggctggagtgcagtggcgtggtcccggctcgctacaacctccacctcccagccgcctgccttggcctcccaaagtgctgagattgcagcctctgcccggccgccaccccgtctgggaagtgaggagcgtctctgcttggccacccatcgtctgggatgtggggagcccctctgcctggctgcccagtctgggaggtgaggagcgtctccgaccggccgccatcccatctaggaggtgaggagcgcctctttccggccgccatcacatctaggaaggaggagcgtctctgcccggccgcccatcgtctgagatgtggggagcgcctctgccccgccgccccgtctgggatgtgaggagcacctctgcccggccacgaccccgtctgggaggtgaggagcatctctgccccgccgccccgtctgagaagtgaggagaccctctgcccggcaaccaccccgtctgagaagtgaggagaccctccacccggcagctgccccgtctgagaaatgaggagcctctccgcccggcagccaccccgtctgggaagtgaggagcgtctccgcccggcagccaccccgtccgggagggaggtggggggggtcagcccccccgccaggccagcagccccatccgggagggaggtgggggggtcagccccacgccccgccagccgccccgtcagggagggaggtgggggggtcagccccccgccaggccagccgccccgtccgggagggaggtcggggcgtcagcctcccgcccggccagccgccccgtccgggaggtgaggggcgcctctgcctggccacccctactgggaagtgaggagcccctctgcccggccagcggccccgtccgggagggaggtgggggggtcagccccccgcccggccagccgccccgtcagggagggaggtaggttcagccccccgccaggccagccgccccgtccgggagggaggtcggggcgtcagcctcccgcccggccagccgccccgtctgggaggtgaggggcgcctctgcctggctgcccctactgggaagtgaggagcccctctgccaggccagccgccccgtccgggagggaggtggcggggtcagccccccgcccggccagccgccccgtccgggagggaggtgggggggtcagccccccgcccggccagccgccccgtccgggaggtgaggggcgcctctgcccggccgcccctactgggaagtgaggagcccctctgcccggccagccgccccatccgggagggaggtgggggggtcaggccccgcccggccagccgccccgtccgggagggaggtgggggggtcagccccccgcctggccagccgccccgtctgggaggtgaggggcgcctctgcccggccgcccctactgggaagtgaggagcccctctgcccggccagccgccccatccgggagggaggtgggggggtcaggccccgcccggccagccgccccgtccgggagggaggtgggggggtcagccccccgcctggccagccgccccgtctgggaggtgaggggcgcctctgcctggccgcccctactgggaagtgaggagcccctctgccaggccagccgccccatccgggagggaggtgggggggtcagccccccgccgggccagccgccccgtccgggagggaggtgggaggggtcagccccccacccggccagccgccccgtccgggaggtgacgggcgcctctgcccggccgcccctactgggaagtgaggagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgtactaagaaaacttctgccttgggatcctgttgatctgtgaccttacccccaaccctgtgctctctgaaacatgtgctgtgtccactcagggttaaacggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaattatcaataaaaaataaataaatttaaaaaaaaaaaaaaaaaaaaacaaatgggtaacttgctgcctgccagggactcctgtggcctggcatgaagataattgactgtgttttgaacgcattataaggcccctgcgaggcctccgtgtggtatttagacagtcagcaggagagaggccccggacagtggtgtgggatgcagtcccggtgtgtgaaattgccagtggttggattgtgcagcggatggattgagcagggaagccagccaagaacagaatggggtggggagggcgttgggggtaggaaaggaggatcatcatttcaagggcgggtgagggaagaacaagcagcagagtgcaaagcccccagagggaagggcgatccttatgaggttggactgtgaccctgggcaagttaccctcctgtcctcgggaggaagtggttgacagaatcattgcagcagtgagatggaagcaggaccagggcagcagccaagggcctcttagatggcggggcgagaggaggtcatccaggacctccaagagaactgtttcaaaatgggaggagaaagcagtgttcctctggtggtggttctaatgctttgtatttgtagttcttagtcgttttcaaggccctttgcattctttgcatcgtgctctcttaccacgatgcatagtgagaccccacctctacaatttttttttttttttttttttttcagtgagccaggtgtggcagtacacacctgtagtcccagctacttgggaggctgaggtggaaggattgcttgagcccaggaggttgaggctgcagtgagctgtggtcatgccactgcattccaacctgggtgacagagcgagaccccatcttaaaaacaaacaaacaaacaaatacttggttcatttggtacttggctttttggatcttggggaatattggagatgacggaataacttcaaggagactaacttcaaggtcaagactcctgccaagactccaccagacataaaataggaaaatgatgatagaatctacctcactgttggcctggcagtgggagtttgttgataaccctgaagatgaactcctcaaggtgaagagcaaggcttcagaatgggctgctctatagatgtgagagacagagacagacctagccttgcaaaaaggttgctgtagtctttctcctaccatttccagcacaggatggtttctggtcccaggaggccctgtcttgtgctgtgtgggacccttagtgctgtgaagactagcagcaccctggaggtctttgttccttctgccctttcccttagattgcatctcctaaccttggtttatatatttgtcaggaggtgggggaaacctgctttcccccacctcctgacaaatatataaactggaaattgatccagtcctggatcagtttgggtcacacaacagggtcggcagtgttggcccacagagggccctgggccccttatttcccctttggccctaggctctgagctctcaggttttggctaccaagcaaaaggtggagttgcatcagttgttgctctttaccaggcccccaggggttgctgtcggtgagctcacaggatgttttcttctctctgctttgacttgtgctgaatttctgactgaccccatgcagcatctgcgtggcttctggggcccgagcccaggtttcagcaagctgcccatggtttaccctcaggatgaactctaggaagctggggagcactgtggtggtggtataagttcagcccctcattttagtttatttttatgttaaaatgtttattaatacaaaataacacatagatcagaatgttgtatgacagaaagggactgactggactcaggatctcccaccccagccccaggggtgaaggtgaaggtgattggtttcctgggtatcgttccttccacggtttttccatgcacgctctcatgtgcgtgtgtttttatcctcatcctgctcttcaccgtggcagtggggagcacactaaattgctctgacacctagttagttttttttttgattgagtgtatcttgggaatctttccatatcagcatatacagatacactgcattctttttttttttttttttttttttgagatggagtcttgtgctgtctcccaggctagagtggaatggcacgatctctgctcactgcaacctccacctctcaggctcaagcgattctcctgcctcagcctcccaagtagctgggattacaggcacccaccaccacgcctggctcatttttgtattttgggtagagatggggtttcaccatgttggccaggctggtttcaaactcctgacctcaaatgatctgcccacctcggcctcccaaagtgctgagattacaggtgcgagccaccacacctggccattcttttttttttttttttaaagcttttttgttgtacatatgatgtatgttaggtggactgtggcttataaaacctcttcatagctgttttccagtgcgatccttctagccctgtgaggaagacagaccagaagaaattttttgcagcttaggatactctgcaaacaaggaggaagtgagaggagttggggctcatttaatgcagactaaaacaggatctttcctttgagagactgagacaggatgaggagcaggctgtagatgtgcacacatatccactcagagagaacatgagaggcagcatctgcagaggagcctggtgggcagcacgtgccgcgggggcaggaaggggagagcttccgggaaggggatggaacttgagccaaacctttttctcaaaaagaggggaggccgggtgtagtggctcacacctgtacccagcactttgggaggctgaggtgtgcagatcacttgaggtcaggagtttgagaccagcctgggcaacatagcaaaaccccatgtctattaaaattacaaaaagtagccgggcgtggtggcgcacacgtgtaatcccaactactcaggaggctgaggtgggacgatcacttgaacctgggatgcggaggttgcagtgagccgagatcgcgccactgcactccagcctgggtgacagagtgagactctgtctcaaacaaaagaggggaaggtaggaatgagacaaaggaaaaggggaggcgggcatttcaggcaggagagcagcataggcagaaggtgcaaacatgtggcagagggtcggtgtccatggacacgcttccaccacctggtctaatcattgacttatcagacatctaaatgcctgctgcgtgcccagcactgtagagggccacaaggcagcaggaacctctcagtgcctgccctctgtgggctctgactccaaccaggagaaactggacgcacaacagcaggcaaaactagctgatggtgatagaggtcagaagagtggtttacagccaggcacagtgactcacacctgtaatcccagtactttgggaggctgaggtgggaggatagcttgagcctaggaggctgaggctgcagtgagctgtgatcaggccaccactgcattccagcttggcctggacaacagagcaagaccctgtctcaaaaaaagcggagtagttacttattgtggagattagctgttcaggggcacaaagaaccttgtagggtgctggaaatgtttactgtcttgacctgggtgatgggtttttttggtttgttttttgtttgtttattttgtttttttgagatggagtcttgctcttgtgccccaggctggagtgcaatagcactatctcggctcactgcaacctccacctcctggcttcaggcaattctcctgcctcagcctctcgagtagctgggactacaggcgcctgccaccatgcccggctaatttttgtatttttagtagagacaggggtttcaccatgttggccaggctgatcttgaactcctgaccccaggtgatccgcccgcctcggccttccaaagtgctaggattacaggcgtgagccaccgcgcccagcctgggtgatggttttatggtggtatataaatgtaggaattcatggggcttattatgtttaagattaatgcagattgcatactctaaccatgagtatgttataccccaattataaatcaagcaggcaaataaatagcatattccccaaaataaagaagtaaaatgcaatagcaagaaagtgtgcaaagagctatgcctgggaaaatacaggaactgtatcattttgaaagggtgagagatgagatttcagaccctcaccctctctcactgtgtcatttctgaagggccctggtgactttctttgcccctctccactcttacagtcattggaaccagagggcagaaccccgggcctcaaaattaagtctatacaccttagaaactaggaattcaaggctagccaggtcctggccctttatctgtccttcagagagtggggtgccccagccaaagcggacagctcgccattcccagatgtgccctgtgttctcggctgcgttgcctgactcaccttggccttccctgggagtgccttttctagttttctggcccagctagaagaaagggccattacacctactccagaatcatccctgctgctcccaagttggaatatttcttcctccacagtggccacctcttatgtgccctccatcacacagtttgtatacttacctcttcaagggcaggctgtgttttactccttttgtcatctctccccataggggtctaggtcagtgcttttgtacatggtgcctgaaacagtcccataaatgatattttatttgagtggggctctctggctggagctactaggtggaatgttgccatgtgggagcaggggtcataacgaaggctggccatcaagatgctggtacttccaaattcccaacagttattaactttcaggattgaggaacaagtaatagaaattccctggaatgcccaaaatcataactttttctatatctttcctaacactttatgagtttttaaataaggagtggtcataataataaatggaattattttttctgtgataaaatttcagaggtgtttctgtaaaaaaaaaagaaagaaaagaaaaagagaaaaaaagatgtaacattaaatgcgtggtttggtggtttggttgggcacagtggctcacacctgtaatcccagcactttgagaggccaaggcaggaggatggcttgagctcaggagtttgagaccagcctgttaacagagaaagattttgtctctattaaaaataaaaaaaattagccagcatggtggcatgtgcctgtagtcccagttactcaggaggctgaggcaggaggatcactggagcccaggagtttgtggctgcagtgagctatgatagcaccactccgggtggtgacagtcttggtgacagagtgagaccccatctaaaaaattaaaataataaaaataaaataaatgcatagtttattgttattatggacaaatatattgtgatatatgattgtatatatttcattagcatgtaaaaatgatctctatctgatatagacatctgataatagaaaatgcggaagagagcattaacacaaaatgaataccaaataaaaatcacttaatgatttaagagtaatactacacatatttaatatttaaaagttactcttaaaggttaaaactagagaaaagttaaaagaataaaacaatgaatttctgtatttccttcaccaagattcaccagttgctaacagtttggcgcatttgcttgatgtgtcatagattgtccacattccatatctgttggattgtttccttgtgattagattcgggtttacgttgttggtgggaacccacatagatgaggtgtgcttcctgttgcttacatcaggaggcacagtggtgccagttggccctagtaaaagtgatgctaacttgattcacctagttaagttggcatctgtgaaggctacttttgtattaaggcagtgaacttcgaaaggaacttttccctgactttgggaattgctgacagccatttaggaaaagagacgactgttttctctgtcacgtgtagctgcagttaagaaacatcctagtatagtcagacaagctctggaagccagtatgtcaggacctgggaccaagctctacagccatctctccctgtgaccatagccaagtcatttctgagctatgtgagactgtacgtataaggaaatagacactcagagaagtgaagcagtttgcccaaagctactcagctagtgagtgacagagctaggattcaaacccatttttgtctggggacaaagccctgcccttgtccttatgccaagctgcctcctttgtgaggcagctggttgttatgattgtggcactgaccactcagatgttgtgctcggaaccaagcagaagagcaccaagccttataggccctgacaggtgagagggaagagagaggtgccttccttcatccatctggactgcccttggaattcctgggccaatttggggaaccctggcaccaaccctaacatgggccagtgccagcaccaggtatatgcagcctgtacttcccagtctgggcaggcaaaggctggaaccgcaccagcagctctcctctgtaacgcagcacggaagtatttatttcaagggtggctcagagaagtgaagcagtttgcccaaagcaaactggttcctcccctgcatgtggcaggctgtcctgcaagctgggaggcgggctgttggacgctccccagccacccttgaaataaatgcttccatgctgtgttgcagaggtgagttgctggcaccgttccagcctccgcctgcccagactgggaagtacaggctgcacatacctggcactggcccactttagggttgatgcatgggatccccagattggcccaggaattccaaggccagtccagatggatgaaggaaggtattgcctcagcctgcctgggttcctcgggggagagagggagacaggaagcattaatgggggaaaggtgtgccaagccttgccaagcaggtcattgtgggtggggagacaccgcctacgtgctcgggacgccccaggatttgggtggaggttcttgaggaggcagcgagaaaggagagctgtgacagcgactctggagcactctagaatggctcttagtgaccttctgctctggtgacccaccagcagcccaccaacctgtcatcttccagttagcagccatccccagggccagtagcacctgagcacttggtaagtagaaagacccagtgtctgctcctcatgttaccctggtgtccttccccagagcagttgttttgggaaaaactggctccggctgaagcaggaaatggtgctccttgtcaaggtcatgttgtcctgttgctatagaactgagagaccctgaggatcagccctctgaggttcctgttacctctctttacactattcatcctcataggcctccaggaagggggccaaattcagggccaggaccagggccagtggcttggtgaggcataggctttgctgtatgggccctgtggggagctctggggagttcttattcccctggctcatggccaccatcatggagagacccccagggctctggcagccaagtgggcaggagcggagggagggggcatcttgggagggagagccccgaaaggaaacagggtttatagacagactcccggtcatcactgcttgtaatgcttgctcagtgaacagtggcagtgcttttcctgactctttcaagagagtcccttctctctcctgctaggtgggctgagatccagactggttagaagcctaacatgacctggcgtgtgagaccttgcactctctgaatgtattccccaagtgtcatcaataagtcactccggttctggcatttccctatcttatcctgcatacccctcctcctggctctgagtcctgaggagtgagattgcagtttttgacccatgttcttactgagaagtgggctgtcatgcaggtataatataaaatccagaagctgctgtcagaattatgtgagaattgggaggtgacagcatgggccaattttctgaatctctagggtgctttgatgcttaagaagtctttctgggctccctgagatttgaaacctcttgttttatctgtcctttcactctggttcttcctttcctttcttggggacttcatgcttctcaaatatttgttaagtgggtgcttatatgggaccttagaaagcaaccagctaggcatgcacttggaaagggacaggaggactgagaacaagactaaacatttctgtgagattgagcagcaggagagctttgcttctttactggtgtcagtatgtgcctgcagctcctgggctgcctttactcgagtgagatccatttacaagactcctgactcttctactccactttattacaaaagatgttgatgctcgttttaaaaacaatttaaactacaaacatgaataaaggtatttatctccccaccagtccccctcattctcccttccctcctgttcttagactggtttcccctcccagtagtttaggttgtggggcaagtgtgtgtagctctgcatcagtgtcttaaacaaaatgagtgtgtcgcggatgcgcagctcggccacttcctgttttcttcggctgtatgtcacggccatcctgccatggcaccatgtctgtgccacctgctgctcttgggcatctgcagagaattccatgacatggatcttgaggtagtcttcttcagctttttctacttcatcttattttctacaatcatttatatctgcttgtaaaacctttttttaaaaaacttgcttactagacacagcacatgttcattttagaaaatgtagaaaaatcagataagcagccgggcatgatgactcatgcctgtaatctcagcactttgggaggccaaggcaggcagatcacctgaggtcaggagttcgagaccagcctggccaacatggtgaaaccccatctctactaaaaatacaaaaattatctgggtgtggtggtgcgtacctgtagtctcagttacctgggaggctgaggtgggagaatcacttgaacccaggaggtggaggttccagtgagccgagatcatgccactgtactccaacctacgtgacagagtgagaccctgtctccccgccccccccaccaaaaaaaaaaaaaatcagataagcaataaaaaaagtagaaatgacccctaagaggtaacattttggtgtgtataatacaaatgtcttttacatttgctccctcatctcagcattgccactgccattaaagaaggcacatggtcattagtcccatctcacagatagaaagcctgagccacagagagggtagcaggttgcccagaggtacacagcatagtaaagacagagctgggggtgtacctgtcatataactcagcactaatgctctctccactgtagcccacttgctgtcttcgcaccttgggacagagaggggggtgccaggcattggatttcagatgcattgaactgccttatccgaaggttaatagacagatgactgcttgaggaaagcccctgattgacttaggagaagaggtagaagacacgctcttcaggtttacagacaatatgagacaagggattgtttgcgctttagagaacagaatcgggcttagaaaaccctcaaagagctctaatgacaggtcaggagcaacaggataaactttggaaggggtggatgtaaaggggcccccttctatttccgtaagcacaggaaggcctgacttgatgttcaggcagtgatgactggtctgcctgggagtcatagtggactgtaagcagggggacatgtcatttcaacactttaacttcatcttacttcctgggagtgttaggagccacacatcaagaggacgtgatgaactaaggaagagggtttgggaacctgtcaaatgacaaatgctgcagtgacagaggtttcacctagagaagatgggtttggggaggaaaaggtgcaggccaagacttggtgaccagggccaggcaggacaggaccaggaatggcagttagttgaagggagagtctaattggtcaggatacagaacacctttttagcattagagttcaggaatagtagcgagaggcagtacagtagagtggttaagagctcctgctctgatggcttactggctcccggctcccagagtcttggaagttacctcactcttccatgttccaattttctcatctgtaaatggggataatgggtacctgccttatagtccacttgtaaaacctaagggagttactccatgaaagcagcttagaataatgcctggcacacagaggtgctgtgcactgtttgattcacacggaagctgggtaggctccatggaagaagagttgtagaaggtcttctgcatgcatttggtatgacctgcttacccagccttttccattccctgcctccctgtctccttctttctttctccatcttcctctcctgggtctaggatcctacatttcccctacctaggacaccctacccctcaatctttattttcttctttgaaactcttaagtattttatttcttcttcttcttctttttttttttagacagagtctcgctctgtcgcccaggctggagtgcagtggcacgatcttggcttactgcaagctccacctcccaggttcacgccattctcctgcctcagcctcccgagtagctgggactataggcgcccgccaccacgcctggccaattttttgtatttttagtagagacagggtgtcaccgtgttagccaggatggtctcgatctcctgacctcgtgatccacacacctcggcctcccaaagtgctgggattacaggcgtgagccaccgcgcctagccctatttcttcttctttaaattgtttttattaaaaaaaaaaaaaaaggccaggcgtggtggctcatgcctataatcccagcactttgggaggccgaggcgggcagatcatgaggtcaggagacagagaccatcctggttaacgtggtgaaatcccgtctttactaaaaatacaaaaaattagctgggcgtggtagcatgcgcctgtagtcccagctactcaggagactgaggcaggagaatcgctttaacccaggaggcagaggttgcagtgagccgagattgcaccactgcactccaacctgggcaacagagtgagactctgtctcaataaagaaaaaaatgagacagggtctttctgtgttgcccagggtggtctggaactcctgggctcaagcaatcctcccatctcaacctccctgcccagctgctgtgcccagcagtattttctataattagcatagtgtacttttcagattatcttgaagacccagctctccttgaccttgaaccttccctgaggcctccagaggcaatttcctcctcaggactcagctgcccttcactcttccctcgtgcacagcctgtcctgtgagtaggtgcaggtactgactggtcttatctttcgccctgaaaatataaacgttttaaaggcacctgaggatttgtcagcacctccccacccccaccctgggtctgacctaggactctgagtcagggaggcctccctccactgagtaatagtagccttgggatctgctcagcaagaggattgtatagtttaagggaggaagaagcaccagtgctgcctccccatgggaaaaatgaagccccccctcccgcaaccaccaccaccacagaaccaccaaccccaacgtcacttggcagattagcaaaagaactagccagacgctgctaggcccctcaggcttctagattcgctctccaccacatttctaccaatttatgctcatcttgataagctcctcctttgaagggtctggaatggtctggagtggtctggaaagcagggtcagatacccctggaaaactgaagcccgtggagcagtgatctctacaggactgcttcaaggtgcgtggtgaacagacgtctttttgcaattatgccagttgctcctctgatacttgagggttatgtgaatctaacaacagacaaaaatctctgcctcctggggcttatattctttgggaagagacaagcactaaacaaataaggaaatatatatacactctgccagatagccataagacggatggagaaagttgaagcagggaagggagatggaagtacctgagggtggactacgcatatttgaaatagggaagccagggaagacctcactgagatggccacatttgagaaaggacctgaagaaggtgaggcagtgagctgtggaggtgggtaactggggagggggaagaactttagctagagagaaaagccgctgcaaaggcccactgaaggcaggatatgcctgctgtgtcgagaccagcaggaggccgtgtgcctggtacttaatataccagaaggagtggagcaggcaggggtaccagttccagaaggacttgctggcaggtattaagatgggctttttctctgtgataggaagctccaggaaggatttgatcacaggagggacagaatctgaattgtattttagaaggatcactttgactgctgtacagagagtgggtggtgaggtgggaggcagaagccagaaagccagttaggaggctgttaagtaatccaggcaggagatggtgttggctgggaccagggtcatagcagtagaggtggtgagaagtaattagattccgtatatttattaaaggcaaagccagcaagattccttgactctaacttaaaggttggagttgtcatttactgagatgagagagaccatggggggaaggtaaagggctcggttttggatgtgttaggcttgtgctgccattggacatccgtgtggaggtgtcagagaagctggcctggagaaataaattggggaatcatcagcatactgaaggcattggaaggcacaagctggcataagatcagaaagagatggagcgtagatggagaatgaaagagacctttagagattaggaagaaaattactgactgagaccaacaaagtagattgatacggagcagccagtgatatcagagcaaaacctgggaggaagccaaatgaagagaaggcgtagaggaggagggatcgagcagtcatatcactatcacatgctatcgtgggtcaagtaaaataaagatcataagtgttaccgaaagtttcaaagtacagtgacattggccaggcgcggtggcttatgtctgtaatcccagcactttgggaggccaaggtgggtggatcacttgaggttatgagttcaagatcagcctggcccacatggtgaaaccctgactctaccaaaaaatataaaaattagccgggcgtggtgacgcatgtctgtagtcccagctatgggagtctgaggtgggagaattgcttgaatccaggaggcagaagttgcagtgagctgagatcgagccattgcactccagcctgggcaacagtgagaccctgtcccccaaaaaaaaggccgggcgtagtggctcatgcctgtaatcccagcactttgggaggccgaggtaggcggataacttgaggtgggttcaagactagcctggccaacgtggtgaaactccatctctactaaaaatacaaaaattagctgggtgtggtggcaggtgcctgtaatcccagctactctggaggctgagacaggagaatcacttgaaccggggaggcagagtttgcactgagctgagatcgtgccactatactccagcctggacgacaaagtgagactctgtctcaaaaaaaaaaaaaaaaaaaacaaaggctgggtgcagtggctcatgcctgtaattccaacactttgagatgccaaggcgggaggatcacttgtgatccgggaggagttcagttcaagaccagcctggccaacatggtgaaaacccatctctactaaaaatacaaaaattagttgggtgtggtggcatgaatctgtagtcccagctactctggaggctgaagtaggaggatcacttgagcctaggaggtggttcagtgaactgaggtcacacctgcaccccagcctagtgacagagcaagactctgtctcaaaaaaatcacctaccaccctcttcatacaggggaactttcttctattctttttctagtcattttcatgagaatcatgatctttatgtaaattcgtattgtatttttcacttatgttattaaatattctatgaaaacatgagtttaatgactaggtaatactcagttgtctgggtgtgccctaatatatttaaccattcctctattattgggcattgggccatttctgattttttgttattataaataacattgcagtgaacagctcagtgttttcctataaggggaagtatagggtcaaagaacgtgaacgcttttaggtgagacttgaacttgagatccctgggttctcctggacagaccgaccaatcacagcttaactgtgggatttttccatgtctcctctctccctgggaaggttgagaagtctctctgccctgcagatccctattcctgcctccccgctgcaattgcacgtcccatttctcctgggccagtcagagtttcattgcctctcatggggcctgctggccacccactcagtggctgcccttctccttaccaccagccttcgtcccctcacctagagcattcacaggcgagcaagagccagtcagagcttccctcagagtagggggtgtagtgataaatgaaatagccctgccttcactcatctcactgggtcgattaagtgatgtgtgatgtacctgaaagcacttcaggaacttaagagtctcatgctctaccaactgagctagccaggtgcccttaaagggctgtcctagtcttaattgtttgtaaagaaataggtagctgggcatggtggctcacacctgtaatctcagcactttgggaggctgaggcgggtggataacctgagcccaggagttcgagaccagcctgggcaacatggcaaaaccccgtctctacaaaaaatacaaaaatttgccaggcgtggtggtgcacacctgtggtcccagctactcaggaggctgaagtgggagaatcacctgatcctaggaaatcgaggctgcagtgagctgtgattgtgccactgcactctagcctgggtgacagggagatcttgtcttaaaaaaaaaaaaagaaaagaaaaaggtataagtggtggtgtccacattgtaaccacagagcccctaaagcagggctgttgacctatggttggcatcctggtcacaagagctctgtgtcagatgtgtgaggggcttgggtgtagttgtcaagcctgggaatgtggctgttagtatcgattggcctcatgccaagcagtgccaagcgccacgtctgctccccagatacctgtgtttgtatgtgtgtgtcatagtcgggaatcactgagaccaggacctctgggaggctgaaccctgggagggcagagcaggaacaggccttggagatgatctaattctgacattttactcagtgaggacacaggtggggcagccagagaggtactcagctctgagtcagggccccatccctcaactcctcagcctgagtcttcccaggaacacaacaggcagctgcttcccagaccttgcagggctccaggtggccttcccctcctgccgactcccttgccaggtttgctgtaactattgctcctccgagcctggctgaaatcatcttcagtctgttatcaccttcagtctgttctcatcttcagtctgttctccacagcagcctgaaaagtctttgtaaaaatgcagctctgttcctccccatcctcttcataacccccttggctctctgctcctcccagaataaatacccacatcctcagcttacccttcaagacgctgagtgacctctagccacagcccttctctctacccacagacagcccaggtcctcattccttgggccttttcacatcactgttcccatcaccctggaatcccactcagcctgcctgggccagaggctacgtaaggtcctcaggaaagcgtctcctggccactcgcacctgactcatgtgctctgagtgccacaccttgcttggcatttgtccttcatagccctggtcattgctggctaatgtagcctggcacatggtggtaggtacttgacaaatatttgttgaacaagtgaatgaaaccagctggcagggaccagaagggcagaggggcagggacagtgtccacaaccatagcccctgtggtcttagctgagaagggctctggctcggtctctggtgagtctctctgctggccggcagaaccaccctaccctggaagccctctccatgtagtgtgaggggtctcaggcccattcaggcttcagtaggagagatctgggtctcttctgggacctgagcaggcctttcctttacctcgttggcatctctcagcattttatttggttttaaaaatgtctcccccttcccccgaccaaccccagattataaaggtatcccacgctcactgtgaagaaattggataacataggaaaatataattaagaaaatcgaaatcacctacagctccacccctcagagaaaagtacccttaacatttgtggccatgtcttttcagttttgtttttatgcatgtgtatgtgctttgacattgctgagcttctctttgtgaaaaccacagatttttcgcagtcttcagtggctgcggtcagaggtggtcagcacgttagtgctcccagtggagaggtgatgcagggatctgggtgcccctttctccctactgcaggtgggtgggtgggcacacccaaggcccccttctgtggcagctttcctatccctggtgaagagtaccctcctgtctctggtctcttctccaggacattctccagccctggaggctgttcctagggggctgcctcttggggcaatgggaagaattgtggaatgcgtgggtggcctcctggctgtcttttctctggttccagcactctctgaacaaaaccagccccaggccactcctggggattggcctcaggtgactctctgggctgactctggccagctagaaggccacccgggcttctcctgtgtccttaagagggtggggtgacctggattggcaaatagtaagcagagaacacggcagagttgctggcctagaaaaccaggtcactaggtcagcacttggattaatgattgataagaaaggttgggagagaatcagccagacccattctcccatgacatccctcacttctgatcccaaaagcacctgccacggagacggggcaacctctgtcttgtatccagaggctgccccttattccgttgcagtatgggaggaaggaggtgacagcaactgggtcacctgcatgtggggcgagaaggggaggaaggtttaggcccttctccctgaaaaaagaagcatgtgcccagagtagggggctccctgccggttctctccccacaattgatggtgaggcagggaactgggaagttctgtctgtggaggtcccttgggtttcagcaggctagcacatttctaggactggaatatcaccatacaatcccttaacacaagccatgggtgataataatagcagcagccactgtggtccttatttgtaggacccttactatctacctggcactgttaagcagttactgcatcgttatttattccacacagcagcctctcaggttaggtggtagtattccagttttaatgtcttccccaagtcataggatgggagggatgagccagggtgtgaacccaggcctgactgaagccggtggaattcacttctttggagtattgcatctcgatggcagtaatatatgaaaactgatacagtggcaagtgctacaactcagaatagtgtggctaaggctcatgtttttagtatatttattcatccagcaaacgtatgttgaggacccactaaatgccaggcaccgtgccaggtgctgggacctacctcagtaagatacagggcattctctgggaaactgataacatggtgaggccagagcagttagcagacattgcagtttggtgtagtgattgcagatctggagggcccgggtcagggttgtggtgagaaggaacagaatggagctagtccaggagagcttcccggaagaggaggtgcagacaggtcgcgaaggagagaaggttttagctagtggaggggatggcattcaaggcaggtgccagttcaagcctccatgctcagggagtgatgtgggatcatgaggcacataggcaggcagagcaggaggataggcctggagagggaggcagggacgagagcctgtggctgtcttcagcacacaggagtcattttctggcagtaatgtccagaagggctttgaccaaggtgttcttgacagaaacagctggggactggcagccagacagaggattcagaggtgatggctccagactgagactaaggagccccagctgggcaaggacatgccagctcctggtccagtcttacccagcaccatatatgaggcacacagtagagtggctaagacttgagccaacctgccttgactcaaatcctgcttctctagttactgtgtgaccttgagccaattactttgcctctctgtgccataatttccacgtcagttaaatggagatgataatagtacctgcctcttagggttgttgtgaggattacatttgccaacatacacagagcatggtgtgtaataagtccttggagaagggaagctagtactattgtgatggaggtggtgatccagcttaggctctggtacagtaagaaggtccatcaggctgtaccatgtggcagatggagcccatggaggatggaggcccctggcacactgactgtccccactcatcccctgggtagggcagaagtgttcccacaccgtacagcctgccagtgggcatcagggaaacacctgagtcaccacgaggagtacgaggcacttgggggttgcccagctgaccaggagcacagagggctgccctgaaagtgagcccctccctactcctagcagagacggggaagggagacaactggacttggtgggaaggactgggccccaggtggcttagttgctctggccccagaccaggtctctctagagctctgggccatttgggttaagcttctaactaccactgcccatgaaattcacctgccaatgggcaatggatggagtcatgcccctccctgcacctaagttctctgaagggctgagtttcttcttggggccagacagtgggtattggaatgggagcatgggggctgcatgtgcactgcaggctttgtgtgtgtgtgtgtgtgtgtgtgtgtgtgtgtgtgtgtgtgtgtgtacacacatacatatatgtcagaattggaatagtccaggggtttgttttgcaagaaatccttttatttttattttttgagatggagtcttgctctgttgccaggctagagtgcagtggtgtgattttggctcactgcaacctctgtctccctagttcaagcgattctcttgcctcagcctcccaggtagctgggattacaggtgcgtgccaccacacccggataaccaggggttttgccatgttggccagggtagtcttgaactcctgacctcaggtgatctgcctgcctcagcctcccaaagtgctgggattataggtgtgagcccccttgcccttcccccatgccccatgcaagaaattattttgctagggactactttttggtgaggggctacattgctgcattcgtgccccctcattctggctcagggcccttgtgttgtctgggggtctgaagctccagcctcttaagtggggcaaagctgtgacatgatcagagggcttctggctctggcatagtgctggggcgtggagaggggagatagccaacactgggagccagaccaaaaaaaaaaaaagccagggttttttgccggcatacaaattaaacttagtgcctggctgtattgtggttgttgttgttgttttgagacagagtctcctctgtcacccaggctggagtgcagtggtgcgatctcggcccactgcaacctctgtctcccaggttcaggcgattctcgtgcctcagccacccacgtagctgggattacaggcgtgcgccaccatgcctggctaatttttgtatttttagtagagatggggtttcaccatgttggccaggctggtctcgaacacctgacctcaagtgatccacccaccttggcctcccaaagtgctgggattacaggcatgaaccaccgcacctggacttttttttttgtttttgagacagggtctcaatctgtcctcaggctggagtgcagcagtgcgatcttggctcactgaaacctctcccctccgggttcaagtgattctcgtgcctcagcctccgagtagctgggattacaaatgtgcaccaccgcacctatctgatttttgtgtttttagtagagacagggttttgccatgttgcccaggctggtctcgaactcctagcctcatgtgatctgcctgcctcagcctctcaaagtgctgggattacaggcatgagccatgcccagcccagcctgtgctatctttagtgccagggcttaagaaaggaagaggagaatagggttcattgcaggaattgtggtgggtggggtggcagctacctgagaaaatctagacagtgggcctaggtccagtgggtcaggggagagagcctaggggtcaaggttgctcctggctgggcaagctgagaacagggagcaaccttggctcagggtagatgacagacctcagctgtagatggagcaaggaggccatatgaaaatggcaggcttctggcaaaatgcagggatgggctgcagcacagcagttcaatctaaataggagcagcccaagggacgtgggtaggttttagaacagccaggctacagctccccttcctcttcactggtgtccttgagaggccacagtcagaagagacaattccaggctagggagagatgtcagcgtgggaactagagaccctggtcccaaattcagaactctagccagagtccagaactgcatctgagtctaagaggcaaccacttacttacacctcccgaaactgagaacagttttaccggttctggtgaaaaaaacccactaccagctcatatgtgggagtgggagctgaggctctgctgagtaacacggcccagtgcacacagctgtcagggcctggcccggctcgagtcctgctgtgtccgaagctctgccgttttctgcttcgtcctctagcatgttctgagatgccctgttgggatcctcaggcctgtcacttttgtcatctgcaaggggggcctataaggccttaatgggggctggcgaggcttgagtgggagcgtgacgcatagtgggagctcagtcagctccctcccctccctccaggatttggtcctgacagggagctccatcaggtcttccccagggtcaccagaggctcagatgctgtgttgtcaagtatatataccaggcagtattgtagcttttcctcctctgttactgcctgctaagcggggaccccacatcttcacgtcctcctcttcctggctctcatcaccacagcctggtgtgcattgccccgtgtccactgacacccacgccacatgggtccaaaaacagagtgtgttctcattgcctcatcccactcaccctgggctctgccgccactgcgctgtggctctcgggggtcccaccatctgacccttgtcacccgtgctgctccttctcttgggactcatcccttctgaggcctcccgtggccccttctcaccctcccctacctcctccatctccaggctttcaatctggtggagcataaagaatcagtgtttctggtacttgttatttggataatggcacctaatgctaaatgacgagttaatgggtgcagcacaccagcatcgcacatgtatatataggtaactaacctgcacattgtgcacatgtaccctaaaacttaaagtataataataataaaataaataaataaataaaataaaataaaataaactttgaaaaaaaagatttcagctaaaattagtttcctctccatgccgagtctgaatatattataaaaataaaagaataattgtctttcacacaattaaaaaaaaaaaaagctgactaatgccactacagtcacacactgctgttggtaattgctagggtcctttttccagtattgtggccaacttccaccccagaaccccactctactcttgagctaagtgtctttatgtctcctattttaaattaggattgcgttcagttgcatgcaacagaaatccggcaatcagtgcctggtaaaacaagtttgattttttcacctaacaagcagtctggaggccggcattgcagggtgggtccagcagctttgggaggccacagtggccaggtgctttcggacttttcacccaccctcctaccctgtcttctgctgctccgaaggcagctgctacacctctaggcatagtattcctgttccaggcaggaagatgggaggggcagaagtttgtctctctattaggaaataatagctttttcggaagctcctcctggtagatttctgttcacatattgctggtcagaattatgccaatgaacactgtagctgcaagagagcttggggaaattgagtgtttaggtaggcacagattgctgatccagagaagactgagactcagaaggaaggagaatggagctggggagaagtaggagtgactgccccagctgccacttggagaaagccacggggtgagcaggacagcacctgtgaacatttcctgtgctctgggtctggtgcttctcaagtttaacacccaggggcgagtggtcagggactgatccttgaggaactgatgtacattaaacaaactatcaagtccctgcaatgcagtgtaaatgagtaaagagcctgcaggggagaaactgccactagtggagaccatgcgagtgggcagccgattgcttggctctgggggtgggtgccagaggcatgcaggtgcccaagggccaggtctgcccaattttcaagagaagccagaaaaccaaaatttttaaaggttttttcgttctaactctattttgaaaaaagttcggtgttacagagtaagttgcagagattgtacagagtccccacatatcctttacccagctcacattaaatcttacataaaggaacactggtacaatactattaaccaaagtcagtgtgttgttcagaccttaccagtttttctgccactgccccctttctgcttcggggatctggtccaggatcccacattcatttagttgtgtctctgtggtctgctcctgtctgtgaggcttcctcagtcacaaagctagaggtttacgtgaccttttccaggttttcccactctaatgatttggaaatcatacatcggcatcttgagacatcttttgagaagtaaagggacttgagctgattgaatgttgatcactccctctcatcttccacattattaagttttgccttcttattttattataatttaaattatttttaagccaggcacagtggctcatgcctgtaattccaataccttggtaggccaaggtgggcagattgcttgagcccaggagtccaaaaccagccggggcaacatagcaaaaccttatccctaaaaaaaaatacagaaattagctggtgtggtagtgcacacctgtggtcccagctacttgggtggctgaggtgggaggatcccttgagcacgggagataaaggctgcagtgagccatgattgcgccactgcactccagcctaggcgacagagtgagactgtctcaaaaaacaataacaacaacaacaaaaaaacccatcagaaaacagctaagagttttgtggtggtgttttattttaggttcagggtacagatgcaggtttgttatgtgggtgaacttgtgtcacaggcgtttattatacagattatttcatcacccaggtactaagactagtacccgatagttattttttctgctcctctcctcctcccagcctccaccctcaagtaggccccgaggttattgttaagtccaagcaagggaaggcctggtggaaatgaatgtgtagccttaacatgttttgtacaaacttggctgtacattacaatcaccaggacaattaaaaaataagaaacccaatgtccaagctgctccccaaaccaatcaaaggagaatctctggggatgggaccaggcatctgtctttttaaaaactccccagtgactacagtgtacagccgagttggcaggtctagagcagggagagagagcagaaggagtctctgatcactccaggttctggttctgatgagtgggtagacaggcaggtgggttgctaaagtaaagattactagaggacgaatgggtttggggaaaatgatgggttctgtttggatagattgagtttgagctgtcggtaaaatatctgagagttggggtcccacagatgcttaacatcttaaagcagatcttttcttctcctgatccttccacaaggtctggtgcagacatttccccgctgggagactctccacagtacctcatgatcttatcatctctgactgtggcatttgtggataatgttttacttgctaagggttggaactgtctcctcctgggtgatgtggacgtggcatcaccacccagtaagttgtcaccttggaaagactccaggatggagcacatcttcctttttctgatgtctctgctattgaggccatggttgcagatctgctgtcaacatgagccaagaacagcagggctttatgtcttttttccacacccaaccactgaaaggatgggactcaccccttcaggaacagtagcacagcagagccgtgattcttgggcctgagtgctgatagggacagggtcggggatgggaggcgtgatgcatatctggatctccaggtgggctggagagttgggaaaagcccctcaagtcattccaatgtgcttcctggagactcagaacagaaggcagcagaggaggcagggaagggtggcacagtgatgtgtcacctctctagtttatggagcctgctccgaaccccacaaacccactacaagagccaggtgggaagggtgatagggcaggtgacttgtgatacaaggagcagagaccatggtatagcactgcaggaactagggaaggagcaggagcagaagaaccccctccatgacagcagcccccaagcgtgccccactcgcaccatcctcttccttgtcactgcctcccctgacctcttcctgtcttctcctctgcccaggctgatgggaaccaccctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacaggtgaggagaggactggcaggggacacggggcagaggaggcacagcccagtgcagtggggatcctggccctctgcaaacgccatcatgtggggcgcagagtagcagagtgctgaaggactggagccggaagcctgggttcacgcccagtgcggtggggatctgctctgccactcaccagcagtggggcctggagcaagctgcaccacttccttctgtaaaacaggccaaaggatggtaggtgatgtggatatgggctttcgtgagaattaaatgagtgggcatctgtaacacatgtcatcatcattattagtattcccaccactgttaacacaaggcatctgagaccaatctccactaacagcacactagaaagatcagctgtacctgggattgttatgatcagtcgaaacacacagttcaattggtctggtaataattatacacatcatcattgagccgtatcataattagataaaaatgctaagcagttagtatgaataactcaactaatattatttttatgcagccaagcagttgtagcttctcctgtctcacttattggttcccctttatttatcagcagtgcagacagttttctctagtaccctgtactgttctgtcatcttcatcatcatcatgttatgtttaccttcaaaagcacccagaatccatgcagcccctggctttccctgctgcagttccccctgcttttttgtttttgtggtttttgagacaaagtctccttctgttgcccagactagagtgcagtggcacagtctcagctcactgcaacctctgcctcctgggttcaagtgattctcctgcctcagcctcccgagtagctgggattataggcgtgcaccaccacgcccggctaatttttgtatttttttagtaaagatggggtttcaccatgttggccaggctggtctcgaaccgctgggctcaagcaatccacccacctcagcctcccaaagtgctgggattacaagcaggagccaccgcgcctggcctgatccctctgcttcttgctttctcccaccacttctctccttacccaagtgctgcaggcctgcacatgcagctcatcctcgctcctccccttagagggaactcagggtcataaggatatactgctgggagtagacaccctgcactcgctgctgctttcagctgcaggagatcctagccacaggcggtgactcaggcagaggagcaagcccaccccgcagaaatgggctctggacccctgtgactgcatggagcaggaggaggcagttagtgtccaagctaaggcagggtgaaggctgtggaggtagcgcaggctcctgtttgggtctgcagctaagatgggtctgaatcctggagccacaccaccttgaacctgcaaagcaagtcccagaattttgcagaagttcttcctcttcagtgtatagagttgggtggagggagtatagagccatcattcagtccttctcatctcacccaggatcacctgggagtgaccaaagtaggccaaatgtgattctagggccaaagtgaaggtgtccgccattccccgagtaagcaacttcctgtctattggctggtaactgggatggctttggagacacagcctgtctcagaagagaggaacagctaaccaggagtgataattcactcagtgccagtagcacatactgttctaaatctgaagaaggtagggagggttagaaagcaaagggaagacagtggggactaagaatgagtgtgggatgtcatgaggattcaggggagaatgcaaggagaagagacggccacagggtttgtggctatgccgcctgccgtggcccacctcatccccacatctgagcccaggcagatggaagtcccctgcagagcagtgttctgtcctggagtttcctccacaccccttcttgggaccagggctgtttcccaaatagcatcactgttcccgtgcaggccaggtgaggtgcctgggagcaggggtagggtgaggcaggcatggcggtgacctctcaggcagcttcgttgtgggatttagggcacagcgggaaacgtccagggcagaggttgcctcaccagtcacatggtactatgtaggcggtggtgtttaatagattctgtttatcaataagtggatgaagtggagatagacttccttgttcagtcattgaaacaggagagagggttacttgacataatcactttgtgttaaagctgtagtgtatgaaaagttcccaaaaattctacaagacaagcaacctagcaggaaaatcagaacaggtaacagtaagacaaatacgaatggcctgaaatcccgacaggtttttcagtctaaccaactcaaagaaagcaccttaagttgcaatgccatttcacctgtcagatgggtggggaggacttggtcctcccaccaccaggggtgaaagggtagtgtgggccaacacttcttaatgtgtgattctttttttttttttttgagacagagcctggctctgtcgctcaggctggagtgcagtggcacacgatctcaactcactgaaacctctgcctcccgggctcaagcgattctcctgcctcagcctcccaagtagctggaattacaggcgtgcaccaccgtgcctggctaatttttgtatttttagtagagatggggttccactgtgttggccaggctagtcacgaactcctcaggtgatcctcccgcctcggcctcccaaagtgttgggatttcaggtgtgagccaccacacctggccaagtgtgcatttcttttaccctgcattcccacttctaggaacgtgtcctgtgtaagtacttgctcagcatgctcagagattcccatgccagcttatttactgcaggactgctcataagagcaaaaataggaacgtgcccatctgtggggaactggttatgtaaactgtggtagagccatatggtggaatactctggagtcattgaaaaggataaggctggtttatatatatattaaataagttcctgacaagttggggatcccattgtttaaaatccttatgtttcatagaaggcaccggaagagtctataccgaaggactcaggggctaactctgaggagcaggatcatggttaaggaggctgtgtcataagatcctgcatacccttctgtgtttttctcaacaagtctgcactacttccataatttgaaaggcaactgtactttttttaagggtaaaattaactgtttaaaaggggggtgaggatctggcaggtgaggggccctggagacagagcctgatcatgtgtccagagcagaagggcttggagatcacagagaccagggcaggcatcccaggtctgtcactgtgagctgtagccctcgccagtgccatcacttctccaagtctcattctcttcacctttataggctgtgtcctacccagcctgagggccagccaggtgagagtcagtgggggtatgtgacacatcgcaggtctcagcacctgctagttctctgccccatccccatgagttattactttggcctcgggagtcccctgagggacccataaggacagcgcacagctttgagccctgaaacagcaggaaggctccacagtcacccctgaccaccctcctcagcagttcagcactgactctcagtgcagatattgagctcaacacctgccatgcaccttctcaccctccccccagccaggcaggacagaccttcccatcaacaaggaaactgaggttaccagaaacccacttgccagggtcccctgggcgtgtaggagtagagacagctagagccaggattcacctcccattcccattctcatccctcctgcttcagtgacatccatcccaatcacccttgagaaagaggaagataaagtgtccttcctcctggcctcagcacctcctcacttggcaagcacttggtgggcatcaggctgggcccagcactgtgcccagggctggccatacagtggtggacaaggctgagtgcctgtcccaaggagcccacagttcaggcaaacaggacagcagaagtaaagaggctgctcagtaacccagcctcaaatccctgcagaatttggcctgacttcagaagctgctgggtgcttgtttgcctgtgagctctgccagcaaagtaaatagaccaatcgggcgcctcctggctgtcttcacagccatgacaacggcattctcccagcattggaggctagatatgcaggagagctctcagccacaaatgatgtgaataaggtcaatagtgtctatttgctgaacttgtcatcaaagatggtgaaactgatactttactctctgggtgagagggctagtgtttacactgaatccaaacatttggataatgacatggtgcctcctcagcagtgactgtgtcttcttgttcatcataataatgttattgattagcggtactgaacatgtaggtatgcgtagtagtgagatgccgaggttaagagctcagctccaggaattgcatggttctaggttataattcttgctctgtcactgtattagtcagggttctccagagaaggagaacctgtgtgtgtgtgtgtgtgtgtgtgttgaaagaaagagatgtgttttaacgaattggttcacacagttgttggagtggcaagtccaaattttgaaaggcaggcaggctggagagccggggaagttgatgttgcagctcaagtccaaaggcagcctggaggcagaatttcctgttccacagtggggccacggtaggcactcagtcttttttcttaaggccttcagttgttggatgagggccactcacattatggagggtaatctgctttactcaaagtcttctgatttaaatgttaattgcatctaaaaaatatcttcttagtggccgggcacagtggctcatgcctgtaatcccagcactttgggaggccaaggtgggtggatcacctgaggtcaggaattcaagaccagcccagccaacatggtgaaaccccatctctactaaaaataccaaaaaaaactagctgggcgcctgtaatcccagctactcggggggctgaggcaggagaatcgcttgaacccgggaggcagaagttgcagtgagctgagatcgcgccattgcactccagcctggggaacaaaagcgagacttcatctcaaaaaaaaaaaaaaaaaaaaaaaaaaaaaaaaaaaacaccttcttagcacattgtttggtcaaacaactgggcaccgtggcctaatcaagttgatatgtaagaccaacatagccgctgccagcaagttactaacacttctgagccttggagcctcggcttccttgcctgtaaagtgggggtaagaagaccatcttgaaaggttgttttgaggttttacgtgagatgaaatgggtgtccaatggagtgcctttagcaggacacctgcttacccccacctctacccaggacatcatgatgcgggggaagtggtggaaccttcagaacccagcccctagtatgagaagaattctgccatcacctttctttcagcagagagggaagcagtccccttccgtgacagtcacatgcgtgagtgatggctccttccaatatcctgcacttcttactgccccttacctggcgttgctccactctgtctcatgttctagttttcttatctctttctctttttttttctattttatttttttcctgtaggcacaagtgagttacagtaggttaagttacaccttacctttccttgtttttcttgtttatttatttgtttatttatttttttgagacaaggtcttgttctgtcaccacaggctggagtacagtggtgcaatcacagctcactgcaacctggacctcccaggctcaagtcatcttcccacattcaggcaatcctcccacctcagcctcccaagtatctgggactacaggcatgtgccaccacacccagctagtttttaaaattttttatagagatagagacagggtctcactatgttgcccaggctggtctcaaactcctgggctcaagtgatcctcccgcctcagcctcccaaagtgttgggatcacaggtgtgagccactgcacctggccttttgttttttttaagtagagacagtcttgctttatcacccaggctggtatacgatggcacaatcacagctctcctaggctcaaggattttcctgcctcagcctcctcagtagctggcactataggcaggtgccacgacacccaactatttttttttttttactttttatagagacagggtctcactatgttgctcctggcctcaggtaatcctcctgccttggcctcccaaagtactgcgattactggcgtgagccaccacactcagccgagtgcaatggcgcgatctcagctcactgcagcctccgcccccctgcccccgggttcaagtgattctccttccttagcctcccgagtagctgggactacaggcatgtgccaccacgcccagctaatttttgtatttttagtagagatggggtttcaccatgttggccaggatggtttcaatctcttgacctcgtgatccgcccgcgtcggcctcccaaagtgctgggattacaggcgtgagccaccacacccagccctgctgttacctctttcttacctcagctatttgaggatagagtctaggtcctgtcctgcatatagaaggtgcttatcatgtgtcttttgagtgaacacagagggtgacattgtcacgtgcagtgccaacagaaaccaaatgactagacacctgctgaccttccatggccacagggaggatgagaaaggcacctccaggaggtgtgaataatctgagggtattggccactgtggacaagactcggtggtggaagtgagctcagagatccaaagggaacgtgagtagagacatgcagagtctcgcagaggaagcagacgtgcaggccacaaagacaaaattacaagaaatgccccaacacgagcatatgctcacggactgcacagattcaaggaggaagtgccagaaaccctgcctgccccagcatctgcacaggcatccacaaagggtttctgtcatgttatctctttttcttccaacatccggtgctgtgagttttattgtccctgttataaatgcctccaggagtggcaggtcctgcccagccccatcagccagttggtgctgcagtcaggacacccaggcagcctgaggactgccagatgtgcagagagctatcgcgtgcctgctgcgtgcccagcacctcacacagctctcagtgtctgaccacgctggtgccctggtggacaaagttcctgcccttgtggcccttttgtctagtgggtggcttccaacaatgaacacacacaggatatgtcaggcggtgacaaaggctactgagaagaccaaagcggcttcaccctcccagagcacagcttttccctcccaggcccgagagatgtagggagcccactgtcccagtctgggtcaagaggaacagttacaacaccttggaatgactgaagttgggagctaaggtgccaggacaagacaggccattttaggaaccagagacttgtgttacccctaaacctcaccagccaggaggggagcagcccactgggtcctctctgccacagttgggtgcttcttgtgctccccctcctgtggtcaggataggggaagcaggctttcctgctgccactcctaggacccaaggggaagctgggggagtggggagaccatgtgggaaggatggagtgcactttgattggtagcaggtggataggtactcccatggtggggaaatcaaagttgcttggcctgtgtagtagacaggtattaccacaggcctggaaaacattagcctgggtttatctctgtggcttcggtcccccaacatccccttctactcaaaatggctgattctctggtttggaggtttggcacctgcttttggggaggttgctcagtcattagagaagagtgcagaggttggacggtcatcatggcagaggtaggacagctggtatgtggggccatgaaaccagctttgggctaggagtcaggaagctgagactcagttcaggtcccctttccaagatgaagagatcatttccgagtgtccaaagggcactgggaagagaatcctagcagttcttatgaaatcatctgacagcagatatatcctgaagtcatagccttagcaaactgcctttctcgccaacacactcaacaccccgtggttcaaacatctatacgtctgatagaaaaacttggagaaattcagtgtgttgcttaatcaatatgactgatacctaagctgttctactcaagaagttttcatgggaatgaacttgagcttcttgaagagattgtttacagcatccctggagtctatgcaagaatagaacttcctgtgggggatggtggggaggctagctctgcagaggtctacagtcctgcagtttctgcaaaacacgttgcacacatctccatatgggccacacggtggcaacctctgaaccaggagagctgcttcctaagggctaagaccctctgtctgctttctctctcttgctttcctcccaaaacacagccatcctcctccccactgctaccccatggtgagttcagcccaggaagcctctgacccagccctgatggtaatagctgctgtgtactggacatcttctgtatgttaggctctgggagaaatgctgtggagactttttgcccatcctcccagagaagctgtcagtaccccctgttctaggtgaagaaactggtcctcagaaaggttgactccctgaggccacacagctgttaagtggctgaggcgagggctgtggggctgttcccacgccctggcttccaggcctggcagcatgtggagctgcccctccatcgtgtgtccgcagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaaggtacggactggggggagcggtggctggccactgaggctgtggtcacatggtgaattgaccctccacaaagctttccttgccttggggtggggccctgactgtacctattgcagaattcctgcccaggaggcagccaggcccttgtgctccagacctcagctctgggcactgcaggagaagagggggttcccttgtcaagcctaccctgctgggcacctgtgttgacccagctctgtgggtgattgtgtccccctggggaccaggcagctagggcagaatgagggtcttgggctgagccatcgtcttacctgaggtctgggtttcttgtttctcaaggctcaaagcgggctctgagaaaaaaggacagacatttgtttttccagtgatatttgtgggtccttcctaacttcacacccatcaaaatctcacagattattttattgaatcaccacctcacaaatacacagaaccagatacatttatgaagaaatcaagttagccgtgagacaatcttatgttaccaaactaacaaagaagctttttttttttttttttttttttttgagatggaatctcgatctgtcgcccaggctggagtgcagtggcgtgatctcagttaactgcaacctccacctcccgggttcaggagattctcctgcctgagcctccagagtagctgggattacaggtacatgccaccatgcctggctaatttttgtatttttagtagagatggggtttcaccacattggccaggctggtctcgaactcctgacctcaggtgatccacctgccttggcctcccaaagtgctaggattacaggtgtgaaccactgtgcctgacccaatttttgtagttttaatagggacggggtttcaccatgttggctaggctggtcttgaactcctgacctcaggtgatccacccacctcggcctcccaaagtgctgggattacaggcgtgagccactgtgtccagccccaacaaagaagctttaggacttctttagacatttaaaatagttgtgttttttttttgttttgttttgttttattttgttttgttttgttttgagatggagtttcactcttgttgtccaggctggagtgtaatggcgcgatcttggctgactgcaacctccacctcccgggttcaagcgattcccctgcctcagcctcctgagtagctgggattacaggggtgtgccactacacccagctaatttttctgtatttttagtagagacggggtttcaccatgttggccaggctggtctcaaactcctgacctcaggtgatccgcccacctcggcctctcaaagtgctgggattacaggcgtgagccactgtgcctgaactaaaatagttttaattaaagttttagaattactttccttctccatctcccctccaaaaaaatttcttctcgttacttccaaatgtcaggagtgtttacaccttatacataatcgggccctttggcacagcctccctcccacctcctggtggcctttcctcacctgttcttggtgcttcagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacggtgagagctgaccagggcaactcacgggctgctggctccacacagcctgaaaccaaggtccagggagcccttggggcagcctagagggggcacctgtagagcagtgcctggcgcacagtaagcaccatggctgttggctgttggctttgctgatctggaccttggatcttagagcctaagacctgccacttcctcagactgccagcatctaccatgggtcccaggcgtggggtagtgtttacctccctatacctgaggtttacgcattctggcccagaagggaactgataattgataccagcttgaacaatttggggaacaccagtcccagaaactcaagcctgtctcagatgacctgacacagcatgaaagctactgccaaggccaggtggcccttcttggttatagaaggcaggcagtaaccagtaagtaaccacatttgtcaactgccaggagccaggcagaagtttcttggaggtcacccactcccaggagacagagccttctctgccctgtgctccaggcctcctgcagagccttgtcttcggaccccagggtaggatattgcaaagcccacctgtcccctcagtacctctctgagtaagacccctagaggacaggggagagcctcttgtgatctctacaggcaggttagctgcttggccagcttttacccagggatgccctaactgccttgcatcttagagggtagcagtacctgagccctccatttgcggctctcctgggtaatggggtctggcaggtctgggtttgactcctttcttaggaaatctcggaactgactgaatccctctccttacgctaactccaggagaagtcgaattcgtatcctactcaattactaatgacaacaatttttgagtgcttactatgtgaggattcttatttaattgatctaataactcagtaagttttaaaaagtattagcctcatttttctgattaaaaaagaaaagtggccaggtgcagtggctcacacctgtaatcccatcactttgggaggccaaggtaggaggattgcttgagtccaggagtttaagaccagcctgagcaacatagtgagacctcatctctacaaaaaaaaaaaaaaaaaaaaaaaaaatttagccaggcttggtggcgtgcacctgtagtcccagctactcagaaggctgaggcgggaggatcactttagcccaggaggtcaaggctgcagtgagccatgattgtgccactgtactccagcctggatgagagtgagaccctgtctcaaaacaaaaaaagaaaaaggctgggcatggtggcacatgcctataatcctagcactttgggaggccaaggcgagtggatcacctgaggtcagcagttcaagaccagcctggccaagatggtgaaactctgtctctactaaaaaaaaaatacaaaaattagccaggcatggtggtgggcgcctataatcccagctactcgggaggctgagacagagaattgcttgaacccgggaggcagaggttgcagtgagccgagatcgtgccactgcactccagcctgggagacagagcgagactctgtctcaaaaaaaaaaaaagaaaagaaaaagaaaagtgaaggagtctgccccaagtcacaaagctagtaaactgctgagctggaactcaagcccaggcctttgtcaccaaagtctgtcttaccccagctagcgtagctcagtcactcagtaagttagagtccttgtgtgctgggcactgtgaacaaaacagacaaaatcactgctcttgcaaagatacaccaaaaaaaaaaaaaaatcacatcttgtggagcttgcgatctggaggggccaccccatcattcctaccttgctgactctagagcttctgggggccttaggctccaaaaggatttggcccatgcacctgtaaagggatggggatgtcagaggtgctggggcctgcctgggctccttgctgactgcccccttccctgtgcagctatccgttttggtcggatgccggaggctgagaagaggaagctggtggcagggctgactgcaaacgaggggagccagtacaacccacaggtggccgacctgaaggccttctccaagcacatctacaatgcctacctgaaaaacttcaacatgaccaaaaagaaggcccgcagcatcctcaccggcaaagccagccacacggcggtgagtgttgctgctgcttggcctggcagcatcctgggctctgggtcccactgccgcctgcctgactccgggagagccaggccttctccctccctcaacttcatggtgcaggcaagggacatggggagcacagggtgggggtctcccgaggcctgatctctaacggggcctggttttcagccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggaggtgagtgagagtggggcaggtgggctggcctggcacacccagtcgtcctgggggttggccctcactgcagggcactgtgcctgagctctgacagtgtggggaagtgtccctgtgatcttggcagtggaacatgcaaggcactgactgagcatgcaggatcagctccatctcattatgtacgtagatagaggtggagacaggaaaaagactaagccagacgtggtggctcacacctgtaatcccagcactttggcaggccgaggcgggtggatcacttgaggtcaggagttcgaaaccagcctggccaacatggtgaaaccccgtctctactaaaaatacaaaaaattagccagatgtggtggcacgcgcctgtaatcccagctacttgggaggctgagccaggagaatcgcttgaacccgagaggtggaggttgcagtgagccaaaatcccaccactgcactccagcctgggtgacagagtgagaccctgtctcaaaaaaaaggaaaaggactaacaggcagtatgctgtcatgttaatgtggggtggaaaaattgtctgcattttttctgcatttttaaaattccaacacaataaatacaataataactatgctaactaacagtggtctagagcttacttcatgccaggcactgttcttttcatcgatgatgactcacttgatcctcacaacaaccctgtgcaggaagaatgttttgtgtctccattttacacatcagagaggctgaatgacctgcctatagcctcacaggcagacacaggatttgaattaagcattgagtctcttaaccacaatactacgttgcctaatcgggggggaggtggggacaaattggcaaaaaacaaaagaagtggattaagaccaggggtagggagattagaacacccagtggagcattgctgatgggacagggcttggtctgtcacggccaaggaggcctgccgtcccctgggccaagtcacctcttggggtggaagtaggggagctccactgcctttctgagctccctggcgtgccctgtgtccccacagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccagcccttgagcacccggcctggagcagcagagtcccacgatcgccctcagacacatgacacccacggcctctggctccctgtgccctctctcccgcttcctccagccagctctcttcctgtctttgttgtctccctctttctcagttcctctttcttttctaattcctgttgctctgtttcttcctttctgtaggtttctctcttcccttctcccttgccctccctttctctctccaccccccacgtctgtcctcctttcttattctgtgagatgttttgtattatttcaccagcagcatagaacaggacctctgcttttgcacaccttttccccaggagcagaagagagtggggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtgggcaggaggccccaggctgagagccagatgcctccccaagactgtcattgcccctccgatgctgaggccacccactgacccaactgatcctgctccagcagcacacctcagccccactgacacccagtgtccttccatcttcacactggtttgccaggccaatgttgctgatggccccctgcactggccgctggacggcactctcccagcttggaagtaggcagggttccctccaggtgggcccccacctcactgaagaggagcaagtctcaagagaaggaggggggattggtggttggaggaagcagcacacccaattctgcccctaggactcggggtctgagtcctggggtcaggccagggagagctcggggcaggccttccgccagcactcccactgcccccctgcccagtagcagccgcccacattgtgtcagcatccagggccagggcctggcctcacatccccctgctcctttctctagctggctccacgggagttcaggccccactccccctgaagctgcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgccccgacccgggtctggtgctgaggatacagctcttctcagtgtctgaacaatctccaaaattgaaatgtatatttttgctaggagccccagcttcctgtgtttttaatataaatagtgtacacagactgacgaaactttaaataaatgggaattaaatatttaagagctgactggaagctgactcagttacttgcatgtttttcctggggcttacagggctccacgcctcctccacatccagtactggagggcaaaggaggctttgggctccaaaaccctcccctgcctccacctcgctttgctcaccgcttgtcagtcaggtggacgactatgccatttccgccctgcagagagaatttggggtgtgaggggacaaaggacttgtggtgccctggcctcacctggtggagcacttggggtctggggaaggggaaggcccctggaggaggcggatgcaggactcaatagatcaaagccagtttttcatcaccacaagagatcacggctttcctctcctttgctgccacccagctctctcctgtctttcctgagtgccatctccccagcggtccagtcgagcccagcccccggcagccatgggtttgtttgcagtgtgaggccaggtcagggtgtgtaacagagtatgtgtttagtcaggaaaaaactacagctaaatatttccaaatggggaatgtactgcagggagttgttacaaaagtattggaagtactgaaagatcaatagggggaaataggagtcatccagagatgactaactgcaggaagccattctcacctccagggctgaatgggaaaatggtattcagggcccaccgttgctacaacacacactgacactgcggcgacccaggagcctgaagtcaccagttgatttgactgtagaaccagactgctggtgcctgagttcacgcagatggtacatatggggccaccagagtgcccgaggccaccaccactgctgcccctggaacctcactgcttgagtgctgtagccccataactcatagcctggtctcagctgcttctgccagaagtgctgtcagagtttggggttggggaagcaaaggattcttccttctgcctatcttccagtctgttgcttttacctcccattgggggaaaaaaatgcatggtagtctaggaaatggagtttgtagacttccagcccttgcagcatagaggagcatgtggaagggtgggaactgaaccaagcgtctgcaggcaaacaactagcacagcgtacaggcaccagccccagtgtgagggatcccagaggcccacagctaagggatggtcactacagcacttgcctccttgttttctttctttgctggtcatcttggcagagcaatctgaattgtcaggtcccatatggttcatctcagtccagagagtgacagccccaggggaacaggaggaaaagaggagaaggaagaaaaaaaggggtgcttggaaccagggcatctctgaaattggtagccttttttataatggaatcctctggtttacttggtgttataagtaaaatgtttattcagaaacagaatgcttgttccttggaactataaggaaaaattagcatttagacaaaaagttttctcagcaaggcaattttactttctgcaggaagggtgttcctcacagatggaacaatggcgagagcacacacgaacaaaggagggaagcaatttttatcctttatgcagcttgtccctgctactgtgtcctgtctccattggctgaagccagaccacacaatctaagctaaacctgactggctaataacttaaaactttcctaaataggtgaaggcaagggagaacaaaggaaaagaggaagttgcttgcaaaaggacttagaaaagtaataaccaaatatctggttaaagtacaaggacatagaatgtactaattcccttatatctaacagctacacaggatagggcttaacaaagagttattagcacaaaacaaggtggcttgaaggaagttagtctttaaaagaaactattatttctaacacttatgatttattttttaacaagaagggaaactttgaagaggaaccttttttactttctacacttggtttattttactcacctccctattctttcccacactatcaaatggggaaaaaatagtcaaagactgtgtgtgtctcagttgttaaaggccagtcctcttcccagcactgaagaacccagtatactaaataaccagttctcactcagttcagagagtcgaagctgtctcaaccactttgcctggcttctggtgctgcaaagagcatcatatgactctggcccccgttgttactaccctaattgctattccttattaagcagctattcatgcattatacatacatcacctctaatcttataaggtaaacattatcacctgtcattttacagaggaggaagcgcaatgagagattaaggggtgtgcctgtggtcacagctaggaagaggcatggccggtattccatccgcagccttaggatctctgcttttcagccaggatcaaaactttggggaaaacagttggtcacctggtctctttttaataatgctcaggacaaatgaatcaagcatttaaactaaaaaaagaagaaagcaaacttaggagacttagaagattctcttggcaataattctataaacctaaaagtattctgaaattagaagtttattagagagatagccgggcacggtggctcacgcctgtaatcccagcactttgggaggccaaggcgggtggatcatgaggtcaggggatcgagaccatcctggctaacacggtgaaaccccatctccactaaaaatacaaaaaattagccaggcatggtggtgggcgcctgtaatcccagctattcgggaggctgaggcaggagaatagagtgaacccaggaggcggagcttgcagtgagccgagatcgcaccaccgcactccagcctgggcgacagagcgagactccgtctcaaaaaataaaaataaaataaaaaatacattaaaaaaaaaaaaagaaatcaaggttgggcgtggtggctcacacctgtaatcccagcactttgggagggtgaggcgggtggatcacctgagatcagaagtttgaggccagcctggcgaaaccctgtctctactaaaaacacaaaaaattagccagacgcagtggcacatgcctgtggtcccagctgctccagaggctgacacaggagaatctcttgaacctgggagatggaggttgcggtaagctgagatcgagccactgcactccagcgtgggcgacagagcaagacttcgactcaaaaaaaaaatcaaaacataagaaaggaataatttgctttgtttgtttttttgttttgagatgtagtctcgctctgtagcccaggctggagtgcaatggcatgatctcggctcactacaaactctgcctcccaggttcaagcaattctcctgcctcagcctcccaagtacctgggattacaggtggccgccaccacgcccggctaatttttgtatttttagtagagatggggtttcaccatgttggtcaggctggtcttgaactcctgacctcaggttatctgcccgcctcagcctcccaaagtgttagggttacaggcgtgagccattgcgcccagccaatttgcttttttaagaaaaaaaaaattaagaaatgcctggaacttctaagaaaaaaaaaaaaacctgaatgagttaaaaattagacacagctagagattattttttgctcctcaagaaggatctgtagaaattttcggccgggcatggtggctcacgtctgtaatcccagcactttgagaggccgaggtgggcggttcatgaggtcaggagttcgagaccatcctggccaacatggtgaaaccctgtttctactaaaatacaaaaaattaggcaggcgtggtggtgcacgcctgtagtcccagccccttgggaggctgaggcaggggaattgcttgaacccgggaggcggaggttgcagtgagccaaggtcatgccactgtactcctgcctggtgaccgagcaagactccgtcttaaaaaaaaaaaaaaaaagaaagaaaatttccagaaaataacacagggaaatcaagatgtagaaaatatggaaagaatatcaataaaaattctcatacactgcagaagggagaagttgtgctgtacgatcaatttgaaaaacaatttggcaaaatctagtcaagttgaaggtgcacacactctgttaccctgcattttcctattaaaatgtgcctgtggatgctaccgggcaccacccagatcccacccctcaggacccagctgctgggggtatcggctgctgaattcaaagctgagttcctctcagtgaattgcccttaccaaaggaagctgcctcacccaaggatatgcacacgccctgctcagggcagcctgtgtccaacatgggagtacaaaggccaagccttcttgcccgttttgggacaactgcaaagactggcccagctccagagctgaggcttctcttataattacattgcagcttaacttcaatggttaacttaactggttagggagaatcctctgaccaatcctgcttccttcagttccttacaggtgttgttctaaagagcattccccagaaagtgttgtgcaagtaaacttccaaatctatttcctagagaagccatcctgagacagtaccctagagagaaacccatcaaattacaccaagacttatataaacgtttacaggagcaatagcaaacatttggaaacaataaaaatgttcatcaggctggtgcagtggctcatgcctgtaatctcagcactttgggaggccaaggcaggaggatcacttggggccaggagttcaagaccagcctgggcaacatagtgagacccccatctctccaaaaagttttgttttgttttgttttgttttgtttttgagacggagtttcactcttgtttcccaagctggagtgcaatggcatgatctcggcttactgcaacctccatctcccaggttcaagcaattctcctgccttagcctcccaagtagttgatataatctcccaagagattataggcgtgcgccaccacgcctagctaatttttggtatttttagtagaaacaggtttcactatgttagccaggctggtctcaaaattcctgacctcaggtgatacacccacctcagcctcccaaagtgctgggattacaggcatgagctaccatgcccggccaaaacgtttttaaaaattagccgggcgtggtggtacatgcctgtagtcccagctactcgggaggctgagggaggaggatcgcttaagcccagaagtttgaagctgcagtgagctaagatggcaccactgcgctccagcctgggcatagagggagacactgttcccccaaaatataaagtattaaaaacttttgctacatacatttaaaaatgttctgcctgaaataaaacacaccataaggaagcaattttaaaccaaccatgtaaaaatggcaaaacctttgggctaatttctttattatataaagaatagttataggccgggcatggtggctcacgcctgtaatcccagcactttgggaggctgaggcaggtggatcacctgaggccagcagttcgagaccagcctggacaacatggtgaaaccccacgtctactaaaaatacaaaaattagctgggcatggtggcgggcacctgtaatcccagctactcaggaggctgaggcaggagaatcacttgaacccgggaggcagaggttgcagtgaggcaaaatcgtgccattgcactgcagcctgggtgacaagatcaagactccgtcttaaaaaaaaaaaaaaaaaaaaaaaaaagaacagttataaatcaatgagtaaaaggtcaatccaattgaaaaatgagcaaaggatatgaacataaaaggaaatgcctcttaatatgaaaagatggccgggcgtggtggttcacgcctgtaatcccaacactttgagaggccaaggcgggcaaatcacctgaggtcaggagttcgagaccagcctggccaacatggagaaaccccatctctaccaaaaatacaaaattagccgggcgtggtgttgagcgcctgtaattccagctactcgggaggctgaggcaggagaatcgcttgaacctgggagagacggaggttgcagtgagccgagatcacgccattgcgctccaggctgggtaacaagggcaagactctgtctcaaaaaaaaaaaaaagaaaaatatgaaaagatgcttaacctcattcataagagaaatgtaaattaaaactacaatgagatactgctttgtttttgtttttgtttgagacagggttttactctgtcacccgggctgagtgcaatggcatgatcagagctcactgcagactggacctctcaggctcaagcgatcctgctgcctcagccacctgagtagctgggactacaggcatgcaccaccacacttcactattcttgattttttgtagagacagggtcttactatgttgcccagactggtctcaaacccctgggctcaaacgatcctcccatcttggcctctcaaaggcctgggattacaggtgtgagctgtggcacccagctgagatactgttgttttacttactaaattgaatacttaaaagtttgataacattgtgttggcaagggtgtgaagaaacgggcagtccatactgttggtaggattgtaaactggcgcagcctccaatgaaggtcatattggtaatacctataaaaattaaaaaaaaaaaatttgatccagcaaaagtgaaatatataacaaaaatttccaggactattggtttcccaacctagtgtttcaacctactgataggcataggaagttgtaaaattcaattttaaaatctctcctttaattttaagttaattcctcttactttttttttttaactttcgcatcttgtctcccacacagggcagtacagtctggcagagagagactgggctttggaggcgtaagatgggaattcagggagtcttagaaacagagctggaagcgctcttagaggccatgatcccccttctctaaggtccccatctcctcagacacattatgtagcagagactgaggccaaggcctgggaggcaccttgtccaaggtcatatcaggtctcctggctccccgcccgttgctctttccccgctataaaccctcgctgagctgtgtgtcaggcccagtgccaagcaatcttcacctatggcctcatttcatcttcacaacaactttatcagataatctttgccgcaaacaatttaagacaacagattgtttatctggaaaagggagttatgaagtgtagtgccagctcacagaacctcctggcagcccaactgccaagcctggagcctcctcggccagaaacaatgttcctgtgccccactgggctgctcagcacccccatcccagggagaaggggagaaagtccccgaccaacgctccagcagggcccaaatcccacggccatgctgctctcaggaccaggtgcgggggacagactcactgagagagggaatcaatcagtccatcacccagctcaggctcgccatcggggcagggatagcctggttcttggggccggtggatttccaggagtgccggcgagccctgccatcagtcagtccccaggaggttgcagggaagaggcacacagcatgtctttgaggaacttgattgagaactcttgggaagatgcacttagggtcagtccctcccagacagacatttccataggcctcctggagggcacagacgtaggctctggatcactcagggttagccccaagccaggtgaaccatctactctcaatatacccaaaaaggaggctctgatgggctgccttcctcccatccgatgtggagtgtcctcaccacatacagtttcgggcagccccctcctggctacctttcatagtggcctttgctaggacatcaacactattctaattttttgtgaccaggttagcaagctggtttcattggcaaacacaggccaggcaacagggactttttgtggaaagatctcaggcctggagtcaggaccctagagcctcctggatctgtccagtacagggccagtttggatcagcctctctgtgcccccacccagctcacaccatctcccagcctgctctctgatctctccacctgaccttagctccacaggtggggctcatgtagctctggaggtgtggggaggctcccaagcggcttcctcagtcacaaataccttcagacgacacattacttcccaagccccaggactcccagactcccaggtcctcgtggccccctcccaagtcaccctgccttcccagactgttaaagtccttaaaccatcccccaatttcctccaataattacctaaacatccttgagggcttttataccccacccacagccctggagcctggattggacaccctgagcccccagctccccagccatcatggctgggccctccatgcctcccaccagcaggcctggggccatgggatggggcgggcctggctgcaaatcgcctcctccctttggccctgcccccagagggtgggataaaggagcactagggcggccccaccagattcttactaagggctgcagctgggatggaccctgcagggccagacggcagtggccatggtggggagctcagccgccactcccagaggtcatgcaggtagggggctggacctcagggaaacacaggggaggtgggaaaaaattctttggagtttggcctggcctctggaagcccagcctctaagaatttgggatgcatctgataagaagcggcttcctttcctcctgcccaaagttggaagggtctagaggtcatgtctcaccctcatatagtctacaggaggagactgagaccagagagggggaaagacagactgaggctgcccagctgattcaggcctggctcagggtctgaccatctagagcagggattccccactttcttttctttttctacccaacaaaggtttctcttgcccagaaacaccacacagctccatgcggctgggatctggtcttctggtcacctttgtagccccagcacttagcatggttccaggtacacataaatgtttggacgaaacatgccaggttgaacattgcaccattagagagttatgcctttggggataccagctttgtaaaagggcatgctagctcattgggccttccatcattcttacctgagcacaaattcattttgcaaacagctgtaagagatcagttctccaaagaaaactgactttgggtaaaggaggggtacttgtggagcttggggtctcagtgtgtcctggttttcccaggctagaaagaaaggcagccatgtagtagatggggaggttggcgggtaggggaggatgtttactaaaggattgtttttttttttttttgagacggagccttgccctgttactcaagcagtggtgcgatctcggctcactgcagctttcgcctcccgggttcaagtgattcttcagcctcagcctcctgagtggctgggactacaggtgtgtgccactacactggctaatttttgtatttttagtggagacggggtttcaccatgttggccagactggtctcgaactcctgacctcaggtgatctgcccgactcggcctcccaaacagctgggattacaggtgtgagccaccatgcccagcccctaaaggagattttcaattgttccttcctgagccaggacaggagggtggcacctaaatttgggctctcaggttgtaaaaatcctggtagagggcttatttggcagctccacctggcccctcctgctgccaatcatccccttctcaattctcccttttcccacagtctcccttcacccatggagtccagtcctctctcctcgggctcactgttcagggccccacggctccaccccttctttggcttcccagcctctgagcccctttggctgcctccccaggactgcatgacctgtcacctctggctgctctatccctaccccttggcctgagaacttggcctgagaaattccccaaatccagcagccctcacccctgacaagtca

SEQ ID NO: 201 - DNA, 22372 bp, Homo sapiens
taagctgtctctgcattaggcggcaccccaagctcagtaatgctgtggtccctgcagcctcatagagtaccaccttggtggtcctgaataagagccaaaataattctctggattaccaggtagaaattcctattctcttcttgtattttcttccaaacaaacagagtctctctcaaagtctcaaagccatttgtagtggcataaggatcttgcctgtgaatagccactgctctccagcttgggcaacatagtgagaactcatctgtcaaaaaaaaattttatagtaatgctgaaatctaaaatcgtattataacctctctcaacccaccatttccctttccagggaccaagttactcccttcctcccctttccccaggaaagcctacttcctgctttaattccattataattggcagatttcatttatttttatttatttattttgagacggagtctcgctctgtcgcccaggctggagtgcagtggcgtgatctcggctcactgcaagctccgcctcccgtgttctcgccattctcctgccccagcctcccgagtagctgggattacaggcgcccgccaccacgccgactaattttttgtatttttagtagagacggggtttcaccgtgttagccaggatggtctcgatctcctgacctcgtgatccgcccgccttggcctcccaaagtgccgggattacaagcatgagccaccacgcccggccgctttcatttattttttattgctggaaaatgtttcagaagttccttacttttttcccagagtgtcattataagtaagactatataaaactcattttcaactgccactatgactcaattttacacacatgcgcgcgcatcccccaccctcgcctgcccacattcttagtgttgttttgtgtgtttaaattagcgcagatggtaccatatcatatatgtcattctgtggtttatctggttcactcaacaatgtgtttgatatgttaggttctttcctttaagctaccttgtagtattcttttgtaataatatactgcattttatctactcccccttgatgagcatttagactgtttctatttttttgctattacgaacaatgctctgatgaacattcttgaatgtttcctaacgtgtacatgtgagtgtctctatgttataggtttattgggtaatttagcatgtgtaattttcagttttattaggtgctatcaagtttttttttttttttttttttgagacagagtttcactcttgttccccaggccggagtgcaatggcacaatcttggctcaccgcaacctccacctcccgggttcaagtgattctcctgcctcagcctcctaagtagctgggattacaggcacccgccatcatacccggctaatttttgtatttttagtacagacgagatttcatcatgttggccaggctggtttcgaactcatgacctcaggtgatccacccgccttggcctcccaaagtgctgagattataggcatgagccactgcacaaagccttaaacattgcctcaaacctcagtgacctttgcctagaggtgtaaaccttgactctaatctaccccgactaaaggactatgactctggagcataatcttggcaggaagcatgttagaactgcccttctcattgccagtctctgattttatttgtttgatttagcacagattaggggaaaatctgaatatccataatcagacaggttcactggtctgagaagggtgtggaggttgagcacaaaatttcctctccctattccagaacttgggagttacacagttcagtgaacccttgaaggtagaacatcagaggaacagagggtacagaactgaatgtgtaaactgttgatcttctgggcattcctggttgtgagctttcccagtatgagaggtgctcagaacggggtgggccaggcctagtggttcaggggaataacgtgttctgaatgtgtgtttattcttttcaactttattatttttatttatttatttatttgtttatttgttttgagatggagtctcactctgttgccaggctggagtgcagtggcgtgatctctgcccactgcaacctccacctccctggttccagcgattctcctgcctcagcctcccgagttgctgggattacaagcgcccaccaccatgcccagctaatttttctatttttaatagagatgggttttcaccatattggccaggatggtctcgatctcttgacctcatgatctgcccgcctcggcctcccaaagtgctggaattacaggtgttagtcaccgtgcctggccttatttttattccttatttttgagacagagtctctctctgccacccaggctggagtgcaatggcaccatcatggctcactgcagcctcggcatcctgagtgcacgccagtctcccacctcagtctcctgagtagctgggactgcaggtgcacaccaccaggtctggctaattaaaaaaaatttttttttgtagagataaggtcccattatgttggccttgaacttgaactgctgggatcaagtgatctgccagccttggtctcccaaagtgctgggattataggcgtgagctactgtgcctggccttattttaagcaatgccaccaaagggctgaggaaggaatgaagactagatgaactaaaatttcagagaggggagaacttttctgaggtgagttgagtatatacttaggattgggtttaacctagacagaatgcctctccttgggaagaccatcaaaagtttctggtggccatgcaaagcaagttggaaacttaaggggcctctaactatggccagttttacctatggaatatttgctgaacactgggaatgtgcaggagcctggagagtcaggctaaaagctcctaaaaggcagactgaatctcctatggtctggaattattgattaaaaaatgaagatctgctgaggcagagcagggagaagagcctcaattactcaactggtcttctcctcctcaagatatttgccagattttgagtctgcatgaagtagaagcctggagagctagctcaatatcattccgtatttcagggcagagaggatgaatacctgtccagttttcaatcaaaggttgtgagaggccgggcacagtagctcacatctgtaatcccagcactttgggaggctgaggtggatggatggcttgagtctaggagttcaaaaccagcctgggcaacatagtaagacccccatctcttaaaaaaaaaaagaaaaagaaaagaaaagaaaaattagccaggcatggtggcacgcacctgtggtcccagctactagggaagctgaggtgggatgatcacctgagcccaggagatggaggtttcagtgagccatgattgcaccactgcactctagtctgggtaacagagcaaggccatctcaaaacaacaacaaaaggttgtgagaagggggatgaaccaggctgaaacagcaacccagtcctgtcacagtctaatcccagattgaattgaagtgatcagatccttactctatctgcctgatagaaaaaagggaaaactctctttggtagaagatgatatgatatggctcctctatatttactcataatttctggcaaacaatacaaaattgtaaaacttgcaaagtcaaaagtaaacgtgaccaaaattaaagaaaaaaaaaagataatggaagcagacccacagatgatccagatattagagttagcattcaagaatgtaaaataactacaattaacatgtaaaggaaaatagagaaaatgatgaatatatagatgaaaatacggatcatttaaacagagaaatagaatctataaaaaaagtcaaatgaacatattaaaactgaaaaaaaatctgaaattaagaactcagtgtacaggtttaatagcagattgggtacagcagaacataagattagtgaacttgaagacaggtcagtagaaaatactcaaactgaaggacagagatttaaaaaagaataaaaaagaaaaagaaaggaggaagattaggggtaagctaaaatatctaccatacatacatctggagtctcaaaaggagagaagaaagattattgggcaaaagcaatattggaagagataaaaacagtagtgcagccatggataaactggacatgttttctttcttatcttccttttatagcccctgaggccagataattttccaaactgatgaaagatatcaactcacagagtcaagaagctcagcaaacccaagcagggcagatacaaacaaaacaattcctaagaatatactagtaatgctattaaacactggccaggcatggtggcttatgcctgtaatcccagcactttgggaggctgaggtagatggattacctgaggtcaggagttcaacaccagcctggccaacatgaaccccatctctactaaaaatacaaaaattagtcggtcatagtggtgtgtgcctgtaatcccagctacctgggcaggcagaggcaggagaatcgcttgaacccgggaggcagaggttgcattgagccaagatcatgtcattgcactccagcctgggcaacagagcaaaactccatctcaaaaaaaaaaaaaaaaaaaaaaaaaaaaaaaaaacacaaaaaacaaacaaacaaaaaaaactattaaacatcttaaagaagtcagaggaaaaaaagccacattaccttcaaagaaacaatatgactaacaggtaacttttcaacaaaaacaacagaagtttgctgggtgcagtggctcacacctgtagtcctagtactttgggaggttgaggcaggcagatcacctgaggtcaggagtttgagaccagtctggccaatattatgaaaacccttctctactaaaaattgaaaaatcagctgggcgtggtggcacatacctgtaaacccagctacttgggaggctgaggcaggagaatcgcttgaacccaggaggtagaggttgcagtaagctgagattgcaccactgcactccagcctgggcaatagagtaagactttgtctcaaaaaagaaaacaaaacaaaacaaaaaccgaaaaacaaacaaacaaaaaaccaatggaagccaggagacaatgaaataacacatttaaagctccaaaagaaaataactatcaacctgtgccaaaggataaatgctacaaaaataaaagtttaagaaagacacttttaccaaaacaatcttgaagaagaacaaagttataggtctcacatttcctgatttcaaaacttatgacaaagctacagtaatcaaaacagtgtggtactgtcataaagacagacacactggccaggcgcggtggctcacgcctataatcccagcactttgggaagccaaactgggaggatcatgaggtcaggagatcaagaccatcctggctaacatggtgaaaccctgtctctactaaaaaatacaaaaaatcagccaggcgtggtggtgggcgcctgtagtcctagctactcgggaggctgaggcaggagaatggcgtgaaccccgggaggcagagcttgcagtgagccgagatcgcaccactgcactccagcctgggcaaaagagcgagactccgtctcaaaaaaaaaaaaaaaaaaaagacagacatacagaccaatggaatagaatagagagcccagaaataaacattcacatacatgatcaaatgagttttgggcttttttttttttttttttttgagacagggtctcactctgttgctcaggctggaatgcagtggtgcaatcatagcttattgcagccttgaactcttgagctcaagcaatcctcctgtctcagcctcccaagtagctgggactacaggcacatgccaccacacccggctaatttttaatgtttttgtagatatagggtctcattagattgcccaggctggtcttgaattcttgagcccaagcaatcctcctaccttggccccccaatgtgctggaattacagatgtgaaccattacacccagcctcaaatgagttttggcaagggagccaagaccattcaatggggaaagtagagtcttttcaacaaacagtagtgggaaaactggatatccacatgcacaagaatgaagttacagcaatacaaaaattaattggaaatgaatcaaagatttaaactaacagctaaaactgaactgttagaacacgggaaaagcttcatgacattgcatttggcaacgatttctggaaatgacaccaaagtcaggacaagaaaagaaaataaataggactacatcaaaattaaaagcttttgtgcatcaaaggacactttgcaagacaaactcagttcctgcctttatggaacttttagcttagtaaggcagtctttcaagttatgacgaatgctatgagaggtgttatagaattgaattacagaggatataaaacttcaaaaatcctcaggggatcctcaagggggactcacatactagtgcagccatggatacattggatatgttttctttctcatctttctgttctagtcccttgggacagaccttgcgtaggtcaagaaagaatccttaactgtattggagttgaaggttcaaatcccattctcttaaaaagtggagtagtggcccgggcacgttggctgacgcctgtaatcccagcactttgggaggccaaggcgggcagatcacctgaagtcaggagttcgagaccagcttggccaacatggtgaaactccatctctaccaaaaatacaaaaattagccaggcatggtggtgggcacctataatcccagctactcaggaggctgaggcaggagaattgcttgaacccgggaggtggaggttgcagtgggccaagatgtcttatgtcttgttctcacggttctcacgttcttttgaatattgcatcatcagtagttagcagtttgctttctctgacatcctactctcaggagggatgactctggatcctctcatttaaaaaattattttatatatagataaaatatatagctatattaccccaccggtaacatagcttctaaaagctcagggtcacatccctgaggtgaccctctcctgccttaaagtgtctgcctgagaaaactcaaggctgccaaaataatttactttgttccagccaatacctgagaataggccaggggcagtggctcacgcctgtaatcccagcactttgggtgggcagctttctttctctctctttcgttcttcctttccttcctttcctttccctccctccctctctctcttctcttccttccttcctttccttttccttcctttcctttcccttcctttctttcttcctttctttttctttctgtctgtctctctttcctttctttctttccttccttcctttcctttccttctttcctttcttttctttcctttttttgagacagcgtttcgttagttctgtcactcaggctggagtgcagtggtgcaatcttggctcactgcaacctctgtctcctgggttcaaacaaatctcctgcctcaacctcccaagtacctgggattacaggcgtgtgccaccacacccggctaatttttgtattttttgtagagatggggtttcatcacgttggccatgctggtcttgaattcctgacctcaggtgatccgcccatctaagtctcccaaagtcctgggattacaggcatgagccaccgcgcccggcctgaggtgggcagatttcttgagctcaggagtttgaaactagcctgggcaacatggtgagatctctcctggtctctacaaaaaaatacaaaaattaggccggtcgtggtgtctcacgcctgtaattccatcactttgggaggctggggtgagaggattacctgaggtcaggagtttgagaccaacctggccagtgtgatgaaaccccatctctactaaaaatacaacaacaacaacaaaaaaaaaattagctgggcatggttgtgcacccctgtaatcccagctactgaggaggctgaggctggagaatcgcttgaaccagggaggcggaggctgctttgagttgagatcgtgccactgcactccagcctgtgcaacagagcaagactccctctcaaaataagaaaaaaagaaaaaaaacaaaaacaaaaattagccgggtgtggcatctgtagtccccagctactcgagaggttgcagctggaggatcgctggagccggggaggcaagggtcgcagtgagccgagatcatgccactgcactccagcctgggtgacagagccagaccttgtctcaaaaaacaaacaaacaaaagacacctaaggacagtgttgaggatggtatcctcaccagtctctgtgggaggatggaatcctaacttccataaatgccagctagcagacatcattgacctaagcacatttacattgactaattctgtaaatgttcacttccctgactctactgaccctctgtctcactgtcccctaacctcattttccctataaaatacccattacttgcatacaaattgcagttgagttcagttcatgctgaactgtttttccttattgtagtagttattactgattgaaatctgtcctttccactttagtgtccggctttgtttatctttgacaaaattcaccagtttgattcaagacagtttccagcccctgctatggagttacactgagaaggaaacccctggaatttagtttcacccctacacttccaatggaatttttctgtttctttagaggtgggcaagggcccttgacaataaggaaactttcagacttgtctaaggtcccacagagagtgcttgatccacctgagctatcacaccccacagggtatacacaagtgtattctttttttttttttttttttttttttttttgtgacagggtctcgctctgttgcccaggctggagtgcagtggcgccaccttggctcactgcaacctccctcgggttcaggcgattctcccacctcaccctcccaagtagctggaattacaggcctggctaattttttgttttgttttgttttgtagaggtgaggtctcaccatgttgccaaggctggtcttgaattcctgggttcaagtgatcctcccgtcttggcctcccaaagttctgggattacaggcatgagccaccgcacccggccctgattcctttttttattctagcttcaagattcagttctaccgttatcggctgtgtgactgggtaaatcactacaccgcaagcctcggtttcctatttaccaaatgggtcgaataatgcctgccacatggggctgctctgaggagtacagatgtaagagatcctgtgttcactgatattttcatgtgggctttttgataatgatacaaaaggaacatgagaactgtgacttctaggccgggcgaggcggcttactcctgtaatcccagcactttgggagtccgaggcaggcggatcacctgagatccggagttcgagaccagcctggccaacatggtgaaaccccatctctagcaaaaatacaaaaaattagccaggcgtggtggcaggcgcctgtaatcccagctactcgggaggctaaggcacgagaatcgcttgaatctgggaggcggaggttgcagtgagccgagatcgcgccactgcattccagcctgggggccagagcgagactccgtctcaaaaaaataaaaaataaaataaaaaattgtgacgtctcactcaggatcagcgtctttaagtggccacctccccaccccaccttcatgcctccctcctccttgaatcgtgtgttagaacgctgtgatctggtccaaactccacggagatgcgatgcgatgcgaagcgatgttgggcaatttcaactccctgtctcggtcgccacctaggattactgcatgttcagctacgacctcatcaacatggctgctggaagtcgtctacaggaaaaagaaagaaatgacactgaaggatcacttccgcttccgttggcgcaagcgctttcattttttctgctaccgtgactaagatggaagcgtttttggggtcgcggtccggactttgggcggggggtccggccccaggacagttttaccgcattccgtccactcccgattccttcatggatccggcgtctgcactttacagaggtccaatcacgcggacccagtaagttctcggcgctttcgtttgcgtagcgggagggaccgtggggcctggtgctgccggctggttttgagagcccgggaaggtgaggcggggaccccgggggcgcgcgaacggcaggggagctcagggcgcggagtcctggagaatgcagaataattggaaggaattatagaaaatcagaagcgcagctcagtgcgcggaaagagggcgcagtccatcccccctctcagctcccaccgttctcactctttaggaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgtaagtcatccagagaacaggagagtggttcccaagtagagaggggagtcccctgttttttattcccttcgatgggatggggggacttgttgcagcgggggactggaagagttgttggaggtgggcgatctgtgtttgcaataaagtttttggcattaggtgtaaaatgggggaaggtgtggtaacttcttttggggatgggtggagaccccgacttaattctctcccttttctcacaaccaattccttttaaggattgatgaggagcttctgggagatggacacagctatagtcctagagctattcattcatggctgaccagggccatgtacagccggcgctcgaagatgaaccctttgtggaacaccatggtcatcggaggctatgctgatggagagaggttcatatgaatacaaataacttatttcctttaccacccaacctagtacctgtgtagtatctcttctgtctcttctccccaagtgaatcccactttaactcagaccccatggtccccttcttcagctaagatgaatctaaggtgaaatgagttttgacccattgtgtcctgttagcttcctcggttatgtggacatgcttggtgtagcctatgaagccccttcgctggccactggttatggtgcatacttggctcaggtaagtagtaagtctagaggtgggggaaagggaagacaaaaggaaatggattagtggttgtctgcttttctcctgaaattctgatatgagggatgggctgggatcgctattactgggcagatggttttctttgtagtctgggggctgtaggtgttgacactgattccagtgacaagatgacatgactgggagtcagtagacatgcaaagagaggacaccctagaacttcttcctgaagtggctcttagcttattttctaagcagagttcattctggtgaggcaagaagtagaatgtcatctttcactctaatgctttttataccatagatttgagacaactagcctgttattcagcccaatatccccccatggttttcccccaatctccctagcctctgctgcgagaagttctggagaagcagccagtgctaagccagaccgaggcccgcgacttagtagaacgctgcatgcgagtgctgtactaccgagatgcccgttcttacaaccgggtgagggatgtgctgggaacctaattggcgggctctggctacttgcaatccctgggtctctatgctttgaagaacagattgccttacttgtgtgactcctattttcacattggggaagacctccacctgacctttcatttaaggacttaaggcgtgggcattattgaatgctctgctttcttccagtttcaaatcgccactgtcaccgaaaaaggtgttgaaatagagggaccattgtctacagagaccaactgggatattgcccacatgatcaggtgagtaatagggaaaaaattggtgacagacttgggaggtctttggcttacactaagctgggcttttctgggaggctcacccaggaaaattttctgggtggaaagttttggttggacagtacagctatttttaggaattgatccctttatgcttcacaattttattattctgtcttccttttttagtggctttgaatgaaatacagatgcattatccagaactgaagttgccctacttttaactttgaacttggctagttcaaagatagactcttcttttgtaaagtaaataaattcttcaaaatgcttgctgagtggtttttgtctgactgggtcacaccaagtgcaaaactgctgagtactgccatgtgccatctccctccctggtcggagaacccttgtggtcttgcagcacacacagaaattctctctgcacaacacagaaagacacactagcgtcatttggagctgtattagaagcagagcttcctgtagaagccagacttaatttttgtgtgctaactggcttttgtgttcaaattcccctcccaaatcttcctccactgcactggattatcaaatacagatttcttaatgttggctgtgattttcattaaaataccactttaaaaataatctagtagaactattctgcatcaggttgccctcaagtcagctggggcatcagccatccctggaatggttctaaacctgaatattttagagacaaaagtctcattctgttgcccaggctggcgtgcagtggcatgatcatagcctactacagccttgaatttctgagctcaagcaacctcctgcctcagcctcccaagtgctgggattactggcatgagccatcatgcccagcttgaatttttaaaatgaacactgtaggcgattctgacacaaatcctctccaaacttcttgagaaagaaaatataggcagcaaattcaaagtacagaaattcagtgagaactgaaggaaaaaataaaaccatccctccatttgcattgtccgttaacaacaaacttgtaaagccaaacaatgagctttcaatctgaaacctccacacattcagtctcaacacaggaaacagtcaataaatacatgtttattgattaaactgaattataaaaaacaaaaccaaaaaaaaatttccttctactactaagccatgcaggcagagtccacaaagacaacttcctggccaaaacccagctgatccactgttggtataatcttaaaaaaaattacccatcaagaaagtcaatcgtgtgcagaagacaggaaccccagctctgctaaggctgtggctgctgcagagactaccaaagagtaggattaggttgtagatagacgtgaccaaccatagttcttgaactttctcaaaggcaaaggctgacttcaaagtccattgtctgtcaataaaatggcatcaggcaaaaagctggggaagagaagcccagatggatccttggttgttttcagatgtcaaaggttcacaaagctggccaagctgtttctggaagggacttttccagttcactatattatagtgtgctgggggatgaaaaaacaaacaaacaaaaaagcagggtggggtgggagaaatgggtggtaacaaatgtcacacctgtaccaccaggcccatcacatcttgagcattccccagtctgtgaaagcctattaaacagggtcacctagaaaaaaaacaagtttataaatccatttcccctcattttattaaatgttccacttatgtacattttaaagacgaaccatttacaagcttgtgcagtttgcctccttggctcacaggaggggaacattgtggaaagcctcaggataaacagaagacttggttttttgctccttttctctgtacggtacagtacgttttggtttacaaccatgagtacatacaattaaaaaaatccctcatgcaaattgtagaaaaaattttctttccttgaagctggcagtgaaaaataaagattcatgtcattttctttgtgcacacccctgtgcgcttcttcctgtcagattcttccctaagtattaagagaaataggggaaagccacagagcacgctggatttcaacaagtggtcttgtctttttaaagttcaacacttcttgaacaattagctcctggctgtaggaccagtaatcccttaaacaggcatgctctccatctaacaggatgaagttcagtaaagcagggactgcccctgggggcttacaggatgaagactcaaactgggaatggcttccaccctaaaactgtttgatcgcttcagtatctcttgcttgctaataacacctgtatgatcctttgtccagagggatggatggtgttgagaatggggaaaggggccaaggatcacaagtgcaaaaaatattgtttatgtcatgttttggagggaaggtggtgaggaaaagacaaatctattcattctggataattaaaggtggtttcatgcatttttaaagccacaattttatatctagggttgctgtagaaaccaacatctctggagagggaaggaaagaaaaggagaaggaagagagagttcagtgggactttttttccattttcatttttatataaaagtgttaagaccacaatgaaaaaagttttttatccatatatataataaaccagtttgtgagctacataatttgtctttcccatcttcagaaatgttctcacattaacaatgattagatagcatcatgcccaaagacattggccacacaataaaacaaacaaaaaaacccagtactatgatacaattgaggtaaaaggggaaacaaaaaaatttaacatttgcccacaaataattttttttctttttcttaattttgtcagaaaaataccaaacacagtgatttaaatttaaaaaaaaaaaaagtcacaaaaacctgtttttagcagaagtgaatgaccaatgggccagctccttggctcagacgtgattactattggttttcctaattaatccacaaatccacagggaagtgtaagtcaacttcaggggggagtggtggtataaaattaaaaaatagaaaccaaataccccacctggtatgcccccttttccctaagcccctttaccctccctcacatgttcccaccctcactccacaccccctcatgaccccaacactcaaatctccatcagatctaggtcagcttcttcaaagccatagaaagactcggtctcactttcaccctcaaagagctggtgaagactttcaggctcaattgtctcttcaggagatgatctgggtcgtggagtggaagactcagaatgttccccactcagcttcagttgctcctctagggaggcaattagctcctcctgcatgtcagcatttcttgtaggtgagttaatgttgccatcggggccaggcagaacactagccaccaggaaggagcgctgaactagctctggacagtccccaatgacacctagcacttcacccagccagacaagcaccagctgaagcaggacatcagaatcacatgcagtatctgccatttcccgagcctgttccttccattttttatgcaggaagttcttgacagttcttttgatgcatacatctaatggctgaattttggagctacagcctgctgggaccactgcaggcaaagtgctagaggcactaagcatagccagtacctcttctgacaagtgagtgcgatgacagtccatcacaagcatgcctttgctgcgctggcaagctgtgtgcttctgccacactcgagttgaccacagctccatgatctcgtcatcactgtagccactctcctttgcctctagcaatatggagtctggcatgttagcaggctgatccatctgccctctgtagaaaaccagggtgggaaggacagtgccatctgccagaatggctaggactacatcacaccaaggttcccctgtgcccactgtctgcagggcattctcctttcgatcatcactgctcagcacctctgtatccaggaacaaagagatctcatcaatagccacaatcatagacaagggtaagtcctggttgtgaatctgccgttgtacaaaatcaatgaagagtcctgcattctctgctacatccttaggtagggtgtgggccacagctcgccgggcatggggagtcaggtggtgccgcagcatgaaacgcacagcccactcataggagatcttaaaccccccttccaaagaacgtcctattttggtggccttctggaacaaggtctcctcatttacaggtagctgttgttcgcgctgggttagcacccactcagccagtttctcttctgcctcaaagctcagatatttgccctctagattctccccctgggaggcctggaaacgtcgaagccaacggcgaatacgtcgctggggatttcggaagtgttcagctgcctgttctgtattgcagcatagagcaaacagtactactcgaagcttcttcacagacagctgctcctttttgccaactccaccactaccaccaccacctgatgctagctcaggttcttgggtgactgggctcccttcatcctgatcatcaacattcagacattcggctccctctgtagccagcggtggaagggctaaagcctgcgggtgagtgggggttggtggtggggttgcagttgaggctggtgatgggagtgctggggctaagggagttagtagctcttcaggctcagctggggtggcccccgcagatttcacagtggcagctttgttagtggggaaggaaggaggagggtacatattcttcacgttccggtcatgcactcggtcacgagtctggccatgcctaaaggggtgaggagcaaagagaagaggagaaatctcagttcaactaggaaattgaaacaataatatgataataataataataataacagagtaaacacactgcaaaccagaaattaaattgtgaggtgagtttttgttaccttgagtgagctatccaagtgagtcctatggaaaatgaaacaacaaaaatagttagctcagtgaaaaaataagccctccaaagacagtgccctgggattcaacttactacatacaaatacgctgttcgcagtgaccagctttcccagttttatataaacttcaggtcggaaggtttctaattaggtccagcacatctcaacagtgaatgagtgaggccaagtaggtatgctcctgatgcatacagtacgaacctgtatcttttttcctccccttgctcaactaatccccttctctcctacttaccccgtggcaggatgctgctggatctgtgagaggggttgaataccaaatgcttggccatagcatcgcccacagaggtaacaaaggtacatgaagtgcaggccagcttgattccactaaaaaagagaattgagactatgtaagacaaacacagcagtgacacttgagaccattaagctttgaggcttaagaaagaaaaggaatgccctcccactttctcctttttctgaaattaattcacataaccacctctccaaataatgaaaaacctgaaaattaatgtaaaaacctgaaaaattaagatgctgccaataagttttttcttacctcacagaatttttaaacaaagccaaatacttggggctcttccgtggaacatgattgctgagaaagacaaagaagtggtatgagttacggagttctgctggctaagctagagatcaccagccagtgacaatgcccccaacaaaagagacacttcttcagtgcaccctaatctcaacctaagccagttttcctgtcaccatgcttcttaaactttaatatgcatacaagtcactgaggatctattaaaattcacattctggttcagtaggcctagggcggggctgagagtcagcatttctaacaagctcccacctaatactactggtacttgaatagcaaggccctatgaaattagagcacagaccatcaaaaccgaaaaaacagagcctctcactctgctaggagagaagaacaaatagctctaagagttgaaggaggaaacatattagaagcaggggagaaaatgaaatgagtgctcaagaatctggctggggccgggcgcagtggctcatgtctgtaatcccagcactttagggaggccgaggcaggtggatcacctgagctcaggagtttgagaccagcctggccaacaaggtgaaaccccgtctctactaaaaatacaaaaaaatcagccaggcatggtggtgcacacctataatcccagctacttgggaggctgagacaggagaatcacttgaacccaggaggcagaggttgcagtgagccaagatcatgctattgcactccagcctaggggacagagtgagaccctgtcttcaaaaaaaaaaaaaaaaaaagaagaagaagaagaagaaaaaaagaatctgaactctcaagctaaaacactggttaaaaaccaacttacttgatcatgtggttggcataagctcgagaacagcaggtgctatagcgacacagagagcagtgtacgtaagtagggaaatgattagggaagtctgggatctcgaagctgcactccaggcatgtctgccggcccatgacactcctgtgggggaaaaaaaaaaagaattctcattactgcctcatgggtccccaaaatgtaggattttcagacaacaaaccctgctaaaaagctaccagattgcactgtgtatcaggaataatcctggccacccagtccccacccgcccagcacttagaagaaggcgctgacattttcctaacagctctcttctggatgctgcgctggacagggggataaaggaagacaggcagagggtccattgaggaggtcagcggtgctgcctcctgcaaggcgctgggaggtgtatcattagaggatacaggaacagttcgtggctgccctcgggaagcccggattgtcacctgagaaccaagggaagtaacaatgagacatcacccacactaaatttcagaatactgaaaatctctattcctccctccctgggcctataaaagacactggcaaactctttaccttggtgcctggtttcaagccctccagctgcttgggtttacggaaggttttatggtgttgaagcttgtgttcaattttgtccttggcaaagagaaactgcagccggcatttgttgcagtgataaacatttctcttctgaagtgggggagggaaaaaaagagacaaaatcccttaaaggttcctaataaattttcttttttgaggagaaagcagatcaatgtcaaccatatcattcttcccacctttctgttgataatttaagagagtaagaaagaaatatgcaacatgaccacaaaacctaccattgagaatcatcacctcccatgatatcaaagaaagatggattctagtccaggatgactaagttctcaaatcatcctttcctgacttgttttaacaatttgaatgagtgatgtaacctttatttgtattatatctttacactgctgacaactggacattcttctggacattcttcattcttctttttttaaaaaaggacaatgtacatagtaaactaaagtcatacttttttttctatactcttccaactttgctttcaactccaacactcagtccccttccatacaaacaacttattaccagtttcctgagtatgctttcgtgggcagtctacacatataactgtatcacaaatacattcatatccaatcattacctgcctcgccccctttttttgagacagggtctctctctgtagcccaggctggagtgcagtggcatgttcatagctcactgcacgtcccaagtagctgggactacaggcacgtgccaccacgcccggctactttttgtatttttttgtagagacggggtgtcaccatgttgcccaggctggtcttcaactcctgggttcaagtgatctacctgccttggcctcccaaagtgttgggattacaggcgtgcatcactgtgcctggcccttacttttttccctttcctttttgtagagatgttgtctcaccatgttgcccaggctggactccacctcctgggctcaagtgatcctcccacctcagccctcttctttttctccttttaacacaaatgatagcacttgtctataccttgctgttttctcacttaacacatcagtatatacagatatgtctcctggtgagaccactttgaggattcagtctgcctagtattgaagtccttcaaaaatagaacccatgtctatgattttctttagtaggataacaaagctctgtaagcttaggctaagagacaatttccatgcccctatttggaaatacagttgtggtagacaatcagcagtcactactgtgcaaaggagactatgagtgtaatagggtacatatgtttgtgtgcatatgtatgtgactattaagcacacatgcactcatcttattctccattttgaatcctctcttatatactatatacctttcactctcctctagtggctctcttcttgtagtattttaaaacgaagtcatagcttttcatcttataaggaaaataaaagcaataaaaaactcttctttgccacttcttcctctggatttacctaccctgggtcctccctttttataaataaacttctttaaatacatcgtcttcatttccttacctctcattcatttgttctgctgaaatgtgacttccaccctaccaaccaacaaaatggctctcatcaatgttgctaaattaaaggcctgtttctaagtctctatgttgcttgacaccttcctgtaacatatgacattttgatcacacccttttctttaaaacactttcttctccccagtttccttaaggttaagactcttctggttttcctcctagtactatggtggttgctttatagataagggacttcaaatatcctaagccttctcttattctcaacagggttggggggcccatggtatttaagtttaaaatctataggatttatataacgctgattcctaaatcttttctacaacccagagttctctcacaggcttgagatctattatccaacagctacacttgacatccacagatactgctaacttacaatatccaagctcatgatctcccccctcacaaatatactttctctattgtttctatttcagcaaatagttccctcattcacccaactgcccaagacagaatcttaggcactattcttaactactgcattgctaccttcacctaatccatctctacatcataaatatcacaaatcttctgaatatctctcaactctaccctctttttatttcaaaagccaatagccactatcatctctcacctaaactactgaaaaaggccttctagctagtttccctaactgtagtctcaatctcctttaatccattctctgcagtgcaggcagtataaagccttaactaaagctgaacacatcactccagggcttaaaacccctttagtggcttcccagtgaattcttttcatggcttaaaagatcctccatgatctgtccctgcctaacttccaacccctctgtctcttacaccctacactgaatctctctcaatttcttgaacctccacaattttgctttgtgccttgggcacactgttcttcgtcttatttcatctggctcattcttattcatccctcaggtattgaacaacacttctttctggaagccttactaggcacccagaatagctatgtgattttctatatcctataatttccccaacacagtactcttcatgttttattgtattgtttgccttgtttactactaaatctctagcatctagactagtacatggcacattaagtgaattcaataaatttctgcaaacatatgcatattataatctctgcccaaattatttgcctagctcagccctggccccagcatccatgtttaaaaaaaaaaaaaacaagagaatatgggaattgcttggtgcctagtacctggtgcctcatgtaatgctgttggaatgcattgccatttttgaagaccttcaggcaataagggcagagcagatgccgggtatcctcatggatcatccgaaaatggacatctacctcagagtagagtgaggagcgatattgacacacctgagtcacataggagggaaaataaggctaagaatgaagtgaacaactgagaggccttaaaaaaaaaggtagcaacaaaaatttttaaattaaaaaaaaaaagttttctcaaatgcatagaaatcaaattattttcctgactttgtaatgctgggctatgtttgt

SEQ ID NO: 202 - DNA, 240418 bp, Homo sapiens
accttgcctggcctaaatttgcattattaatgtaactggaatctagtttgtagacaaactgacagggttatgaagaaggtgatttttggttaacagatactttaactcttcacccaattcaagctgctattggtgaagagaagcttgaagctgctattgagaagacttttatccaataaaagtcttggattaaaagtccaagacagtagctcaataatatccaatccaggacttttatctaacacttttatccaacttttaatccaattcaagctgctattgagaagactttcccattaagagaactggaccggagaaaggaagattattcaaacaagaaagcaagagaatgcttattgaaagccgagtaactggagtatattctttgattaaaggcagtagagtttatacttctttaggttcatattaatggtataccgtaataaccatatcattagaagggtaaaaagtcttatttccccctccacactccaagactctgtatgcagtagtaatctctcttcattttttaaaaatgaaattgaatgctatggaaagacaaatcattgccacaaattactatgggcaagaaaactggaatatattacaaaaatatatttaatggaagcattctaaactcattgtttcacaagtgtcctcaagctatatgttccctttaacaaaaactaaaacaaaaaactgttggttttgcattatggaaagtgtttatgtaaataagacaatctagaactcccaacagtagatcgatggtcaaaaggccttggcccagcatccaaagactggctaatgaatgcataacggtaggtttttagtgaaaatataatgcttacatcatatatgtataatattttatagttctctactttaactttttagaatagctgaagaactactcatcctaatcgtttcagctctctaagacaaatttcccctcttcatgttgttgaatgtggcaggttccccttttaatatgaatatcgtaagtctgggtttggctctagattaataactagtctctgtagatatgaccattttcctcctaagttttctactagacattatagggggagatgtaaaaatcaagacaatcgacttaaaaaaattattttcaagtgatgcctgtttaaattaaatgctctaattccacctaacaaagcctttaattatcaattttcttgcacagcagctcactcccatcagacaatatgaaatcacactctttaagacagaagataaactagaaagcttaacttctgtcttggtcttcatttctgggaacacttttacaaatcaagattagcagccatgaaccctaaggcaagtccctgtgggtcaggattagagcatattcacattaaattacttagtatatgttctaacatggctaagtttcaaaaatacagaagggttatgcttatttgccatattcccttcaaccaaactgaataggcagttacataacttgccaggacaagtagtagaaatgagtcagagacaggaccaaccctagtaaaaattgtgaattaggcagtttgacttcagtgccacacccctttagtactacatatacttccttgatcccctcccttggtatcatcagccccgagggccaccctcataccacatacctctcccccaccaaattcctctctctgtctttcactcatcatcgaaactggcttcccctctttcctacttccccttcgttaatttgaatttgcagctccagtatctctctcctttagggtttaaaatgacaactaactaatctgataaaccaatccacattaacgtgtgaagagagaaagctagaaaataaagtgaattttaactatgactttctaaagataaaacctttgcagtttaactcattaataactaaaagtgagaatttctagccaaaaaatttaggtgagggaaatgttttggttcgggtagagccttgaagcacctggaaaatcaagtaagaatagatggttgcttttatggtgtagccagctctaataagtgtaactgactagccctggtcagtttggggccagtaggggaaaacgggaaataagctaaatatacaaaagaagttcatttgcaaagaaaagtggaagttacaggagcaccacaattaaatttttctgtcttagtatttcatagatctagcgagtcctggtgcctgtaaatattttccaaagtttctcttcagaacgaaaaaattaagtccaaaaattatctcaagcctaaaatatccagcaattccaaaaacctgtaaagctttttgttgtttggctttaaaaaatagtggcctaaagcttacagttttcatgcatatattgtatttgctcctgctgaatattgaaaaaacattacaggctatcatgtgtggaacatattcgctattcttatttccttcactttacaaatgaggaagatactcaaagaagttaagtggcttgccaagatttgtacttaggttttctgagtgcaaacgctgtgttcttttcaatgtactttgtcccagtgtttagttatctctgtcatttctgtcatgtgactctgcatcctaggggaattctcaaattttaaagagcgttcagctactaccaaaagaaaataacttttgtattcaatggacctgaaggtaattctagtcctatctggtttctatcactgcattttttttccccagctaattcttggttcacttggaagtgttagtattgcctcacaaagtcttccttaagcactgtcagaatttgtgcttcaattatctgctcatgttttagtggattacttatcttgcttctgcttctcacctgggcaacgttcccatcacagctcttactctgtaagcaagaaaggataatatgctcctgggcttaaagtagggaaaaacactaacatagttggtacaagccagaatgcaaatatttcacattgagatgaacacaagaagccagctgggaaaacattgctatttacagatttagattagcccagaattcatttcagcctttgaggtaaaaggtggcatttaaaaatcactggcatttaaaacacacactcttaacactttggagagatatagacccctttgtgaatttgtcaaaaaattatggatgaagctgggtgtggcaatgcgtgcctctagtcccagctacttggtaggctgaggctgtagattcacttgagcccaggagtttgaggccgctgtgtagtatggctgtgcctgtgaatagccactgcactccagcctgagcaagagagcaagacccatcttttaaaaggagaaaaaaagtatggacattttccctagaaaaaagcacaatcacacatacctggaatacagtctgggggctccattatgtggttgtccatgggtccaacataaaatactggaatacagtctgggggctccattatgtggttgttcatgggtccaacataaaatattcttgagttagagtgtgtcatgagtacggtcccaaagtgatgaacaacccatatgccacttaaaggccaatatttattatggccagctttctaatttccttagtagtagcagcaataaatgatgtggatcttttataacaaaagtaacatatggttgtaaagattttttttaatttcagaaatgcaatgttttccgtaattataatcctcaaacagttaacagaaaaatatctccatatatatttatagatataggtatttttaaacagaaatcagatcatactatatggcaacttgattctgttgctagatcatatatattggtttaccagagtttaatcattctgttagcatggacatttattttgtttttgattttataactatcaacaataaggcaatgaatatccttgatcacatatctggtcatgtatataaatatatgtaggataaatttctgaagtagaataaattaaaggatacaaacataaattgtgaaagacattgaaattgtacttccaaatggaataaactaacctatgatctttctattacttacagaaactttttattatattttatgtagtaaaatgtacaaattattttaagtttttggtttttatcacgtgtagaaacaagactcaaatgctctaaataaattcactcatacctccttctagtatgttatgactcagatttttatatggaaatctaaatgttattaaacagaaaagagcttaagggtagatcctagaacatacaggaatttgaatatgatacagagaggatttcgtttctgtggggggaaagctgaattattaggtaaagatgtggggacaaaggggtcgctgctgctaccaccaaaataaattccatatggatgaaagaataaaatgtgaaaaacaaagccataaaaattttaaaagaaaatatgggagaatatttttggtaacagaaaaaaaaatggcttttaagcagagaaaaatatcctcaaatagaatagaaaattataactgtaatgagatatcattttacatctattagactgggaaagataaaaacagtttgataatgctgtattggtgaagatgtggggaaacacagtatgctatcaaactttccgtctttgttaggatgactggaacttgtaccacttatctggaaggcagcccggttttgtctatcaaaatgtaaaatgtgagcgggcacaatggtccaacgcctgtaatcccagcactttcggaggccgaggcgggtggatcacctgaggtcaggagttggagaccagcctggccaacatggtgaaaccccatctctactaaaaatacaaaaattagccgggcgtggtggcttgtgcctgtaatcccagctattcgggaggctgaggcaggagaatcgcttgaacccaggaggcggaggttgtagtgagacgagattgcgccattgcactccagccagtgtgacaagagcaaaactccgtctcaaaaaaaaaaaaagtaaagtaaaatgttctttaatctagcaattttacttctagaagctaaacctacagatgtacaccacatgtaagccagaatcgtttacaaagagatatatttcaacttgaaaccccgtctctactaaaaatacaaaaaattagctgggcatggtggcaggcgcctatagtcccagctactcgggaggctgaggcaggagaatggcgtgaacccggcaggcagagcttgcagtgagccgagatcgcgccactgcactccagcctgggctacagagcaagactccatcttaaaaaaaaaaaaaaaagggaatagcaaagacttggaaataacgtatatgctcattgaaaagtgaggagttaaataaattatgctacatctaagcaagagaatactacacagcctttcaaaagaactaggctcatctaaagcatctgataacagaaataaaatacatattatgaagttaaaaaatcaatatactagatgagtaatatcctttggaaaaggatatttaggtgtgtgtgtctgaaaagatacacaagaaataactaggtttctcaacaccgtaacctgaatgatacacatcatcccgccctttgcctgtacctagttgactgcttgagcctgctgctaatcattctaatttatactttattttaatattttttatgtaactcccactcatttattttctttttaagactcttcttatttttgaatggcactcttccaaatgaatttttaaatcattttatcaaattcctaaaagtatcctgttggacatttgattagaattatactggataggctgggtgtggtgggtcacacctgtaatcccagcaatttgggaggccaaggagggaggattgcttgagcccaggagtttgagactaatctgggcaacatagcaagacccctctctacaaaacttttttaaaaaattagctgggcatggtggtgtgcacctgtagtcctagctacttgggaggctgaggcaggaggatagcttgagcataggaggttgaggctgcagtgagctgtgaccacactactacactccagcctgggtaacagagcaagaccgtgtctcaaaaaaaaacaacaataaaaaacccaaaaaattatactggatatataacttacttttaaaagataattatacattctttcaaccttggtatttaatttaaaagaagattgcttttttatttcaaacattgttatttctcataagtctgtcatgattctaaaattttttttagagaagggatcttgctgtgttgcccaagctagcatgcagtggctaatcataggcacaatcatagtccactacaaattatatcatttttaaagtatgtcttataacttttgtttatattttacattatgtatgtatttattttttttaaataaagatggggtcttgctatgttacccaggctggtcttgaattcccaggctcaaacagccctcctgccttggccttctaaagtgctaggattacaggcgtgagccaccatgcccagccagttttataaatttattttagtgtttatttttagctacttaaatttctgtggctactgtaagtgggatggattctttttatattgtattttcaaattggttatgataatacatgagaaagctcttgattttcatatgtttttttattattattattattgttatttttgagacaggatctcactctgttgcccaggctgtagtgcagtggtgggatcatggctcacttcagcctcgacatcctggcctcaagcaatcctcccacctcagcctccagagtacctgggactacaggtgcatcccaccatgcttggctaacttttttattgtttgtagagaaagggtttcaccatgttgcccagactggtattgaactcctggactcaagtgatctgtccacttcagcctcccagagtgttggcattacaggcataagccactgtgccccaccccccgtatgttaattttataactagttatcttaatttatcttttattgcctctaaaagcttttcagttgatgctttggagttttcatattatttgcaaacaaatgacaaccctgacttatttacagtacttaatttcttatttctattttatatctaattgcattggctatcgtttctattgttacaatgtgatggtgaacattcttgccttgtacttgacttcaataggaataattatgatgttatgttataaaggaagtggctggctttagtataacatatatatatatttaaattattacaaattctaatttttattgggaatgatgctggactttacaaaatccttttcagcatcaactgagatcctcataatgttttcctcctttgacttactaatataatcaagcatatgagaaaattttctgttattgaactattgccataactatacacatgaaataatttctcttaattttgttatattatttgtaatgtagtgctgggttccatttgttagtattgacttttacattatatccaaaaggaatttaacctgtagatttcccttgtgtgtactttttaacagattgtattttaaaaccagtctttcagctcatccaaaacagagggattactggtgaaaatgccttgagggcaaccacctgaaatggccttaataaaaaaaaaaacacgaagaagaaaaagaaaaggaaaaaagctaacaacactgtggtttgtctacttttgcggaaatttacaacactatacttgctataccttctttctgatgtgaatccacaagctattgcagccattaattaaggatattgcttttctttccaataaatacatgaactttctttcagaggcaaacagagacagatgtttcatgaaagtttctgttcttcccaacctgcctttcctacctccctgatagatgatccagaacatttaaaaatgggggaagaactgagaaaagggctccaatcatccacttgtgtttcccatccaaggagcctggcctgttatttactttcaccacttatccctgctgctgctgtttagtttttgttgttcccctcaactgactttcctcatctttgctgcattcatcaaagcccagtgtaaattcccctcttccataaactgaggaatccagcccattttacatagcaaactttctcttagctgctacctactcaaagtttggctgcacattttagctataattgttctcaaattgtttcaagagtgctagttttctttcttaggctccaggttagctccttgggagcggggacttagcttaaaatcctgctgtgtattttccgttgtgtttagccctatgagtaatcacattcaatgcatacttgtaaggcatatttgactgaagatatctatcatagttattcatttagtaaatgatataatgaaaactcaagtgctcgccaaagataaatcattactattaattccctcattcatcatacatgtatggcagcctcaggggctagggaacctaggattgctgctttgactttttttggggaagccaaataagcctcagatctctccactttggagccagccatgaaattcagatttacctagggctcaacattaagggtctcagactaaatttatcttcaggtaccctttccagagtggaccagtttaccttatacctctgagaataacccaaaactttcaaaactcaaatcacaggatattatttgttcatgaattcagcaagactctcttgtttaactattgaaactcaaatatttcggcttgcagcaaggaggggtacagctgtctggatataccttggccaaatttcagtgtatatagaaaagtgggaggttatcgactatgttaaaccttttccttaaattttcaaacttcgggattattttagtctcatagataaaataacaaggcaagtatttacaaacttttttcaaaaatatgagaatttcagttttccctagggcatttggcgttgtgctgtcaccacacttttgaagatagctttacaaccgtgggaaaactcaccgggcttttttcgttgaccccgccatttctaagttgctatattgctgcaaggagctggcaaagccatgctcttcctctcccccattctcctcttcctttcaaagaccaaagcgccccgtgagaatatagaaacaaggctgagaggcagcgaagagtaagggaggagccagcacttacgcatttttcactctcctcctcactccctagggtcatagttttgattctgaagttagaagtgtgggggtcgtcggctgcattttcaacttggcctaaaagttggagttcaccacactgcaggcgctaggaactctgccgctcggtcaccaacctgagcctctggctagtccgaagaacgcgaaaagccaggcccaaggcactggttgtcatggcaaccggggcgctggtctccctggcgacctcgtccctagggaggaggtggagctggatgccaggcgggccaatgaggtcgaggggagctcggggtgggagatctgcggtcctcccagtgccggggaatggttgagtgacaggaccgggggggcggagccggcgcggctgcccgaggtggagccccagtggtgcgagtagctccagcggccacgctgaggcgagggtgacacaccatgctcacggcccctggagaccgtcgtgctggcgagccgtgctccgtagctccccggtccgcctcggcagcggtcagagtcgcctacaggagttgagccgcccgcgccagaaggttttggcgaagctcttggagaggcgtcgagcacagtagggcggcgggggtgcgttgagcgctcgggggtcaggcagtcggccgggatcgccgctggggagcgtttccgaggcgaggaggaggaggaggagatgctgctcctcttctccccctccccaggctccttctacagctccttcagcccacgcccgcagccgcttgtgggagaagtggtggtggctctcggcgcccgcggcggctgccggcggcccgccccgacgccgcgtccctgcagccctcgcccggcgctccagtagcaggacccggtctcgggaccagccggtaaggacgagagccgccctgggctctgcgctgcatgtgcagaagtgcaaaacaaagtacattgcgctcgttctcttcctcctctctctgctttcgctccagtccctaaacccaactcctcggttgccctggtagaaggaacttttctttggttttggtggtgggtgtttttgtacgttagagtgggggtggggtgactggagtggggaagaatgagatgaaactccattgctaattaggtagatccatctcctctgcggaagaaagccggattctcgggaatgaaacccacagggggagtaagagattgtggggtaatagggagtgacattgccccgtcgtgcttgcacagctccgctctgtgcgtgcttaagggaagggctcccggagtctgtttctaatttctgcaaatgattgtggagatggtgtggttagaggccgcccagaagaatgtgtgtgtaagggctcgagaagggggtgggatggcggggaagcagaggaagagggggcagagggagagacactgtctgatgcaaggtcttttattgcttttcttctgcttgctaaagttaacactctaccctccggccccctagccccaccgctttgctcattacgtgatactgtaagagcagacagctgggaagctaaagttaaaccaaagtcaagaaaattcttacaaagtttaatttccttctgttgtgaatataatggagagaggaggatggggagaaatatcactaagagatttacagcaatacagttttcattggccatacacgtatatgatcgacaccaccgcacacttccaactaatctgttcgacagccttgtgtcattttcatttaattgcatctttgaaacaacaaacgcggtgacttcatagggagctgcctggagctgagctccctcgcagaaaatggggcaatcgggtttgttttcaaggcaggacctgaacaaaatgtaggacacctgatctgtgggatgaagggcgctggtaactaattataaattttaagattttaaaatttatatctagaaagtttactaaaggatgggggggggagtaaaagtgcatgtattatgaaacaagcttaggtattttcctaaagtcttcatgactgtgttggcagggtccaggtgaaaacttgcttcatgctcattggctgcttgtagtggtgccaatatacaaattatttctcgttttaatatcactaggagcatttgttagtaaattcatacatatattgatttagtaaatttatacagaggcgcactgactgacgtccaatcttgtttattatactttgttcataacattgtgttctacttgatgttctagaggctttgtgggagtatgtgtggggagaggataggatggaaattagaactaaaaacagaaaaatatttgaggttagttgttaagaaaaggactgatttcatagtgtttttcacttttacaattagagaatgatagcttgctttaccattatgtaggtttatctttgaatttgcatttgtcccaccatttttacttgcatgtaaagcctagttatattttggagggtgattaccagcatccaaaaatataaatggcttttcatgtcacaagtaacatacacgcacaccattaaaaccagtgtcaatttaaaagtcagattttaattctatgatggggtcacgttataaaacttaggtcatctttttgttgttgtttttgagggctgcctcctaaatacggtatgtgaatgtgagaattagctaatcatttgttttggagtagataatataaatgataggtgttcatctttaaatgaatgaaatttatgtattctttgttattgagaaaaacgggtgttgatttgttctgtctttaatgtgttaaggattggatggggaagtgttgtagcttctcccgtatcaatggggtgtatatttttccagctcatcttagtgcccagccccaaatgtactggagagaaggactgtaagggataaactattacttcttttttttcctcttcaccctcttcttttgacagagggtgtaatttttaaataaaccccaaaacatttttatgcataattaaattataattaacaccatttgaaatgaaaaagaaacacaaccatactccaagccagtgcatttagtagttactcctgtcaacatattcttgttttggaatatgctttgggagaactctgtgtagttcaaagtattctcctgtttgcctctgatgcaaccaagtacgactcatttgagttaatatcactttacaaggtaggggcctgagaaaggagaaaagataatgggccttaggatagaagaatcagtgctgatggaaatgacgagaatcttttgggctgggcttccttttttttttttttccctgaaaaactctcttttaatttgaaaattaaaatgggtcaaataacttaggaactaaatgttttaaagatagcttttaagatagggtctctgttgcccagtttggaatgcagtggctcgatcatggctcactgctgcctcaacttaccaggctcaagcaatcctcctaactcagcccccaaagtagcaggtaccacaggtgtacaacaccacacctagctaattttgtttattttatttttttaaatagagacaatgtctcgctgtattgaccaaggctaaaagatagcttttaatgagtacattaatgtaggacttttaatggcttaagttaaagttgaaagtttcatactagctgtaaatgtcccatcaaaactcccgtctgtaaactgctttgggaggtggagttctaataatcctttgagtttgggaagaaaatgaaaacacctttaagacccttattcttgtttagtgtcaggcactgtgaataagcaccctgctctatcctgcccaaccctgttcccaagaatgtgtgactgtcactaatagtaaggcagtaggtgggccatttcttaggataaaaagagaagaattcctaaataatcttgtatagaggctggtgtagatttaaaccataaacttcacatgtttttcccagagtttgctatcaaatgcatgggaaatacaggaacagggtctggttcaagtgcttgtttagatgtgtttgccttatcctgtgctctgccattgaatcctgcttttttaatttttgttttgttttgatttgttttcacactggaaaagtatgaaaattctctgaaacaaactgtctcaaagaaaatccttctgcatagtataaaaagtgtggaggactgctgtctgacaaatatgtatccaaatcctagagactaagtttatttttaataatttaataatatatacttctcaaggcttttttgctttgttgtgctttttttttttttaagatggaatctcgcccaggctggaatacagtggcacaatcttgtctcactgcaacctctgcccccgatcctgggttcaagcaattctcctgcctcagcctccttagtaagctgggattacaggcgtgtgctaccacacctggctaatttctatatttttagtagagacgaggttttgccatgttggccagtctggtcttgaactcctgacctcaagcgatcggcctgcctcagcctcccaaagtgctgggattacaggcgtgagccaccgtgcctggtccctctcaaggtattttgaggatgaaattaatatgtgcaaatgtggtttaagtgcaagctgacagtatttagtttgcttccttccttgccaattttctttaaaaaattaaataatcacaaaaacctataactactcaaatcattcttgaatgtgtaacttgaatctggctggtgaaaaggccctctttacctactagccaataaatgtcttttgttgcatacttcatctgtgcttaataaacagtttcttttttttcctcctagtttagtagtattcaactctgcctgtaccttagaatcacctggatagcttttttaagttttttaatttttttttaagagacaagatctcactctgtcacccaggctagaatacagtggtgtgatcatagctcactgcaactttaaattgctgggctcaagtgatccctccgcctcagcatcctgaataactgatactgcaggtgcgcgctatccagctaattttttattttttgtagagataatggtcttcctatgttacccagcctggtcttaaactccctggcctaaagcagttgtccctccttggcctcccaaagcacggggattacagatgtgagccactgcacctggtctggatagcttttaataatctccatgccccggcctcaactcagactattaaaccagaatcattgtggatgagaccctggcatctgtatttttagaaactccttaagaaaccatagtcaactttggaaccaatgttctagactctactagaatagagtgtagaaaatttggttcccataaatgcagcaacattttttgtgttggattatattttatatttatgtattttttctatataaatcttaagaatttaaaacacaaaaatgtctcagaagcatctatgtatatgcctatctacaggcctttttactatttggatgagaatttaaggtacaaatatttccctagagctgtactgtcaaatgtagtttccctggccatatatggtatgtaaatttatattttaattaattaaaattagatacaatttaaaattctgcttattacaactagccatattttaagtgctcaggagccacttgcagctactagctactgtagcaaacagctcagatatagaacatttcctcatcacagaaagtcctgtactgcttagaggttttgaaatttgtgtatgtttcttatcatctgaaatggcatatatataattcctgttatttccttcagatttataatttaaaaatatattgtgttattttttaaagttactttttttaaagtcaggagaaataccacattttttatacatttcctctttcctcagtcttttgtacctagttaaaggtttttcttttcaaagttaactgagaagaggaaatttagtgtccttgtttttattacttatatcagtatgctctaaacctaactaatggcttaattgcccttgtgtactgcaagtttcaggtctggaaatgtgatgtcccaaaatactgaaaatagtcatcatttcaacacaaatgttaggatttgattaaaagttttcctttttgctaaagatcctttttcttttgcatacagaaattctgagttatcaaatgatgtgattgagctttcaacagaaaactgttttattagttttaacatgagcataaaggtgtgagagaaaatttttttcttataggggaaggcatttccttgaaaaaaatgagattcctaaagaattcccaatgtttggaagctaagactgtgtcatcaaacttaatggtatttgccacttggtaactactgatgcacagcttacaagaaactgctgtgtggttcatcctataccccctccttacacacctagaaaagatgtttcctaatcaaagttttattggtttagtatgctctgagtagagtaggaacaataattaatttcaattaaaaatattccttcttggtagatggtattttttttttttacataaccacttttttttttttttttttttttttttacctattctgatcaggtagatttgcctacagaacactgggagttatattgttgaaagaatgcttgatggaatgttttgtgtacgatatcagtttcatgttttaatgcttccccacttagttgtaatagagtctgtggaacaaaaatgaaacattcttgttgaacttaaggttagaatgattatataacctgagattgtgttaaagatattcaaagttgtgttctgttttgttttttgaggaaagatacagcctgggaattttaaaaacttcttttagcactatttaagtatttttgcttcttctaaaaaagtgtaattttaaaaataaacatttaaattatttaggggatgattattttaggtcttagtgtagttaaatatttcttctggaacatataatgtaattcagtttttgaagcaaaaataattagtattttagaacagaagtttcagtttttaatgataaattcccttgtcagtgtcttttatatttctgactttagctgagatgtaatttcatgaaattatttgaacaccatattgattaaattcattctttacacaatctgttctaattttattttgatgctgatttctctgcctggttcaaggaatgagcttaaagcaatgtataacatatgtgaattttctagtactctatgaaaatttaccaagactgaaatgtatttttgtagctgtacttcatgaaagctgggacaggtggtttaaaacaaaaacctaaaaattaaataaaaaatcactatgataatataatagaaactttagtttgggaatgttcggttatcaaatctacaccagataaaactattgtagctataccatttacttgagttccattggagcttaaattctggcactgccttaagtagtatagaaatgaaaaacaggatatgtgttattacatagtacccagagatactgtaacttcagttataatttaacatattcccctatgttcacagtttgtggcatataattcttagagttacagtgaaaaatttagaatatattattctctaatattaaaacttaatatttaatagaaatttccttcaatttttgaacaaaagaaaatattttaatatggttacataatatatcacactgattgtgtgaagaccaaattgagctctgtttttaaggtaagatttcacctgaatctttttcaggtttatgttagtacatcaaactttctaacttcaaagggattttaagattgtattgagatactaacattcaattgaaaaaatgaatactgctgttcttccaccgcggggatacttaagaatcactgtctgtgagccacaatgtttgaggatttttctagatgaatctgtaatgataaatctgggcttatccaacatttgtatacctagttccctttttaattgttccttattcattgattcctattctttgccagacactctactaggcactggtggtgcatagagaagacacatttccaagacaggcaacttaggggaatagtctgaggccacatagctttaatcatctgagttcatgctgaataaatcaatctattggcaggatgtattgtacagagtggctgtgaagataatattaaataacatgtaaattgccttgtaaaacttagcaaacatgtgggtacctatctgaatatatatacaggtgatttgtttttagatgttgctgtgcatggtgttgaccactcctgtttgatttagagaaacagtatagtatggtatttaaagcatagactaggagccagaatgcctgggttttgatctgactctatggtttacaagctctgtgaccttgcccaagttacttaaccttgctgtactttattttcctcatcttcaaaatgaggatgataaccaagcctactttatgggattgttgtgagaaccaaatgagttaatacatgaaaagcacttagaatagtgcttaatacatactatgtgtttaataaatattagctattattatttttagtatacttatatttgatttataacagtttttttaacacggtacaggtaatatatgaacttaaatatggtttcttgtttcaaagtttataggcctactttgttccttgggccacatgttccttccagtcatcgcttgggcttgttgatacatgtgatgtgtgccagatttttacacacttactagaacttgtgaaatgaatgtcatccttttcaaactactataattatttttctgattttttttttttttttgagacaaggtctcagtcactcaggctggagtgtagtgacccaatcacaggttactgcagcacttcaacctcccatgctcaactgatcctcctacttcagccccgcaaagcacttggattacaggcacctgctgccacacacacctggctaattttatttgtatttatttgtagaaatggggtctccttatgttgcgcaggctggtctcaaactactggactcaagcgatcctcctgcctcagcctcttaaggtgttgggattacaggatgagctgccatgcctggcctcaaactactcatgtttagaacactgtatttcctgtttaggaatcacttttaggacatatggcatattgttttaaacatcctttttggtggtatatctcttctttgagagtaggtttgatttaattaaataatatattttttcatgttttagaaaggtgagtgataagaagtataatttgaattaaaatgaaaaatggagtataaagtaaaatgaatattttaaaaatatctaaacataattagaaaagaagattccaaaaatatttttgataacttgtccttgtttacccttctgaagtgtctatttagaaaggtgacactgtcagatatataaattgtagtttgttaaaatgtacatgttcacagtctcacacagaattattacttaatatttgtgaatcttatgttgctatgcttctgaggctaagtactgtgtaatataacctaaaattctttagaaagtgtttgtggtcacatttcctagctgatattgtgcatgcttttaatagcttttctgttaaaaattatttggtatttctcacagaactttaaatatgctctaatgtatgttatgaattccaaagatgatatggtatgtataatttttcatttattaactacagaattcataacacatctcttagcatctcttatacccagttcccttttttaactatataaaatgagtcattacattatatgttttacatgtcattttgtcttcacagctattctctgcaatatatcctgccaataaattgatttattcagcatgaactcagataattagcatcactcagatgatgctaataaagtacctcgacctagtggatatttaagaaactggatttactcttcagggagactagttcatggccattaagatcatttggtacttttgtgctttgcattgtttgacatttaattatttgtaataatatgattaatttatataattaaaaaatcaatatttgacccactattgaaatactaaattgagttattgttaaccttttaacaagacaaaattaatgtctacttatattcattcttaagtgtttagcttttgtgaaaactgaattcaggtagtgttatgacttgtttattcatgttcagacctaaattaggaagcacagtataatagaaagagcaaacacattgaatttgggtagtcctcggtttgagttttagctcttttagtaattagaatgactttggataaatttaatctatttctgatctgtaaaatgcaaataataatatatatctcaaaaggttttgtaagctttattcctgaattatacacatataaaatgattgggcatagcctactgattctgtttacaggaattgtttacctttacttccctcttcaattgtgttactgagagaaatagtaacctaataaatctgattaataatgctgagataaaagcatctctttatcactcagattttagcctctttagtttacattggtttgattaggccactgctattgctttggttatcagattgttttatatgtaagatctttttaggtacagtagctacatataagctactttaagactaaaatggttgacattttaaaggaaacaaaataggtaaatccgccatgtccccttgaatatgtgaaaaatacagaaattgatagaaaaaaataccacagcattattcgaccatttaaaaaatagcaacaattagaaatgttttataaatacatttatttttttaatatcctttgtttcttgtgtaaactaattatactactgtaacatatttgaccactctatgttcagaattattttccgtattttgagaaatattgaaaaataaaagtggttgctaccaaaaaacttaaaatcttgcttgaaacacacagagaaaagacaggaagccattatatattgtaaaataatgattaactgcaatgaaagctttaaggaagaaagtgtggtctgatttaatcaggattcacttggggagtagagtgtgagctgagtcttgaagacattaaatgtctgtagatgggaatggtatgtcatggagtaaaacaaaagataagagtaagtgaattcatgagggaagtgtttacaaagaaatgctgaagatgacctgtcaaagtgagaaaaggatgaggacagagaagggagtgcctaagaaactaggaaaatgttatgttaaagaaagtgccttaggagagtggagggtaaaggaccaatagttccagatgccacagggagccaaagagagaaggctaaagaaaagtagaacattgtgatcagttgaatattgcagggatagaaaggaaattgaaatgggggatgatatttggtttcaaaacagatgaaagttggatgatctgatctatgaggattcatagggtcagaacatttttcctttttaagatcaaaggtggtgaaagaacagattgattctgtgagattaagagatttaaaatggcagagtgagaaagaatcatctccttttatgaggattgtctggatggtaaagaatgagtcctaggtagaggtattcattttagtcagggggaaacaactttttcctgtaagattgaaggaaaggctacaaagatagatgtgggcctattgatgaatagaaataaaaataagattttatagataatttacacttaatgatagtatcttcagaaagtgctgtcataggaggcaagattatctcttggcatataaaatctaaaaataagattttatagataatttacacttagtgatagtatcttcagaaagtgctgtcataggaggcaagattatctcaggcattatttgggtagtggtgaaaataaagagatataggtaaagttgggaatcattactgttgggaaagtaatgagaggttgttaaaggatttatagaggctttgtgagtttgaagttgaataagttgaacagtgatggcctcagtccacatttgcagaaaacgaagagtaaagtgaaagaaattattacagtctataatggtcaagtaaaatatggggcttgtagtaatgaggaaatcccactgaggctgggaggattgggtgaaatggaaagtgatttttttagtagtttctaaatttgctcaataagccaactattgattgaattaaagatatttatcattttcctctatctgccacttttttagaacaagcgccaacaaaggatcttgatcctaaaacaagtatatgatgtttgtttaattgaatatgctgtgtggattagttactgcttggttcacttaatctgggattggggctgtatttaaaatgagccacctacactatacacttagaaaaaaactgtttaaatcaaaatcttactcattttttaatattctgctatagtagttggttttatatttgccccagtgtgactttactgttagtctttatgcttatttattgtgataatcactaggattcataatttaaaattaattgtaagtgctttccacaaattgttttgactactgtctaaagaaatagaaatgaatgaatgaaataatgaaaataattctattctcctcttacaaattagcattatacttggcaggtatctattcctaaaaagtttctaaatgaatcgcatctttccatctgaaaatcagataaatgttttatttggcgtaccgtcaagtgcaatgcaattcaataaataggtttagtattttacccactcaagactagatttttttcttaattcttgaaataacataatgaaactccttgactctacaaatacctagttgattgcataaagtcacctagttgcttgttaaataacagcaaaattcagtatagacctctaaaagtactattttagctagccatatcatctgaaggattgtcattgccttgattaataactgtccataatggtggccagtacattttctgctgctttttgtattgccacatagttctaagaaaaataactcaagaggaaataatgttattccagctgataaattaatcctggagcacttagcattcttttaaattcattaaacctcttaatcatataaaataagacttaaaaatttgattctgtctcaagataaaaattataattgtatgtgctataaacagcaaaattcatgtttatgattcctttaaaactgttaatcttttttttaaaaaaagtctttaaatacccttactaccctaatgagggatatcataaagatttttatatatccatctacattttacaacctttttatactacatgaaaatattttaaaagatatctatgatgtctataaataggattctatgccattataatctgtagattacaccattaatatatacgtgtatgcttatattgtctttcacatcatctaaatgaacactgaaaatgactccaatgataaggtactatttgaatattattgtgtgctaggcactcttttaagaaattgagacgtagtatattatttatctttacagtcctgttgaggtacacgcaatcctgtgaagtaaatgctgttattcttattttacagatgagaaaactgaggcttagagaggcttaatgagtggtagtggagtacacacttgaatccaagcctgtcctactccagtcagctatcataactgtaacttctcatatcagtagtgtcttttgacatgagcagtattaaggtggggcaaaaaatcgcctcaatttccctagaaaagatgaaagagaccttggcagtctaatttggcatctaaattcatgagtttttttatgagcttttaaaacagttcttgcaatgatatattttccttttagcttttcttttttcaaggtcttcctctactaacttgtcacttttgggcttcacagcgccgagttcctataaaactgttgagtaaagtaaagataatgaagtgcccttttgaaaatcttttaacaatgtttagatgctcatcacagcattatttgtagtaatataaaattggaaacaaatagcttagaaaagaggaatgatttattctaaatccttacaatagaattttgtggtcatcaaaaattagattgataaggagctttttgtaacatggaaatatgttaaatagataaaaggtaaaacctggcaaataaagcatgatcataactattgtttttgtgttgccttattttttaataaaaactttcatttaaaaaggccagaaaaaaatagtgagggacattataaagatttgtatagggagaaccaacctattttaggagtagagagattcgactgtgaagaattcactatgtatagaatctggtttgttaagttgaggaacaaattatgatattttgcccgaagatttttttcttctaaatatggaggaagcttactgattctaatgctttatgttattctagccaattcttggaagatttacttgaggctctgttgctgctttacaaagatgactagaaatgatagtacatgcttataaaattaggctgggttgctgctttacaaagatgattaggtaattataatgatagtacatgcttataaaatatactgtttaataaaaatttaattcctcaaaataactttatggtaaatactactgttatcttcctttttatagataatggaaactgaggtgcacttagattaattaaaatctgcccaaatatagatggtaagtgggagagccagcattttgcatctaggcaatctggttccgaagcctgtgtgcctaaacactatgcactaggtattttaatagtgaaaatcatttataacttttagttcagagttggaaataattatcttattaaggtatggccattgagaatagtttatgaccaagtcttcattacatacttagtacgtttaaaaatcatcctttggtttggttgatggcagttatttacagagccccaaactgttgttgactgctaacaaagtttcttttcttctcctttgaattgactctttcagtagggctggatgctttgtatgtggtgatgtaaaaagtgtctgaggagaactacaaaagtttctaaattttagtttatcacatggttttagaattcattcacaattggttgccatttgctcttagttggagaagtggactttgtagcttagagttctttgagacataaaattgaaatcactattaatcctttccctcaactggctgtcttcacatctatttttttcttacgagtcatgtactgttatccctatgaaaatagtttagatgatcatgtaattcttttattaagtaaacagttttgttatcctctgaagaggatgagttatgcagactttagttatagcagataaagtttattattaagtatcttattttatagaataggtaaaacttgtatttatataaggttgaaaatgtacaaagattgaaaagtaagtcatctttgttttgcctccaagtccccttcctggggtgcttttctgtatccttcattttcagtaatgtcaccgaagccaggaggagacataatgttgcactaaactggtgttttagtcttcctcagtgtgaaactttgtatgtaccctcgtagtatgctaaaagctcttggcttttgaaaagaatttatacaaataaagtattcatcttttatatattaaatagcataacttattttttctgcttttcttttttttcctcagattacctcattagtcaaacatgtttcacacttttaacctgttaatccctttcttttgttagcacttagatatcagttagtcgtaaaagcaaacgtggatgtcttagcagtactaattttatggttttgtttaagttgaaaattttcttttaattgaggttgacaaatattgggtacaaccgaagttgtacttcgggggacttagatctatttcagttatcttatagagcattggtgtgcaaagaagctagatacatagaaatttttaaaaacatgtttgtttttctagttttctttccttggcttaagtatgaatactaagactaaatatggagttagtcttattatgtacctaaagtttagattcaacatggtgaaaccccatctctactaaaaatacaaaaattggccgggtgtggtggcacgctcctgtagtcccagctacttgggaggctgaggcaggagaatcgcttgaacccaggaggcagaggttgcggtgagccaagatcacaccactgcactccagccagacgacagcaaaactccatctcaaaaataaaataaaataaaataaagattttggaatacttcctgcagccccagtaatctgtagtttaaaaatgtgccccaaagacagcttcctactattggtagaaaataagaactctttcaaagtatctttctaggaatctatctcccctttagagaaattagaaattttggtcatgcttttatgcagttattctcaaagtcaaaaaatgttagtttgttagaatattattatacatagcctaaatcaagtgtcactagcctaaatgcctgcaggggcaaaaaaggggccagggcagttaagtgaggaggaagacaataatgagtgatgaaaactgtagtgaactaaagagctcagactagataaagtgggaagctactatccaccttgagtgctgccacatctcctatttttccctccaatttttatatgaaatctccctaatttgtgaagtcttctaatttgtaaacgttggaatgcaaatttacacttttgcaaatgtggtgtaggctgttgtcctataggccaaacaaaacatgtcagcaggccaaataaagcccatgggccaccagtatggagtttatgccctagattatcttaacagccttacacttgcatgaacttgcctattctgttttgatacttattaagagataatggtattaataatgattccagctgtctgttttgattaatattttaccttagcatattaatgaagtaaataattggattttttgtgtaggaagagagagcaaaagactagttcctaaaatgtatagaagatgatgtcttatgtgtaaatatatgacttgatttccattatttttcttagaaaaattttattctgatcccctttcattgtcaagttctgctattcttcctttttcctactttcacattcagtatctccctgcttctcccacgattattattttcatttgcaagagttataaaataaaaatcctcttgtacaaactctgtagaaagtcaatcactttgtgatttatttacctgcacaaacttccagacattcttccccatagcattacaattccttacttagtcttaatattacttcttttaaaattgctttttaagcagaatggactgcctttaaggcagttagtgaaaaggcccacagaaaacaatctagaggggtgatctcataaccatgtaagatttgaccctactctatcagggatgattgaactgggatgccatttacagtggttcagtacagagaaataagcataagttagtgaaacttgtagctaagatggaataacagggataagatttacccacctgcctgcaaaaaactaaaatagggacaaaatatgtgaaacaacaattttcaggacactgtacatcgggtaataaaggacagtgatccgtgagagatggaaacaagataagccttatcactacctctacttactaccttgagagagtttccaggctgcggcatatggtgggagaaaccagatggagaatggtagactccctgagttcaggagatggagctgaaagtctgaggagaccaaggcagttagagttaacaggacagagtactagagaagtgagaactgcagagaaaaaaccctggagatctacagatggtcccctttgagtattcagctgagtattcaacattacatgcatgtcaggaaaggaccagaggcctgacaaggaaccacacaaaaggattcaaagaaaccgtacttgtgctcacacagggctaggaatagtgcctgttcccacaaactgggctgcaaatgctcaagatgtatgaagcactgggtagagcacacagaagaatcttacgcagtagtgaggaataattagccctagactgagtactgctctggacaagtccaacaaatctttaaaataagacctgaaaagatcaaactttgaagttttcaaataatttaacttcaagcctgagcaaaactcaaaaatatttacaaatattttacacccaactagataaaatttatgatatatagcatccggtaattttcaggcacacaaagaagcaggaaaatatgatctataatgagaagataataatcataactgtctcaaaactgacacagaggttagaattagcagataaatacattaaaagttttatgtaactatttcatgtgttcaaaagttaagtaggaatatattaaacctctaaagactcaaaaatgaacagaatatctgagctgtgggaactttaagtagctcaacatatgaaatttgagtccctgaagtagaggagagagaaagcatgatagaaaaaatattggaagaaataatggctgagatttttctggatttgatgaaaactataaacccacaccttcggaatctccgtgaacacaaagcataggaaacatgaagaaaattacaccaaggcacattatattcaaactgttcaacacctctgataaagagaaaatcttagaagtagtcatagaaaaaaaagccaaagaaaaaggcaagcgagcatgtgggacagagagaggaaattgggttacgtacagaggaacaaagatgactattacagtatattacttgtcaaaaatagtgcaaacaagaagaaggcatagtgacatctttaaagtgctgaaactgtcagcctaaaatttctacccaaagaaaatatctttcaaaaacaaaggcgaaataaagtggttttttttccccagatatacagtagctgaaagaattgataaccagcagatctgcattaccagaaatgttaaagacagttgttcaggcagtagggtaatgataccaaatggatttacacaacaaaatgaagaacactggaaatgctaactacatcaataaatgtatctgatacttttctaattattgaacttgataataggctgagaaaagtaaattggcccactttataagactctttaaagtgcagtaatgaaataataatggctaacattttgactacttactgtgggcaaggaatattaccttcagggctgatcatgtgggtaacctctgccgagcacttaccaaaattccagattcccataaggaaagcaggtgttcagcataaaccacattgtttgcacaaatagtttagacacacagtgtgccacttttaagagtttggggagtagtggcctggtgcggtggctcacgcctgtaatcctaacactttgggaggccgaggcgggcagatcacgaagtcaggagatcgacatcatcctggctaacacagtgaaacccgtgtctactaaaaatacgaaaagttagccgggcgtggtgacgggcgcctgtaatcccagctactagagaggctgaggcaggggaatggcatgaacccgggaggcggcgcttgcagtgagccaagattgtgccactgcactccagcctgggcgacaaggtgagactccgtctcaaaaaaaaaaaaaaaaaagagtttggggagtagtgagaaccctcctgaaatcaaagttctcagatgccagctaaaggtcaaccttgcgagcaagcctgctatgttaattcttttttgcatcgctagacaaagaataaagacatttcccctcatttatctttttgttaggaaggaaaatctttcctggtttctctctcactacattctgtctcagtaccattagctaggatgggttgcttatatcctcactgcagtgagactgggaagttaaatacctagaatttctgatctctgtattggaagacagattgtgcaacagggagtaagggcagtggaaatggaagaagaatatctgttaagagttgtgtatttttctaactcataattgtcaatcctattgtttttaagggtaaggggctcagagatacatagctaggaaaaataagcaccatggcatttactttttatataaaatacaatcgaatttattagcaactttttcagtatatagggtagttttgttgtaatatacaagacggatttctagacaaagtgtttaagacaaaatctgtgtcagtaaactgaacagaaaaacaacccaaaattacccccatttataaacagaacaaaataaccccactctaaattactctgtttgatttattagtttaaatgaattgtttttactaaaactgtaatattgcaattttatttgcacacaaaagtttttgtcaacactattgtatggttgattttacaaattgataagatactattcttcaaaaaggataatcttttttttactataaaaaatttaatcatttctcagtaaagctattatttcttggtttgacttctaaaaatttcctttacttctgacagaatacttttgacatggtcaattaaacaaatagccaattcatgccaaaaaccagttggaattatcaggtaaatgtaaatgggtatttatagtgaaacaaaaaacatcaagatatatttcctgataataaggttgtgttgtcttgccatggactaaaacaaaacagtcctgtaatggaaaatgtaaagcttgcttactcgaaaatctcagtactaaaggaatgctaccaattccagtaaagtattgttgattttggaaataacctctaacattagactgctaagatgtagatttaggtttaagaaagctgaaatgccctttgtaaacctcagacctaaaaattatacttggtttttgaattaagaaaaaaacctggttgtattataattgtactgattacctaagatgtaattactaattgaagtagggggttgtcatctagattctgattattaactaacaagtttgaatctgctactgaactacatgtctagtcctagcatatattatagtacacaatttgtttttagcagatttttcaagttcctaggaattaatggacctattagttgtaggttttaagagtaaatctctcacggtctattgattggaaccaaggatttatcgtgttttgttagtccaagtgaaatgttagaagatggcatatgctattgcattgattttgttttctgttagccgaatacttttaagaatgactttctaataatgcagatacagaaattacatagtgactatgctaataaaacctgacaagtcatttttaagttgaaccataaagatggtcaaatattattagtttcatatggttcaatctgatacttacatgactgtatttctgcaagcacaggtacatagtgttcttaattattcagtagaatatttgtgtgttaattctgttttgatcctcattttcattccctactgtctgtcaaccctgaaagttattacttgtaacaagcaggaagcaacttgttagaaaataacatatattaatttgcgttcattatagcattttacagacaatatagtgttagacttggaaaacatgttagaggtcctctgaggccaccccagtcacctaatataggaaaatccctatgacatcctctccagatggttatttccctctgcttaaccacttaaggacattatctcaagagtttttctatattattagaaggtacatatatgatactgaaaactacccaattttaactcattggtctcagttctgcattctgttaggaataccataaaaagactacttcttccagatggcaaatgttttaacattaaaagatagacatcatatctcctactctcttccccaatggaaacagttccagctatttctaagtcataggctcaaaacttaggatttaaagaactttaaggagtattccagcagtaatctgatttacagggtctaagctactttcaatttgaattccctacattgtctgatgcagtgccttgtaaataatgagcactgaataaatatttcttatgtgactgtaagactgagagagggtaaatgagatttgagtttattgtcattcagtaaatatttattgagaatctgttgtgtactagcagttgtcctagacatttagggatacaccagttaacaaaagagacaaaatctctgtcctcattagttttacattttgttgtcaaatacattcaataaagattaattctataatataaagtgttataaatgtcatgaagtgttatgtaattggataatggtatgagagagtgagggagtgggtgatgctggtattttagattgaggtggtcaaggaaggcctcatagagatgttacctcatagagatgaggtaagaattgatcaatgaactgaatgaagtgaggcagctcagacgtggatatttcagacaggagttgatatagtttagatgtttgtccctgcccaaatctcatcctgacatgtaatccccaatgttagaggtggggcctggttgggaggtatttagatcgtggggccatggggggtgggtgggcagatttctcatgaatggcttgggtcatccccttggtgataagtgagctcttgctctgggttcatacgaggtcaggttgtttaaaagtatgtgacacctccccacccactctttctctcccttgctcctgctttcaccatgtgatgtgcctactcccccttctccttctaagcttcctgagatctccccagaagccttccaatgccatgctttctataaagcctacagaaccatgagtcaattaaacctcttttctttatgaattacctagcctcagatatttctttacagcaatgcaagaacagcctaatacaggagtgttctagacaaatgcaagggcttaattaagagtcaccaagactggagttgagtgtgtcaggactgaaggggagagcgtgaatagttgagatgagatagtttgaggaaaaaatcttgtagggagctgtgagcttgagtaggaatttaaaatttttattctaagtgtgatgggaagccacgaagcattggaattacatgattagacctatattgaagagtcactagtgagaatagactactgagggacaagagaggaagcaaagcaacctgttataaccctattttcataattttctagggctttactatctaatgtggtagccacaagttccctgtggccatttaaatttacattaattaaaattaaataaaaattaaaaattcaattcgtctgttgcactgaccagatttttcaagttatatgtctacagacggtcctcgacttaggagggttcaacttaatgatttttttactttacgatggtgcaaaaacagtaggcattgaattgaaacagtacttggaattttgaatttttatttttatttttttacttttttaaattatattttaagttttagggtacatgtgcacaatgtgcaggtttgttacacatgtacacatgtaccatgttggtatgctgcacccattaactcatcatttagcattaggtatatctcctaatgctatccctcccccttccccttccagcatctgttgtttcctgactttttaatgatcgccattctaactggtgtgagatggtatctcattgtggttttgatttgcatttctctgatggccagtgatgatgagcattttttcatgtgtcttttggctgcatacatgtcttcttttgagaagtgtctgttgatatccttcacccactttttgatggggttttttttcttgtaaatttgtttgaattctttgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaataccaagggttttcttctagggtttttatggttttaggtctaacgtttaaatctttaatccatcttgaattaatttttgtataaggtgtaaggaagggatccagtttcagctttctacatatggctagccagttttcccagcaccatttattaaatagggaatcgtttccccatttcttgtttttgtcaggtttgtcaaagatcagatagttgtagatatgtggcattatttctgagggctctgttctgttccattgttctgtatctctcttttggtaccagtaccatgctgttttggttactgtagtcttgtagtatagtttgaagtcaggtagcgtgatgcctccagctttgttcttttggcttaggattgacttggcgatgtgggctcttttttggttccatatgaactttaaagtagttttttcctattctgtgaagaaagtcattggtagcttgatggggatggcattgaatctataaattaccttgggcattatggccattttcacaatattgattcttcctacccatgagcatagactgttcttccatttgtttgtatcctcttttatttcattgggcagtggtttgtagttctccttgaagaggtccttcacatcccttgtaagttggattcctaagtattttattctctttgaagcaattttgaatgggagttcacttatgatttggctctctgtttgtctgttattgatgtataagaatacttgtgatttttgtacattgattttgtatcctgagactttgctgaagttgcttatcagcttaaggagattttgggctgagacaatggggttttctaggtatacaatcatgtcgtctgcaaacagggacaatttgacttcctcttttcctaattgaataccctttatttccttctcctgcctgattgcccctggccagaacttccaacagtacgttgaataggagtggtgagagagtgcatccctgtcttgtgccagttttcaaagggaatgcttccagtttttgcccattcagtatgatactgactgtgggtttgatacgcagttggacactctctcacaatgccaatcagtggcagagagctacagctcccagtcagccacgcgatcacaagggtaaacaactgacacggtagcctacagtgtactgtattcaaccttatgtatggtgttcagaaggttaggtatattaatcaggagtagaaacaaatttgattctagagaaaataaatggaagagtaagcccaaataacttctcaaatcacagatgaaacattatacatctatgtatattccagtaattacaacaatttcaacttaatatttggacattgtcaaaaattctactcaaattgctccattctaaaaatgattttgatattaccaatttccattttgaaatattttatacatttcagtttttaaaaaatctaatttttatatctaagcagtgacatgagattttatcctgaatctttccaaatcttcaggcctttcatttcttaggagaagtggaaaaggcagtggagggagggaagagtccagatttcaactcctgtcaccataccacatttctatatttctaaatgttttctctaacatctctgattattacatttggcttaaggtagagcttttctaagagtagtaatatggtaagagaggtaatttctgcagctaaatttcagaaaatcaaatcctgcaataagcaagttcctttctttttcttttttctttttttttttcccccaatacttgtctccatgatgaggtcatggagagagtcccattctggtgctagtttgtttgtttgacttgctaatctccctttttaacaaatagagacatgtcccaagcttggagtgttgctgcacaggcaggccacactcttgtggctcatattcaataacattattgtgttctcatgtatggattgatagtgacttttgtacttaccttctatttatggaacattttactggttttccatttaagaacataatattgacctaagatttgctttttaaataaattcaaatgtaaaaatgagacatttaaaaaatattaaataaggacatttgggtatggtaagattataaggggaggaaataaatcttaaataaattttattattgttaattattattatttttgagacaagttcttgctctgttgcccgggctggagtgcagtggcacaggcccggttcactgcagccttgacttccccagctcaagcaatcctcccaccacagcctcccaggtagctgggaccacaggcacacaccaccatagccagctaatttttgtatttttttagagatggggtttcaccatgttgtccaggctggactcctgagctcaagcagtttgtccactctggtctccccaaagtgctgggattataggtatgagcactgcacccgcagaaattttattcttaagaaaaaataggtgacttagcaagatgattcattaatgcagtacacatatgggttatttgtaaaggagaatagagcaaaaacattctaggacctctttctccaagtttcatgacctagaactgtactagaacatcatgtctaaatagccaacattactgatataatgaaatttaaatgctacactgcaattaaatttaattttcaaattctatcacaaaatgtacttatttgtgtatagtttacattttctaacttaacaaaggaaataatatttctaccaagtgctcttccctaaatcagtgcattactatctctttctagcaggtctaatttcgggctagctagctttacctctgggaattatagaagtgattttagaaataaatgtcaaataacgattattcctgctgtttccctcttattagccaagtgtttaatagacatagctaaagatttttatctttttgtttaggtatctgttgtcgcaagaagactcactctgctatttttatctagaagcactccgtttctccctaaaacacagatttatgacttaattctctttcatgtaggacacctgttacctctatttggatcttgtgcttccagtttctcactcgtttaatgaattctgtacacttagaaggcacacaaagcctgggctggggtacacgtggggatcacactgcaggctgtgaatgtagacaaaaatcctttgttgtgggtgtgatcactttaacaattagtgcatcaaaatctcttgtattcacaataagcaattgcatatttaaaaattttttatctccatttaaagatgtagccctcatgtatttagactttaccgtataaattttaattaagttcagttccactctcaagtccctagaattatggcaaaatgctttcaaagatagccgactttcttatagagttaaccagcctttttagtgaaatatgtgtccacaatctctcatctgcaattcaaaatccaaaaatgtctgaaaaagcaagtgtttttttttaactcatttgaatgcaaaactgtacttgagcttttttggtggcaaaacctgactgaactgacatgaagctatttacagtttttatttatcccacttagtgtaaatattcatcagtttactgcagaaatgttgatgtgttagattactgggtgttgccccagacctttgctggggatgtttcagaatatagagtaaagcactgcattacttttttaaacataacatagctggtccagagtttgtcataagtagttgggaacccgtgtgtagataagaatatgcataagagataaagtgaggctagatatttttcttttttttcttattcttttccttttttgtcagtcatgttcttctttgtctcttccttttgctccctctctcctcatcctccctcctaataaaagtcagtagcaataacccaataagcagtatcaaatgtgtcgagttctgtccttaatacattttaaatgaccttaataagatatatagttcactgtttataatagaatccataacagacagaaccttaaataaacattattctttgctaaaaacttctctgctttgtttctccaaaaggtcatttgagttatcattacaaccccctgtgttttcttccttctgaattgcacactgagtaattaccacacaaattagtaaaattctgttacatttatcttcagactgatagaatatggagaataagaccattgcccttattttgtgctctgtaaatcagtgtgaacataaattatcaattttactttttatcatttactgtagcttagatttttctgctaatttaataaaggctaattctttaaaaacatactgtagttttgagagagataattacagaatacgagcttatggagagtctttggtaataactaagtacataaagccccttttaatgtatgttaacgaagggtagtaaaactttacctatttgctgtgaatttacttcatttgtttctaatgatgggactctaggtcttaaaatgaaaggaaaaaagttgaactttaaaaatataaccaataacgaagggattactgttttagattaaaagagatatacagtgtatagaccttgtttgaatcctcatttcaacaaatgctatttaaaagccaaacctattctgagataatcagggctctctagaagaggtggttttggggcaaagccacttagtcttcttttcttgttagtcttcatctctctgtccttggatgtctcttctatctgtgtgtactactttagagtctcatgaaatttcagggctttaaaatacaatctatatgttgactattctaaatgtttatgcccaccgcatatattcagttacctacttagcatcttcacttgaatgtctaatcagcattgcaaacataacatacaaaatcaaactctgaaactttccctccaaaccaactcctttcacaggcttcctgtcttagttaatggtaactccctcctgccaatttcttagggcaaagagcatcaatatcaacaaaaacttttggcccttccttcaagatatttccagaatctgatcacttcccacctgtcccacagctaccagtttgggagctcaatgtctcaatgtttttatgttgagaaccagggaagctgatggtgtaactcattcagaggctgaaaacctcccgggggtctgctggtgtaagtcatggagtctaaagacaggcaggtatgcagttctgatgtccaaggcagtggaagaaaagtttgttccagttctcagagagagaccagttcaccttctgtgtgtgtcctatccaggcccctgactaattggatggtgcctgccaatattgagggaagattttctctacccactccactcagactcacatactaatctctggaaaccccctcacagacacacccaaaataatgctttaccaggtttctagatattccttaatccaattaagctgacacctaaaattaaatccacaagtctactccttgtcaacttggcattcatatgcatctcctcaaaccataactcatttccaaataaagacaataaccaggcaatagtttcacctaacacgatgcaactatcctgtgattgtgattttcagaattttagactttagggattttgatcttttgagatttcaacatttgggattatgactttcaggattctgtcttttggaattatgatccaaattctttactttctgcccagaatgttctttcctatgtatatgcacatctcactctctcacctcctttagaactttgctcaaatgacaaactctcagtgagggcttccttgattgttatattttaaatgtctactttctgactttcctgctattccctaggcctccttcttagttattttcctccatcacatttattaccatacgatattctagttattgtacttatttattgtctgtcttctccataggaccagttatttttgtctagtttattcactcttatctcctcagtacttaaaacagtgcctggctcatagtaaataataaatatttgttaattgattgaataaaaacctagcacctatcaatgcatagcacataatagttgtaacaaatatttaaataaatgaaggaattaataatctagttggtggatcgttccattcttttacaatttatttgactctcttgtagctttattttcttttttatactgcatagaccccataatccttccccacaataactcctgccacaactctcaactctctttctgcagtatcctccaagcaaatctttgacttctctctacttatttgttggttgctaaatgcaaccaagaaaaagctgaggatctgatctctggctcaagggacagccaaaaagagaatacccagggaccagtgctctcattataagatgatatatgattctatagtacctgagctctgcagctctaatagtccctttgctttgtttagttttctagttttgtagacttaaaagggcaccactcaaaatagccctttgttgaatagttagttcagttgctaaaatcaaggatgagcatggtaaggaagtattcaactagctgacctctgagtaattaggaaagtctggcattgactgctcatcttagaattgattaacatcataggagctattggaattgagggttaaagctttatccaaaagctgggtgcagtggcatgcctatagttgcagctacttgggaggctgaggcgggattgcttaaggccaagagtttgagaatgcagtgtgccatgatcatgcctgtgaatagccactgtactccaatctggttaacatagtcagaacctgactctaaaaagcaacaaaaaagctttatccaaaaatgcaatggttctttaacattattgtgtatgggacctacctggggagctacagattcctgaatacacagtgaaagccattctttgagggtatatataagcacatgggcaggtatatgaagcatttgaaataggtcatgaggactacctcactaagccaatgaatgaggccattagacaagaagtcctccacctaacatttccatctctaaacatgaaacatgctcctttccctttgacttcagcagaccagatgaagtatcattggaaaggtaatcactctctaatctttgtgactttacctattgcttacccacctcctcctatatcttggaactttcatgatctgactggtatttaccacttagcttcatctcttgtcttctcttccccttctctggatagtctacagaatttgaatacctcctactgtttcttgtctctctcttaatacaggttatttcccctacctggaaggccttaactataacccccttatatcttctttatctaccttcttcttacttacaccctcctccctcatcccaaccttggaatcatttctaaaatcttcctttctggtctaattaaataccctttttggaatcccatggcactttgaaccattatgatatttaacacaatatatattataatcattgatttatcctctcacctgctagatatttttagtttgtttttgtttgcttatttttttgtgtgtatgtgtgtgtgtttaatgtctggtaccacaccacacctattcaacttttagtcccagactcatggtcctgaagtctaaaggcttgttggtagaattcagtccttgtgattgtaggaccttttcttcctggtcgttggctgggatacacttttggctcctagaggccacccttaggtccttgcgatatgccccactacgtaggcagtttacaacgtgaaaggaatcttgagggcaatcgcagaatgctgcttagcacactattttttacaatgtaaaggacaaatatgaatttttacttgatcttttgtgttttatccgtatttgtttcctttggttgctgtccagtagacattttaagtctatgtaatttaggaagatcagcagtatcctaaagcaatgatcttaacataagtctgtaggtagcgaggaaaggtgttgtagaaagacaatactcaacatcaaaattctaccattgcattgttttctgttggtaccttccagttggtgaagagaaagaacaaatgtgaaattagagatttcccccctggttttacttttctcctaagtttaaatgatgcagagagggactgaagaattccagagtttttcttcttattctttgaagctgtcctttgaaagcagggactaggcatacatgatttctatttagataagtagttgacatgaaccagaggcccagaaaggcaatttagacttgtgtttattttagtttatcttctttcacagggaaagcataatggaaaagttgacaaatactaaacattgctccaactgcaacaaaaacatttagatacatgctgtttctaccttgtggcaacatccaattaaaacttcactgagctttattcctttttctcttaaaattcctattctttcttagttttttgtaactatattaggcaataatattttttctctactacctgatctataactacttctaatggaaagaaatattaatgtattttgtattagggagatgaacccttaatcttctacacctctaatagtgcttttattagtgagagtgcaaagatgctggaactctttgcattgttggtggggatgtaaaatggtgcagctactatgaaaaacagtaatcctgaataaattaaaaatacaattaccatatgatttagcaattccacttttgggtatacagttgaaccttaagttttaggggaataaaaagttatatgtggattttcaactgcacagagggtcagttcccccaacccctacgttactcaagggtcagctgtatatccaaaataattcaaagcaggatctcaaagagatatctgcatacccatgttcatcacagcattatgtgtaatagccaagaactggaaacaaccccaaatgttctaaacaggtgaatggatacagaaaatgtggtatatacatatatggtaaaatattttgcagccttaaaaaagaaggaaatcctgtcacatgctataacatggatgaaccttgaggacattatgtgaagcaaaataagctagtcatttaggacaagtactaaatgattccactcatatgaaatatctaaaatagtcaaaatcatagaaacagaaagtacaaagttggttaccaagggcatttcagttttacaaggtaaagttccagaggtctgttcaataacgatgtgaatatatttaacactactgaactatacacttaaaaatgggttaaaatagtaaatttaacattgtatatttttaccacaataaaaaaaatgagaaaagttaacttttagaaaacaaatttaccatttattattatttcttaaaaagcaaatgttacctgaagttgtggttagtttcttctaacactaaaaacatccaggcagcttcatggaacaaagaaaaggattgctgtttcacctttgattgggtttagtttttggtttttttttttctttttaacagctttattgaggcatgtttgacatataataaactgtacatatttaaagtgtataatttgttaagttttgacatatgtatgtacctatgagatcatcaccacaatcagaataatggacatatttatgacctccaaatgtttccacatttcctcatgcccctttttaatctttcccacatgcctctccatagggcaataccatcttcaggcaaccactgatctgctttctgtaactgtaaattagtttgtattttctataattttgtataaatgtaatcatacaacatgtacacttgtttctgtcttgctttcttcatttagcataattatttcagatttatccatgttgtcacatgtatcagtaataatttttattgctgattagtattccattgtgaggatatactaagatttttttttgtccattcacctgttgatagatatttgcttgtttccagtttttagctgttacaattaaaactgctatgaacatttgtgtacaggtctttgtatggacatatgctttaatttctattgggtaagcagcttggcatggaatggctaggtcatatgttaagtgtatatttaactttttaagaaactatattaacagttttccaaagtgtgccattttacattcccactagcaacgtatgaaaattccagtttctctacatctttgtcaatacttagtatgctttgtcaacacattgtggttaatctttttaattttagatatcctcatagctatgtagtcatatctcattgttttatttttattttcctaatgactaatgatgttgagaattgtttcatgtgctcatttgccagccgtatatcttctctgatgtccattcaaatctaaaaaaaactggattgtttggttttttaattatatattctggatataagtcctttatcagttatatgatttgcagtatttttccttagtttgtggttcatttttttttttaatttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaacatgcggtgtttggttttttgttcttgcgatagtttactgagaatgatggtttccaatttcatccatgtccctacaaaggacatgaactcatcattttttatggctgcatagtattccatggtgtatatgtgccacattttcttaaaccagtctatcattgttggacatttgggttggttccaagtctttgctattgtgaatagtgccgcaataaacatacgtgtgcatgtgtctttatagcagcatgatttatagtcctttgggtatatacccagtcaggacataggcgtgggcaaggacttcatgtccaaaacaccaaaagcaatggcaacaaaagccaaaattgacaaatgggatctaattaaactcaagagcttctgcacagcaaaagaaactaccatcagagcgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtggttcattttttaacagttctttcttttcaaatagcaaagatgtttaattttgatgaattccagtttatcaattttgtttttctaatctgggtcatgcatttgttttcatatctacaaaaacattggctaactgaagtcaccataattttctcctaactttttaatggccttcaagaccttattgtgtgcagaaaagcttattgaaaattatttttaaatgaacattcttattacattaaaaattctaaaacctatgtcttactttttttttaatggggtcttgctctgttgcccaggctggagtggagtggtgcaattatagcattgcagtctccacctcccaggctcaagcaatcctcccatctcaacctctcaggtagctgggactacaggcacgcaccatcatgttcagctaatttttttaaaaagcattattatatatagagacgaggtatcgctgtattgcccaggcagtcttgaacccctggactcaagtgatcctctcaccttggcctcccaaagtgctgggattacaggcataagtcactgcacctggccatagttcttaagcttttaaggtcaatttaattattttttctatttatacatgcagaaaatttcaagggaccctttgagtgtataatctcattttcaaatttagtcagttaacatcccataaacactttaaactgcattcatacaattaaaagccaatttttaaagtatttcttgtatctgactgacagaaaaaaccttcccaagtacccaaataagtcttctaatgaatgaaaacttatatagtaagacttatgtatagcaagcctttaagggtctcttgtatgttccagtggcattttgtatgttttaaaatacaagcctcaaccattttctcattacactatttaaattggaatcaccatgcgaatctgttattctaactcacctatttctcctagctaagatactatatatgtacagattctttaattttaaaaaatactaatatatgggctgtgtctcaaacttttctatacttaattctgaatcttcctggatgaaaagatgcttacaattttggggttgccttctcaactcactgtggttttttaatgaccaaagatgtccttagcctggatggtgagtgaatccttgctcaaactagtggcatacacagagctccattttatagctgctttgttcttgaaacagcatgtttctattagccctatttctttagattcaagttaaacattcctaattaatctgtctccagacaggttattttatcacttgattggatttagttaatctgtttactgttcattctgttctcaatcactggtatgtactagctgtgcgtgccacaatccttcaggattaaaatgacatctgttagaatctccttgtggctttgtctctgtgagcagttttaaggtcatgtcagtaatacctgtgttaaccaaaaacataataatgattctggttatgtgatagaattaatttttcttatttgaaatttttttccaaaaactttctagttatcatgcagcatataaccttcaagagaataaaagtaaataatatggctatgtttattgtaaaatttaacctttgtgataggttaatgtgataacgtctgttatatatctgtactcccaagttacctagtactgtgtctaaaggaaacaattgaagcaataggctttaaaaaatttttgtaactaattctgtcctcatctgttggttgacttcaagcttttttccctccattttcttttttcttttttgcattcctcttcagcttctgcatttctttcattcccttgttatcttcggagctaatgatctgaagtgctataacagtaaaataaacatgtgagagagaaagatggtgctagtaggcaatttataagctgatagctttgttgtttgttttctagaaagctgctgtaatactacattaaattctgacattgggtaattagaatgaggcagttttaaaaaaatctttaagttcttgcctagcaaagctgtaaattaaaaatattaaatctattctgatagcttgatgataactttgaaaaacaaatgttcctttctatgttttggagttctaagaagttctaaccagaaatgttcataaagatcccatattgaatatacaaaaaaagtttaaataaaaattaacacggtattgatataattcgtacccgattcaatcaagcaacagaggtataattagcaatctttgtagctagaaaaattaattgctgaaaaaattctattgtgtgagaagttacttttaaccttttcatttttttatttatagggaataattatattttaaaacccaatttatttttaaaaagtaaggaaaaacagtatcttaagatttaaaacctagtctgtctcttgtgctctctatatatacacataaatatatgtgtgtatgtatgtataaagccaacatactggttttacaatgggatacataacatatcatcataagcaacctaattttgttctccttccttttgtccttccatccttccttatatcaccagaggaagttctgcctctatataaaaacccagattcataattccctccttgccctttggtaatactaatgactacagtcacttaaactccataattaaaagtacctagtcagtatattaatcaacctttcaatgtccattcagagctaaaacttttcccttccctagctaagattatctatagatggaagacagtgtgattagcttctctttttgttgcttatctcctcacccactggcaagttgctatatctgaccccatcaggatctaaaccaggggaaggaagagagaaagcaaggcaaacagtttttgttgttgtttttcccacactcctgttgtgaaattgctttactgtttttgaacttgatatgtgtttaaggctggccctttttcttcggtgtgcttttgtgggttcttcacaatccttcactggaactacactacatgtgacactccagaatttttccctccaactagccagtaacccctaacccctctagccctcagcctagttttctttcaggccattccacagtagaaataattctaatttgaatccttcttctttctctttctcctcttctttcccttctctccttttcccctcctccccctgcgcctcctcccttcttcctttttcttggtggtggtctgggtacttcaggtggaactctgggtagaattttttaaacagcttttcgagatatacttcacatacaataaaacttaccctttaaaaaaattctttttagttttttagaaacggtctcactctgtcaaccaggctggagtacagaagcatgatcatagctcactgtaacctcagactcctgggctcaagcgagcctcccttttcagcctccttaataggtaggactacagtaggcaccaccatgcccggctgattttattttttgtagagatgagggtctccccatgttgtccaggctggttttgaacttctggcctgaagcgatcctcctaccttagcctcccaaattgctgggattacaggcttaagccactatgctcagccttcacccttataaagtgtacctttagttatttttagaatttttgtgcaaccattgccactatctaaattttaggacattttaatcctctgggtaggatttcatataggtccaagctggccctctgtgtggccgtgcttccttgcccctctcttaccctgagcagtggaagtatagctggcttctgatacagtatgtctcctcactcttgtgtgccctccctctcctgtctacctcatgttgctgcctcagagtgataggcaacacctttagattcctaaagtgtgtattaggcactgcctgatgtgccctccactaactccagagaacatatatcaaggactcccaggggtcccattaaagcttctttcactggcttgaggtgaaaggaaggcacctttccacatccctcccactttggaggagacatgaaaatcagcacacaactctcttcaaagaaattcttgttctatctttgctctactctttataccctgagtatatgcgttagagctatctaaccagttctcagacatattactttggaaatttgctacagggtagtccttcacacaagtcatgttggtatctgattgctaatattatctgatccctctgttgaaacttccaatttatcaatatttttcatgtagaagataactcacatatctttagaaaggaatgaagcttctacttttttctcttgaataaatatgctattatataataaagtcaatgagaacctagagactttggtgcaggcaggggatctaaataaataatcgcacttcttgtacaacctaagtaaaaacgcttttggcttttttaaagcagtatcttatagtttccttttaactttcacattgtgtatataagtagacaccctggaggcagactttaagcataaaatgttttagtaaacatttaaaaaggaaagtgaaaggacaagactggcctcatttatagttggaattgcttttttcagtcaggattaagtaccataaatgtaaattaaaagaaaatagtagcttgtcttgttagttgagtaaacaaagtcaacttttatctaaaacagatgtttttataggttaacttttaaactccttatttggcttcttttccaaatctgcttctcccttacagtagaaatatactatatatgttatgcttaaattggttttgtctgggtagaaatcttatgaatcactctaaagaacaattttcaagctgtgtcaatttaggaaaatttatatagaaggattttaactagttacattttcctcttttaacatgaaaataggcttattaagccccatagaaaatcttaagttttatcagtatatcatcacttaactgaacgccattggaaaaattgacctgacaaaaatttcagcacagacacttatctgatcttttattaattcaccttctgtagaatcatatatcaaagcatgttcacaagcatagccacttcccttgtcatagccacccaaaatgacatttttattgttactatcattcctgtgttacaatagggaaacagaggtttaaaggaaaagtgactctcccagggaaaatggtgagttgccaacaaagctgggtctggaaatacttaattgcatttagtgcaaaatatacagttatagtatatatattggagataatagaaatcaactaaagaatgaaagaaatgtgttccatcttattcccaacttcccctaccatggctgtaggttctcctctctatttctctctacttttatatctgggatggataggatgaaacctggaacagaaatctgaaaggccttcagttcagtctgactgctttggtttatgatctgtattttggtgcctcctagtaccctggggtctcttcctttttccgtaaagcagtcaccacccccattctccagttctgtctctgaagttgaccgtgttgggctagggcaagtggttgttttgagggtttttccctccaattcctttaccttctgtgagtttaagataacatttagattggtagccatattgagaaattaggtagacagggggcttatagtctgtcatcactgatgtagagcttttactactgcaagtatagttaagttgctgatgcatagaccatctgttacctttgtttcccaggtaatatgcacgtgtcactagctgaggccctggaggttcggggtggaccacttcaggaggaagaaatatgggctgtattaaatcaaagtgctgaaagtctccaagaattattcagaaaaggtaagctgctgctgctgctgctgttgttgttgttgtttcagtattgggtacttaaaaaacagatacagggtcagagattagatttttgtttcattattcctgtgcctttggcagagtatgaaaggaatactttccttatctcttttagggctgaaaaagctcagctattatctacattcatttgaatatcttctatgtgcccaatattacaccaggcagcaaaagtgtaatggtgattgaaaccgaaacagttcttctcagtttagagctcacagttcaatgtggaaaatagctattaacaaaatatttgggccaggtgcggtggcttacacctctgttcccagcactttgggaggctgaggttggggtgtcacttgaggtcaggcggttgagaccagcctggtgaacatgatgaaaccccatctctactaaaaatacaaaatttagccggtgtagtggtgggcacctgtaatcccagctactcgggaggctgaggcaggagaatcacttgaatccaggaggtggaggttgcagtgagccaagattatgccactgcactccagcctgggtgacagagtgagactcctctcaaaaaataaataaatacacacacactcacacacgaacacatttgtactgtataaacaaatgtaaaaaatgcagccatgacaaaggctaaaaaggagggattcagtgactctctgagaactcataataggaggatttgacttgatcatggcacagaaaaggaaggctctcctacacaagctaagacccaaaagaaaagttaaccaggtgagagggaggggaaaaaaatctggtagaataatatatgcatccgtgttactctaaatcagaatgatatagggtcaacaagtattttggtgtttccctgtggaggaggtcacttggtccaaatggttttgcggcattgtggagttagaaaagttagaatcatcctttggttgtccaaaaacatttgatatcatgccagaagttgcacatgaagatgttgtttgccattcatagcacctgaccaaaacttacttagaatagtaggtgaaaaaaccaagcgtcatctaaagaatcagtctctaaaattgatttgaatgcatacatcagacacaaaaaagcctgacagaaataagtaaggattgagggtagtgatagttctgaaagtgtggtaccagcaacattagcatcttttgaaaacttgttagaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattgaaagaactagaaaagcaagaacaaatacattcaaaagctaccagaaggcaagaaataactaaaatcagagcagaactgaaggaaatagagactaaaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaatacctctacgcaaataaactagaaaatccagaagaaatggataaattcctcgacacatacactctcccaagactaaaccaggaaaaagttgaatctctgaatagaccaataacaggatctgaaattgtggcaataatcagtagcttaccaaccaaaaagagtccaggaccagatggattcacagccgaattctaccagaggtacaaggaggaactggtaccattccttctgaaactattccaatcaacagaaaaagagggaatcctccctaactcattttatgaggccagcatcatcctgataccaaagccgggaagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctggggtgcaaggctggttcaatatacgcaaatcaataaatgtaatccagcatataaacagaaccaaagacaaaaaccacatgattatctcaatagaggcagaaaaggcctttgacaaaattcaacaacccttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccatcgtctcagcccaaaatctccttaagctgataagcaacttcagcagtctcaggatacaaaatcaatgtacaaaaatcacaagcattcttatacaccaataacagacaaacagagagccaaatcatgagtgaactcccattcacagttgcttcaaagagaataaaatacttaggaatccaacttacaaggaacgtgaaggacctcttcaaggagaactacaaaccactgctcaaggaaataaaagaggatacaaacaaatggaagaatattccatgctcatgggtaggaagagtcaatatcgtgaaaatggccatactgcccaaggtaatttatacattcaatgccatccccatcaagctaccaatgactttcttcccagaataggaaaaaactactttaaagttcatatggaaccaaaaaagagcctgcatcgccaagtcagtcctaaaccaaaagaacaaagctggaggcatcacgctacctgacttcaaactatactacaaggctacagtaaccaaaacagcatggtactggtaccacaacagagatatagatgaatggaactgaacagagccctcagaaataatgccacatatctacaactatctgatctttgacaaacctgacaaaaacaagcaatggggaaacgattcgctatttaataagtggtgctgggaaaactggctagccatatgtagaaagctgaaactggatcccttccttacaccttatacaaaaattaattcaagatggattaaagatttaaacgttagacctaaaaccataaaaaccctagaagaaaacccttggtattaccattcaggacataggcatgggcaaggacttcatgtctaaaacaccaaaagcaatggcaacaaaagccaaaattgacaaatgggatctaattaaactaaagagcttctgcacagcaaaagaaactaccatcagggtgaacaggcaacctacagaatgggagaaaatgttcgcaacctactcatctgacaaagggctaatatccagaatctacaatgaactcaaacaaatttacaagaaaaaaacaaccccatcaaaaagtgggcaaaggatatgaacagacacttctcaaaagaagacatttacgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaacaggaacacttttacactgttggtgggactgtaaactagttcaaccattgtggaagtcaatgtggcgattcctcagggatctagaactagaaataccatttgacccagccatcccattactgggtatatacccaaaggactataaatcatgctgctataaagacacacgcacacatatgtttattgcggcactattcacaatagcaaagacttggaaccaagccaaatgtccaacaatgatagactggattaagaaaatgtggcacatatacaccatggaatactatgcagccataaaaaaatgatgagttcatgtcctttgtagggacatggatgaaattggaaatcatcattctcagcaaactatcgcaaggacaaaaaaccaaacaccgccatgttctctctcatagatgggaattgaacaatgagaacacatggacacaggaagggaaacatcacactctggggactgttgtggggtggggggaagggggaaggatagcattaggagatatacctaatgctaaatgacgagttaatgggtgcagcacaccagcatggcacttgtatacatatgtaactaacctgcacaatgtgcacatgtaccctaaaacttaaagtataaaaaaaaaaatgcaacagtaaaacacacattagagacctactaaataagcaactctgggggtgcagcccagcaatttgtgttttaacaagccctcaaggacattgtgatgcatgctaaagtttgagaaccatttataggatagagtttctaaagaccaggagccatgggaaccttctggaaagatgtagggataactactgattgagtacaggaaggtctagagacaggggaagagtgtttggggacagatggtaaagctttgttgtttttgttgttgttttttaattcagagacaggattgtgaaaaaacagtgttagggcccacacatcagtgctataacctttatgtttgatgatctttaattagagttaggattaatttaaagaaaatttattcatttaatctaatatcacttaaccaaaaatctgggtgttttaaataaacattatttctttgtttgcttcactttatttttcagaaaattttcagaaaattggaaagtatagacagtccagaatatacaggatgtagctatactccaaaggtgttattgaaggaaagatatgttgatggcactattcagtcaattaataattgtcaattaatatttaagaaataccttctacttgtgaggtattgtgtggaagatccaaataagtaggtgtcacttttgcccttaagggatttgttcagataaaagacacaactgcaaatttaccacttcaaaacaaagtgccaaataagtgacatagacgataagtactacagatgttcagaggagggagagagaatacctctttttattatactaatggcaggattactgcccaggccatgactcacagtatataaagcatcttgcatactgtaagtacctaagggtttttccttgtttcacatttcataatgttaatagagatcaaatgaatataaaggtgttgtcactgagaggcaattattgcataacatattggcacattataattaaaagacttaccagatgtattataaaattaattgtgaggtagctgtgtcttaaatactgtccagtaggagctggttagcataaggcctccagtctaattcacagagtattatcagtaatacagagagattgaatttggtttctttggcagtttgaagattaccaattgttatgattgctaattggaaatttctatttatttggaggaaacaaatgcttatttgatttaatttgtcagaaatttatgatttttcattctttgtatttgataacacaatatcttttttgtatatttgatcacacaatatctttttgtcccaagttcttctcctgactcttgtaacgaattgaaataattattagtttttttattttatggatgaatggtggttgtcttagttctctcttagaatccttatgcataacactgggagtggcggggggaaaatagcaggtaaagtataatggtgtccaagaagtttatgtgtttttttaaaatgctttcttgtcaatggcttttcccccttatcatcttgaacttgtacgttgttcctgtttctttttcagaatatgagtgcaagcatgctactgacattcctataagagggggctggaaataagcatttctactggggtattattgaacaaaagccaagaaaattatctgtttcttcatatttttgagcctcccagcaatcgaaggctttccatttttaaaagcaaaattgctatggttattattcataggataatgatatctaagcatggccttgttgaaagacaccatcttcaaatgaacttctcttcagaggagggaaaatgtaaaacttttgataatcatgcaattctaacatgtagatgaaggtgatgaaaggtggttccccttttggtgtaagtttcttagttttgttgccttgtggttactaaaacgtacaatctgtatgactaccctgagaaatcatgagatagtattttttgagattttcttgtgatcttacacatgatctatctttgtaaatattctgtaggcatttgaaaagaattgtactgtctattcctaggctatagcttaagctcgtgaatgtttgtgcttacaatttttttaaactttattagtctgtattcttcatctgtcaaattcctagggatagtcaaaacttcccactatgattatatttttgtctgtcttcttctgtagttacatattttcgcaattttgtgtgatacatgtgatggctaatgactaatataaatggacaagatattttattaatataaagtaagtttttttctttctacaagtcattgcaataaattctgttatctgcccttaatatggccacctttgcttcatttttgttgacacttgcctacctttcctatctctagtatagctttcctccttcctttattttcacatcctttatgctataatttaggtactttttgtgaatggtagatagctagatttttattttaacctagctaaggagttgcttttcttcaattaggaagttaattgtagttattgaaataaaagttctgggaaattttactaagaatcttcctgtgttatgatttcccagttgtatgcctttcagttcatcttttcttttcttcttcttcttcttcttctttttttttttttttttttttgagatggagtctcactctgtcactcaggctggagtgcagtggtgcaatctcggctcactgcaacctccacctcccgggctcaagcgattttcgtgtttcagcctcctgagtagctgggattacaggcatgtgccaccacacccggctaatttttttgtattttttgtagagacggggtttcaccatgttggccaggctggtcttgaactcctgacctcaggtgatccacccacctcggcctctcaaagtgctggaattacaggcgtgagccaccgcgcctggcccacttcacctttttaactgattgagaatcctagcttatgtcagaaaaacatatatacatttaagattttagcttttatatcatggatgaattcatgtaggagctcagtgttcctacataataaaaaaatgctattctcctgctctttatgaataatctttagaagtgaggttattgctaccttggaaaacttagcttacaactgtagtaattgtccaaaacagtaattttttttgttatggaactgttgctctctgcagaaaacagctctttcgaatcttgaggttttagggtgttagactgattgattagtcagaggaagagactcaatttccctcacttaggcaaggatataaatccctttataagtagtcacttctggttccctgtctaataaataaaagaattaatgaaatgagtaatttcaataaaccgttaaaaagataatagaataaagcatttgataaagagaaatattaaaaacaagccaggttcattgtctacattaaaaagttctaagagataccagcaagtgtcctgcaaaaattgaaagaccacattgtgtttcttatattctttgaaagacaaatttggatcagattgtagagaacagcttatataattatttcactgtatttcatttttatagtcttattataagtgaaaatgacaaattactatagaaagctaagacaaatatcaaatttcactcctaaaaaagtgcctaaaaattagaatttatagacaactttaaaaaatcttattagggaataaatctgttaaataatatcagcaaagtttagtgaatattatgttctgttttttatacaattacttttattgcataaatactttcaggaaaattatcttgctactaaaagaaaaaagtgtgtatgagaaatacctacatatactcagaaccacacacacttcttttatttatggaatcaaactcttagagctgaaaagattttaatctgttcggtctaatcattttagagataaggaaacagcccagtttaaatgacttataggagttagtattggcagagcagaaataatgtaactattttaaagcaaatcattatgaacttacacctatttagagctataaaatcacttcatgtgtacataacaatgaagtttaaaaattgataacactcttatcaatacagcaacaggaggtttacaaaaacagtatcaggtgacatgatttcagattctatagttatttaaaaaaataataagggaaaatgatgaacaaagttgttgaagtatttaacaacttacatgaaatggacatcttaaaagatacaaacagctcactcaagaaaaaaatagacaacccgaattgtcctatatctattaagatgattgatttttttttttttcttttcggagacagaaatctcactctgccactcaggctgaagtgcagtggcgtgatcttggctcactgtaacctctgcttcccaggttcaagctattctgcctcagcctcccaagtagctgggactacaggtgtgtgctaccacgctcggccaaattttttttgtgtgtatttttagtagagatggaatttcgccatgtttgccaggctggtcttgaactcctgccctcaagcgacccgctcgcatcagcctcgcaaagtgttaggattacaggcatgagccaccacacctggccaaggtgatttaatttatagtttaaaataccccacaaagaaaattccaggcccatgttgtttcactagggaattctactaaaaatataaggaagaaataatagcacttctatacaaacactaatagaacattgaagagaaggatgtacttcccaactcattcattctatgagggcagcattactatgatttcaaaatcagacaaatacattagagaaaaactacaaaccaatatgtcttatgaacatagatgcagaaattcttgagaaaactttaattaattgaatccaacaatatataaaaatgatagcacctcatgatcaaatggatcctaggaatgcaagattagttgaactttcacaaatcaatcaatataattgaccatagtaatgactaaaaaagaaaactatattatctttttaatagatgcagaaaaacatttggtaacatctaatatccatttcaatcttaaaaagctctcaactcaacgccgggcttggcagctcacacctgtaatcccagcactttgggaggctgaggcagaagagactgcttgagttcaggagttcgtgaccagcctgcgaaacacggtgaaacctcatctctacaaaaaatacaaaaattagtcagacgtggtgacatatacctgtagtcccagctattcaagaggatgacttgagcccaggaggttgcagtgagccaagatagcaccactgcactccaccctgggcaacagagttaggccccgtctccaaaaacaaacaaacaaacaaacaagcaaactctcatctaggaatagaaaggaactacctcaacctaataacgggtatctacacatcatacttactggtaaaacattgactcttcccctaagatcaggaacaggtcaagggtatctgctctcattacttatattgaacattgtattctaagttctgactagtacaaataaagcaagacaaataaaaggcatccagattagaaaaaagcagaactgtttgtatttgaatatggcatgttctatgtagaaaatttgatagaatccagaaaagccacttgaactcatagatgtttaacaagttgaaagatacaagatcaatatgcaaaaaacaacttttaccatttagaaatgataaaaaaagtaaaatatggaatacaaaatttaacaatatgaaaaaattaagaataaacctgacaaaagatatgaaggcctatgaaacaaaaagtaaaacacagtgctgagagaaattaaagaacacctaaatagagagctatggtgtgttcctgtatcgagagactcagtattgttcagatgtcagttttctctaaattgatctctagattcagtgcaattccaacaggctatatttttttttgtagaaaatgacaagtggattgtaaaattcatgtggaaattcagtggacttagagtagccaaaacaactttgaaaaaagaacaatgtttaaggactctcactacctgatctcaagatttattataaagctacagtaatcaaaataaacaactagatcaattgaacataacagcatccagaaataaatccacacctatatggtcaattgattttcaagaaagaaagatgcccttttcaatgaatggtgctgtaataattggatatccatatatcaaaaattaaagttcttaaaaaaaaatgagacggtagttgtgtccctgagttaggcagagatatcttaaataagacaaatgtatgatccataaaagaaaaaaaaagatacagtggacttcatcagaattaaaaacatccactcttctaaacatattattaagagaatgaaaggaaaagacctacactgggagaaaatatttgcaattttttttttttttttttttttttaaagacagaatctccctctgttgcctaggctggagaacagtggtgagatctcggctcactgcaacctccacatcccaggttcaagggatcctcccacctcagcctctcaagtagctggaatcacaggagtgtgccaccataccgggctattttctcgtattttagtaaagacgggattttgccatcttggccaggctggcctggaactcctggcctcaaatcatcggcctgccgcagcctcccaaagtgctgggatgacaggcacgagccactgtgcccagccagcaactggaagtttcatagactgctagtgaaaatgtaaaatgatacagctttacatttgggaaactgacagtttctttaaaagttaaatatacctgccatatacactcctagttacttacttaaaagagatgaaactgtgtgtccatacaaagacttgtacatgaatgttcatagcacatttctttgtagtaaccaacagctggaaaaaatacaaatgtctgtcaacaagtgaatagataaacaaattgtgatatattcatataatgaaacgctacacatcaataaaaaggagtgaactattgatacatgcaacaacatcgattaatctcaaaataattatgttgagtgaaggaagtcagacaaaaaaatagtacattctatatgattctaatctaaaattctaaagcatacaaactaagctgtagtgagtgacaaagcagatcagtggttgtttagggatgagagatgatgatggggatgaagcagggaattataaaagagcatgaggaaacttttagaggtgatggatatattaattatcttgatttgattgccataatagtttcacaggcatattcatatgtcagaacatcaaattgtactcttttagtatgtgcaattattgtatgtcagttattccctaacaaatctgcttaacgaaaaggaatatcaaacattttttcaaaaactgtttaaatttagagcttgatattttttcttactaattttaagctgtgtttttaaaagaaaaatgtttttcagtcaaatgctgtacctgacttttttgagccaaatgttcatttttctctttgtagagcatcaggagtagactactcacctttaaaaaataatatatgataatataattttctaataagtatatttaaattagtttattgaatttagtttttaaaatgactaaaaacatttttaaaaatgagaaaaattttaaaaattttaaaaaacatttttaaaaatgagaaaacgttaaaagtaggcaatgttatgggattgtgttcctcaaacattcatgaagtcctaacccctaataacctccaaataggactgtatcaaagatagggttttcaaagaccttataatgttaaaatacagttattaaggtggggcctaatccaatatgactagtgtccttataagaagaggaaattaggacgtaaacacatacagaaggaaaactgtgagaagacatagagagaagatggccatctataagccaagaagagagtagtcagaagaaaccaaccctgccagcaccttgattttgcacttttacaaaagtacagaattgtgagaaaataaatttctctaacttaaaccgtccattctgtggtactttgttatagcagcccccaaaaatgaatacaggcagaataaaaaaaattaataaaacatctcaaaataaaatatatggtaactaaatttaaaatctcaatggagatcttcaacagattaaacagaatatcatttttatttttaattatgcttacatactagttatttttgaggtacatgtgatattttgaaaaaagcgtactctgtgtaatggtcaagtcagggtagctgggttattcatcacctcaagcatttatcatttctttgtgttaagaacattcaaattctactcttttagttattctgaaatatgcaataaattgttaattgtagttgccctattgtgctactgaacattacatcttattttttctgtctaactgtatttttatacccattaaccatcctctctttatcccccctccatactatctttcccagcttctagtaaccatcattctactctctatttccatgagttcaattttatttttgaagctcccgcctatgagtgagaacatgtgaaatttgtctttctgtacctggcttgtttcacttaacataatgtgctcccgttccatccatgttgttgcaaatgaaaggattttattcttttaatatggccaaataatatctgttgtgtatatatgccccattttctttacccattcatctgttggtagatacttgagatgattccgtaacttggctatggtgaatagtgctgccataaacataggagtgaagatatctctttgatacactgatttcctttgttttggatagatacctagcagtgggattgctgaatcatatggtagttccatttttattttttttgagaaacctccatactattctccatagtggctgtagtaatttacattcccaccaacagtatacaagggttcccctttcttcttatcctcaccaacatttatgattgcctttcttttttatacaagtcattttaactagggtgagatgatatttcattgtagctttaaatttatctgatgattagtgattttgagcattttttatatacttcttggccatttgtatgtcttcctttgagaaatgtctattcagatcctttgcccgctttttaatgggattatttgtttttttcctcttaagttgtttgtgttccttatatattctggttattaatccatcagatggatagtttacaaatatttctcccattctgtgggttgtctttttgttgtttcctttcctatgcagaagctttctagcttgatgtgatcctatttgttcaattttgctatgaacaaaaatggtttggttgcctatacttctgagatcttatgcaagaaatctttgtgcacgccagtgacctagggtttttccccaatgttttttcctagtagtttcattgttccaggtcttagatttaagtctttaatctattttgatttgatttttgtataaggcaagagataggggtctatcttcattcttcgacatatggatattaagttttcccagcatcatttatgaagagactgtcctttctccaatatatgttcctggcaccttagtcaaaactgagttcactgtgaatgtatgaatttatttctgggttctctattctttttcctttgtctatatgtctgtttctatgttaataccatgctgttttggtatctatagctttgtattataatttgaagtcaggtaatgtgatgcttccagctttgttcttcttgttcaagattgctctggctattctgggtcttttgtgactccatataaattttaagattttgttctatctctgtgaagaatttcattgatattctaatagtgattgtattgaatctgtagattgctttagacatgcgtcatgtctaaacctgcatcatatctaaatgcatgtcagctacagacatgcatcatgcttggataatttttatttaaacatttaagcaatattgattagtccaatccatgaacatggaatatctttccatttttgtgtgtcctcttcaacttattttcatcactgttttgttttgttttgttttgtggtagagtcttgctctctcaccccggctggagtccaatggcatgatcttggctcactgcagcctctgcctcccaggttcaagtgattctccctgcctcagccttccaagtagctgggattgcaggtgcccaccaccacacccggataatttttgtgtttttagtagagatggggttctgccatattggccaggctggtctcgaactcctgaccttaggtaatctgcctgcctcatcctcccaaagtgctgggattacaggcatgagctacaacgtctggccttcatcactgttttatagggttgtgttttcgttttttcgtttcaagatggggtctcactctgtcacccaggttggagtgcagtggcacaatcatggctcactgcagcctctgcctcctaggctcaagtgatcctcccacctcagcctcccgaagagctgggactacagacatgtgtcatgcttggctaatttttatatttgtttgcagagaaggggtttcaccatgttgcccaggctatccacctgcctcagactatccacctgcctcagtctcctaaagggctggaattataggcataaatcattgcacccagcctgttttatagttttaattgtagagatcttctgcttctttggttaagtttattcctaggtattttattttatttgtagcacttgtaaatggaattactttcttaatttctttgtcatattgtttgccattggtatagaaatgctactgatttttgtatgttgatttttgtatcccttaactttactgaatttgtttatcggttccaaaggttttctggtagagtgtttaggtttttctaaatacaagatcatatcatttgctaataagaataatttgacttcttcttttccaatttggatgtcctttattatttctcttatctaattgctctggctagaacttctagttttattttgaataaaagtggaagtagacatccttaccttgttacagatcttagaggaaaagctttcagtttttccccattcagtataatactagctgtgagtttgtcatatatggccttgatcatgttgaggtatgttccttctatactgtttgtcaagagtttttatcatgaagagatgttgaattttattgaatgcttttccagcatgtattgaaatgatcatatagtttttgtcttttattctgttgatatgatatctaccattgattgatttgcccatgttgaactatccttccattcctgggatgaatcccacttgaacataatgaatgatctttttattgcattgtttaattcagattgctagtattttgttgaggatttttgcatttctatttatcagtaatattggcctgtagttagtttgtttccttcctccttccatcccttcctccctccctccctccgtccttccctcccttccttccttccttccttcctgatgtttttttgtctggttttaatatcagggtaatactggcttcagaaaatgagtttggaagtattcccatctccttgatttattggaatcatttgagtagagttggtattacttttttaaatgtttagcagaattcagcagtgaagccatcaggtcctgggcttttctttgatgggagactttttattactgctcttatctcattacttgttattggtctattgttatttggatttcttcatgcttcactcttggttgggtgtatatttctaggaattgatccatttcttctaggttttccaatttattgggatattgtttctcctaatagtctctaatgatcctttgaatttctgtgatatcagttgtaatgtcccctttttcatctctgcttttatttaattgggtcttgtctctttttttcttaccttggctaaaagtttttcaattttgtttatcttttcaaaaaaccaattagccagatgcagtggcacacatctgtagtccaagctacacaggaggctgaggcaggagaattggatcagccgagactaggagtttgaggcttcagtgcactatgatcacacctgtgaatagccactgtattctagcttgggcaacatagtgatgaaccatctgttaaaaacaaaaaacaaaaaaatccagtttttttgtttggttgatcttttgtatttttttaatctcaattttaataatttttgctctgatctttcttttcttctaattttgagtttggtttgctattgctttctctttaaaagttattttagttattatttttgatgggtttttcttttagtctactaaaatatgcatgatttatatacaacaattacagtgttagagtattctgtattttttatgtacttattatcactagtgaattttattctgtcagatgatttcttgttgctcataaacattcttccagattgaagacctctctttagcattttttgtaaggcacatctagtgctacaaaatccatcagcttttgtttgtctggggaagtctttatctctccttcatgtttgaaggataattttgctggatataatattctaggttggaacagttttttccttcagcattttgaatgggtcattccatttcctcctggcctatgaggtgtccagtaggaattctgctgtcagaaatgtcagagctcctttatatgttatttgtatattttctcttgctgcttttaggatcctttctttatccttctcctttgagtttgataattatataccttgaggtagttgtatttgggttaaatcttcttggtgttctgtgatcttttcatacttggatattcatactgtaggtttgaagagttctctgtaactaaactttctattgcactgtctgtctttacatcctctttaaggccaataattcttagatttgcccttttgaggttattttccagatctcgtagccatgctttattcttttttattctttcttatttttcccccgactgtgtatttccatatagcctgttgttgagctcatcagtttttccttctgcttgatcagttctgctgttgagattctttgatgatttttcagtttgtcatttgaatttttcagttccagaatttctacttgatttttaaaattttaatctcttagttaaatttctctgatagaattctgaattccttctcttgttttcttgatgttcattgagtttcctccagacagctattttgaatttcctatctgaaaggaataccttcatcactccaagattggtcactagtgccttatttagtccatttggtgaagtcatgtttccttgtgtgtccctgatgctttcggatgttcattgatgtctgggcattgaagagttaggtatttattccagtctttgcagtctagtcttgtttgtacccaactttcttgacaaggctttccatgaattcaaaggggattgagtattgtgatctaagcctgcaattactgcagccatttcagcactagggggcgccctaagctccggagcgcctcaactcttttttttttttttgattttgtgtttattgttttttattaaccattcacagaaaaacatgcacctaatatgcaacttgaaagtccagttcacaactcatgattcaaaaagcagaaatttcaaaccattgttttcagaagtccataatataaaatactccaaacataaattcaacattgcatgcagcaactggccatttgcttcaaaagaagtgatcacagtgtgtatatatttaaaaagagaaacctttatttgtattattttttaaaaaactaagaagaaatacaacttcagaaaatcttttccagaataaatatttctagaaaattgaaaagtaactaaagacattgaaaagcagagctttattaagaaacatctgtggtgcagatacgaatatttaacttaaagctgtgatgtgtacctaaacttcaatgcataaaatgtaaagtttaacatatcaaaactccaggatttttagctttggatcatcttaaaactataagatagctcttatcacatttaaagcagtgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagaccagagcagaactgaaggagatagacacacaaaaaaacccttcaaaaaaatcaatgaatccaggagctggttttttgaaaagatcaacaaaattgatagaccgctagcaagactaataaaggagaaaagagagaagaatcaaatagacacaataaaaaatgataaaggggatatcaccactgatcccacagaaatacagactaccatcagagagtactataaatttccctctacacactgctgtaaatgtgtcccagagattctggtatgttgtgtctttgttctcattggtttcaaagaacatctttatttctgccttcatttcgttatgtacccagtagtcattcagaagcaggttgttcagtttccatgtagttgagcggttttgagtgagtttcttaatcctgagttctagtttgattgcactgtggtctgagagtttgttgtaatttctgttcttttacatttgctgaggagtgctttacttccaactatgtggtcaattttggaataagtgtgatgtggtgctgagaagaatgtatattctgttgattttgggtggagagttctgttgatgtctattaggtctgcttggtgcagagctgaattcaattcctggatatccttgttaactttctgtctcattgatatgtctaatgttgacagtggggtgttaaagtctcccattattattgtgtgggagtctaagtctctttgtaggtctctaaggacttgctttatgaatctgggtgctcctgtattgggtgcatatatatttaggacagttaactcttcttgttgaattgatcccttcaacattatgtaatggccttctttgtctcttttgatctttgttggtttaaagtctgttttatcagagactaggattgcaacccctgcctttttttgttttccatttgcttggtagatcttcctgcgtccctttattttgagcccatgtgtgtctctgcacatgagatgggtctcctgaatacagcacactgatgggtcttgattctttatccaatttgccagtctgtgtcttttaatttgagtatttagcccatttacatttaaggttaatattgttatgtgtgaatttgatcctgtcattatgatgttagctagttattttgctcgttagttgatgcagtttcttcctagcatcgatggtctttacaatttggcatgtttttgcagtggctggtaccggttgttcttttccatgtttagtgcttctttcaggagctcttttagggcaggcttggtggtgacaaaatctctctgcatttgcttgtctgtaaaggattttatttctccttcacttatgaagcttagtttggctggatatgaaattctgggttgaaaattcttttctttaagaatgttgaatattggcccccactctcttctggcgtgtagagtttctgctgagagatcagctgttagtctgatgggcttccctttgagggtaacccgacctttctctctggctgcccttaacattttttccttcatttcaactttggtgaatctgacaattatgtgtcttggagttgttcttctcgaggagtatctttgtggcattctctgtatttcctgaatttgaacgttggcctgccttgctaggttggggaagttctcctggataatatcctgcagagtgttttccaacttggttccattctccccatcactttcaggtacaccaatcagacgtagatttggtcttttgacatagttccatatttcttggaggctttgttagtttctttttactcttttttctctaaacttctcttctcgcttcttttcatttatttgatcttcagtcactgataccctttcttccagttgatctaatcggctactgaagcttgtgcatgcatcacgtagttcttgtgccatggttttcagctccttcaggtcatttaaggacttctctacactggttattctagttagccatttgtctaatcttttttcaaggtttttagcttctttgcgatgagttccaacttcctcctttagctcagagaagtttgatcatctgaagccttcttctcccaactcgtcaaagtcattctccatccagctttgttgcgtttctggcaaggagctgtgctcctttggagtgggagaggccctctggtttttagaattttcagcttttctgctttgttttatccccatctttctggttttatctacctttggtctttgatgatggtgacgtacagatggggttttggtgtggatgtcctttctgtttgttagttttccttctaacagtgaggaccctcagctgcaggtctgttggagtttgctggaagtccactccagaccctgtttgccagggtatcagcagcagaggctgcagaacagcaaatgttgctgcctgatcgttcctctggaagctttgtctgagaggagtacccggctgtgtgaggtgtcagtctgcccctactggagggtgcctcccagttaggctactcgggggtcagggacccacttgaggaggcagtctgtctgttctcagatctgaaactccatgctgggagaaccactgctctcttcaaagctgtcagacagggacatttaagtctgcaaaggtttctgctgccttttgtttggctatgccctgcccccagaggtggagtctacagaggcaggcaggcctccttgagctggggtgggctccactcagttcgagcttcctggctgctttgtttacctactcaagcctcagcaatggcaggcgcccatccccgagcctcgctgccgccttgcagtttgatctcagactgctgtgctagcagtgagcgaggctctgtgggcgtgggagcctccaagccaggagcaggatattatctcttggtgtgccgtttgctaagaccgttggaaaagtgcagtattagggtgggagtgacccaattttccaggtgccatctgtcacagcttcccttggctaggaaagggaattccccgaccccttgcacttccctgggtaaggtgatgcctcgtcctgcttcggctcatgctcggtgggctgcacccactgtcctgcacccactgtctgacaagccccagtgagatgatcccggtacctcagttggaaatgtctctgcattttctgcgtcgctcacgctgggagctatagactggagctgttcctattcggccatcttggaactgccctcactgcaactcttgcagacccctaaatacactgccttggtgaacttggataagataaggaagattccctaggttagcaggcaaagtcacttgctctcttttctctcttttccccagtcagaaggaacctctctctgtactaggctgcctggagttgagggagaggtgacacagactttcctgtgatcaccacagctgacactacagagtctcacctgaaggcttgcagaccagcacagtactggagttcaccagtactggtagccactaccgcctagctgctgctgatgtttattcaaggaccatgaccactttagtcagcaggtggtgaatcctgctgggactgagtctcttccatcaggacagtgcattttcttctggcccagaatgggtctagaaacaccatctaggagcaaagacttggaattgggggcttcgggaatctgctaagctggtgcccaagttgcaagacaaagtcctctgtgctcttcccactccatcctccacatagaagatgtctccccaagagctgcactgcctggaactggggaggggtgatacaggcactcccttagctgccacagttggttttgccctgggttgcattccaagtccactgcctctgagactagtgcagcaccagcgtttgcctgaggactgcagtccttgtggcctgactgccactcaaatttattctgtgatccaggccactttagtcagctggtggggaagccccactggcctgaaactgggttcttctcgctggagttggggattcccctgtggcccactggtagtctgaatgctccctccataggcattgacggaattcctacctgtgttgtgttctgctatgacagagcagcactgagctccattgtaaagtcccccactaacttcactctctcctccatgcacatagactctgtctcctcaatgcactgcctgggattgctgtagtcaatgcaagactgtctctcctacattcttgaatgcctctttccttgataaaaagtacctggtttgaacataggtacttttatcactcacctgatctttttgttcttatgaagatgctttcttgcatggatggttgttcaatttagtgttcctgatgggggattattgctcagggttctatctggccatcttgctctgtctcctacttcctggttatttttaaaaacttctgttttcttttcaaagagaaaattagtaaaatagaaaatagtgctgaagagatcaccctaatactaaaaatatgagagagtttaggtttatgaagcattcaatgagaaggtccaacatacctctgagttccagaaggaaaaccaagaggataggaaacagaacaattaatgaagatataatagttgataatttttgagagctgataaaatatatagatcttcaaattctagaagcttaaggcacagtcaaaattttaaaaaaaattctacacgtagattaatgggattggaaatacaggacaccataaacaaggagaaggtttttaaagcagtcagagagaaaaagaaagctgaattatctacaaagaaaaaggaattagctaagagcagactgaacagtaaaaataaggtcagaatttggtagaattaaataaattcttaaaactacttaatttcactaagaaataaaatcttaaaactgctgtgaggatacatcataattattttaaggaaaaagagaaaatattatcactataacaacctagaataacattgtctaatagaaatatcataaacatcatatataatttaatgttctctatgacctgcattagaaggatgaaaagagatagatgaaattgatttctgtattttatttaatccaatatactaaaaatatcattttcatatgtaaccagtatgaaaaagtgttaataatatgttgtacactttatttgtactaagtcatcaaaatctaacactcataacatatgccaattcagactctaaattttatcaaaaatatttatatttcataaaaaatacagatgaaaaagtaatttacatacctaagttgttacaagcatacttagaagttttccaatatctgattaagtattcatctgaaattaaattttaaataaattaaaaactcaattcctcagtttctgaagccacatttcaaatttttaaaagtgaccaggtgtagtggctcacacctgtaatcccagcactttgggaggccaaggtggacggatcacttgatgtcaggagttcaagaccagcctggccaacatggtgaaaccccgtctctactaaaaatacaaaaattagctgggcatggtggtgcacgcctgtagtcccagctactcaggaggctgaagcaggagaattacttgaacctgggaggcagaggttgcggtgagccgagatggtgacaccgcactccagcctgggtgacagagtaagactcaaagtctcaaactacaaccacaacaacaacagaaaaaaaaaaaagaaaaaaacttaaaagccacacgtgcctgatagccactgcattggaatgtacagatagaatttgatgtctttctaaactttggttcaagattaaggtcaaaacaaaacattttcatatgaaaactgtgagtacttatgtatttcaagaagaaggaaatataacccagaaggaagtaaaaggttcaagaaggaacaataagcaaaataatcagtcaacttgatgatcaatctaagcaatcaatggctgtataaaacatcaacagcaatcatctcaaatttaaaattataagtaaaacagtagtatgtgagactgatgtcggtgataggagttaaagcagtctaagggtcgatctgtttatgagaatagcaataatttgccttagagtttgcatagttcaaatatccttaaagtttttagcaataatcacaaaataaaaaagaaagtgtaaaacttcccatctggtagaaacaaaggagaataagtaacacgattaaagcataagaagagagccaaagcatgaacttcaaattgaattcctgaggtttttttttaaaaaaaagactttataggaaatatagaaagtttttatggattaaaagttttaaagtaaatctttgtacagggtatgcagcttttaaaagatcaaattctaactagtgccttaattattatattcctttttatctatagccataattttgttgattaagagggtgtattagttgtctttgacatgctacatcttgccctgcattcgtaactccagaattaacatgtccttaagttaaatgtgtttgaactgtgtgaaattacgcatttgttccctggaaacaaactataaaatacaaaattaaatttaatatataacatgcttaatatgaataatgtaggttatttgataagtatatgacacacttgtagcaaactaccccttccccacaaacacagtcaatacactgtgttttaatttaaaactattttgacttcagatgttctaaacagccagttttatatatttaaatagccatgcagttagataggagagttgctacagttcatcttctctagtcctatccttggtgataaatgttacttttactcactatatttattgtttaaatttttatacttaacagagactttattattgttgaggtataacatatattgcaaacagcattattcttaattgtacagcctgattaattttatgaatgtatgcactcatacaattaccacccagattcagagcatttcagcacctagaagtctccctcatgttccctcctagtcaattcttgtttaccaagggtaatcactgctatgacatatcacacagataatatttgcctggttttggacatcataaaaatagaatcatacaatgtaaactcttgggtgtctgacttcttttactcaacattctgtgagacattcagattttgtgactaaggcttttacagaaaacattttacaagtatttctcaatatcttttctccaatatagaaattaaaaaagagctttacaccttgtatcatttagtaacaagttaaaattttactttcttggggtgatgtgtgtcagtcatagttagcatttttataagaaatgtatactattttaaaaaaattgaatagtttaccattcaaataatcttccttcctccttttctttttgagaaggaaaatgtctttacaaggtaagtggcaaggcagagaggggtgagggagttatgtcaatagcagcagagaatggcattagtgatcagaaaaatatttttcatgagttcctacagatcatgtttacatggaaccatgtcatcacaagtcaaagccagttccgctctgcaaagatatatgtattttcctctggaagctaaaaatatacactattcctcattgaccttttcatccaattctccaaaaatgaaatcaatgccagtcatcatctttgatattataggtgtttctgtctttgtgtaaatttcaggcccttgaaagtaaaatgaaatcactgagtttattctttaaattttgtgtctgctcctcttacacccccaaccccaagatttatgcagattgcagagatggaagaaaaaagatctcttttaacttgaaactttgtctgcacttgcaaaaataaaaaaaaatttaaaacctgctgctttataaaagtcctttactgtaaaacttttttttactggtaattatctctgttgtagtttattttgtctggcaaaatgtaatgtggcagctgtaaaatctacagaggcttaatgaaattgctaggtggcaacagaaatgctagcattttaaaaggcttagcacatcattccaaaattgctttgacaaaattgttaagctaacaataagatcaagtttttaaatagaatttaccattcatggttaacatttttatagctgctttaatagggtggtcaaataagatatgattgttatatttttatttcttatttatttcttatttatttatttgagacggagtctcactctgtcaccaggctggagtgtggtggtgcaatctcggctcactgtaacccccgcctcccaagttcaagtgattctcctgcctcagcctcccaaatacctggaactataagcacgcaccaccacgcccagctaatttttataattttagtagagatgggattttgccatgctggccaggatggtctccatctcttgacctcatgatccacctgcctcggcctcccaaagtgctgggattacaggcatgagccaccgtgcccagctgttatatttttaaaaagaaaccacttttaagcaaactgtcgtttagaagtctgcagctaaaatattacacatacatagagtagttttgctctcaaagtttggatactcttcaggaaaataaaaaattgatattaattccatgaccttgaggtactggttatatgcctaataatgcatttgtatatcagacagggtgagagattaaaggtgctcacctcatacgttatggatattggtttatagaacgtgttggataacaggcacttactacagctacttggaagcagaagcaggaggattgcttgagcccagaagtttgaggatgcagccagctatgattgcaccactgctctccagcctgggtgacagagtgagaccccaactcttaaaaataaatgagtaaatatagaaagtgttacagaagaaacaaaatgcttaggaagttcatttgtagtttgctttactttgggaatgagatagaaaaagccaaatgaaattaatgtttaattaagtggtgtaggggaaaagaagtatctctttcttacccattgctaggttcatggctgaggcccctataataaaagacagattaacaagagaaaagcatacaaatttatggtatataagttttgtataacacaagagcctttggaattgaaaacccgaaggtacaattaaacccatgggggggtttgcactgtttgatggagaagtggatgaagttgagagtataattggataacaaagtgtgatctaatggtaataaactgggggaaacttagcaaggcctttttgatcagattcttctttgcgtccctgtgtcttcagagatgaggatgtttctttcctccagctatacaaagggcacctcttgaatgaaggtcttatgacctatttcagaggaaaagggtgggagaaggtcagagagtgaccttcctgcttccgtggttttctcaaataccaaggtgccataattatggggcagcatgttctgaaccccatcagtggataaggcaatttatttctaaatgtcagtggcagtctcaaattggtgctctttaatcagcttccatattataaatagagaagagctatttaggtctcatttgtagttggaaattactgatagttattctgcctttctaataaaataatgtaattataatttggataaaatagttacttgtaacactttttggctagctgtatctcctgtaaaatgccttacttacagctttgtaagctgtaaaacaaacaaaaagcatcaggaaaggatataaagtcatacatacctcattttatgtacttaataccagttaattgacatataattggagcaagtacaagatcaagaagcaacttaattagtgataccattttaatgtccctaatgagagcagtggttttcatttgtgtgtaggataggttggtacacatattggaatctccaggaaactttttaaaaatactgtgtagattcctgtactctgtctccagaattcacaccaaagtcctcagtggatcaggaaacagaaagcctgcgtaatttcttaattaccttaaactcccaaagtcagacattgtaaataagtttgtttcagtattcaaataagccaagctgactcttatcttaaatcatacttgaaaatgtaactaaaagagattagagaataaagatcaagagtattttctgggtgaataatttatacagtttctggtatctgaaagttgaaagaaaactttgcttttcttgatagtggaacttcaaaatttttgtgtgtgtgtggtcagcaaagtctaaattagtaagttattctcaagcagggcagaaaggcaactttaaaaggttgtggacctgtggtatagattttaaatgggaaacaaattctttttcttgcaaatatttcaattagataattctaatggcattgtacctgatctttagagaaattatagtttgtatccttaaaccacttttattgtagaagaaatatgtgaaaacagagttacaaaaactttttttcagtattttggcatgtaattttgggagatacagtttttattgatggtaagcataaagcagttggtggaaaaggtggaagtgaaaggcaaatcaaagaggaagaacatagtatttcaaaggaataaagtgagcagctcctcagcacattattaggaaggaggaatgaaaggaactgctactatttctttcatgctacttgaatcaggtggccaagaaatcaagagacctgcttccctctatccacgttgtcccatcacttaagccttgttacttttaataataaccaatttggttttactaatatagtggccaagaaatcaagagacctgcttccctctatccacgttgtcccatcacttaagccttgttacttttaataataaccaatttggttttactaatatagattgtctgtatatcacttgtttcattagtgttttgttgccaagtagcatagttctggaagtacataacaaaacacaactactggaagcctaattgatcagtagccataccagcattccagtggttgtggtttgagcaagcagcttgcatgtgtttagtcattttaaaaagagagaaaatgtgtgtgtttgtgtggctaatgtcatcattaagaaataaaaatatcttttatctcctattcataaaacagaccaatttggagtaacatgtttgcatgatttcatgttattagaatattgcaacttgtattacaaataaaaatttctaaaactatatgctgatactgtactgatcatgtgcattcaaataaatgtcttcatttaataagtcatgttttacctaaagttaatgactatgtatagtaaaacaccaatttgacaaatgtagttactcaataagtactaattggtttgatcgtcaaatcttaaagcaattgttctaagttgaggatctgtgctaactaggaatatcatgtaataagtaataaatagactacttacaaaaaggatattccccaagaaattaattaaagaacaaattgatattttaggatactttgtaccttaaatcatttgtatttctaatatttttttctacgtaaaagatgccaaaaaatttcccaaagatctagaatagaacggtttgagaattagatctattattctggaactacagtacttgtcatggatgatatgctctttgtcttctgtggggggaaaatgctaagtaggtgattgaggaaaaattcaaggagtgacttttcttagacatgtagtctacatctggtatctctgagaaaaggtttattagataataatagtcaccacttttatatggcacttactgctgtatgccaggaaccgttctaagtctttagttttggtttttgtttttttctttaatcctcacagcagccttacctatgatgtaacaatgatttttataaataaggaaatgcaggcacagaggggctaaataactcactgaagatcactgtataaaccataaatatcaaacttgggatttgaacccagggattctggcttacactatactgtctctcagtaaaatgagactacatactaaattactgaagtcagctactataaaaagaatgaaatgaagctgacaagtttctctgatattgaagcagcgtcattgtctggggtaaatacccgaggttcgtagacttgcattaaggacagggacacacataaggagtgagtttaggaacagaggttttaataggcaaaggaaagagaaagaacagctctctcttctctctcttctctctcttctctctctctctttagaagagcagcttaaaaaggttgtggacctgtggtatagacttaaaatgggaaactaatttttgcaaatatttcaattaattataatggcattgtacctgatctttagggaaattataatttgtatccttaaaccacttttattctaggagaaatatgtgaaaacagggttacaaaaacattttctttttttctagagagagagaagaaaaagagactcccgaattggaatttcagcccagaatgggagtgtaccaaattttgtaggcaggcttgaggaggcgatatctgatttacataggacccacagattggctggaccaggtgtgatgtttacatagcacgtggtaaagggtggccaccccgccctaatcttattatgcaaatggactttccacttggctggcaccatgttgtctgctacttgctgtacaggtggctggcaaagagaagggaagatggagccgccattttgaacatgcctagtcccaggtaaccttttcctattggcacagctgccagtattcacctatgcaagcttccagcttgcttgtccgtctgcagctcaattgtacgggctactctctgttagaaaagaaaatgattttggtactgcttttcattaaaggaataccttactgaggacttccttactctcactatctgcctaaataattctttttaaactcctatatcagtatctttccaaatcttctaggtgagtttagggatttggatgattagcaagatctgaccaactaccaccagaatataaattcttgagaaccaaaagttcataggagtttagtaaatgatgttgcatgattatctataccaagaaaacttaaatgtaaaatgtctttaaagagactatgattatcaatttacattattgtagatatcaatttcaatcatttacacaattttattttcaataagggattgctgttttatcctttatggtatcagagaaacaagttttttttttaagtagtaacaaaacttttgaggaattaatacagctttattttgtaatcaacttctagcatatactacaatttccagtgaaccttaaataatttatgacaaaactatcaagaaaatgttaaaatgtaggggaactattctgaaccatttattttctatttgtgcattgttataccagattattgatttaacaatgtatgtattgttatgaacatatggactgaattttttagggaattccatattatagagggactttgtcaaatccttcagagtttggaacagcggcctctgcatacatttttgccagacaccctaatagaacgtataaaataggaagactacaatttcttgtgcctgaatatgcaaagggatttttcagatcaaaatcatgtcattgttgttctaagtctcaaaatggtttcctgatacttttgattagtgtttccttaccatgtttgttgcctagttaagattatttccctaatttttaatagtatgtgtggaagatgaaaaataaggggacaatctaaaggaaatggcaagaaccctcagggaaaaaaatggatgaacataaaatgatcttagtttaaaagaacattggaaagaagctctaaggtgtttgcatatcaaatttctgcttatccttaaccttgcctctagctgcttgaaattatgtttagcaacttttctgtggaatgttggtaaaatctataaatataatcattagactactggaatcaattcatatcagatttactctttcataatagcattcttgaatgcagtcaacacacaattaaaacacagtacacggaattataagcttctagaatctcatttttaaatattcttttgttagcatttttttgaaggattttaaatacatttgctttaaatttcttccttttagttagacaagatgagtgaattaaagactgattctagccacaactctaaattccctcacttgcaggtttgcataaccctttaaaattattttaaaatattttctgtggtttgactatgttttctcaagaatccagtacgtaaatgtcatgtgtgtgtttacggaatttgacagcaatgtagtttgttgtcacggtttctttaactttattacaagccatttaaaaaatcacatttgaaaatatttgtgtaatttctcatttttgttttctttcttttctttttttcttgagacagagtctcactctgtcacccaggctggagtgcagtggtgtgatcttggcttactgcaacctctgcctcccaggttcaagtgattctcctgcctcagcctcccgagtacctgggattacaggtacccaccaccacgcccagctaattttttttttttttttttttttttagtagagacggggtttctctatgttggccaggctggtcttgaacccctgacctcaggtgatctgcccacctcagcctcccaaagtgctgggattacaggcatgagccactgcgcccagcctgtctgtatttttttaacaagcaaaagtatgatcctccttggtaattctgtttctcactgctcttcaccatttctctgcccaaaattcttgctgttccttgtacaaacttagtaacttcctgacccacatgcctttgctttggccgtttcttcttttttgaatcctaaccttagccatggtcaagtcttacctattaaagggccacatataaaataagaaattaattctttattgtagttgaagtaatttggctatcctccaaactcttttttttcttagatacctaatactttctatcttgtatttatgtatgtattatctccccaataatactttagactctattagcaaatgacctgtaatgttgggaagaagatgtatatatatatatatatatatatatatatatagtgcttaaaataaagatatactttaaatgttcaataaaagcaaacaacatattgtataaaagttgaaatatatagtttcatcattacacattgtacatatgtaccaaaacattacactgtacgctataaataagtatgattatatgtccattaaaaacaaaatacaacttaataaaaaaggagagatacatatagttcttaacagagtaattatcagtttactgaccttggttgtcctggtaagtgaataaatctctacattttagagtgataaggaattatgaattgctttcaccttcagcagttctgattggtgctaccatgctgaggaggggagagggtcagtctgtatccagggatgaaaaggaagaatgtagcaagccttttctggtctgggtggataccagaatccacagtgacaggacagggacagggcatagcatttaggcttctaggtggcattcaggcctctgtgttagctgtgatccgcaatcatttataaatttgaaatggtaacagttacactcaaaatcataattttgcctccaaaagaaagacaatctggaattagccatgacagttagaatcccagcttcctaacttagattcgggacttaggtactggagaactggacagaaagtctagtaagtagaattaattaaaatagtgggatggagattggcagtagtgagcgaaagaagtgttagagggatgttacagcaccatacatgcatcagtccccaagagaagaggaagaatctggaaaaaaataaaaaaccgagaaggcgcagtctttgtgtttgagtaccctagggctcagtccttggtcttcatttcttttctatcttaattctttttttttttttttttggtgacctcatcaagtcacatggctttaaataccatctagtaggccagcaactcccaaaatatatctgcagttgtgatctttatcccacatttcagatcaaattgcctaattgacatccccattcaaatgtataacagatatcttaaatgtaataggttccaaagttctaattcctgccaccacctcctaacccccacctcagcagcctgcactattttagacaatctctgttgatggcactctgtccttttaattactcagatcaaaactttgatgtcatccagagtcctctttttctgtcactccacatccagtctgtcaggaaattctgttgtcactacctctgaaatatcttcagttaccagcaggttctcaccacctctattgccaccactgtgcttattggccatcatcatctcacaccagattattagtgcgttgtcttcctaattggtctcctagtgtttgttccccttagttgataatttgacagaaattgattttagattgttttgtgatatctgtgacatgaaatctcatggttttgaatggtatctttttgcaagggaaatattgttttgctttgtcagttcttttccagctagattgtgtgttgtctgtgtatgaaataactaagaggcggcttttaacagaaaacttgtatagtgactgtaaaatacgacaacatatacctaagattatgagctgtgatgattcattgaaatgattcattgaaatgtatttggcaataacaattgtgagccaagtttcagaagtctgatgtatgattggttaaggctttgaggaccattggtctataacaccacttcagtgcaacctaagatgtgctgactgattaaaagttgcattcaaacacatttttcttctttgacaccattattaaagacatgtctcagattcataaacatgcaggtttttgaccttcaaaggaggaatgacttttagtagtttactttttaatcataagtcatattctgatcatgtagatgataggtagaagttaaaaagtcagaatgattcagtcctgatttaaaaaaaattcagttctggttgttttcaggaaagtatagatactgtatgataaacttttccatgaacttctgtcaatgtcttatcatttgacagagtgatatcagtataatttattcagattgaataatggaatttcagtcataggccttttgtgatttttctatagctattatcttgagtctataaccaagttcacctagcagttttcttaaaacctgtattaacttactttttatatgagggacaaaataaagtttattctaatcagtctgttttgttgagcctaatgtacagctttacttctaggtggaggcctactggtgtctagggaatgtatttgtgttaatactcttaggtatgagctcttaggcatctatacagccaagcattaaaacaaaaagttaagggacctcattgatcacatttggtagtacaaaacaagctgcctgaaatgctagtgaaataatgaacaaatgtaaataagataaaatctaaattcaagcaaaatatatacttcgactcaagacatttcattgtagttagaaaccttgtgaatgcctaacaggaattttcaaaggaattgatttctatccatttcagaacactatagtctaaatcggaatcttaacttgggatctataaatgggttataagtagatccataaaacttcagaatttatacagagctttatatttatgggcaatgtccttgagagagaaaccacacctttcaccaatttcttaaaggaatgcataattcaaaaaacattaaagagctactaatccttatccatatctatatgtcacgttgataaaacatttgaaccaagtttaattcttaagaacaatgaaagggctctatttctagtttctaggatctaccatccagattttgaaagattaagccaaatcaaggcattgttgttaataatgctacctgttgtatttgtatgaaacccaatctttttgtagcatgttgatttggtatatgttaactacttattaacatctatacaaataggctgcattatccattgaagtgattgctgtttcctgtgattataattttaagcaattttcttctttttttttattttttattttggtgcaattacaaaccagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaaggtaactgttaaatttttttgtttgtttttttatttgggtggggataggtcaaataaagacaatgggctaccatgtttcaaccctctgaaaaatctattgagttttaaatgaccgtgtattccaagaagttcagttattttatttaagaatccaaaatagttttataaagatttatggatctgagaaatatatgaaaaaaattaaccattagaagcacatgtttacaaatacttattaaatacctgctttgtataaaacaccgtgcctgaggaagatatagaaataactggaaagttgaccctgattaacatgtacagaacaatctgtaacagcaatcctcatcctttttggcaccagggactggtttcatggaagacagtttttccaaggatggggtggtgggggaatggttttagcaagaaactgttccactcagatcatcaggcattagattctcataagaagcatgcagcctcagtccctcacatgtgcagttcataataggattcgcattcctatgagaatctaatgccaacattgatctgacaggaggcagagctcaggtggtaacgttcacttgcctactgctcacttcctgctgtgcagcctgcttcctaataggccatgggactggtatggggctggaggtgggggttggggaccccgatctctaatatatggcaggatgaaataaatgctatggagagtgatagtattttgagaatgtacaagatgagcaattaatttttagtgtagaatgatatcacagagaagaggtagctatttgtgttaggctatgaagaatgaatagacttcagataaataaaaataggtagaaagggcattctactcagagtaattggtatgggtaatgacaagaggtaagaaattgtccactgtgattggggaatggttggttagactggctaggctagaatattactacctagagggatgtggttaaaggaaggaagaaaggctccaggtcagaaggaggatgatttttgaatgccagaacttgaggctttcttcttaggcagtggggatctatcatatttttaggagcatgactgatgtaatttgtgattttggaggttaaatttgacaaaagtagataactatgggagaaggaagattttgtgagtctctaattggggagttgttgttgttttgttttgttttgagacggagtctcgtttctttgcccaggctggagtgcagtagcataatctcggcttactgcaacctctgcctcctgggttcaagcaattctcctgcctcagactcccaagtagctggattacgggcacatgccagcacacctcgctaatttttgtatttttagtagagatggggtttcaccatgctggctaggctggtcttgaactcctgacctcaagtgatccgcctgcctcggcctcccaaagtgctgggattacaagtgtgagccgccgtgcctggccagggagttttaatactctgtggaaaagaactgaaaatggcataatgatttatttgatggcataatgaagaagtgaaggtttaaaatagaagtatccagtatgactatagtgatataactgacttcagaataagacctaattttattgtcaaagttatgaaaaaatttaggcatatatattgtgttttatagcagacattaggtaattgtgttatatagcaggctgtgggtaatttagcactgtggggtactccagagaattcagaattggctatgaacattctttcccatatgtcattccacataagtgtaaaaattaacctagtaatttcctaatagcaaaattgttaaatcaaaaatacatacatgttaaacttcaatatacattgtctaattgccatctaaaggaattctaatttctttaaactgacaatcatatttttcttttcagagattgaatgtgtatgagtgtgtgtgtggtgactaagctaaaggaaggcatcttgatttgagccatcaattatgtatctgaaaaaagactgacaagaattggtagagtgaattcagatttaagattatctacctttgatattccatgagctacttaagaattttgagaggtacaagcaaccattgaaaggagatagtagttataaggtaggggtaatgcttaaggcattagactaaaaaatttcccattacataagatgaagtatttgaaaagaattttttgtatgttacggagtagatatggtcttggtcattgttatgtatcatgaaggtattcaagtgtaccagtaatgttttattaagctggatagtatacatatatagttattcatttttattatttaaacaggatgcagtcattctgtacattgtacgattcatttaataatatttttaaaaagggattcgaacattggaaataggtatagtatgtgtgcataggtattatgaattctttctgtaagcatttaaaacccacaataaaatttaaaaagtgcttagtagaaatttgggatgcacaagtgcttttctgattttctgagaggtttcccaatttgccttgtgatgtctagatccccacacaagttaaccctatgtttaggaataactgttagaccacatatttgggaaaatgactaaagccactctattattttgccaagtgtttagaagcaatgttggggatgaaatgggtgtgggattgttgccattatcatgttaaagttgatttcttagtctgtctaattggaacttctagcttacctcatgcctcaaaatcttaagtgtaactctaaatacaaagaaaatcaagtttcttgatcctattcataacatgaagcaaaggtcagaagagtagccatatattctagcacagtattctggttttaaaatggcaagggcattttgaaaatgaggaaagtagctgcacttaattactttcatgagttaagaatatgctattaactagcactcaataaatgcttgctgttgatgacatataaattttttataatgctcagtgaccagcactcttgatacatgacaatgttctcttcattcagagggacttacacttaaaagtctttcataaactgtacatgtttgtatgaaaaaactcccttactatcaactatgtaaacaggcattttcatttatttaccttaaaactttacttttcaagataacatccctttaaatgagtagacaggtttatacaggctacactaagctttttatcctctggcttttctcttttattgggtaattttctacttcctgcttgcttggcagaaggtgtacttatttgacaattcctttgaaatcggtttgatgggatggaatttgaatcaagttcctgttgtgctttctgttcaaaaatattgatgtgcaccagagatttgtactatgtctctgataaattaatcttgattattgccactaatttgtagtctaaatatcaagaattattgctctctgtgctttttgaaaatcaaggatcatctttagaaagacaataatagtaaatctatttacccaagcttagcagaagcctcaaccgaacttgaccaaaaaacaacgaaatgcccttaatcacactataccgtacatactttgtattaaatcttgttaatccattctctgtcccgttttcattcattcataaatttgacaaatgtttgttatatgccaggaccctgtgccactgaagaagaaattctaggattgtctagtgacacagtccaatatgtaatcatataattaaattgaaaatgttaaatgttgggcttgtagggatactatctcacatccattacaatggctactatcaaaagaacaggatataacaactgttggcgaggatgcagagaaattggaacccttgtgtgttgttggtgagaatgtaaaattgtacagtcacaatggaaagcagtataaaggtttcttaaaaaattaaaaatagaattaccatatggtccagcaactccacttctgagtatatatatccaaaataattcacagcaggaactcaaagagatatttgcacacccatgttcatagcagtgttattcacaatagccaaaagctggaagcagcccaaatgttcattggcagatgaatggataaaaaaaactgtggaatatacatacaatgaatatcatacaggcttaagtaaaaggcaggcttgtcacatgctacaatatggatgaacctggaagacattatgttaagtgaaataagccaattacaaaggacaaatactatgtgattccactcatatgaagtatctaaagtagtcaaaatcatagaaacaaaaagtagaaaggtgattgccaaggactgggcagagagggtagagggaagaattagtgtttaatgagtatagagttttagttttgcaaggtgaaaaagttccagagattgttgcacaacagtgtaaatatgcttaacactactgaaatatatacttaatggccgggcacggtggctcacgcctgtaatcccagcactttggaaggccgaagcgggcagatcacgaggtcaggagatcgagaccatcctggctaacacggtaaaaccctgtctctactaaaaatacaaaaaattaaccaggcatggtggcgggcaccagtagtcccagctacttgcgaggctgaggcaggagaatggcgtgaacctgggaggcagagcttgcagtgagcggagatcgcgccactgcactccaacctgggcaacagagcaagactctgtctcaaaaaacaacaacaacaaaatatatacttaaaaatagatggtaaatttagtctttttttttttttttgagacggagtctagctctgtcaccaggctggagtgcagtggcacgatctcagctcactgcaacctccacctcccgggttcaagtagttctcctgcctcagcctcccaagtagctaggactacaggcgcatgccaccacacccagctaagttttgtatttttagtagagacagggtctcaccatgttggccaggatggtctcgatcgcttgacctcgtgatccatctgcctcggcctcccacagtgctgggattacaggcatgagccactgtgcccagccggtaaatttaatcttgtgtgggtttttttttttttttaaccacaatgaaagatgatgccaagtcctagagttttaataggtgcaaaagcattatagaaagttaggtctttaaatatcacttcaccatactatgttccactagctaaaaaactaatttctggtaatgttattggagtgttaatggcttaatgttttgctctagtcagataacacatttccatcttattagtttttaagtgtatatcatcttaacttgaaggaataactcttaagatggaaatttagccccatgagagagtacttagggcaccaaaatggatcctaaaataattctatttcagcagatccctggggccatttgcagttggtgggtctcccctagagcactagaacatgttttggtttgcaataaatgatactggtgttcctagtcctacagtaagtaacctagagttaaataagttgccagatatattgttaagctattatatcttataaactaaccatcacactcagtatgtaaagtgtgatgaaatataaaaggtaatgtgttgtggggaaagggttaattttaaaattagaaaataacaacctgctgttttgagctttaaaaataattttggaggtgacttttaggaaataccgaaagaaaagagttatggctaaataaatttgtgcaattgctttatatatcagatcttaacctaagttccatcataccctcagaggtcaaaggaataagcccaagaggccattaaaagtttaaaaattgcatgcataccaaaaaaaatgtgtcttcgtatattcttctggatagagggatcatagcttttattcttccttctttctaaagggctaaaaagtgattgactatttgctgacagatcccaaatgtatatatctctagcaccatgctcttgacttttatgtaaagctacttattagatatcttcactggaatgtgccacaggcatctgagactcaatagatctgaaattaaactcaatgtttcttcttataccctgaaacttttctcccttccattgtgtttcctgtaaatgaagggaccatcatttccccaatttccaaggaaaaatctaaggtgtcattcttaatttttcattcacctctggccccatttcctaaatcttacggttaatttcttttgagtctacctctttagtatatctcatatatgtctacatatattagctttcactgcttccacctcagttcagtccatcacaaatgaccagtgctgcaaacacttctaataatctcccaactccagtcttgcccatggctagttcattctgtaaagtacagtctgcatttttgaaaacccatatataatcttgttctattcctgtttaaaattattcagattctccatgtcccctgaatgaactcttgactcctgaggatggccttcaagttcgtactgtattggccttgtctgagccgtctttatttcaagctctgtgcttcaggcattctgaatttactttagtgtctgagatatgccacatactttctttcttctcaacctttgtgcattctcttctttcagctttgaaaactcttttcacccagactcatgctatttcaactgatctcctcactgtctggctaacttttactgtagatgtgaagctttctcttatgctctattgttctctctgtgtacttctcacatgtcacattatcttatcttgtatacagcagtgaagatttgatatggaagggaccctgtttgtcctcctcattattgtatcccctatgctctctactagtggtcctcaaagtctggtccctccaatcagcagcatcaccatcacctgggaaacttttagaaaagcaagttcttaggccctaccccagacctattgaatcagataccctggaggtgtgacgcagccacctatgttttatcaggcccttcaggtgattctgatgcataacatagtttgagaacagttcctctatgccatatttggcaatgagtaaaaataattttttaacccagaggtatctatgatttgttgccacacagtgccagggttgtgttgctaaaaggagctatgtagcacatgtaaagcagctcatatttcttcacagagatccagagatggctgaatgagaggtatctgcacatcagactgcagtgtctcacccagcctgtctcttgtggtcagtgagacaaatctttgaaggcttttcgtctcctctttagagaatggatcgagaggtagaaagtattctgttagccttcccaatgatgataattttattatcccattttatatttcaacaaatatttatcatatgtgggctctggattgaattctggctttgtcacctaagggatatatgaactcaggcaatttgcttaacctctccatgtcttaggtgccttatctatatggtgttaataatagtacttaccttgtagggtcattagaaagtgaaataaggtaatacttgtaaagtgcttgggacagtacccagcatgtagtaagcatccaagaaatagtaactatcactattatatgtcaaatgctgtgctaggtctagggatagagtggtaaacgggacaaaatccctctgtgcatggagtttatattccagtatgttataactgtatagacagaaatgtatttctgtcctacaggacttatattaatgagcttccttgactctcatctttccatgtcacattttcctttctatctatctctatctatctatctatctatctatctatctatctatctatctatctatctatctctatctctatctctgtctccatctctggttcctcccttttcacatatgtacttaattgcctgaatttctcaagtctgctaagtttagcccttctaattctttcctcttcagccctattgctggcactatggtgaagttctcatttctcttctctcggacttttgtcatatctcctaactcttattcctgcttcctgactgttccctctgccactgtcagattaatacccctgatcatgagggtcttttcccctcaaaaaccttcattgagttgctccttttttacccaatgaagtacagattccttaaccaaacatgaaaatctctccagagtctggtcccaactaccttatgactcctcttttttagatgcacaggctgtagccagtgattattagacagatcttgtgcttctgggcttcacttctttgcatggcaatgcctttctccctgttttcaggtttccacatcctgtgtaccatccattctttcagggagcatctactgaggacttataatatgtccaacactataaaaggtcaaggagatacaaagatgaataaggagtggaccttactctcaaaggaccaggaggctgagagacaaagaaaagatgatgattttgatgatggtgatgatgatgatgatgtgcagggaatatgcacaatgataatagatctatacagaatattaagagcagagagagggacacatagtctgtgttccaagtctcagcttaatacccctctgctttaagtttcttctaactcctctgtagtcaaaataaccttttcttgtctccttgagtttccttagcacaaatttactactttttttaatacataggtgcatacatatatatttatatctctctcctgttagacttctaattctggaaaaggatatacagattaaattagtagttttcaaccagaggcagttttctctcctacggaacatttgacaatatctggagacaattttggttgtcataactgagagggtatgagtagatagtactattggcatctaatgggtagaagccacggatcctgctaaatatcctgcaatttacagggcagctccccactgcaaagaatcatccaatcccgaatgtcagtagtgctgagggtaagaaactgaagccaaagttagaatcttgcctctgtcagttaaatagctgtgtgatcttgggcaagttaccttccctctgtaagattgaatgagctaatgtatataatgtaggccgggcgtggtggctcacacctgtaattccagcactttgggagaccaaggcaggcagatcacctgaggtcaggagttcaagaccagcctggccaacatggcgaaaccccgtctctactaaaaatagaaacattagctgggcatggtggcaggtgcctgtaatcccagctactcaagaggctgaggcagggagaattgcttgaacccaggaggcgaaggttgcagtgagctgagattgcaccactgcactccagcctgggcgacagagtgagtctgtctcaaaaaaaagaaaaaaaaaggaaagaaaaaaggaagaaattgttctacaatgtatataatgtaagtttggcacacagtaagcattatgtacatgctagctatttatattctaatacatataataatatctattagcttatgatagtagtgttatagataccaggatgaaatatttgtatcttatcacactccctagtttagtgactttcagaaaaaatgttgactaaatgggtagttgtctagctcttctatacatgcatgtcatctagaatcagctcttccatcttttcattgaatcctgtatatatgaatcatcactatcaaaggcacctacctctataggactgtgtcctggcctgctatactactatactaaggaagggaaatagagcatctctgtgctgtccgtaaggtacggatggaccaacaaaggtcataaaaccacaaattccctgggaggctaaataaataagcaatacaagtgagaagcagatcaaaacttttttttttttttaacttgtactgcctgattcttttttcgccttggacttgttgatatctttaataaaagatttaataatcctggattgtggattcctcttttttctcattacgtaaaacacaaaggaaaatatgtagatcaaatacttgcctgtttttgaataatccttcctgtgcgtgaccttcctcctttctacacaatatatatatgcagtctgtaacccatctattgctgctatttattaaccagatgaactaagcactgtcagtgatgtcagtgctgctatattaatttagttacatctttgtatcagtgatctttatccctgtgtcttttcaggctgcaccaacagtacaaacgcttttaatttatgaataaagtgtatggaagcatcatgcacttaccctgtactgactgtttggaataaatgtaaaagcatttttctttgtattctgtaagaaatatttttctaatattaggtaccaggttgtattaccatgttattttaacaaagatctgacatacctggagttgtctaacagctcaacaatgtatttttaattatgatttaaaatattactaaaagtgtggaacccatataaagtactgtcctaataaagtagcaattgtcattttgcatattttatttctctatagagatatttcatacttatatgtattagtcaaggttctgcagagaaacagaaccaatagggtgtgtgcgtgtgtgtgtgtgtgtgtgtgtatttgtatgtatagagaggtttattataaagggttggctcgtgcaattatgaaggctcacaagctccaagatcctcaggatgagtttgcaaactggagattcaggagagccaatgatgtagttcaagtctgagtccgaaggtcagagaaacagtagaattgctggtgtagttctagttcaaagactggcaggcttaagacccaagaaggtttcagtttgagtccaaaggaggaaaacactgatgttccagttctaaggcagttaagtagaaagaattctcttactcagaggagagttgacctttctgttcttttcaggccttcaactgactggaaagggcccacccatgatagggagggcagtctgctttactcagtctactgatgtaaatgttaatctcacccaaaaacactttcacagaaacacccagaatgagatttgaccaaatatctgggcatcctttggtccaatcaagttgacacatacaactaactattatatgatatatataggtgatcagcaaatgtacaattttataacctagttttaagaatgttttattatagtcatgtataaaaattattaacatatagtaactcacttggcatattgagaagtaagtataataaagaatcttaaagcatgggccatatctcaaagaatcataaaccaaaattaatataattgagcatgcaattagtcctttatgctaaaactatgaaaaatgtttttcatatatgaggttctttgaaaaggtatttacacttaagactatttggaaagaagcttaaagagaaatatgatacaaatagtctgcactaggctgtcttgaacttcttgcacatttaatttaattcaacagacatgtattgaatatctgctatgtaaagttctgtgttacttgctaagagggatactaagatatgttaaaaaaaaaaaaaagctgtttccctcaaggaggacaaacaaggactcatctaactatacaacaaggtaatagttaactacgtcatcaaagtgtggtgcagaaatataactgtatcatatatgagataatgctttaacctgtttggaagtatttatacagcatatataagggggaacatcatcactggcctatcagtaatggccagagacaatatttttggtggaaagaacagctcacgaaaagctgagaaagaaaaggatgtattttgccaacagaaaattatctagatgtgcctagtgtttaggttgtgataagggaaggagcgatgacagaagaaaacttaaaaatctgcttgcaaaatggaaatagaggaaggtcacagtgagccctaaatgtcattattttaaaatttgaatgtttaaaaattgagagccatgaacatatttgaaaagtggaacaacttttctaatctgtaatttaaaaataatttaggaagcaatgtaagggatatattaaagtgttgtgagactgtaagaagggtacccacttttattacatatatctgactaatttctaaagaggatttgatacagtttatagaattgaaaaataaaggtgaaaaaataggagccgagtaaataaagacaagaaaataagatgaagctgtagtaaggatgctgcaaaacgaaacaacaacaacaaaagcacatggcaagaattcagtattgatagaagtggcccagaagatgagctctgaatctcgacagaaggaaataggaaagatgattacttataactgagatcttgctttttgtgtcacagaaaaaaatagaagcaatcaggactttctctaatatatctctagcagcctccccgtgtgaattcccatatgctctgccatcttactacagatgaactgtccatgctcttctataaatccaactcctccatttgtgctttagcttcaatctccttatctactcaacaatgttcctctagcaatctccattctctcctgcatttccagttttccctgttgaatcatttctgtcagcataaaaatatgttgagtttttttaatctttaagaaacaaacaaagcaaacaacctaaagagaagtcctttgattcagcttccttctccttgtactacgctacccattcattgtgagaaaatgcaaatcaaaactgcagtgaggaaaaacaaaaaacaaaaaactgcagtgaggccaagtgaggtggttctcgcctataatcccagcacaccgggaagccaaggcgggaggatctcttgaggtcaggagttcgagaacagccttgacaatatagtgagatcccatctctacaaaaattttaaaagttagccaggagtggttttacatgcctttagtcccagctatttgagaagctgagacaggaggatcacttgagtgatccaggagtttgaagcaacagtgagctatgattgcaccacctcactgcagcctgggcaacagagagagatcctatcaaaaaacaaacaaaacaaaaacggcagtgatgcagtgagatttattggtcaatttttagattggcaaaacgccaagtctttgtaatacctctatggaaaaggtttgtgaaaaactcttacatgtacaaaaacatgtggaaaaactcttacatgtacttctggtagaaatacaaaatggtacaactgttatgcaagggaatctgacaatatatataaaaactgcagatgatttactttctcatccattatctcagaaaatccatttaagagaaatacttacaaggctgtttgctgaaacatcatttgtagtagcaaaggtttgaaaaaaattttaattctctattaataacagattggttaaataaacagtgctttaaccactaatggaattctatataccatttaaaaaaataagatctctaagcattgatatggaaatacctattgataagttaaaaatgcaaggtgcctgccaggcgcagtgggtcacgcctataatcccagcactttgggaggctaaggcggacagattacctgaggtcaggaattcaagacgagcctggccaacatggcaaaaccccatctctacttaaaatagaaaaattagtcaggcatggtggcaggcacctctaaccccagctactggggaggctgagccaggagaattgccgggggatggaggttgcagtgagccgagattgtgccactgcactccagcctgggcgacagagccagactctgcctcaaaaaaaaaaagcaaggtgcctagtaatttttaaggtttctgaccttttatgaaaggaggaaataagaatatatattcgtatttgcttgaatttgcatcaggaactttaaaagctaacaaaactgattatgcataaaggatgggctggggaattaggaaaacatctgttgtaataatttccagtcttgctatctcttttaagctctcatatacttttatggaaaatataaaatgatgattttctcaaattgtgtattatattttctttggaacaaaataatctgtttttatagcacttgcttaattttctattgtattttatcataaaattatttcttaaaaattctattcctagatccacatttattctcttggaatgacactgtattggggggctgattatgaagtgcctcagagccaagtaagttaagtttttacagttgttatactttttacatatgttcaattttacaccttatatcatagctcttccacacgtttatacgtgttctacagcatgctgtcaggtgtaccaacattcctatggagtttgtttacattaataatgtcatactttcaggatgaactttcagtaaagtactaaagacactatttttaaggtattcctagaattgtagcaatcactacccaggtttcaacaactcagtctgtgagatggacctggcctcttcaaaaattatagcaagataaatgagcgtgtactttattttatctaatgtagtgactgttaagagggattgaaaatctcttgtctttgatgattcattctactgaatgtaatagcttttttgatgcaaaaactctaggaatagtagccctatgtctcagagtgttgtattagagaatgtcatagctttttctcttggcacttcaaatcgtacatcatacttcacgacccctgtaacagcagacacaggtattaaagtaacacttgctgaggtcttgggccctgtttgccattgggctgcttctagtcattattttctaaaataattctgattcttaatgaccaatataaacatagtagtaaatagtaattgaaaatttaaaaatagctatatttcatcaaggcaagatataacatatagaattaggttttattttaggcatttataagtcaaaaccaaaaataactaggtgtggttttttcttattaaataaaaggaagtaacaagcattttagccttttattctaaaatacaaacatcttaagatccataaaagataaataatattcttcactttgtttggttttattttatatcatgaaaaataatgtatattttctttttctcttcagtttcaattctgtaaatataaatgagaaagttaaaatattactggaaatattggtgtcatatattatgcaacctaacttgtaaaatgtgatcacagtctataacactttatgttcttttctgataactggaaataaagtcaatatcaaatataaatagagagtcaatatcaataaatataaattagaggggaaatataaacttgtattttaggatcagaaatcaggatattttggaaatatttaatattaatttaaaagtatttattaagtacctaccttgtgtcagatactgttagacactaggactatagtgacgcttgcctatggagttttttggaaggaacagacagctaaacggccaactgcaacataatgcaataaatgctatgttagggaaaatagaggatgctatggaaaacagagttgggacttctggttaggcttggagggtcaggacagatttcttaaaggacattgcatctaagctaacacctaaaggatgatatattaataatacccaaatggataagaagtggaagagtcataggaaaggcatttgtttagaccaaagtggatataccagtttaaactcccgtcagcttggatgtgagttttaattgctccactccttaccaattcttgtattgttagtatttttatttttcactattttattgggtgtgtagtggcttcttcttgtagtggttttaatttatatttcttagtgaataatgacattggccaccctttcatatgctctttggccattcagatataatattctacaaaatacgttaactaataaaaaaaaaaccctcacattctggcttgtctgtttgaccaacataatgataatttatatttaaatggtcttgaagcattgcaatattttaaatcttctttaagttatcatgggagtatctaattatatttatacacattgaatgtattacattttatataatattaggaaacagtttattcccccaaatggtgtgtatgtttgtgtgtgcgtgtgtacatgtagtaactgtttatcaaaacatttgaataagccaagaatttcactactttactttatatttaaaaatgcccagagtttttctgtacttcctttctagggaagtataagttaactatcttctgctaatatatttttaaaaaaggtaaaacacagtaaaatgcttatgctgataaaaaggaatttatttcctccaagtatgtgaagtgtgttttagtgtggttcctgtgattcctagaatgatttgtctcattagaaaaaatatttgctcacatttactcactggcttttcctttatttatattcagcctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctggggtaagctacagttacaatagtaaatatagtcatattttaaaatttagtagatatcacaaaattttctttaaggatactatataggtagcattttctcaatgaagactagaaatggaaaattgaatttcttcttctaatataaattgtttatttgaaacaatacttaaaatttagaagctcattgcaataagtctagattttgtgagaattattcccaaaaatatcatagaatgatagcatgtttgagctgaaagtgtctcctcttgttttctttcttagatcttttcccaaggagcttttagcaaatgcttctattgtgaacacctagaaaaaatgtattaacatgaaaatgggttttagaaatatttaaatgtactttctgttgctttatacctgtttcgtgaccactcatttgtctggatcttctaggtatttcccaaaccttctccactttcccttcttctcggaacactgctacctagtgtatccagggaatccatgcttgtatccctgccagatttccccaagacctggactcttctagtttttctcttgttttggatatgaagaatcccaagaataaccaatgctatatattacctgaaagtcccacctctgttctgcatttctaaggctgtattttatcttgtttgccctatctgatctggatctatactttatctgctcttatccttagggttgtagtcctggagtgttggtccctcttccttgcacaggttacaaatttaccactgccacacagtgttcttgttgacttcctcagaattcctcatcggtaggggtttagttcccatcttaaccaggatgtcagatggctgccaggaatgtattcaaattctgcacagtttttcagttgataacaaacaggcccacagatcttctagacaaatggtttgtaaactctccctcaagaaacctttgcggttctatagtgaagggaaatgtaggaagtagaggccgaataaatggagttcttggttgcccattttccctctttaactagagcagctccagttttatttgatctgtttatatttctgcgtgtgatttttttgaacaaaggtaaagctattaaaaaatctttgaaaaccatctgtccagaccaaagtttctcatattgttttcaatatttttgttttaaaaattcctctatgaccaaataagcttgagaagaaactatttaaaggaaattaaatgtattttcactggagaacttcttagaacctttaatatactagactatattactaaccttcaagaagaataggcatgtaaataaagcatttcccaaactttcttggtcttggaggtctttttttcagacattctcataagactaatattctttaaaacttcactttatggataaggaaactgatacccaaacaactatgggatttgagtttcctattagacagtccagggacttttttattacaccacactttctctaagacttttgtgctgcttgctaattttactcctatagtaaaattgtgagagatatttttttctgtctttgaatgaagaattttttttctgtcaccatagaaattatattacctatctaataattgcccatattacatataaaatcttcatccctttaaggtttagcatttagttctctttattatagtggatctttattgttcatttatgtatgaaacctgtgctagggattatagaagatacaaatttgaataaaatatttgatctaggagctcttatctaaaatgccataaccatttgcttaattataaaatgaaagaaggctataaaatgatacatagtaaaaattttaacagctatgagagtttaaaggaaaaggatacaaattatgactgcattgaaaaatagcactttgaagctgagcatggtgatgcatgcctttagtcccagctactcaggaggctgagatgggaggactacttgagcctgggaggtcgaggctgtagtgaggcatgattgcaccactgcagtccaacctaggcaacagagtaaggccctacctcaaaaaaaaaaaaaaaagttaaaattaaaaatagcacttcgaactgtatcctataggctagataatctcggcagagggaagtgaacctggataaaggctgtgaaatgggaaagcaggaatgtttggggaacagtatgacatggggtgtattgtggggttatttaatgggagagaaaaatagaaggatcagttggaatcagcatgtagagagcctctcttcacaaagacaaatttttactaagtataataatgctccccttacctttctattgctcttcctcatctcctagacatcactgggtagaagtaactccaacagctactgttttttaagtgtttgtttactttgtgccagacactatgctaaggggttgatgtgcattatcacattattcatcataacaacctcaatttaatagagatacttttatcctcattttagagggcataaaactaaggctaagaaagattaaataacttgcacatagtcacagatacggtaaatgatggagacataattggaactggggtgtttttgaccccagtatattccttaaagcttttgttgcctccagtagctgacagaatgagttagtctttcactggtgtgaaattcattctgagtgaccatcattcttacttaacattaattagcgtgagtaaaagtcagcaagccagcttacttgtctaggtttttccactgatttaatgttataatatttggaccacaattttacttatctgcaaaataggaataataataatatgtgtcaatcatccatattattaaactgttgtaaaagtagttatttccacattaatgagctgctttgtggtccttagaagtttctttgctatttctccctttatttataatatgaggataatattgtctaccatatgaggttgtttgaggattaaatagcacaaagtgtgtgcctagcatatagtaactgttcaataaacaacagttattaatagtaactaacttcaatgcaggaattttcaaagatgtgggatgttagtaatactgtcttttcagtcactgacagtacagtgtaatctggactaacatcatttatgcaacttaactgataacatgatttcagaaatacttccatttacaagtcttcttataggtagaaaacataatgcttgagccttgaatataccaccttagatgggtttttaatccatacttcagcaaaattcactaatggagcaatattaaaacatttctgtggtatgtgcgagtttgtgtgtgtgtaaacaaatatgtatgcatgcttttggtgctagatttaagtaatttctcttcaccattctctcttcttccatttatattgacatttctcctctatttggccacctgaataaaacagtggtctgtccagttttttatcccttatagtgtggagtttgacctaatttgacatactttatttcaagcagataccctttgctaaagctattaaactttaagattacattttgttttaaagggaacttaaaagagcattgatttaaatttgttatccctcagagcgtccatttaaagacttagcatttctcggccaggcatagtggatcacgcctgtaatcccagcactttgggaggccaaggcaggcagatcacttgatgtcaggagttcaagaccagcctggccaacatggtgaaaccctgtctctacttaaaatacaaaaattagctggtgtggtggtatgcaccagtagtcccagctactctggaggctaaggcatgagaatcgcttgaacctgggaggcagaggttgcagtgaaccgaggtcctccaacctgggtgacagagtgagactccgttatatttaaaaaaaaaaaaaaaaaaaaaagacttagcatttcacaaatgtaatttctgaagggcaagatctataaaattatttctgaaagtaatttaaattcctcaattcatagttataatcaagagaaagctttattataccaaaattaatgtggtttttaaattataaactaacttaagagtagttagtggttggggaaaaaagaagacttcaagtttactgttttcaaatagaactcattttaacaagtttaatctgatggtattttctagttagtaggttactcttcagtcactgcttcttcccttttaattttctgaaatgaattggccagcactggtctacataaatcttatccaagaatacaaattaccctacaaatacaataggacatagagtctcattatttaatgttacatcctccaaaaactgtgtaactagtgtcattctgtaaacagttaccatgaaaacaaaagggagatccttttgtcaaacttgattttttattacctgtgtacagacagatcagctttcctgtaacagtgaacaaaagcctgatcgaagccaggctattcgagatcgattgcgaggaaaaggattaccaacaggtaagagtatattaataggaaatgtctaggctttaaccttatcccattgttttctttacaaaattatacttacctggctttgaaatctggtaattgagactatgattagaacgtaaacgtacaaactggaggtagggaatgggcaggaacactagctacattaaaaataatttcattaaacttatacagaaaacattattaatatacttaggattcccagagtaacttatttccctttccagtattggtatatcaataataataatatttatttactttatcgtggtatttcatattaaaaatactttttaaagcatgactaaataaacacatgtatatgtttatgaacataaacactactgaaacaaaagtttcagaaaacgtttttcttactgcactctgatattttttatcatatttctttttttttttaaatgctagtaataactcactaaatagattttatcatggagttatcaaatactaccttaggtcatgtgatacttagtaaataaaaactaatgatgagtagtgattttgctatttgtcaatagcattatataattctgtatcctatgataagtattaaatttatttttttgaaagaaatgaatggaaatttcaggccaggcgtggtggctcacgcctgtaatcccagtgctttgggaggctgaggtgggcggatcacctgaggtcaggagttcgagaccagcctggccaacatagtgaaatcccatctctctaaaaatacaaaaattagccgggcatggtggcaggcacctgtaatcccagctactcgggaggctgagacaggagaatcttgaaccggggaggcagaggttgcagttagccgagatcacaccactgtgctccagcctgggcaacaaagagtgaacttctgtctcaaaaaaaaaaaaaaaaaaaaaaaaagaatggaaatttcaaacacttgaaataaaagtaaatataattttatgtgacaatttatttttcattgctactttcaggcatggcttatttataaaataaacttttgattttgttgattatctttgttctcttcttatcaagcagttttgagaatcatgataatctaaacattaacagaaatacttttttagatcttgtcctagatcttggggctaggtagaagtaaatgtacagattgcttaaatatattctaacaaaatatattctaattgatatagcttaataaaatagattaaaaagttaagattttaatttaatcagagcatcagagaaacctgtcttacttaaaacctatgagcaactctaattgtgaaaaataaatgtagaccttgactatctggaccaaatgttttacagagtcagaactctcatatctgagaggaaggaatgtgtaagttaaagaaaagcagtaaaattgtttctaagggagtgattttgtaatggtacagttaagtatctgttttggtgcttccattttaattattgtgaataaagactatctgaaaagatattttagctttcatttcattggtatagtaatttatttctggttagatcagagtttttttctaatgcatatatgattagtttatatatgggccaaaaaaataacagtgtggtaacaattttgaaagtatttttcatcctttcttgcaaatatttccttcctatacttatgtccccatactgtacttttgtcactttctttttgtaggtaaaaatatgtttatttttatactattctaggatttgagatagtatatagtgtaaactttagcactaataatagcagcaatttgttaattgatcaaatttgcagtcagtctcctattttagaatcgaataataacaaacttatagatgaatatcaatagcaagctgaaataatcttttgggagacatagtgaacattttaataagtagaacattagatttaaaagacatttttgtttttcttacttatctttttctattttctccctctctttctttgctctctccacctccctctttcctttcctctctccctccctcctttcttatttctctttgttattctttctctaacctctttcagcagttccctactatcatttcctactaccattaagtggccatgttatgtagttgaagtttatttgcttatgtgttacttcttgatttagtaactgtaatgttgtattattaatttttgcagacagtgtatttttctaagaataaaaaatattcacatatgatttatttatgtatatatgacttccatcctatctccctttccagtgtgggtctgtagaaagaaaaaggtgagccttgcaatatttatcaaattgtaaggattatcaaatgctaacataatttagattttattactttcaatggttcagaggcttaatgtttcagaaattaattgttacatattattttaaagatagcaattaagagattatactgagtctatacctacttgataacatatttttaataggttatttgtcatttacatatatacgtatatttgtttcataaaggacattcataaaagttaagctttctggacatatagatgctggggatagggaaaacctatattaagttcattagtttttataggtgttcagtgtatatttgttgactgaacgagaaaaggttttatggaaatactggattttgaagtgtaatatatttgtagtatacttctttaatagctccataaagaaatatgtgagactatggtttatttatttagcctatgttaaacattaagttgtatgcaaaagaaaaataaaacatcttgcctcatattattggaccattttcttattataacaataaaaacatcagaaattttaatccagattttaatgccttttatttgtgattttgtttttataatactaagaaagatttagtattattgtctaatagttccttagaattcttattattaatatgctgttctaatacagataaggaagcgttgactgtcatgactttacaaaattaacagagaaatcaaatccttaagtagattgtttgttgattttatcctctaatagtcatattggagaataaaatctcccttgtatctaaactcaagagaatttgtgagtaattacaattagtcactcaggattaaccaaattttgtttgtgtttctattttttttagtagagttaaaggtcctaatactgaaataatagtcttatttggatcaagtataaggggagagtattctttagaccttcttaaccatcagtgctttgcacagtagtattgcacaagtgctcttttcatttaccttttacaaattcataaaacctcattttaaggacagaaccaatataaatatactaattatagccattaccaggcagaagcattcagcagctaatagtcaactgcatagactaattttaaaagtttaagattgaaaaaaaaattatctcttgaagaagtaattcttctaagacacctaggacacttggcagtgccagttcttaactgtcagtggtcaattgcagcaaagcaaccttgtgatacattattaataaaacattttcttcagtgtgcaccaacctaaaatctgtatgtggtgatagcattagtttattaggctcctgactacaggagtagtctttaataaagaaaatgttaagatggacagggagatacagaattagatggaaagatgtatgcaaatttggggataatgccttatacctagtgatttaattgttcagctcaaatgtaataaagatttttatctataagtaaatgaccttaaaaggtctcttcttatatcttacctccaagatctgtcacagaagctaaagcctaaactagtgggctctctgaccctactttgttacctaatactgccagtgctgattaaatagcttcactgagcagaaagaaatcaaacatttcctgccaagcttaaggtggaaacttacactattattcagatcaacatggtggtgctttagaacttacgcatattagtaatatcatgtttctttcttttgaaacgcacttggacacatttgtgaggatacatggggacttggggagcctcttttaatattgaaatgccatttcgaagtttacttctaagagatgtgaatttttgagtctgggtgaattgaaaggtaaatgatgatatccagtgtaggataatgttaatcacatataacaaaaatagttaaaacacaatgtaatttacaaggaagttttttctaaaatttaactaaaataaatgggatgtgttctattacaaagactttttatattcttgaaatcttacccaaggaatacaaatatgaaatcttttatttgtaaataaagtatatttattgtttgccatttaacttttagcaagctatgcattctccagaaggaaaatgcttagggccattgcagtgatctagtcaagcaataatgttaattggaaatagggtgatggcagtggaattagaatacatgaaataataagatgtctttgagaatttaaatagccatcatttactgttggatttgatatggggattaaataaggtaaaagatttaaggatggtgcccatatttctgttttgaacaatcagttgagtaattgggccacttattgtaataggaaagactgggggagaatggacagttctggatgtacgaagcaaaagatcagttttgagcatgttgcatttgagggtcttctgaaatataagtagaagtttcattacatatgattggaactcccagaagaggtcggtgctaagcatatcaattgggagttgtcaaggtatagatgatattactgccttgttaatggaagaagttatataaatacaaagtgagtagatgaaattctaaaactgacacctaaggaaatccaacatttggatatctcataaaggaagaaaaaccaaagactaagaatgagcagtctgacaggtaggaggaaagcaggtatgtaaagagaggaaagattgagtaaaggatggtcatcataaccagcttttactgagaagtaaaatatgtataccaaaatgtccatctgatttggcaagcagagatcattggtcataactaatgagagttgctaatgtatagagtagttggaggctgattaaagtgggtacaataatgaatgggaagtaagaaatgggagatagcagtagctagggggaaatgtggttaacagaggaagagtttggtttggtttgactatgggagatactagcttatgttcacatactaatgggaatattcaacagaaaggaagaatattgaaaatatgaggagatagcaacagagaattaacgaaagaagtaaagtctttgataaagtaaaattatgaggggggaatccagaatacatattggggattggccttcaactggcaggaaatttcatcgtttaagatggcaaagaaaagagtagacatagcctggcacagtggctcacacctgtaatcccagcactttgggaggctgaggtgggcagatcacgaggtcaggagatcaagaccatcctggctaacatggtgaaaccccttctctactaaaaatacaaaaacaaaattagcgtggtggtgggcgcctgtggtcccaactactcgggaggctgaggcgggagaatggcgtgaacctgggaggcggagcttgcagtgagccaagatggcgccactgcactcgagcctgggagacggagcgagactctatcccccctccaaaaaaaaaaagtagacataggtagtatagaattactcatggaaagatgagaaagctctcctccaacagctccggttttcctggagttatgacaacaccatcagccaaaagaatagggagttaagttagaaaatgtggagaatgaggaaaagtgaaacagtcattgtggaaagtaagcacactgttaacatgtggtgttgcgtgtacaaagtgattgactatgaatttatggtgttgccaaatacccacttgtttgatgtttttccaagttttaactgcttgtttggtagtcaaggtagcaggataaggcagatggttaagttcatctatgtgtggtttatgatccttgaatcctttccattctttttttaaatctattgtgttctatcaattttcaagaatatctctgttctctattcaataaaattttaaattaatgagttccaaatgtggtttgtttaagaatataacatccctaaaatactgtaacacagacatatgtttatcagttttcaaattatcttaggttagaagctggagtctgtgacaatctgtgtctggatgtggtatggtatatttcttggtgttctttatctgatgtgcccaaaatatagatgttatccttatttacacttgagtagattcatgggaagatgaggcacaataaaagcacaatgttttaatcttatccttaagcaattatttgctgccattctgaaatgaattccctttttaaagattttttaaggtaaaatttgtgttcagggaattaaagcttatagttgttacactaaagaggcaattgatgtctttaaataaattaacaagcaatttattattattaaggttttagtcattattttatattgtatagcagatagatatcacagcgatcacagaaggtagcacatgaaatcttcagtgtttatgggctattgagttagtgactataaaatatttacccgtatttcttttttcagtagtggccatatatatgcttttttgttgaatctatggattcacaaaattaatttctggatggacatttttggtgtgtgtcacatttatagactactgccttttaaaaaaaagtaaaatgactactgatttttaactatatcaaggactaaagaataagagttggtactttattacaattggcaaataatggtaaattatgttctagaggaaaaaacttttttagtgcatgagggtctgccatggaaacagtaagtttctttcataacttaaacacagtcaaaattatttggatttcaaacacaaagttttctgaaaacatgtctaattataataaaatcttgatacttaagaattcgaaatgctacaatcctatttccatccagaatatagcaagaattctttgtttcttccttaaatgtatgtatttaaaagatcgaaatatactagggctttatagtgatatgacatacatttgagttatacctttagaagttaaagtagttcactatacattccattactgccccaaatcatttcttggatagtgaatattcttccaaactggatagttgtctgcttttttaaaaccaaataattcacatttgatgaatataaaataataccactcaaaaatgtcagttcagtatattgcttttattagataagagacgatgaactatgaaaagttatgcaaacatagtatctctttcctcttccactatgaccatcatcaccatcccatttcacctctgatcttccatttggagcatttaggaaattgccaccactttcattgtcaatagtggattacatttccatttattttctaaaaattgtgtgcatacatgatagattcttatcattccaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaaggttagtaattctgtgcatgtttgagaaagaattgaagtattttaaatatttttttgaaataaagaagggttattaaattattccacaagtcttattttcactgccaaatttttgtaccctggttagtctcttacttctctgtcaatttctgttctcccttccatcaaaaccctaattgaaatactctgcttccacaaagtcatccctaataaaaatgcccagtcacgttatagtctctcgatatttgggatagtatatttttagattgtaagcttctcaaaggcaggaggcatattttctacttctttttgcttaaattctccaccataccgtctaccatgcactatctcatgggaggcttcagtaaataactggtttgtggaaataaaaagcagttcatcaaaatcagcaatgccggagaagcagaatagcatggttatggtgcattgcttctcaaaccaccagcttcaaattacaaattttgggggcacaactgtagaagattataatttactttgtctggaataaagttttgaatccataccttttgaatcatagtacattttaggtttacagagtcagcctaggtttgaattagttcctccattagtaactatgtggtctttacttgggcttcatctctccaagtctaaattactccatctataaaatgggcttctcaaagtaggttaattaggtaatgaatgtaaagtgattaatattacattattagtgtgagtaatataaaaataactttataaatggtaatttcttattctagagaaaaactgtttcaaaaatacttgatttcacacacaaaactcaatatgttgattggagtaaaattatgtccaagacatatggatagaggctattttcagtataaatagatgtgacatatagaggctatttttagtatgaatagaagcaagagaaaagaagagataatttttaatctaattctgtacattttttaagattcaagttttatactgcccttgcttcctagacaaatcctaggacatagctgattaaagacgactttaagatctttctagttcaaagaaaagaatgacataattaaggatcatatttatttttaagatcgttattctagtgtaatattttttattaatatatttcctttaaagtattctaaagatctgttgtcctgttacttaagtttcaggcatagctctggagctgaacaacataatttatgagttttgctgtactttgagtaaaagaagctttgcattgttttttcaatttcaggaattgaaaattagtaaagaatttgaaattatggaggaaattattgaatagttaattgatatgggttccgatataacatgaatttttcaaaaacattagccaactttatgagatggttgtatataaccttgatcgaatactttcaaagataggaagtaaaaatttagaaatttatattatacacaacttcacaacttttggaattgtgatagcagagagattaggcactttctatggtttaaaagaaaagtctccttttttatgttgtacaacagctagtatatgaacattaatttagtctgaccttctgtcaagcatgccctcatggaaacaattatataaagaaatcttgtccattgtgaaaaaaaaaaaaccttcaatgattcaaatagataaaaccattatagttttgaaatagaaataatgaagatatgtaccaatctatatgagtatttaaaaggctgaatggtatcttttttttattgtgaatgttaaaaatgaaattataggccaggcatggtgggtcacacctgtaatcctagcacttttggaggtcaaggtgggagaattgcttgaagtcagaagttcaagaccagtctgggcaatatagcaagacctcatatctacaaaaaaaattttttaattatccaagtgtggtggtgcacacctgtagttccagctactcaggaggctgaggtgggaggatcacttgagctgagaagtttgaagctgcagtgatctgtcatcaagccactgcactctagactgtgcaacaaagcgagactctgtctctaatgatagtaataataaaattggccaggcgtggtggctcatgcctgtaatcctggcactatggcaggctgagacgagcagatcacctgaggtcgggagttcgagaccagcctcaccaacatggagaaaccccgtctttactgaaaaaaaaatacaaaaattagccaggcatggtggtgcatgcctgtaatcccagctacttgggaggctgaggctgaggcaggagaatcaagtgaacccaggaggtggaggttgcagtgaaccgagatcgcgccattgcaccccagcctaggcaacaagagcgaaactccgtctcaaataataatcattataatttctaatgtttttatgtgtgatctaagtttcaaaacattacttgtcttgatatttggtaaattagtagtaatgtgaattagcaaagcttgagattttttttttatacttgaaccttggtttgagagttaaacaggaaaaacatcaaacattaatggaaacgtatttaatctgttaaattataccataatagtctatttaatatatttcgtttgtttttcattaccaataacaaaatatattagactattgtagcatatgattctattatcttctcagttaatgtgtatgcacatgtgtataagtgttaaggaaactcagaccatcttatttctacatatgcttttatatctgcaaagatgatacataattcttgtagagccttatttgttcaaaaggtaattacgtatttgatacatcatttccagatttagaaatttcgtatttgttataggatgcacaaacaaaagaaaagctttttaaaaaaaaatctgctttcaattgttcgatataggacaatcttgaaatctttttaactagggttttcaaaagcatttgctctcatgaagaacctacccattattcccccagaggatattttacaacccagttaaacaaacacctaaaaatgttggattattatggaaatacactaccttaaacctccattattatatagtaacttgaaagcagcaataaattatgtttgctttagactacaggcattaatcaaaaggaatgttagaagtttagaattcaaaagcactaattcttactagttatttagttgagtaacttgctggtcttatgctgtgctttttctaaaggtgaggtaatttatgttgcaaacaaggctgggcgcggtggctgatgcctgtaatcccagcactttgggaggccagggcgggcagatcacgaggtcaggagatcaagaccatcctggctaacacggtgaaaccccatctctactaaaaatacaaaaattagcctggtgtggtggtacatgcctgtagtcccagctattcaggaggctgaggcaggagaatcacttgaacctatgaggcagaggttgcagtgagccaagatcgtgccattgcactgcagcctgggtgacagagcaagactccgtctcaaaaaaaaaaaaaaagacatgcgcaaacaaacgtgcagcttgttaatatgaagattttagctactatacaaagaaaaaagaatagaaaatcatgtaaatcccatttttctcatttaattctagtgagagacaggcttcacagatcccttttatgtgtgataaatcaagcagaactgtaaatatcaatgtatacattttattgtacacatttctttcttaaactatttgtgttttaaaagttttaaaaagaaatgttttgtacaatttttgtgatctttaaatttggcagctgctaatgggtttcagtaattatagaattagaagaggtcttagagcacatgttatcgaaacatattcttgggcttgtaaagatttaataacatacctaagatcacataatgagttaaagatagagttttattattttggagattgtagattttcatcatggattttcagaatatcagtctaaggatttcccactacatgtgacttaaaaaaaaaaaaggatgtattctcacattccttgagctgatataataattggaagaaacaaaattgctaaattttaatttgttctttgggtgttctaggagggttattgagttaataaacagttttctcctccaacctctgataatatagctttttccttaacccaggccccattctcttgaaaggatcctttacctaaataatctcctcagcatttccccagctaacaacatcaactagctaactagcataagggacacaagaccttcaaatcatggaatttggaagtggaaggaatctggataccatttaaaccaaacatctcattttcagaggtccagagaagtagactagtttgccaaaggagatacataattcataattcataacagagccatattttgaatcccagtctctagagcccaattataagattcttccactctgctgtcctgatttaaagaagagaccagatacatgtcagatacatggttgaaaagatgttgttactgcctgggacattggacattcaactaactgccttccaagtcccttaagtctctccttaaaaaaattatataatttttaatacagtgaaacaagatagtattaggaaaggctaaaatgaggcacttttggttttttctgtattaaaccataaggtgcaggggttaaggtggaactccattatgttatctattgtggtagatagtattttggtggggttctactatggtcgaatctttaaggcagctaatcctatgactgaccagataggccataaattatcaaaaagcagtgattggcattgagtggtctgatttctttgggaacaaaatgagataggaacaaaaaagatctcaagaaagaaattgtagttgaaattgaaaaattataaatagaagattattactgcgattattaagttaacttttcagatagttctctacatacgtaaagcagtagggaaggggcaggaagaaacataacttaggtttctcttgtagaaactagttttaaaatttgatgttgcccttttttgcttcattcttttaattctacttttttttcacctcagcacaggactatctaattctcctcttttttctcagtattttattttctacctcttcaactccatcccaagatctgagtagttgtctgttttctaataggagtatctgacaaatgtctctttctgtctttcttgtaatgtgattaccatacacgccctatccattgctctgtgggttggcagtagattcctgattatgagagattgacttggaaccagtactgtgagtacagagtgagcagtactcccacaccctgggtggggatcattaatagcatttggcttccaacagttgcaactcctctgcattctgcacaatactagaaaggaaagtatgaagaacagatacaactaatttctacaaaagtggctatagttaagtgttatttgtttaatgggctgttaatcaacctagttcacatcaaaatgaaatattgttttcttccttctagtagtgtgatctctggtcctagcctagttttgctatcctgtgactgccctgtgaacacagcttagactctatgttgtgcaactagaatatgtaaacactcaagtatgggaacccattctcatttgaggaaccttaatgtttcatttgagaagattgaatttaaaagtttacattcttacagttacgcttaagaaaagcaaagggatgaatttataagtgtgtgagttcatgttcaagtattatgtgtggtacttttagtatcttaataattttatggagatatatatattttttcaaaacatcttttttaaattctaaaactagtatttctttacttccctttgaatagcaagaaaaaaatgattgagttattatttaagttactccgtgagctaaaataaataattttaatattaaatttctatttgatttatatcagttccacaaaagtaaatgagaataagcagggattttctgtaatattggtcaaataccacatgtatttcaggcattaatgacttaattactagattaagaaatcttaagtattagattataaatgagatgcaaatatattttgtttctctgaattataatgtagatagaatcaacatcttagaaaggaaagaagtgtctactgtgtttccatggctggattttaaagagatttgtaatttagaccagtattgtccaacagaatttcttcaatggaggaaatagtctatatctgcacagtccaactcagtagctactagctacatgtgactatggagcacttgcaatgtaggtagtgcaactgaggaactgaatattttatttaaacttacatagttacatgtggctagtagtcaccatattggacagtgcagctttagactattcccatatgatattaggtcagtataaaataccaacactcagttgaggaaagagtggctttagaaccatttgggagatggtgagcaataaatcgttatttagtttaagtaagaatacaactgagaatgtatatttacttctcttctttcggtttatccaagtggaaaaataaaattacatttttaaatactagggaaaattaaaggtcaaaccaatacagactttccagtgtctgtactcatgataacgtgagatcagagttcacagaaataatatgttcctttattggaaatgagagacctaatttaaatctactcatagcatggttcacatagacccagtttggctttgacatagccactctctaaggacggattgatatgtcttaagaaagatcgaaaatggatcttactaacaataggtatcatcacattttttaagacccagcaattttaaacttaagtgtttccttatttcatcccagtccccttgtctctccatttgtctctctgccgtgcaagtttgaatacctttattctctgctatcagccatttaccaatgttccatcacctgaacaggataaaattctagctccttggatcatcatacttaaggttccccatgattatatctctcctctcatcttttagcatttcccatatcacacctcatactatcattctctccctttctccctgtctccctccctccctttttctttctctcctccccactcccttctttcttactctcttacacacttttcctccctccttgcctccccagctctgaatttgtgtgtatgtagagaaaaagaaatacatacacacacacatacacacacacacacacaaacacacacttgtgtggatggatgcgtggatagatagatgattgattgatagatctacctgcctacttacctatctacctatttataggccattttatatttccttgcctttattcacacagcaatctgccttaagattcaaagctttcggacactgatgtttcaggaatctttctctcacctccccagtttaggatgatgatgggctgtttttcattgaaattattgcttttcaggagcttgtctttcctcgtacagacctcaaaaatttggccttatctaattcatagctgtatccttagcatctgccactatacctgacatataataggtactcagtaagtgtttgttaatataaatggagtattacaatgtggctattaaagaattttaatatatgcagtggtgctatttcagataatgggttacaacaatattctctggcaagttatagtgaggacaaatcacacctcctcttcctccgttttgtccaactcataagagtaaactcacatacttttcacatataacctgaacaaccaacagagaatgtaattcatttcctattgaactctgtactctttgaaagttttgaaaaagacagtgaagtcgtaacaacagtgaatccttgaagattctgaaagagtgatacagtgagcctagccgatgtcacagcccagctatgtggctactatatcacacaagacccccatagaaggaggtggaaactgttcattctttttgatatccctactctgcatatattttagatctatagagtgactaacagtttgtttacagagcacttcttcatatatccttctttacttacatacattcactcttgtatgagctttgttcacccaggttaaaaattttattcattatgtctagctctcaagggattttagaacatattctattgattgcaatgtggtgtaatatggaatacagtagactaataaacacaaaaggtacagtcgctaatctcccaaaattattctcccataaaggaagcatagaaaagaacacttaatatatgaatacataatattattactgtgtttctctgctttgtttgaaaattgaaatattttgttaggacccatatctttaaaaatgtgagattttaaaaatgttttatacttctgcactacaaaagcagtcattttatttctcttcgaaacttgtgtctgtaatttgggtcatgtattaaaggtaaagaaatgtcaaggtaaaagtggttatttaattcttgttgcaattggctgagtctcactttctgcatattacttgtctgagcttgaatatgtgtcacttgtaaatggtgtttctagattacaatttgtgttggcttagattcatcttaatgtgaaaattgtagactttaatgtttcatttgaaatagctttatataaggccagaatattatgcaaatcttcataatccaagtctgatctcctaaacatttaaagtatagtgtacatggtcacatgccacaactttatatggtaaaagtgctaattgtgttaagtggtggtagaaattgagactttcagttgtcaagaacttatggcaaaacacacttgcctattgaaaaatggcttttcattgttgctgtataaatggcatcaatataatagagtcactgtgaattttgttcagaggataagattacagataaaagctaataaaatatttgttaagtttttatacctcattctgacaaaaaatagtatactcttaattatggtaaaatagtactagagatgaaaggacatcttctaatgattatagaatctgtataactagacttctgtccaaatcttaattctttgttttttggtttttttttgagagagggtctcgctctgtctcctaggctaggtgcagtggcatcgtcttagcttactgcaacctctgcctcctgggctcaagcaattctctcgcctcagcctctcaagtatctaggactacaagcatgtgccaccacacctggttaattattgcctttttttttttttttttttggagagatggggtttcaccatgttgctttgagtcttaaggcagattgctgtctgaataaaggcaaggaaatataaaatggcctataaataggtaggtaggtaagcaggctggtctcaaactcctgggctcgatcaatccacctgcctcagcctcccaaagtgctgggattacagacgtaacccaacatgatggcccaaatcttaattctttaagccattcttcattagtccttattgttttcattctttcatgactattctacaaaatggttttggagagaatatattgatataagttttatgtgtttatgtacatttatttacacacaccctatatggtacttcttttttggtgacatcacatttggtgatgtactaaggctgattttactctcccattcgctcttttcttctcattaatatttctaacactgtgattttttgctgaaacttcattttctgtaactgaaaactaaagtactcataggaagtcaaaaagaaggaaattgtctagtaaaataaggaataattatgattctaaatggaccctagtacactaatttttacattgtaggcttcacttagatatttactagctgagaaaagaaatttgcaaaccaacaaattagatattgagaactaattttcagccccacaaaaggcaaataaattcagtctgacacctgtaatggtgaaagcttaaaattttaccattacagttataacattgcaatgaaggtggctacacatgcatttaatgtgtattggttatcctaataggtccattgcacatgattcaagaattttggcattcagaaaactttgtaatattctgtaagtatgtagaagcatctttttggtttaaaaaaatagtctgatacattctagttaaaataccagccaggttttgttggtactgggaaatgggtacatgaagattcattatactctttatttttgtgtctgtttgaagtttccataataaacagttttttgaaaatcacccgattaataccacattcctgggatctgtatcaaatctaaagtgctggaattatacactcaaaaatagaaaacatgtttgtgtgtctgaatcctctaaaaagaaaaatagttagtaatgttagcatacctcattgacaattagatattacctctcttcaacagaccagaacagaggaagaaaaccacttctatctggttagtgcctactagatacctttatgtgcaggtcatctcagagaaccaagaaatgtttctgctcagatgacttgtaaacatggaaaatgtgcctctccatatataccactgcaagattctcttggtaaagaacatgtaattttataacaacacctgaaaacgttaaatttattattcataaattttccaagacacacttcagaacacaagaagctcacaaaaaagattcttactacttcagttaacatagatacacccacccctaccccagtatttgaagaaaaagaaaaaagtctttctacccctggtaggcaaagcaagttatcccatttgtgttttggagtaccagtgctctattactataaagcagtaaagtatcataaggtaataacctcctccccgaaggtgtattactgaaaacatttacagaccaatagttcatgaagagaaaatgatttattatgtttttaagagtggttagtcaaagttgcatttgtttgttttacagaaggaacccagagattgaaaaaagtttattagtagtgtcagaatgaactgaagaaaaaagaaaataaaacatagggtagtagtaagggtgaggaaatatggatatgtgaaacaatataagaacaattataaagtaccaccaaagaatggaaattcagattaaaatttatttatgatcttacagccactttgcaaaaatagctgtgaaacagtaaattcatttattacttaatatggggtgtgaaattgtaacaaggcataacatccaagtgactaaaagttctttactcattttattgaacaggtttattgtgacttctacttttctctgtaaggtattaaaaccatactgcctgtttagatttggttcttatccatggccttattggtcttattgtcctgtatgttgcaattccgggtttgcaatttggttaagtttttttggaaaagtcccttaaaaatttagcatgaggattctgtaacaataaaacaaatgtactttggtgttccttgaaaatggcagttcctcttaagtaaaaatataacttgcatataatgtactgtattcattcaatttaaattagtattaaataaaattattgttttccatctctacagtccattcaaattacattcataatgagccagaggattattttaaattgtttattttatcataagactttcctgtggtaggatgcaatcatttagaaaaaaaaaagtactggtaaataccttgatttttcaattctaaaactcaatggtagtattattgatatttctgttcaccatacacaaagccagacaaagtcaagtatgcaatattattcctagttctccaagtaaacattatcctagaaacagtgcagaactttctgtccatggagtctgtggccagtcatctatacttcttctcgcatttatttaaagctttgtctcaatgtgactcttatcctttcttggggcgtgaactctcaatttccagttcatcatccctattctggttccacaaacctggtttctatggtaccatttaactatttcacttattattctttttctgttaagaatctctattaaacaccttccaacataaggaataattcatcatgtgaatgaagactgtcctcaggtttgcagactagcaaaaaagaattcctcacccaccttgattctctactgccgtgcacttcgtgtcactccccagttttagatacttcccagggtctcctttcttcagtgtcaaaaaaaaaaaaaaaagacacaagaaaattctaattggttccactaaaatttaggtattctagcctaccctacatcttcatggctacatgaaagctttcatgtactttttgctgacttttatcaacattgttcatgtcagaatttctttaatcttctcaagccttagccaaacaggctcccaagaggtgattgactttttatttccaggcaacattatgatatgaatatcttgggattgcctctgtattttcaccttttcccttgtctgttagttacctcttttaagaaggtacgatttttcctccttgccagtctactcgtcccacatgtgttcttttttccatctcctgtttccttcaaaacattttttttaatcagtttttcccactaccatttgcaacttcagtctctcccactcaacgggcttattatccaccacctgaaatcaagcacagacattcttctgtgggggggaaaatctatttttttaacctctttttgcttcccaaatcctcaaaattcttgaaagaatactggatactcattctctcaaattcttaccatctagtccttctttaaccctctctgatttggcctctgacctgttcatgcaatgaaaatagttgtcttaaaggtcaccaatgacctttatataccacttatatacatttattcactcagaaaatattcattttgtgcttgctatgtaccaggtacttgctagactaggtactagaagtacatctaaaaaagacaacattctttttctcagagaacttataatttagttgaggaaacaaacaagtagagaactacaaagtagtgtaagagttgcaattaagcatgaggcaacgtgaaagtaagaggagcaatgtctaactcagcctttatgtggtcatagaagcttttagatagaggcttcctttaaaggttaaggaaaaaaaagatattcaggtaaagaagaaggggaagagcggtgtttctaacagaaggtatccttcagaaaggaagctaaaagttaatatgcttttgattatctgcaaatttagtaacacaggtacagaattcgtttagggaagtggatggagataaggcttttacctgaattgagtttttaaatttatatttaaattgttgtgtttgtgtgtatgtgtgtgtgtatatacgtgtgtgtgtatatatgtgtatatataggagatggaaaaaatatatgtgtgagtatgtgttcccactcctcaaaactttgattatatatatgtatgtgtgtcttttatatattgtgtgtatgtgtacatatatatactttttgcccaattctcacaaatgaatctgtgacttcaaaatataaagagacactgctataaatgtagttgggagccaggcgtggtggcacatgcttctagtcccagctacttgggaggctgagacgagaagatagcttgaacccaggagtccagcactgcggtaagctatgactgcaccactgcactccagcctaggcaacagaatgagaccctgtctctaaaaaataaaataaatctagttgaggaccagcttataaaaggctttgaataccaagctaagaagtttttttaaactgtatgttgaagactctagtttcaaggattttaagaaatataatagctcagattttcatttctgggaagttaactttctataatgtgaattatgtaaaggagcaaaactgcagaaaggggatttaggagacaggtagtagttcaggagtgacatgaatagtgctcagtgatagaaacaatgcagctgaagaagaggggatggttcagaaatacttagaaggtaggatttagattctagtccacacttgcccctgggctcggccctcttgtacagtgcacactctgcacaaacctacacagtacccccttccaaatgcttatcttattctggtggaactaagcattctgtgtcaatattggggtacttgtcttccacatttcaaattctttgagattgttgtgtctttagattgtctattccttatagaatctaacagagaattacacatagtaaacattgaaaaactgtgataatgatgcttacatagtgtgtgctctgaaagcttcgtgtatgttaattcatttaattctcacaaccttatgcgatgtgcactattattataccccctctttggctgaattaaaagaagagtcatggggagattaaattactttcctaaggtcacacactagaaagtggtggaactgattcaaactgaggcagtctggctccagagtccgtgctcataaccagtatactaaacccattattggaacgcattatttgaatacactccagcaattggtaaatttaaagcaatgtataaaatgttttagtcccacaggattaaaattaatattttgatttatgtggaatagctaatgagtttgctttctaatctttttgttttaatccttttagaaccagttcgaagatacaaaacttatcatggtgatgtctttagtacctccagtgaaagtccatctattatttcctctgaatcagatttcagacaaggtaggaggcatctgaaacaagcaaactgtttttaagaaaccacgattattattattttcaatagtgttcaaatattaatataaattgccagaaagaataatactgtataaaattgaaaaatttaaaaaagctgctggttactcagtagtagtattatagaaactaaatagcagtttcttcaaataacgatgtagtccttttcattacagagataataattcattgtctttaaaagtaacatgatttacctcaaaagagtttaataacattatgtcattaattttgttctgtggattagatttgtacaactctatgtctgctaagtgtttgagttttaaatgaaattactctcatgtttctatcacctgtgccattatttctttttcattcataattagtgagaagaagtgaagcctcaaagaggtttgaatccagcagtggtctcccaggggtagatgaaaccttaagtcaaggccagtcacagagaccgaggtatgtcatgaaaaagtagtgatgatacatttccagtgaccagtgtttgttttttatttgaattaaatggaatttttttttttttttttgagacggagtcttgctctgttgcctaagctggagtgcagtggcgcaatctcggctcactgcaacctccttctcccaggttcacgcaattcttttgcctcagtctcccgagtagctgggattacaggtatgcaccaatgtgcctggctaatttttgaatttttagtagagatggggtttcaccatattggccaggctggtctcgaactcctgacctcaagtgatccacccgcctcagcctcccaaagtcctgggattacaggtgtgaatcaagtagaatttgtttttttactatcctttttcctttattttttgcattttccttttctcttcctttcccctagctctctttgtttttataaaagttctcagaaattcatcaattatatgaaagacaaagtattggaatcttttaaaatcatgattggctctaattatttatagttgtgcttgatttttaaaattatcaatatgaatataaaataacaggaaggtcaaggcatgggattaaaaatctgtgagaagataggaaaccttgatttctaagatacctttcttgaaaggttggaatagtctcagccagcaagctttcagtgagtatttatttgttgaatgaatagtgagtaggttactactaagtaacctattatgtaaaaggttaattattcactgtatctttcctggcttaaaagaggttatgtggtacttttttttaaagcctgatttaggctatttagagttcatttttatactgacatacttagtgaatttcttataaggtgttagtattatgtttgtgctcagcttaggatggtggtattatagctgtgtgttgatttatgttgtttaaactgaaaggtgtcaagtcaatagtgatgtgtgtctttgtcgtgtatgcccaggtcccttacatgaacaaaagatgtagttaatgctaagcattaatttcaaatttgtaatatattagagaacaagaggttgcttgagaatttacttctaaaatgtgggaatcctttctaattctgtatttcagtttgtttaattcagatgctaccaaatagaaaagaatcatttagaaataaacagaaacttgccccttagctaattaattctgccagacactgtttcacacctgtaaactattaatagatcaggtaaccctagccatgtgattaaaacagactattcacagtttagagtgtacgtaattaaatactttacactaaaattattctttagttaatggtccactttttttttttttgagacagagtctcgctttgctgcccagactgtaatgcagtggcgctatctcagctcactgcaacctctgtctcccaggttcaagcagttctcctgcctcagcctcccgagtagctgggattgcaggcacctgccaccatgcccggctaagttttgtatattcagtagaggtggggtttcaccattttggccaggctggtcttgaactcctgacgtcaagttatccacccacctcagcctcccaaagtgctgggattacaggtgggagccactgcacctggcctaaaggtccacttttaattaaagttgtttcttttgttttttgtactttttaaaatagtctataatttttttctttgaggaaaactccagtaagtattcatttacctaaagcaatctatatttgcataatagcattttatattactgtgtccttgtgatgaccccattttgatacttttgaacaaagaggtaggagacaaagatctatgctttacgttacagttttctttttattttttaacatttattttcggtttgggggtacatgtgaaggtttgttatataaacacgtgacaggggtttgtatacatactattttgtcaagcaggtattaagcccagtacacaacagttatcttttttgttcctctccttcctcccactctccccactcaagtagaccccagtatcagttgtttccttctttgtgttcagaagttcttatcatttagctcccacttacaagtgagaacatgtggtatttggttttctgttcctgcattagtttgctaaggataatagcctccacctctatccatgttcccacaaaagacatgatctcattcttttttatggctgtatagtattccattgtgtatatgtaccacattttctttatacaatctgtcattctgaacatttaggttgattccattctttgctattgtaaatagtgctgccgtgaacattcgtgtgtatgtgtctttacggtagagtgatttatattcctatgggtatatacccagtaatgggattgctgggtctaatggtagttctgcttttagctctttgaggaatctccatatcgttttccacaatgattgaactaatttgctctcccaacagtgtgtaagtgttcccttttctctgcaacctcgtcagcatctgtaatttttttactttttaataatagccattctgactgttgtgagatggtatctcattgtggttctgatttgcatttctgtaatgatcagtgatatgaagcttttttcaatgcttgtaggctgcatgtatatcttcttttaagggtgtctttcatgtgctttgcccactttttaatagagttgtttgtttttcttttgtaaatttaagttccctgtagatgctgggtattagacctttgtcagatgcatagtttgcaaatattttatcccattttgtaggttgtctgtttactctgtttttctaatgaagcaaaagcatgtggggatgaacaacaaaagtaagccaatattgaattgcactaagctcagtgttgaattgagggagaatgtgttttagaagtgacttttctctatgcatctaatttggaacctatgagtagttactattatgcccactttagccaattgaaaactcttgcttttaatataaacaactgaaatagagataacacctgaagaagcactgggatatgtgttaacaattgatttacagcccatttggtttggatttttaaattttaaaacatattcaagcgaaattaaatcattttgggagccttatgttaattttcttgataaggaacctcaaaaatgtcaaggttatgagagaatcctaattttgattgtttccagattttattcaaggaaacattaaggccgccatatttgtcaaatctatgtttaaggggtaaactgtcttttttttcatacttcatggggagaaaaagcccatgtggtattcatagcatctgagttagatataggtttaggtgaaagaaaaatatttcaggaagtagattgttagttgtatgtatgtattatctaatgttaagttgctaaactctatttcttttaactagttccatcttttttctgcccacttaaatacatattagcttaaaatactgtccaaattcctattcacttgcagaacacactctgataatatccctaacatgctggtacgtaatcaggagtcttgttttcttctttaggtcacacatttgtaaaatctatgaatagtgctgtatttgtacatattgcatgcttcttgacaaaagtttctattccctttagctagaataaaatggcaaaacagatccagagagtgctattgatttgtaccatagtgggatggggggagattaacaggaaattatgagtcagatgcagcagaatgagtaatttttttatactgagctatcaaaagcgtctttcagtgaccaaaaagggcattcaaagtagtttccaaagagaatttctaagcctttttatgtactagcttttgaagtaagtttatacgtagtacattcccactgcttctgtgcctctctgcttgttgaggtaacctttgtttctgactccaaacagagttgtttttgtttttgatttttgtctcaaactttgcagtttttatagaagttttggttagatatcatatttggagagataacaatgataattattttgctaccttttagtagctctgctgtaaaataattttagctaaaagactgtaatattttatgaaaataacaggtttgagtttaaatgtgcagattcaaggtcttattattatctttgaccctccccttaagtgagagagggccataaaattacattcagttattgactttacaggtaatcattgagcacctgccatgtactaggtgctttcagatactggagatagagttgtgaacaacacagaaagtcccttgagggaaatgagaagtagccaataaaccatgaaaaagcaagtaaataatatactgccatataatgatggtgccttgaagaaaaataaggctacttaaggggatagggagaacggggagtaatgtccaaattctgttttatataggtagtatgatcagtttcattactagaacaagaggctcctaacacccaagagacttcaagggttttaggagctctttgtcaggaactggggacaaagatcatatatgtatttccttcccttcccctctccctctcccccgctccctccccctctccctccccctccccttcccccttcccccttcccctcttttctcctttcctctcctctcttctgtcacccaggatggagtgcagtaataccatcccagctcactgcagcctcaacccccttacccccaggctcaatcaattctacacctcagcctcctgagtagccaggactacaggtgtgtgccaccatggccagctaatttgttgtatttttttgtagagacagggtttcaccatgttgcccaggctggtctcgaactcctggactcaagcgatccaaccgccttcacctcccaaagtgctgggattgcaggcatgagccaccatgcccagcctatatatttcttcataccatactgtgtaatgtaaagattcttctgagatgggaaaataaaatttgtttaaactcttgcaaccttacttaaaatgaaatttgcttgattagccttaaaacaattgttttcctcccaatcctcacctgtctcctcttttctatatagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgagggtaagttgattctcaggttactacacatctaaacctgctctcacagggaactcttgggcaaagtacttttaaaaattgctacaggtatccatctaaagttacctgtagatgaaactgaaatcccatattcatttccactgggattaaatatctttttggttgattttaaaataaacatttagctattttcattattttatctaaaaaataacttagatgaatttagagtgtcctaactatatactttaaaagtatattcataatccttaaagttaactagctatcttcattattgtgggggattattttttcatattaagaaatttattattccatatattgagaagatcagacatggaaagttcaaggttaattccaaagttcaagaatgttatcaagtgcatttcatcttgctgctctgtgattctcagaattttagtaataattcactttctggttaaaagaggactccattagctccaaacatcatatcctcacatttacagtatccaaagacaggaaggaccaagtctgtatcttgtatcttgtgggtggatatttttatgtatctgttcttctagttgatgtatttttctttcaacctatgacaatatatttttataaacataaaatcaaaatgaacagttcttttctcatgtaaaatatcttaaatgttttacaacttctacattattgttagtgttataaaatactttattatgtgactttactgtgtactgtaatttctttagtcagttccaattactggacattttaaatgtttctaattagctgttgaaagtaatgctctaaagcagggctccacaggccagcattggtccatggcctggtcacagcaggaggtgagcaaggagctagcattgccacctgagctccacctcctgtcagatcagcagcagcactagattctcacaggagcatgaaccctgttgtgaactgcgttgcatgttccttatgagaatctaatgcctgatgatctgaggtggaacagtttcatcccaaaaccatcccctcctacctgtctgtggaaaaattttcttccacggaacctgtccctggtgccaaaaagatcggggaccgctgctttaattaacatccctgcagctaactcattgcagataactttctccaagtaaaatagtcaattcaaaggcagacaccgtttaagacatttgatacgtattgtcaaattaccctcccaaaagtttgtgccagtttttgcttcctatgatcgtgcctgtttcttcatattcttatgtattctggatattatcattcttttttactatcatcagcttgaaaggtgaagcaatatttcatttgtaacattagtttaaaataattcttaaaaagcaaaataaataatagtaaacctggtaaaatctagaatgatttttttctttttagttctgcactaagaaattgtattaccctatactgttttcattttctgttctttgcttcagagaattatcttaaaagcacatttgtatgctctgaagataatagaattcaaatttccttcacagtattctaaggagaaaaagctgttggttggtgaaaattgcattgaactacaaattggaagacatgtattctattccttatgatgctgttatatgactttatgtaaattttaaaacctctttattcctcattgtgctaatttttaaaatgtggaattggattgtagtttataaaacactatccaatttttaaagtttttagattccaataaaatataactgaacatatttcaggtaaaaggaagaaactcaatagggcttcatcaattcattattaccaatatctacatcaaaactaagtaataggcaggatgtcatacaatatagtgtggacttccaatataataattcagtgaacagcacaaactgcacgtacatatacacccctttttcctaaaccacagttttagagagctaagctagactttggttcattcacaattcataaattatagatcgtacctttatagcatgccactgtgatatgtcatctcgctaaaaacctgtttccttttttaggcagtcaatttctagctatttcaaaccaaacatttctttgccagagatattttgtgtcagtgattagataatttgaactactggtcattaaaagactacctagtattttttctgaaaagagctggaggttatatttttgaggctgaaaagggtaatggggtttggaggtacagtttgaattaatattctttcccacagcataaatgtttaggatttttttttcttttggtgcagacacatcttaacttcttcataccctgtttccatagttgatctttattatattctgtgtttcccatggcagaccactttcattcttttttttttattattatactttaagttctagggtacatgtgcacaacatgcaggtttgttatgtaggtagacatgtgccatgttggtttgctgcacccatcaactcatcatttacattaggtgtttctcctaatgctatccctcccccagccccccaccccccaacagaacttggtgtgtgatgtttcccgccccgtgtccatgtgttctcattgttcatttcccacctatgagtgagaacatgtggtgtttggttttctgtccttgtgatagtttgcttagaatgatggtttccagcttcatccatgtctgtgcaaaggacatgaactcatcctgttttatggctgcatagtattccatggtgtatatgtgccacattttctttattcagtctatcatcgatggacatttgggttggtttcatgtcttcgctattgtgaacagtgctgcaataaacatacatgtgcatgtgtctttatggtagcgtgatttataatcctttgggtatatacccagtaataggatcgctgggtcaaatggtgtttctagttctagattcttgagtaatcgccacactgtcttccacaaaggttgaactactttacgctcccaccaacagtgtaaaagcgttcctatttctccacatcctctccagcatctgttgtttcctgactttttaatgattgcttttctaactggcatgagatggtatctcattgtggttttgatttgcatttctctgatgaccagtgatgatgagcattttttcatgtgtctgttggctgcataaatgtcttcttttgagaagtgtctgttcatatcctttgcctgtttttcagtggggttgtttgtttgtttcttgtaaatttgttgaagttctttgtagattctggatattagccttttgtcagatgggtagattgcaaaaattttctcccattctgtaggttgcctgttcacgctgatggtagtttcttttgccatacagacactctttagtttaattagatactgtttgtctattttggctttcgttgccattgcttttggtgtgttagtcatgaagtccttacccatccccatgtcctgaatggtattgcctaggttttcttctaggatttttatggctttaggtctaacatttaagtccttaatccattgtgaattaatttttgtataaggtggaaggaagggatccagtttcagttttctacatatggctagccagttttcccagcaccatgtattaaatagggaatcctttctacatttcttgtttttgtcaggtttgtcaaagatcagttggttgtagatgtgtggtgttatttctgaggcctctgttctgttccattggtctatatctctgttttggtaccagtaccatgctgttttggttactgtagacttgtagtatagtttgaagtcaggtagcatgatgcctccagctttgctctttttgcttaggattgtcttggctatgtgggctcttttttggttccatatgaactttaaagtagttttttcttattctgggaagaaagtcattggtagtctgatggggatggtattgaatctataaattactttgggcagtatggccattttcatgatattgattcctcctatccgtgagcatggaattttcttccatttgtgtgtgtcttttatttcgttgaacagtggtttgtagttctgcttgaagaggtcctttatatcccttgtaagttgaattcctaggtattttattttctttgtagtaattgtgaatgggaattcactcatgatttggctgtttgtctgttattggtgtagagaaatgtttgtgatttttacacattgattttgtatcctgacactttgctgaagttgcttatcagcttaaggagattcggggctgagacgatggggttttctaaatatacaattatgtcatctgcaaacagggacaatttgacttcctcttttcctaattgaataccctttatttctttctcttgcctgattgccctaaccagaacttccaacactatgttgaataggagtggtgagagagggcatccttgtcttgtgctggatttcaaagggaatgcttccagtttttgtccatttagtatgatattggctgtgggtttgtcgtaaatagcatttattattttgaagtaagttccaccaatacctagtttattgagagtttttagcatgaagggctgtttaattgtgttaaaggccttttctgcatctattgagataatcatgtggtttttgtagttgtttctgtttatgtgttgaattacatttattgatttgcctatgttgaaccagccttgcatgccagggatgaagcccacttgatcctggtggataagctttttggtgtgctgctggatttggtttgctagtattttattgaggattttcacattgatgttcatcagggatattggtctaaaattctctgtttttgttgtgtctctgccacactttggtatcaggacaatgctggcctcataaaatgagttagggaggattccctctttttctattcattggaatagtttcagaaggaatggtaccagctcctctttgtacctctggtagaattcggctgtcagtctctctggtcttggactttttttggttggtaggctattaattattgcctcaatttcagagcctgttattggtctaatcagagatttgacttcttcatggtttagtcttgggagggtgtatgtgtccaggaattcatccatttcttctagattttctagtttatttgcatagaggtgtttatagtattctctgatggtagtttgtatttctgtgggatcgatgttgatatcccctttatcgttttttattgtgtctatttgattcttctctcttttcttctttattagtcttgctagcagtacatcaattttgttgatcttttcaaaaaaccagctcctaaattcattgatttttttgaagggttttttctgtctctatctccttcagttctgctctgatcttagttatttcttgccttttgctagcttttgaatttgtttgctcttgcttctctagttcttttaattgtgatgttagggtgttgattttatatctttcctgctttctcttgtgggcatttagtgctataaatttccctctacacactgctttgaatgtgtcccagagattctggtatgttgtgtcttcgttctcattggtttcaaagaacatctttatttctgccttcattttgttatatacccagtagtcattcaggagaaggttgttcagtttccatgcagttgtgcagttttgagtaagtttcttaatcccgagctctaatttgattgcactgtagtctgagagaccgtttgttgtgatttctgttcttttacatttgctgagtagtgttttacttccaattatgtggtcaattttagaataagtgtgatgtggtgctgagaagaatgtacattctgttgatttggggtggtgagttctggatatgtctattaggtccacttgttgcagagctgagtttaagtcctggatatccttcttaaccttctgtctccttatctgtctaatactgacaatggagtgttaaagtctcccattattattgtgtgggagtctaagtctctttgtaggtctctaaggacttcctttatgaatctgggtgctcctgtattgggtgcatatatatttaggatagttagctcttcttgttgaattgatccctttaccattatgtaatggccttctttgtctcttttgatctttgttggtttacagtttgtttcatcagagactaggattgcaacccctgccttttttttttttttttttttttttttttttttttgctttccatttgcttggtagatcttcctatgtccctttattttgagcctatgtgtttctctgcacgtgagatgggtctcctgaatacagcacactgatgagtcttgactctttatccaatttgccagtttgtgtcttttaattggggcatttagcccatttacatttaaggttaacattgttatgtgtgaatttgatcctgtcattatgatgttatctggttattttgcctattaattgaggcagtttcttcctagcatcgatggtctttacaatttggcatgtttttgcagtggctggtactggttgttcctatccatgtttagtgcttccttcaggaatttttgtaaggcaggcctgatggtgacaaaatctgtcagcatttgcttgtctgtaaaggattttatttccccttcacttatgaagcttagtttggctggatgtgaaattatgggttgaaaattatttctttaagaatgttgaatattggcccccactctcttctggcttgtagggtttctgccgagagatcgctgttagtctgatgggcttccctttgtgggtaacccgacctttctctctggctgcccttaccattttttccttcatttcaaccttggtgaatctgacaattatgtgtcttgggattgttcttctcaaggagtatctttgtggtgttctctttatttcctgaatttgaatgttgacctgcctttctaggttggagaagttctcctggataatatcctgcagagtgttttccaacttgattccattttccctgtcactgtcaggtacaccaatcagatatagatttggtcttttcacatattccgtgtttcttggaggctttgttcgtttctttttactattttttctctaatcttgtcttctcgctttatttcattaatttgatcttcaatcagtgataccctttcttccacttgatcaaatcagctattgaaacttgtgcatgtgtcacaaagttcttgtgccatggttttctgctccatcaggtcatttaaggtcttctctacactgtttattctagttagccattcctctaacctttttgcaaggtttttagcttccttgtgatgggtttgaacatgctcctttagctcagagaagtttattattaccgaccttctgaagcctacttctgtcaacttgccaaagtcattctctgtccagctttgttcgtttgctggtgaggagctgcagtcctttggaggagaagaagcactctggtttttagaattttcagcttttctgctctgtggttttatttacctttggtctttgatgttggtgacctacagatggggtttggtgtagatgtcctttttgttgatgttgatggtattcctttctgtttgttaatttttcttctaatagtcagatccctcagctgcaggtctgttggagtttgctggaggtccactccagaccctgtttgcctgggtatcaccagtggatgctgcagaacagcaaatattgctgcctgatctttcctctggaagttttatcccagaggggcacccaaccgtatgaggtgtctgtcagcctctactgggaggtgtctcccagttaggctacaggggtcatggacccattctcagagctcaaacgccatgctgggagaaccactgctctcttcagagctgtcagacagggacatttaagtctgcagaagtttctgcttccttttgttcagctatgccctggccacagaggtggagtctgtagaggaagcaggccttgctgagctgcggtgggctccacccacttcgaggttcccagccgttttgtttacctactcaagcctcagcaatggcagacatccctcccccgaccaggctgcagcctcggaagttgatctcagattgctgcgctagcagtgagcaaggcttcgtgggtgtgggacctgctgagccaggaacgggagaaaatctggtctgccacttgctaagactgtgagaaaagtgcagtatttgggcgggagtgttccgtttttccaggtacagtttgtctcagcttcccttggctaggaaagggaaatccctctatcccttgggcttcctgggtgaggtgatgccccgtccggcttcagctcatcctccgattgctgcacccactgtccaaccagtccctgtgagatgaaccaggtacctcagttggaaatgcagaaatcacccgtcttctgtgtcgatcacactgggagctgcagactggagctgttcctattcggctatcttccactttcattctttctactctatttctattcttgtttaaaatgtgtcctattggttcattgaatattaataaaccccttatgttgaacttttacttttacataaatggtatctgtcacatgttacacactcaattaaattgaatagaattcctacaccaagcaatcagtgagctgtacaaccaaatgcaaagaagaaaccaacaaaaataaaactctggtaacattcattagttcaagcacacacctacacatacacacagaccacttgcttctggcctcaagattagctctggtttcattctaccttttgcccattaagatatgatctttcagtcttttctcaacccttctcccactcagagtctaacttgttttaagttgtctcctaaactagttctccctcttagccaaaaccccagaatatacaaaaggagaaaagggaaatcatagattgagaagcactaaatacagagtttgcactctactttccccatctcatgggtcctttatttcctgaaatattttcttgctggggacattggcaggggtcagagactatgtgactgatactatccctagttgccactatttaaaacgaaaagtacagtgtcatagggttccaagatagtgattacaggtggatatatacatataggcacaaagtagatgtcttttaactatgaccaatttttttgtttttgtctgtttgcttttaattttttttagaggtagggtcttactttgttggtgaggctggagtgtagtggtgtgattatagctcacagcagcctggaactcatgggcacaagttatcctctggcctcagccctctaagcagctgaactacaggtatgcaccacagtgcccagctaattttttattttttgtagaaacagggtctaactatgttgcccaggttggtctgaaactcctggcctcaagcgatcctcctgccttagcctcccaaggcattgggattagttgtgagccagcacacataccctacgatctgttttaggctgaatgtcgctttctaagacaatgagattctgttcaatcacttcatgcattagcaatattaaaccaaatacttatatgagctttataactctatattacttcttcaagaccttttttttgagtctgagtctatctggatgccaaatagtgaaaaccctgtaaaacagtgtaaaagtgaggcattatgtttgacatcaatagtagaaaacaaagatggggaacaacttgtttcaacttaatgtaaggcatactccatttctgttattggtaaattccagtatacctcttcatgaaagcttcaacgtttgttttagatcacctagttctaatgtggtgattttgtagtttcatatgtaatttattattcttacattatttttcctttcaaggaaaaaactagaataaatagtaaaaaatattgattctgcttatgtgatttgcagaatttctttggccctgagtttgtgaaaatgacaattgaaccatttatatctttggatttgccacggtctattcttgtaagtaataaaaccaatttgtgtcactcttagaaaataatttcagtagtgttaaaaaccagttaaaattcttataatgcttattttaataaatgccgtttattttttcaattgtagactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaaggtaccaagacattttatattcagagtacagtatagaaatttagcaacaagcagacttcctatgtttgttaccatgcctgacctcattttgacaattagtaactaaatgaactagtcagtagaagtgagttaggaactccctttcttctcccagctactttcattgttttaatagttatgtttgttaggcaccttctgtatctgactgggaagatttttttattttttgctatggttatataaaaatatattttaattatattttagggaccgttttatatgttaatggtctacatgtgtactctagaaattagtatcctaatatgagcctgaatgtatagcaagaccttatttctgaatttccacatcagtttatttagtctactatcctaaaatcacagtgactttttaaaatgtcaattgaaggctaaaaattagttatttcacattatcttttaaatattgtatccacttaaacccatgatgttcacaaccacagtggtctaagacacagcttcagtagaaacttctcctatttatcaattagagttgccatagcagtaagaaactttttggaattcatctcctttttaaataaatcattatatttataaattactctttaatatttcagattcctgtttacctcaaaatttaacttggaaagtttaggcaacaaagtactataaatgacaattgacaggttaaaggatcctaaaactctataagctcttaatatcttctgtatcctaaaagaaatatttccctcaatatagcttattgaattattgtgccttaaaaatgaataatttatgctgtagactcatacaataaatagtcaattagtacctactgatgttctatcactttactagtttcacttttagactaatcagtcaatattgtctacatgaagctgattcagttcatccaaatatctatttatactatacctaatttcttacagattctggtaaaatcaaattgtattgaataattcttttatttgtagagagtaaataatagttaactaatgacattaaaaaataaaatgataaatgtcattccttctaggtttcagctggtagctcaataataataagtatactagctaatatttattaaatgtttaccgtgtactgtgtgctttaacaagtgtttttattcattatgtcatttgatccttataacaatgctgtaaagcaagaattcccactagcctgatcttaaagccaagaaaactgatgtctagagaggtaaaataatatattcagtgtcatacggatagtaaatgttgtgaccaggtgttgaatctaggactgtatgtctttagagccgccattcttaaaagagtgggccatattgcctcccatctaaatggagtgtctcagagctccctgccacatttttaacagtcttgtatttatattctcatatgatactcttttatgcaagtctgaccaaaaagtgaagaaatcggaagaaaacactaaagtatttttttattttatctgaatatttttctcattctgtttagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacagtgagtacacaagagtttctcttttgctctttttggacactggtcttttgaccctttagcttactgatactgaattacttgattccaatcaatgataatgtctgctttatcataaaagtaatatttctttcaacacagtttatctaatccttatgccttaaaagcttaataataagcttagtaataaactcatggaaattaaccttacatgcctataataaaaaccaccccagtattcaaaatcaaaggccaagatgtctgtgtgtgtttgttttttcagacatactctgacgtgtcatcagtattaccttcagcttcgaaaagatattttggaggaaaggatgcactgtgatgatgagacttccttattgctggcatccttggctctccaggctgagtatggagattatcaaccagaggtaggatttgtgtttttttccaggaccatttttgtttggtgttgttacctttaacatagttaatgactaaacctgattcaggtgtttgatgtttagatctgaagatttttgaggcttctttggttcctcagaatgaccaagcactccatgtatatcaattatataaaatcatgaagtgtgggatttttttttcctgtttaaagttatcctgttttggagtttaggaatatctaccacttactccttctcctgagttctaacctatagagactatacacaggagttattagtcaaatataaattaaaaggatctcctgccttccacatgatgggctggcagcctggcagagcttactgtgtggagaactcacagtatacttaaagcctgatgtttctaaataaaattgatctaagaggaagcaaggggctagaagctgtgctgctggagcagcatccttcacaacgttcatcctaaactagagtgatatgaggcccttgaatgtcacacttctcaagcttgctgatcagttcagtcattttatctcactgaatagaaaagaaagactgatgcatttcttctaaaactcattcctcagagagagaggtagaaatagaagtacttcatctcttagccaaagcaagaactttaagatagaaggaaaagggtttactccaataaaaggcaaacaattgcttatgaaaacattcttttatctaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtaagcatccaagattacaaatgataagctttgtatcttttccaagtaagcaagaagtgttagaggacacatatctaagagttcaagtgccagtaactgatactgtgcataatctcatctcattgctggctaaaattatggtattttaattctcattttgtaaaagagggaaatgaggctcaaagaggaaatgtaatgttcccagagatatggggcagatatgatttgaacccatgtctatctggctgttaatcctatgcttttatcttattccatactcaaaatcaaaatacattatacagaagaaacaaatgaatttggtgaatggcttgatatgagaggcaagttcatactgattctagaattgtttgttttgctttttctcaaaaggcttaaaattcaattacatcctttaaaaatggtcttcccactaaatgccaattaatgtagataggggtagagagtcacaaaaattgacttattagtttacagttctattagttctacagtctattagacctataaccagctttctatatgaccttagataaatagtacatttacgatcaagaaaaatagtattatgtaaacttccaatgcaaatagcaaatataagatagtgttctgttgaaaagacaaattttcagaacattcttctgttttagcttcctaggatgtaacagtatgccttccattcactgctgcatatagaaagaaatcaagtttaccagccctgtgaaaatttatgaagggattttattcacagacttacattacctttaatctagtgttcatggaaagaaagaaaggcaaggtggttttttctgtttgagtccaaatttaaagatattaaattatggacttatacttttcttagttattacatttttatacttgtagaaagtaagatgttacattataattttattaataaaggtagaaggcagattggcacagtgaaaagaatttgcatgaggatttgcagacagacagtcttgcatttgaattcttatttcaactagctgagtgaccttgaacaatgtgtttaacttctctaagtctcagttttctccttgtaaatagcatgcctaaggaatattaggttgccctactccttctaataatatattctgttacttcatttcactttaactttagcatctttcttctaacttaagaagttttatcttgttaacacaaccttctaaggctacacttttgctatatattatgttgtttttgaaatatctttcgtaaatctgctttattgcagtataatttacatacaataaaatttaccatttttaagtgtttggtgagtttttaaaatatatgtgcagttgagctgggcatagttagggatgcatgcctgtaatcccagctggttgggaggctgatgtaggatcacttgagcctgggagtttgaggctgcagtaagctttgatcttgtcactgggttccagcctaagtaacagaacaagaccccatctcaaataaaataaaataaaatataaaataaaataaaataaaagtaaaaaattagtataataaaatataaaaatatgtatacagttcagcaatcacctccacagtcttgagaacaagggttagcaaactgtggcctgcctgttttgtaaatagttttattggaactagtccatactcatttctttatatatcatctatgtctgcattcatactataacagcaaagtccagtcataacaataaagatcatatgacccacaaagcctgaaatatttactatctggccctttacagaaaagtttaccaactcctgatacagcacatttcgaatacataaagctccctcttgtctctttatagtcagtcccctccccctacctgtaatccttagcaactactgatctgctattaccatagtgtttttttttttctaaaatgtcatgtaaaaaataatataatatacagtcttttatgtctggcttctttcacttagaataatacttttttttgtttctgagacagagtctcactctgttgccaggtaggagtgcagtggcatgatctcggctcactgcaacctctgcctcccgggttcaaacattctcctgcctcagcctctcaagtagctgggactacaggcacatgccaccacgcctggctaattttttatatttttagcagagacatggtttcaccatgttagccaggatggtctcgatctcttgaccttgtgatccgcccaccttggcctcccaaagtgctgggatacaggtgtgagctactgtgcctggcctagaataatacttttaagattcatccatggtgtggtatatatcagtagtttcttttcttttttttttctgagtagtttttctttgtgcagatacataatttgcttattcttttcattagttgatagatataaagctgttataaacattccagttcacatttttctgtgaacacagtttttatttctcctgagtaaatatctagcagtaggattgctgggacctatggcaagtgcatgtttaactttgtaagaaacttccaaactgttttccaaaatcattgtacagttttacagtcctaccaacagtgtgtgaatttcagttgctccacatccttgacaacacttggtagtttcagtctttttcactttaacatttgaaataggtgaatagtggtatattattatggttttaatttgtacttccctcattactatttatgttgaccaatcttttcatgtgtttatttgccatttatatatcatctttattgatgtgtcaaataaaactttttacccccttttgtaactggttatatgtttccttactgttaagaagtacatgttctttaaatattctggatacaagtcttttatcagatatgtgggttttacatatatttatttactcctagtctgtggcttgccttacattttcttaacattgactcttttttttaagagtctcactctgttgcccaggctggaattcagtggtgcgatcttggctcactgcagcctccacctcccaggctcaagtgatgcttcttcctcagcctcctgagtagctgggattatagatgtgcaccaccatacctggctaatttttgtatttttcatagggacaggattttgtcatgatggccaggctggtctcaaactcctagcctgaagtaatctgcctgccttggcctcccaaagtgctgagattacaggcataagccactgtgccagccaacattaactcttgatgagcaagttttcaatgttaatgaagtttccaattttttttattttctagtttatggtttttgtgttccatctaagaaatttttgcccaacccagggtcacagacaccttctaagttttatgcttttagtgcctgtatttaggtctgtggtccatttttggttaaatttcatgtgtagggtgaagtaagggttgaaattcatttttttagcatgtggatatacagttgtcccagtaacctttgtttaaaagattatcctttccacattaaactacattgatatagtgtgttagtcctttgtcacactgctgataaagacatatacccgagactgggcaatttacaaaagaaacaggtttaatggacttatagttccatgtggctggggaggcctcacaatcacggtggaaggtctcacatggcagcagacaagagaagagagcttgtacagggaaactcccctccttaaaaccatcagatctcgtgagacttactcactatcatgagaacagcatgggaaagacctgtccccatgattcacttacctcccactgggtccctccttcaacatgtggaaattcaagatgagatttgggtgaggacacagccaaaccatattccacttctggcccctcccaaatctcatgtcctcacatttcaaaaccaatcatgccttcccaacagttctccaaagtcttaattcatttcagcattaacccaaaagtccacagtccaaagtctcatctgagataaggcaagtcccttctgcctatgagcctgcaaaatcaaaagcaagttagttacttcctaggtacaatgggggttacaggcattgggtaaatacagccattccaaatgggagaaattagccaaaacaaaggggctatacaggtcccacgcaagtctgaaatccagcagggcaggcaaaccttaaagctgcaaaatgatctcctttgactgcatgtctcacatccgggtcaagctgatgcaagaggtgggctcccaaggtcttgggcagctctgcccctgtgtctttgtagggtatagacccctcctggctggtttcatgggctggtgttgagtatctgtggcttttccaggtgcatggtgcaagctgtcgttggatctaccattctggggtctggaggacagtggccctcttctcacagctccactaagtggtgctccagttggcactctgtgtgcaggctccaaccccacatttcccttccctactgccctatcacaggttctccattagggccctgcccctgcagcaaacttctccctgggatccaggcatttccatacatcctctgaaatctaggcgaaggttcccagacctcagttcttgacttctctgcactcacaggctcaacaccatgtggaagctgccaaggcttggggcttccagcctctgaaacaacagcctgagctgtaccttggccccttttagtcatagctggagtggctgggacacagggcaccaagtccctagactctacacagcagagggaccctgggcccggcccacaaaaccattttttcctcctaaacctccaggcctgcaatgggaggggctgctgcaaaggtctctgacatgccctggaaaccttttccccattgtcttggtgattaacatttggctccttgttacttatgtaaatttctgcagccagcttgaattttgcctcagaaaatggaattttctttctatcacattgtcaggctgcacattttccaaactgttatgccctgtttcccttttaaaactgaacgcctttaacagcacccaagtcacatattgaatgctttgctgcttagaaatttcttccacaagataccctaaatcatctctctcaagttgaaagttccacaaatctctagggaaagggcaaaatgctgccaatctctttgcaaaaaaaaaagaaaaagaaaaagaaaataacaagagtcacctctgctccagttcccaacaagttcccaacaagttcctcatctccatctgagaccacctcagcctggaccttattgttcatatcactatcagcatttttgtcaaagccattcaactagtctttagaaagttccaaactttcccacattttcctgtcttcttctgagccctccaaactgtttcagcctctgcctgttacccagttccaaagtcacttccacatcttcaggtatcttttcagccatgcccactctactggtaccaatctactgtattagtccattttcacactgctgataaagacatacctgagacagggcaatttgcaaaagagagagctttaatggacttacagttccatgtgactgaggaggcctcacaatcatggcagaaggtgaaaggcatgtctcacatggaggcagacaagagaagagagcttgtacagagaaactccccttttaaaaccatcagatcttatgagacttattcactgtcacaagaacaacacaggaaagacctgcccccatgattcagttacctctcagtgggtctctcccataacatgtgggaattcaagatgagatttgtggggggacacggccaaaccatatcatacagcttcaatatctttatgtcaccatttaccaaagtgtattgctatggtatggtattattccaacaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctgtatgtccatttaacctcttttcattatattttcaaatgatattaccaacttccaatgtaacatattaacagactttccttagactctgccattcagtggggataatacatcttaatactatttaactcttcctttgtagttgtggaaattattattgagattttatttatgtctggttttttcaacaggtgacttttaagattattacacattcctggctggttatatgctcaattaactttagttaaattacaaccaagttgaattctctgaataagtcagaatttattctagggttgtaacttctcacatggagaaatcctcctaatgtttttaagaaagatagttatcttaaccctagtgaaccttgtctggcccaatagtaaaccccctcgtagcaactgttatttgaatctcagaggtacagagacttactggattttatgaactagtcccaggactttccgcaattttagatttttagtgtacagctctctataaagttagaaaatgatttttagaaaataatatgtttatggaagatagttagtgataaaggcatattttgattttggacctagttgggacacctgaacattaaagttccattggcagacttcagagatgaataaaaaatattaatatgttcaggtgtttgttttcctagtgctattcaggaactactgatacctttagttcatctttaggctaaagtatagtctcagcaaaacagtatttataaagttaccaaggtcctgatggatctggataatcttcaaccctgagaccattcctagacctaatggttagttgattggcttcctctgaaaccaagagatatcactaagatttccagattatatgttctccagaccacccacatcttctcaagattgtcaggaccaagaaattacctgggtttaacttaccttcccccagtggaaatgctggcagagcccatgtctgaaggaaaccttagattgattaattataaatccagttttggaccgttttgaaaaggtgacaagtcaaataatcacacagcagtcaactctatgtaatttgccaagctaccacactaacccacatatatagaacgagctgtgattagttcatttttaaagatttgtgggaatagagaatagtttgcattcccatggaaattattcctatatttaatagcattcatttttcctgaagttctttctctaacacaaaactattttttttaactctccttttttcttctactaacctctggggaagtggaaaagttactatttggtcttctcatatctcacaactgagttctctcaagcacatttcttatccagtccatccattaacacttggagagaatcaaatattctttgtatgtgtttcaagactatacatctttcttagatattaaatcatctatactatcacttttcataattaatatgaacctctaacctatctctggcattttttgtgtgtgatatttgctgcctttgggtgttttattataggtagtggttctgtagttcttttgactgatcaactaagaagattctttctttcatgtttatgcttgaatcagtgagagagttttacaactatggagttcagtgtctttgcaaattccttgacagtggttaagtggcatgtttgttaggggaaaaaaaaaatgttctccaagtatttgaagagttaccaggtatactactgataatgaagatactagtttgttgctactgtatctttagctcctctctaatacttactaatttctgtttctaacaaagaaaacaggtttaatcctggagctttcattggcaacaatatctagctagaatttaacaatgttgttatatttctaaaatttctttgaatttatataaataagaaaagtccattgaaaaatttataaataaccaaggctagaaattgtaaagatgacaggattgaagtctgggtaatactctgttattacaacttttgaaagcctactaaatttggcttttccatgactatttccgtatttgaagtaaagacaaggaacatgaagtagaataatctgcacagtagccaagagctagagtacagtctaactggacttaagtggttctccagagacattagtcttagatccccgacatgttgaacactggtctcttaaggcatgggtcaccagcaagccttaccatataggtcacaaattggagtatgctctcttccacaaaagacattcagttttcaagaaatttcagagtgataaaactgatttgatgattctcctactttctctatatttggcacaaatcaccatctctaaatatcaatgtgttttatctctcaacccagcagttatgttaccagtacctttccatctcacattttctttaattttccacaacttctattcagcctttatgccacccagactctacttgactgaatcctggctcttatcattatatattaataaaaaaattattgttaaactttcattttcttgtatccaatagagtagaacacatatttattatttccttttcaaacagttttggtgtttgtaaacattaccataaattcaaaatatcaataatcttatcaaaggaatctgtttcccttgttaatgactgatatatacaatctagatttaggctacaatttctgaaagtggcaaacgatgttaatttatttcttgcatttgtttataataatacagtcatgtgccatgtaacgatttttcagtcaacaactgaccacgagcaatggtggtcccataagattataatgttgtatctttaccacaccttttctgtgtttagatgtatactacacaaacaattgcctacagtatttagtacagtagtatgctgtacaggtttgaaacctaggagcaataggctacatcatatagcctaggtgtgtagtagtaagctagcccatctaagtttgtttaagtacacttcaggatgtttgcacaatgacaaaatcgcctcatgatgtatttcttggaacatgtctttattgttaagtgatgcatgactatataggattatattcatattagatgtaagtcaatatccagtgcctaacaagaaatataaataatatctctacttactataattatgaatacccttggttaatattgtagaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattggtaaggagaagcagactatttcagatgactcctgggaatatgaataatttttgccaccaagttttaaaagaactgccatgattaggatgaaaacttacaatgtatatacatgttaaatagctaaatcaagtctataaaggtgttacaagtgaagccaatatttcaatttcatgttcaccctgagagaatactcctagggagtacctgttgaagtgtccattttgtgcttagcaatgataggctagttgatgtaaacattataaacatttgggccatgttctctaccctcagtaagcttatccaatatttggaagggtaagaccaacatgcttgaaacagcaatacacaatagaagttcaggatttcagccaggcacagtggctcacgcctgtaatcctagcactttgggaggctgaggcgggtggatcacgaggtcaggagtttgagaacagcctggcaaacatggtgaaaccctgtctctactaaaaatacaaaaaatcagccaggcgtgttgccgggcacctgtaatcccagctacttgggaggctgaggcaggagaatcacttgaacctgggaggcggaggttgcagtgagctgaggtcgcaccattgcactccaacctgggcgacagtgcgagactctgtctcaaaaaaaaaaaattcaggatttgaagaacagattatattgaacagactttatgacctatactgttagaagagggaaatcagagactagagtactggacaggtggcacttgaattggatataaaggataaaaataatgcaagtagtttggagataaatggaagggctttagagatgagggaaaaaacacaggaaacaaggcagaggatgggggaagtatgcacccagaacaggacagtgaagagacacactgtatagtcttctgggtggcagatttactacctattagttttacttgggtgcatccctgttctgagattgagatgaataatcatagtacccaatgtaaatggtcaggagaatggtttattttcttttgaaaaggagccagcagaagaaactcatctgactctggaaaaaatatctcaatcagaactgaaatatttaaatttcagagagataaaactgatttggtgatttctgcaattagagattaaaattatacaaaatctaattctacatagtaaattcttataggtataagtgaaacagtcagaagtatgtgatttaaaaatttaatggaatagcactgatgaccttgtgcagcagggtcctatgaattctttacccaaactgtttcacattcaaaaaatgttttccccataagggcagactggggcgatggcaacctatgactagatgtttctcaacctttcagaatcatgataggggtggaggttgtatgctgatttaaaatgaagattccaggaacctacgtaaaactcagagagctacagtctttgggaatttgttccctaaaatctgtactttaacaggctttcctcagtaatgtttttttttgttttgttttttcttttatttgatacggagtttcgctcttgtcaaaatcttgtttgggtgcaatcttggctcactgcaacattcgccttctggtttcaagcgattttcctgcctcagcctccagactaggggattacaggcacccgccaccacgcccagctaatttttgtatttttagtagagacggggtttcactatgttggccaggctggtctcaaactcctgaccttcgtgatctgcccgcctcggcctcccaactcagtaatgatttttacacatgctaaaatacaataaccactgctataatatcattattctctttctgctttgctctgctagaaagtttatatgctcatatattttcaaagtatagtgaaatatcagacctattagagccatcagcattcttactttgactaatattctattcagtacaatccataacaactgaagattacttcattatagttgttgtatagtgaacagaatcagaagacaaaagtttgaagttagtctgtcatcctcaacatttcttatactgaagaacaatatggtatagcagttaagagcatgagctcaggagccaaattgccagtggcaaattaggctctgtcacttacaagccctaaaactttgggcaagctacttaaactctttgccttagttactttatctatagaatgattgccataagataatacctatatcagaaagttgtgaaaaggaaatgaattcatacgtgtagaatcctttaaaactacctggcacaaagtattcagtaaatatttactgaagtattcattatcattgtcatcaccatcatcaacaatgttttacctctagaagatagtactactactatactatatgctgctatactatgtaatagcggtaatagtagcagcagcagcagcggcagcagcagcagcagcagcagcagcagcagcagtagtagtagtagatgaatgaatgaccttaggaaagtaagtgactttttagaatctcagtttcttcatccatggagtggggctgggaataatgttgtatatatagatataacaggtttacccccaggatcacaacagctatgtatccttgccctcaaaagtgaaagcactttaagatggtgtgatctatatttttccccttggcttataagtaactgtctgcctgtttatttgtactacaagtgaaaacaactggtgttatctgtgggcggttaatgggctaacaaatgtatgctgcttctttagagtcatagaatattgatgctagaaagaaccttacaggtcattaagttcaaaattttactaatggcaaaacaggttcagagaagatagtgttttgccctcatgtcatatatagaggtctcttaattcctaatccagggtactttctgtttgatgagtttcccaagaactgatttgcatggatttaagattaatcaattattgagcatttactatttataagtgcacactactatgggataagagaataaatgaagtccctctcataaaaagagaatatgattaagctggagatataaggaagcacaaaatggtaccagggactgaacaatagcagaaacagattaggaagtatggattgcagacagtgtggagctagcgagcctttgtgttcaaatttgaaacattagtattaggatacaggctcattctaatctatgttggagttctttccaggtaaaaggcagtaggaaagaccagataaatggttggtttatgatcccatcccatatccaagagtaggctacaaatggatttgaatagcatactccctaatatgttcacaaaactgactaaactgagcctgctatccttattcctgccaaagtttggtccacattttctttaaggatggagaaacctattgggtgtaaaggcatttccttctgaagactttattttgcttctttgattacaggctactcgtaaagtaaatgaaaatagaatagcattatttgctctaataaaaactatattttgaggtaaagatgattatggaaatttttttttttaatgtagtatcgctctgttgctcaggctggagtgcagtggcgcgatctcagctcactgcaagctctacctcccgggttcacgccattctcctgcctcagcctcccaagtagctgggactacaggcgcctgccaccacgcccagctaattttttgtatttttagtagagatggggtttcaccgtgttagccaggatgatctcgatctcctgacctcatgatccgcccacctcagcctcccaaagtgctgggattacaggcgtgagccactgcgcccagcctgattatgggaatttttaacaaaggtgtatttttaaaagtctttgttttttaaggtcttgttataacttggtgcccacttccacttcagagagagatcattgaattttcctagtgacaatgaggcatgtttctttaaacttcattctgatgcatgaatattaaaaacctttaatgttttcctacctctttatgcctgagagaaaatatcaattattaatcttcctaggaagtagaagataaatgaaacaatccaagaatctaagtcagtaatcatttgatattttctttcttccttctcccctccctccctcctcctctgtctcctcttcctcctcctcctcctttttcttcatcttcatcatcatcatcatcatcatcatcatcacctggcacccttgagggagacattttctttataaaaggaagttttcccagttgttgtatgtagcagtcaaacttagttctgtgtagaatgcaacaacatagaattgctgctttccagagggcatcaaagggagtgccttgtgatgtgggtcactaactgcatgaaaaactaaatcatttgaaatcctttgctcctattcttcatttacatatgctgcattgcttttgttattagcctcaaatattaaaatatcactgtgacattggttcctacaaaatagaatagccaaacacttgttataaagtatctgtaaatttagcctctataagagaactttggatgtgtatttgggagtgaaagaaattgaagcataaagagatgcccagctccctgatcatgttaatttacagatactgaaacagacagattagtactgtttgattctcccattcctctgttgcctcagataaatccttaagtcagcccagtgagaaggtgggtttggcatagtagtgaaataacaaaaggaataatttgccataaatgctttttctttgtaacagcattattgagatacaattcaataccatacattcatccatttaaagtatgcaattcaccatcaccgcaatctgccttaagctttaaaaactgtctgggcaaaacccctctgcatagctttttcaggtgtgtattcaccatctcagcccatctaggtttcgtctctccctctccctatccttgggtgctgatattttagcagagacagtactaggtttgaaaatttctgtgttaaatgtcattctcatttctaactgaaacctataaggaatttggtgtcagcaagcctgagccccaaacattgttgagtccaagaaaatcattagatgaagcaggaaatgttgagtaggctgcaactaagagaaagctaaagagatgaaaatatgttatgaaaaccagatcttcaaccctcctttttaaaaccctgattgccacactttgaaagctacctacttatgctggcaatcaaaatgattaaaaactgcatgctgcttatttattaacataattattctcataaaagtactgtggcgttaccatcatgtaaagcaatcctatttccttgtagagagagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttggtgggaaaaccttctcaccagatgtcaagatctgatgcagaatctttggcaggagtgacaaaacttaataagtaagaacatattaactaacccaattacatatttgtaaattctacatttcatacgtttctttttgttatgacattttattattttcaccatatttttttacattaacacttccctcctaccttccttttccctcttcagttcaaagtctgttgcgagtttaaatagaagtcctgaaaggaggaaacatgaatcagactcctcatccattgaagaccctgggcaagcatatgttctaggtcagcaaaaacaagcttaccttctttgtcccatacctcatgctcagagggaagtgaacaagatcatcttaattatcaaattattttgggttccatgtcctaattgccaaaactgaatataaattttaggctacttaaaatgcaccaaatcaaattaccacttgatttaacaagtgattgcttcatggtacagactattagcttctctttttttccccctcagacagggtcttactctgtcacccagtctggagtgcagagatcatggctcactgcagctgcaaactcctgggcccaagtgatccccccacctcagcctcctgaatagctgtgactacaggaacgcagtaccacatctggctttttatatttttttgtagagacagggtttcactatgttgcccaggttggtcttgaactcctggactcaaggggtctgcccaccttggcctcccaaagtgctgagattacaggcttgagccatcacgcccagtctgttagcttctcttggtcacagttgccatgacagtcttactaagactgtcatgtgccattactttggattaccttttttggcttttcctttcaagccgatgtgaatgaactctggtaatgctatagttttggagaagcatttacttagaatgctttcagcttagcaggaacaaaattgtctctaaaaccttagataattttatgaaatgtgctatggttgataggtagaagtttttaagttgatttcagtttcttcaaattctcccagatagcagggcatattatttaagtgaaattgtatgtatgtgtgtgtgtgtgtgtgtgtgcatgcacatgtgcatatatatctatatatatgcaccttttaagatgcttaccttttatacatgctaccttttaagataaatagttcaggtttcctgttgccttgtgcaacttaaaagggaaacgcactggagtcgatctttgaaaagaatggatgtttaagcacagagatctgaactactactcaaaatatgaaacagcgtgggaaacaaaagggaaatgaggactgtttcccttctgttgtcttacgaaatactactaaactctcttcttaggctcaaggtttgttaatttatctctaattacccaaagtttaaaagctttttttattctataattggattcagggtatgtcgagtaaatgaagacaaaagacaattctgcattataatacataaatatttatggaagcaacattactttattaatgtaggctttcgcaactttcagagactatactatcaatttaatttcagtcagttaaaaaaacttagataaaaggcaagatttcattctataggtaactctgtgttgaaaataggctaagagattgatttgatcttttaggaaatacttttcaaagtgttcacatataacggggcctcatacattctaaactattttcattaagaaggctttggtctacatgaaaattcattacatatccgaaggaaaatagtaaatactctatagaaaacataaaacactcttaaaggaaatttttctgcattttgtatttattcattcttactgaataatgaatattcttttaacacttgaacaaatgaaaaactcattccagtttcatcatttcatatttgatatatcaaagtattgtcagaaacaatatatttgtgtttaaatttatgctgcaaaataagttattatgcttagctactatttaaaatagtgaaaatgcccattggaggatgttttctcagtgtaaatacaaaatgttgctgccttattgttctattgatttttatgagcttatcagaagaaatcacttcgatatctagcatctgaccatcttatgaaatgtctaatatttaatttatgccacaggaatgactatgcatagttctggaaactcttcatcccaagtacccttaaaagaaaatggtaggtttacaaaatgtttttcccctcatttccatcatttcttgtaccttactgagatagtcttggacctaacaatgaagagtcttgagttccatgcctaggatttgatcttacattgaagttaaaggagagttgtatttttcagcatcataatgatgtaatgggacctctgatttaggctaatgttgatgaaatgacaaattagagataaggacactaattgggaagctaagataatagttcaggtgggagataatttctattaaaaagagttttaactgaggcagttattttaaagggatgctggagctgaattttagagggaaaggaggattcattcagacggaacaataaagataagcattccagatcaagggcatagcatggtcagagacatggaatcatgagaaaagaaatttagggaactgcaggagtctcagtatggtggcatgtgggggccagggtaaagtttgagaactaagtagggaccagtttttaatcttatgctaaatattatgaggatattttgaagactttaaatgctgagattatagtttagaaggaatctaagaaacaaaatcgtaggcagaagaccagaaatgtccagtgacttgaacatcactggctttaaaatttttagaatttagattgcaaagtattttcatatacattatcttatttgatctttctaacaactttcatgagtagaaaataatgttttattactatccatacactactttcctccaaaaatgtttcagtcttggactcttaaagttgaaataattaaaagcctgatgagaaagaagccattatgttaattaaaattattaatacagctaaacttgatgaagttgtaaatttagtttcaatattcctgtagccagggtaaaacagaaggcataagactgaactatatagaattgctgggtatttttaggtcaaaactgtcaaacaccagagtgctattttgtatgattctcattctctaataaaaatacacatactaattctttaagacagaaaaaattttcttggaattaaaattgcttttaaaagtaaaactacacacaatgtcttaaatactcatagcaaatcaagatgaggtttctttccttctcattttatttttgaatgtatcctcgaaaaatatgagggcctatcattaaagaaaaaattattgaacttatacttggacgtaaattgctaatcctgttatatagctttctagtgatcaaactccttacatggactgaatttagaatgcctatatacctgaaataccttagttattaacatgtccatatggtagtaattattgactaacagttatttagtgcttactatgtgtcaagcactgttctaagcactttttattatttctcatttaatgcccacaacaaccctatgaggtaggtgttaatgttattttttttcacacgtaagaaaccaaagcatagagagttaagttgtacagaaggtcacaaagttagcaggtggtagagccgtgatttgaacaaaggcaatctgtttctagagtctacactctaatctactctttagacctcctcataatgtgatcatgcctaagtattatttctccctgctaaacttttgaaagaagctggataataatctattcaagtatgataattttaaatgtgttttagcttagattatgatgaaaaagaatatgaatgtacattggatagccaatgagcatgaatttacattggttagtttctctatttaaaccttcagaaggcttaaagtctcacctgccctggacagtagggccaatccaccttcatatagaggtatgcctcagttagcttgcaaacaaggctatattttcttcaaaacgctctttgaatctggccaagtagcctgaattagtactctgttgagaatcaagttttcacataatacagcatggcaaacatgtttttgcaaatagtgtaactaaggatcaaaaagtaaaattacttgcccatgcctcaaatatgggacctcttactctaatttcaatgttcttcctgctggtcaagattattagatgaaaattataaatggacatcagttaatattaaattattcatcacttagaacaaggatgaatgtattatattcgctcttaccttttatggcctccagagattcttaaagaatgtgaaatttgaaagaaaagataaaaaagtcatgattcttctaatctcacactttgaaaaggtgatatggaaaggattctaatcccttgataaattgtgatttcaaaaacaaaagttgctcaacttaaaaaaaaaaacactggttattttcctttgtaagagtaaaaacaaaaatatgtaaaaacttttccaagaattatgtaaaattgattttaatgtttcttgttttactgtaattattatacagcaattgaaaagtaacttttagctaagtttgtcatgttgcttcctgaagtgtccaaaccacgaactatagatggtcaccgacttatcatggtttgactttacagtggtgcaaaagaaataagcactcagtaaaaattgtactttgagtacccttacaacccttctgtttttcactttcagtacagtattcagtaaattacatgagatagtaaccaccttattgtaaaataggctttgttttagatgattttgtccaactataagttaacataagtgttctgagcatatttaagttaggctaggctaaagctgggatgtttagtaggttagatgtattaaatgcatttttgacttagggtattttcaacttttgatgggtttgttgggatgtttaaaactcaccacagttaagtgcctttttattcttagttgggatgagaaccagagcaactcaaccattagtctcctcaagccattttctctttcttctttcattttattccgtctttactgcttggggttttgattttctgggaactgtatgcctaatggacttattaagtacctaccatagaataatggatttccttagtttccaagtatcccaattcctgaacggtgggttattaaatctgaaacttgaaggaggaaatggaaatttaaagcaatgatcatcatttaatcactttacaaagcactttgctttaatctgttctctcttaccacctcatcaatgtggtctcttaaaggctatactgatttcagttcctaatgtgacctcacccccttatttgttttatttaattttatgggttttgttctgtgttgttttgtatttgttctagctaaaaaatagaactaattgcctattttttgataaaaggatcttggatacttaaactcattaaactaggcattaaataatggatgggcttttgcttaggatcacctaatatgtaaagtacttcacaccattgtccaatgatagtttttgtaatttaattaataaaatcattagaaataccgaattaccactactcttattgctaataactaagttttggtcaaaaagaaacaacagaataggaatatatactctacagagatctagcaaacttgcatcaaaacagtattgagatacaaggctaattcactcctgagaggaaattattgttgttattgtcttttgaaattaaaggaatttatttatacaatatgaagtatcacatttacatcatttaagcatcaatacaagttttgtgacaaaattactatttgttttgtgacatattaatgcaattttaagtccatgggtggttatatgttgcacatacagaaataaagtctgttttcatactgatttggttgttacaaaaatgcatatgaaggtctaaggaaattctggcttacagtttagtgaaaccaaaacctctaattttcagaaagcttcaatatagttgagaagtatgtagagttgaatttgaaaattcactttacaaaaatatccttaggaatatgttgaacgaactgaccaccaccaacaccttcacacacagaccaatttgaactgtcattgtaattgatgttaagaagtgtgtgtttgtgtaaatgcttgaattgcgaagtagatgaattaacttgataaacatgtcaattaagtgtcatatttattggtttcagaagttaattgtgaatgattagcctactttaaaaaacctagtggaaataagaaagagtaaattctagttctgattatgacatttattcaatttatttaactaggatttatcaaggactgacttcaggcattttaatgggcactgatactagttattatgttgagcaggtcactaactgttactcctcatctgcaaaacaatggttaaaaatctctttacttacttgtgagattgtttcacaaataaaatttgaaatgaatgaagatcctttgagagtacatgtgctagacaaggaattattaatggaactattaatagatccagtttctgaccaggtaccgtggctcacacctgaaattccagctcttttggaggcctagataggaggatcacttgaggccaggagttcaagaccagtctgggcaacatagactccatctctacaaaaataaaaaattagctgggcatgttggcacgtgcctgtcgtactagctattcaggaagctggggtgggaggatctgcttgagcccaggagtcaaggctacagtgagctgtgattatgccactacacttatcctgagtagcaaagcaagactctgtctcaaaaaaaaaaaaaaaatccagtttcctcttgctattttactcaagaacttactaagaatattttaccagttataaattaaaatgccaaccattaattagaaggaattttttaatatattaagcactgtcaaattcagggagttgattatggtgtaacaaacagaaaacctaaattgaaaagttcggctctttcctgtactagctgactaaacttgtgcaaatcatttaacctattgaggtttatttaatcatttgtaactgaaatatacttatttcaaaagaatagcttatgaagaataaatgtaatacgtagtcattttataaattataaatcactataaaaatataaaatgttaacagtatcagtaaacttaaaatatatgtttaagtgactgagcaattaacacactttgttaacatttaaattgttaaaacaagctgacagtcttaatgcctgagcatgttatatttatttttaaattataaattcccaatagatgtgctacacaaaagatggagcatagtatcttcaccagaaagggagatcaccttagtgaacctgaaaaaagatgcaaagtatggcttgggtaagtcaccgtgagattcttgaaggtctatgattgttggggattcagaggaaaagtctatagcatagcattggcattgcagtgccagctcacttctggtctcaagatactgactggctgcccacctacaagcccatcaacctacccgcccagtcaccaaatgcctaataagaaatgcctacaagaaatacttccacaaaatttaatatgtgttacctactaatcatttgatatcaatagtccccacatttctgtgtttcaggcaggctaatcattagtctttgaaagcagcaatatgaaaatctttttaaaatgtgttattttacaggatttcaaattattggtggggagaagatgggaagactggacctaggcatatttatcagttcagttgcccctggaggaccagctgacttggatggatgcttgaagccaggtactttacattttggtagttttctaagtattttctgacaggcatgaatttaggaacttaggccaaactaaaataattgagaaagagatgatatttctaagattcagaataaatgtatctttgttgttgaaaatactggattgtctatttgtacaggagaccgtttgatatctgtgaatagtgtgagtctggagggagtcagccaccatgctgcaattgaaattttgcaaaatgcacctgaagatgtgacacttgttatctctcagccaaaagaaaagatatccaaaggtaatgtgaatgtctcttacttatgtattctgtttcacttttctgtctcattcctttttagtgatattcgcacaaaaatggattcattgtgtacaaaattgatgcaacttaagtaaactgtgattacttaatgtgttccatctttcttttgtcaaatcagagatagagtcatttatcattgtgtagttaatattacataatagttatatataaagtcctgtcctgaaccagatgatgaaaaggaaaggaccaccaccaaaaaccagaaattttaaaacaaaaccatatcattttgtctcattatcccagtcttcagtggctgagagacaaagcacttgatgaagatcagatgacctgcgtttgagctttgcctgtgccttttattagctatatgacttaagccttcttgagccatagttttcttttgtttttacttaaagagtagacagtgatctttgccctgctttgtctgccttgcacagagttatttgttacgaggatcaagtggtaggacagtatttgtggaagaagcacaataggcccctgtggcgtagaacagtgcagtgggaaacagggagggttgcagaatccagggtcagattctgtttctaccacctaaaactgtacacattgagcaaaatcacatgaaccttctaagcctcactgtgctcgtatatcaaatggtgactataaacatgcttatcttatagattatgaaaattaaatgagataatacatgtaaagaatgagcacattgcctggtacatatgaagcatttaaatgtgaattttagctgtcattaatattgtttttcaaaaacattgaagtgctagatacaagtaagttaccttcatgccaaagatattgggaaatacataaaagaattagtaaaaaaaattagctgaaaaacaattttagacatagctttggattcttatgataaaatagaagatgaaaaacatgaacatgttatatgttgtgataaaatcttattaaattttatatagatgagtcattttgagtatgatttcttcttactggatattatatatattttgtatgtctgtatatgtacacatataaataatatgttacacacttgtttactgtgagcaaacacaatcgatagaagggaaatagaaaacaccaccactgcccacaggaactttatataatctaattataatctagtcacattaggcaaaggaagacaactacagttggaaatgttgtaacatacttctaagtttaaagcagccaagactagaaattttacattgggtcccattattcaccattttttaaccatttctgaatcataggaatgcagaataaatttattgccccctgaataaagctctaagggatttccatcttactcatgttttcagtagatgttttgtagaaaatttattcatttgtccaacaaatatttattcagtgcctgtgatgtgcaagacaaaaaactctgccctaatggaagttactctttatcaggggaggcaagtattcttgtctgactagacagatttttaattgtaactatggtaagtgttaacaagaggcccaaggtgccaagagggaatataacagaggaactttacctattgtgaggatcagaggagccttttcttctcagcagagttttgtgtggtttttttttctgtccatgctaaataaaaattaaaagcataatgttaaaagtatacacctgtgaaattgtttcttcagaaagtaggtgaatcttatcatggtatgtaactattctgtagtgtcactttgaaaagaggtaaaacccaaaagaacttagaaaattaccaatgtgtattctagctacccctgttaattgttaagcaccaaagaggaaggcttttagttttgtttttgtttgctaatttttaaagttacagaatacatactagtttattaaaaataaatccaatttatgcaaaacctatgaaataagaagttgaagtccccttaccccatttcctagggaaactttttggcatacatgtagccttctgtgtagaatagatatatatgtgatgtgtgtgtgtgtgtaaatatatatatatatatatatatatatatataaacacaacacatacacacactattttttaaaaatctgttttatactctaaataccattctgtaactgcttactcaacatattctgttgctatccatgtacatgcatatctttttaatgcaacattatatttatgttatagacatatcaaaacttacttaacttttcttctattgttatgtatccaggttagctataattctattataaatgttactccaacaaatacaccttttaatacaccattgaaaatgtatgtatttctagaggttagatgcctggaactagattaaagagtatgtacattaaaattttgacaagtgccaccaaattggacttcaaaaagttttaccaatttatagactaaccaagtagatatagcagtgcttttctcctcataccatcagtggtgcttaaaattatcagtcattctcatttttgtcagccaaataagtagagaactgcattaaactgcaggtccctgagcaatagtgagaatgtcttttcatatatttactatttgtattttactctgaatttccagtctacatatcccttgttccgtgggagttttgaaaacctcttttttgttgaattttagcaactctttgtatattagggatactaattctttgtttattgtttgttgtcacaaatattttctctccagttgctcattactcttaatttttcccttgttgtcaattactacataaaacttttaatttcatataaattctcatctttaattcctttacacgtgtctttggtggtttgtgtcttcagaaagctttttcaagtggcgttttgtttgtttgttctttgagacagtcttgccctgtcacccaggctgaagtgcagtagcacaatcactgctcactgcaggctccgcctcccaggttcaagtgattcttctgcctcagcctcccgagcagctgggactccaggtgcacaccatcacgcccagctaatttttgtatttttggtacagacagggtttcaccatgttgggcaggctggtctcgaactcctggcctcaagtgatctgcctgcctcaacctcccaaagtgccgggattacaggattacaggcatgagccactgcgcttggcctaaagtggcttttgataagaactatatataagcaatttggagttgccttccatgataatcacttggagtccaaaaagtgcaatctagtaggtcaatataaagtaagtgtgcaaataactatttaataaggacaaagaatgtgggacactaagaaagtataaattatctgtggaatcagtagagtctccacagagaagcctggtttgaaatggatcttggagaatggaaatggggagttaaggtgaaaggggtatgcatttcaatagaggttgtcacaagaatgaccaaaggagaaagcaaagaaagtctaccaaacacatgacctaatggtgttttgtgtgtcatccttataaaatccttccaacaatcttcaagaaacattgtgtatgtgtgtaagcacgtgtatcactaacttgttactctcattgatggattttgacttttagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggcatagtttaattttaatattttggttttctcatttaacaaagcaaaatagcagcaaataagttacagagcacaataatctacaagatgctttcattattctggaaaaaagaaatagtttatatcttctaattgctactgcatttgatgctaactttcagagaaatcaacagctttggataataactttaaatggctatgactttgcaaacttgctatctaataacccaaagaaggaatatgcagattatgattgttttcttaccagttgtttgtctctggcatatttaatgtttgtattaataagagaattttaatatctgaaaattgtttctaaatagttcgtataatgggcatttgaattcactatttatagtctaaattcttctgaagttctgaatgaatgatgataacgacattgaaaatagctcattctggctgggcacagtgacccacatctataatcccaacactttgggaagcagaggtgggaggattgcttgaggccaggagttcaagatcagcctgggcaacatagggagaccctatctctacaaaacatttcttaaaaaattatccaggcaaggtggcatgtatctgtagtcctagctccttgggaggctgggtgggaggatcgcttaagcccagaagcccaggcgatcgagccagaccctaacagaaagaagggaaggaaaggaggaagggagggagagagataaggaagggaagaaagagagtagcttattcctagaaatgatacaaatttaaactcaaattcacaagcagttttagaaaaaaatctaacgccttttgtttactgaaaaatcaacattccttataagagttatactcttataaatagggcttagctgttgttcccatgtttatattattggatttataaatataagtaatgtaaacatgaaatcccattttagaggcttgggttaaaagctactgcttgatatatattgattattaaaggaaataaaactaatttgtaaatttaggaatataaaaagcattggaccaggattatataaaagccaggtttgaactgggttctatataggtttccatctgccatatctagcagtttgacctgaagcaagctctttaatctctggatatcagtttcctcaaccataaaatatgaatacattggactagatgatctctaagatctcttccaacctttatgttctttgactatactctatcctttaatatcttgctttttcataatttttccaaaaacacatatttgtctttcagtaataattcattttgattctagccagctttgtcctgggctaggtttaaaaaaaaagaaattaaaaaaagaaaaattataattcattttgactctaacaagaaatctttgtttgtttttctttgttaaggaatcttcctcttcagtgaatacatccaacaagatgaattttaaaactttttcttcatcacctcctaagcctggagatatctttgaggttgaactggctaaaaatgataacagcttggggataagtgtcacggtactgtttgacaaggttttcaaatgttttctcttctttaatttccagcagcctattgtatgtcaactttttaattgaattattttgcatcaaaagggacacatcaaatacctccaaaattctaaaactgaatcatatctaaaaactattttaaaaattgtgttagtcactttttcctgtgattttaaaaaaattagacaaacactacctttttctccatagatttaatacttgctttatctgaatataaaacttgcaaattgtaaaattaatgtaatgctttgtagatatttgacagtttctacgtgagcatagattatatatctctaacctacattattagtaattaaagactgtatatttctgtatactctccataatatgtaataccttgtaaacatgttagtatcttaaaattagaagttcccaaggaatatatgtatctttaaggtagtcagaatgtgagcataggctatttgataaaattatttttgaattatactgatgaatataatatccctcattagtatactaatgaatatactgtacatcagcacatgctgatgggatgtcactgctttggctaatgaatcctttctaggcctgagatttgaaagagagtgcaaaatttttcatgttataaaatattattttgtctttttctctttagggaggtgtgaatacgagtgtcagacatggtggcatttatgtgaaagctgttattccccagggagcagcagagtctgatggtagaattcacaaaggtatagtgtttatattatgtgggaattatatgtatgaatattacaacaaatagataagaaattataaagttgataactgaccttcaaattcatgatatgaaataagaacatactcaattataaaactgtagcattaagaaactctttgatgccatttcaaaaactcttctttccagcttattttctagtatcagaagatatctatacatcaacattgtgtgagaagttaaaaaaattaaaaaggaaagaaaatatctagacagtgctttcattcatattttacatgtactatgaagcaaattgctgtaaaaacactgtcatctacacttgttttttttgttgttgtttttttttttcgagacagagtctcactctgtcacccaggctggagtgcagtggtgcgatctcagttcactgcaacctccgcctcctgggttcaaatgattcttgtgcctcagcctcccaagtagctgggactacaggcgcccaccaccatgccgggctaatttttgtatttttagtagagacaggttttcaccatgttggccaggctggtctcgaactcctgacctcaggtgatccccccactttggcctcccaaagtgttgggattacaggcgtgagcctctgagcccagcctgatatctacacttttagtaaggactaactaggaactttcctccaatctctatatatttatagttcaacttatcttctctcttgatttaaatttatttttataaagatactgttctaaaatatacttaacattagacataagattggggaataaattaaataacatattaaagaaactctgtaacacaatttcttccagaatttgcctgagtccctcctcaaacaaatgaatacgaaataagaccataagatttaaaagaacatgtaggatttttatttatgatttgaactgcctaatttttaggtgatcgcgtcctagctgtcaatggagttagtctagaaggagccacccataagcaagctgtggaaacactgagaaatacaggacaggtaacagatcattataccaaccttttacagtaccttagaagagcaaaacaatgtgtgaataacatcagttctcattgagatctctaaatttgtcagctaatcaagaaaccaagcctgatatatataaccatctgggttgttgatttttccttccaaattgaaatgcaagtattacaagacattttttactgaggaagctgactttctatgtcacatttaacgcttacattaccaaagagatctgatgggggagggatggaaattgcattttaaatttgttgtataaacatctcatttctagtggttttcactcttattctttagccttaacacaaaatttattttgttgaagtacattttgagttagggagtttaaccaaattatctataatggtctttggaggtttttgttgttgttttgagacagggtgttgctgtgaggcccaggctggagtgcagtggcgcaatcacggctcactgcaaccttgacttcccaggctcaggtgatccccctgcctcagtctcccaagtagctgggactacaggcttgtgccaccatgcctggctagtttattttttatttcttgtagagattgggggcggggggtctccctatgttgcccatgctggtctcgaactcctagacaagaagtgatcttcttgccccagcctaccaaagtgctgggactacagtgggactacaggcgtgagccaccacacctggcttttttttttttttttaattgagatggaatttcgctcttgtcacccaggctggagtgcaatggcatgacctcggctcattgcaacctccgcctcccagagtcaagcaattctcctgcctcggcctgtcaagtagctgggattacaggtgcccaccacgacacctggctaatttttatatttttagtagagatggggtttcaccatgttggccaggctggtctccaacttctgacctcaggtgatctgcccaccttggcctcccaaagtgttaggattaccagcatgagccactccacctggccattatcatacatttctaacatgtattatatttataatagattctttttaatcatttatctttctatacagaaatgtaataaaaacttgattttggaactttcaaccccttgcttttgttcctctattttttttttctcccccttcatttggtggaccaaatttggtagttactttaaatgattttataccattaactatacaaagtcctgaaaatgtatctattttcttagcattcttcttaattaatgaaatgctattttacttatccaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaaggtcaggccttgggagactacaatctcacctttaaattattcctcgcctattcaaaatttgatttttacatgttggattacagttaatgccctagttttgttcattattcttgtcaagtacaaataataatctgacatcacaccatactgaataaagacagaaacatatttgcagctcatagggtctgaaagactttggataataaagtcatgcatgattatggtcttttaaaaatgctttaaattgttgtaaaattcaaaatagaatttggtaagtgaaaaaataaagaaaaacaaatgctgagatgccttcaaacccatgggaaaccttgacccttagatttttgtatttctatttaatttaattttaagaactgtgaatcaaactctgggcagatattcacatagtagtgcccagaaagtggtctttgttacaaactatgctagcctttggacagatcactaattggtagtaagaaaattaagaatgacagtggctttccagtaccctttaagattctgtcttcttaagaggtttatatttcctttactttataaatgatggtgatggtgtacagtcattgttttattttacacaaacgttagcaactctgaatcagtccccaaaataatgagaaaaaataacacagactatattattttttcctgaatatgaaaataaaattaatgtactcattttatcatactgctctttattctttatttcttccatctttttttttttttttttttgaaacagagtctcgttctgttgcccaggctggagtacagtggcgcaatcttggctcactgcaacctccgcccctgggttcaagctattctcctgcctcagcttcctgagtagctgagattataggcacacactgccacatgcggctaatttttgtatttttagtacagacggggtttcaccatgttggccaaactggtcttgaactcctgacctcaggtgatccgccctcctcagcctcccaaaatgctgggattacaggtgtgagccaccacacccagccccatcattctttctttaaatagattttttttttaaacacccaagccaaccatgagcaaagactttaaatgtattttttaattattttctggttattgttcttttaatttatttagctgataagaaatttattgaaatattgcaatttatctgagttaaattacacctccccagaacattacaatttcaatttatttccacataacctcctctaacatttattttgttcttcttttcatctttctcacgctgtatacctgagtttctcccatacctgtccttctgtggagtttcccctttttttgtctgttatcgtactctgttttgttttgtttttgtagagattggatctcactgtattgcccaggctggtctcaaactcctgggttcaagcaaccctcctacttcggcctcccaaagtactggggtttataggcatgagccactgtgcctgaccatagtgtcttttaaaacacacaagtttgatgcataattccattttcagaatcctactttcagaactctccttcctaatcaaacagcttagttcatgcagttagttgataagatttcttaatgatggaaatagactgtaagatacagcttcagtataccattggagtgcagtaagtacatacagagctataaatacgggaaaatgggcttttaaaatgtgtctagaagtatatatgtttgtatgttcctatgtaaacacagcatgttaataatatctaaattttttttatatctttttctccagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggtgagcccctagcatgtggagtatagcatttttaatgatgagatggattggcctttcagaatggtttcataatgctggtttaactgtaccttcatttgtcattcatggtacccccaggaagtcatatctgctctcaggggaactgctccagaagtattcttgcttctctgcagacctccacctggtgtgctaccggaaattgatactgcgcttttggtgagacttatgaaaagtaatttacagttttatagaatatcaacttagcaactaactaattcagctgtggtggtttcatcatgaattgttctcctgggtttcatacctagctacttgttttaggtaggcatgttatcttgtatgtgacaacttctttgaatgtattccatatttatataataatacaaagtaatttattcaatttatttaactaggatttatcaagtactgacttcaggcattttaatgggcactgatactagttattatgttgagcaggtcacaaactgttattcctcatctgcaaaacaatggttaaaaatctctttaataggaaaataacatttctgtaagatgcattataaatagcattttaaaggactacattgatttgaggcaccagataggaaaaagtgaatgaaactctcttgatgagcgtataagttggtatcagtttttagaaaacaatttggaaatacttaattaggctattaaaaatggcctatattctgacagtatagaaaattacaaagtaatagaaactcaggtaaaaatttacatacaaagaagttcttctagatttctattaataatgaaaaggtagaaacaactctgtccaataaaaggagaaggcagaaataaaggtatagccatccattggaccattatacaggtattaaaattgttttaaagcatatttaaggacttaagaaaatatttatggtagaaccctaatttttgagagtatgagacaaaatatataatactactgtagttctaacttaaggtataaattgtacaatattaactgttattttatatattattttctctattgaacataaattacttttatcatcagaaaattcaatgcatactttagtagaaagttgttcaatggtttattttcaaataaatgcttctaaaattcatagaatggtcacaaatctctttaaatgtgtccattacagaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacaggtatcatcaatataatgtgaaccgctcaaagcaactggttgttgttagtagcagtagcagcaacatgcatttctcttaagaatgaaatgtatgtatctgtgaccttcacagtggttaggcagaggatgactctattggatgtctagctattgtgactgatagttttagttagcaaaccaataagctctctagtcagtcagcctgagtctttcttccctcttgagcatatttactagtaactgagaaagttatttgtatttcactgttaatcatactacttaaacagaaacagaatagacttatttaggcagtaacacagtgggagactagggaccagaaatatagaggggagataagggcagagagtttgcaaaaggtaagacaaagaagatggggaaaagaagaaatgattgaaaacatagaagcatacaaagagaaggactacatcaatacattgcataattattcatacattttactctttggttatgtctttgtatctatccacatccaactttatttattcaagtttttttcctttgtattttatccaaaataaccacaggagtcagacttttattcttctttcttcttttccttattatgttgaaacacacattaagcttctgataacattagcttcagctttgaattaacaactagaaatcaaaagaattttatttaacctatcttgctgactttatgcagcttaaagagcttcatcaaaatagaacctaggccggcgcgatggctcacgtctgtaatcccagcattttgggaggccaaggcaggtagattgcctgagctcaggagttcgagaccagcctgggcaacatggcaaaatcccatctctactaaaaatacaaaaattagttgggcatggtggcacacacttgtaatcccagctacttgggtggctgcggcaggagaatcacttgatcctgggaggcagaggctgcagtgagccgagatttcaccactgcactccagcctgggcaacagagtgagaccgtgtctcaacaacaacaacaaaaaaaacctagacagagaataaattattgttaattttaacatttaacagatatggagtaaattcatagtccagagtcatacaaaaagtaactaggatctcaatcaaaatcagacatgaatatttgttaagtgttttctgtttctggcacaaactaaccatattgacattgaaatgtatttaaaaatagtcttacttctttgtctctgtagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggtaagttgttttctctatatttaaaaaaaaatccatattttttaaaagaaggtgtgttcataaagtttccctttagggaaaaagctatctttaaaatagcttcatatgtgtgtctaataaatggataacatatctggtatgtttctgtgctgagaaattaggaaataaggcaaaaagacctgagtataaatcctgactctaccactgacttgctacaatttggcagactcctatggaccaatcacttaattcttctgagtcttggtaactttgactataaaatggagcaagtaacctcacagggttgtggtgaagattaaatgaaataacatatgtaaagcacgtagtatagtatctgctacagagtagacccttagtaaatattatttttgtctgcttctcaaattctgatgagttacctatttgatttttaaccaagtttgaatgtaattttttttttctcctccacactttttttgtgtgctcagatggaatcctttacattgtaataatagtcctagaacttctaaacctacaaataagatttagaaacaaaatttccaagtataatatcctttacattgattgaaagttagcctttttaaatactgcttttattatccaagtaataaatgtttattgtagaaaaattattaaggagagaagaagattaaagccactataatctgattaccccaaaactgttaacattttggagctaaatttccagttacccttttttttttgcctataattgtgcatgtgtgtattggagatgaggggtgtgcagcatctacatcttcagtttcattcttagcaatagagtaaaaataatctttaatttttcttagaaatctttcacccttgtaaacaacctccgtgtctcatttgaaatcttttaaaagtatattttatttatacaacaaaattaataagattgtgataatcaccgaaagacttcatatttttaccaaaaaaaaagctttgttgtggctctttgcatctgtttagaaatatatggctctttgcatttgtttagaaatatatgaattttttttctgaacctttcctccagaaagtattttttgatcatcaaagtataaccactattgtgtccttatttatcctaaaaatataagaaagaaagcaggagtaaattctgtctctgctgtctctagacaaacataatgttgtgcttaaacataacttttacgtgggatgcagtggggggacagtctgtctagaatcagacagactgtctagagtcagacagacttgacttcttcacttggacaagttaagtaaccttttaaggtttgactttctcctctgttaagggaaatgatagtcatctttctgtttgtctatagtgcagaatagacaacctaaaagtattactgcttttttcccttaggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggtgagacatttaagaggaatggattatttgtgtaaatgtagacaaagagcaagccagaaaaagaagattgaattattgtaatactgtatttatctattcggtttatgctttctgtttccaccacttaaaagtaaaggccttcatatcgttaacagtttgggaaattattttatatatatatatatatatattttttactatactttaagttctagggtacatgtgcacaacgtgcaggtttgttacatatgtatacatgaaccgtgttggtgtgctgcacccattaacttgtcatttacaaatttgaaagtccctttaatctcagtaaggcataaaacaagctatcttaggtctcaaggacagaaagtttaaattacttagaggatgaatttcctagattagcaaaataatgatgcatttgttagggatttaacattattatttcattgtaatggcttgatcgttgtgcctatgatttccataataaaggggattaccaataaattagagatcactgttgtgaatctcttactagctaatatatattataaattaggaggattattgtattttcttggcaatttagcttctcttttctaaaaattgtgatcttcacatgcccctttcttgtttttgtaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtaatgaaaagtcaaactttgtacaatatgattttcttggttagcttaagagtaagtacttttatgactgagaaaacaaatattttctattatttcaaggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaaggtactctgcaattatttatgagttttgattgtgcgtgtgtgtgcatttcaggtcattgattatacttcattctctgaaaatatattactgaattagtaattcatagactaaattggcaggacttaataaatttaaaacagacttcttgataggcgattttgagaacactaagtgaataatagaatggttaccacatttatcagttaggatgttttcacttgcaagtaatagaaaataaaactcaacttttgtttaacaagaaagggaatttattgggagtttttttgttttgttttgttttcttttcttttttagacagtttcactcttgttgcccaggctggagtgcggtggtgcaatcttggctcactgcaacctccgcctcccagattcaagcagatctcctgcctcagcctcccaggtagctgggattacaggcacccgccaccacgccaggctaatttttgtatttttaatagagacggggtttcaccatgttggccaggctggtctcgaactcctgacctcaggtgatccacccgccttggcctcccaaagtgctgggattacaggcgtgagccaccctacctggcccgaaatttattggtttatattggactttagaagtcccagagatagggtggtcatcaggtgaaatctgatcagggctctaccttaatttatttgctatttttagttatttcctcctccctgttatcagttttcaaaagactacatcattttcatacttcccacctgtataccacatcacatcacctagagcagtcttcaaacagaaatctcaccaatcactactatttaagcaagtactgtgtaccaattgcgttatgcctaaattaaggtcaatctctaagttggaagcaagggataagaatatacagatgctcctcatacagtggggttacatcccagtaaacccatggtaaattgaaaatatcataagtcaaaaccacatttaaaatacccaacctaccaaacatcacagcttattagcctagcctagcctaccataaacagttttacattacttacattacattatcctacagttggacaaaatcatctaacacaaagcttattttataataaagtgttgaatatctcatgtaatttattgaatactgtaatggaaatgaaacacaggatgattgtatgagtattcaaagtatggtttctaccaaatgcatgtcacttttacagtgtcataaagctgcaccatcgtaagttggggaccatcagtatcgattggcttaagccagtcctggctcattcccagagctgggataggattaatcccactggaacttcatgcctgctacccatgaggcatagaactaccgcatctactcaaccttataacagtttcacattataaaacatgctaatagcaacttttctttcacttataatggaaacagattgagaaaatgtattagtttcctattgctattataaaaaattactataagtttagtggcttaaaacaacacaagtttattatattaacgttctgaaggtctgaaatacaaaatgggccttactgtggtaaaatcaaggtgtcagcagggctgcattccttctgtaggtcccaggagaaaatctattttctaccctctagagactccccatacaccttggtttatggctcacttccatcttcaaagctaggaactgcagcaccctctgcttctgttgccacgtctctttctgtgactcagactttcctgcctccctctttcacttattaggacccctgtgattataatgggcccacccagataatccaaaataacctccccacatcaaaatctgaacctaatcatatatacagtttcttttgccatataaatagtaatatcttcagaggttctgaggattagaacagaatcattagaatgtaaacatcttggaaggggattattctgcctaccacaatttacaggaatccaggctttctagattacagacttaagtcatataaaggaaaaattcacatttttgtttgtgaattatttcttttaaagtatgggaacttgttgatcaaatcattgatgataagcttatttattccttctgaacctgtaaattagattgtgtacttttttttccccttgaacatagtctttgacttgattccttcatatatgtctaaaaattggattggcatacaattgttttcatagatctacttgaatgttaattaggaggggagggaagtcttcaaacaacctggaaagtatttttgtgaaaattaacatttttgctaactttaggtccaactgaatattttgcctcaaaattagtagagcactcttcagctcagccttgaagtcattttcttttgtctttctgcttttatcttagctgtcgtcaccaaaaatacagtcatggtagtcacagttattttctcctttgttcttcttctagctctctcttcattgtgtttatctaccctcttttattaaagtccatagggtagcaataatggagtgatgtatacttgtggtaattatctgtatgtccaccttctagagactcctcatactccttggtttatgacttccttccataaagggaactgtaaagggtttaggattttactgtacttgcaagctaataagctagcctgtctttgttacatggatactggcagaagacataaaactcctgaatcagagataaaagactattactaatgcatagcaagcagcatgagcatggcattagtgtcagttccacgtcttccaagtcccgtaaaaatgatgtatgtgacgcacctccccccgcccacccaggcaaagcagtgcctggtatcacatcacacaaaaggaacaaaagcaaaacacacaaaccagcttcaacttacacttggttactcaaaagaacaagagtcaatggtacttgtcctagcgttttggaagaggaaaacaggaacccatcaaaccaaccaatcaaccaaacaaagaataaattccacaatgaaagcacgtattttgtctttttgcattttggtgtataagccatcaatattcagcaaaatgatttctttctttaaaaaaaagtggaggaaagtagaaatttaccaaggttgttggcccggggcgttaaatttacagatttttttaacgagaaaaacacacaaaaaaagctacctcaggtgttttttacctcagcaccttgctcttgtgtttcccttagagattttgtaaaactgatagttggagcatttttttttatttttttaataaaaatgagttggaaaaaaaaaagatatcaactgccagcctggagaaggtgatagtccaagtgtgcaacagctgttctgaattgtcttccgctagccaagaacctatatggccttcttttggacaaaccttgaaaatgtttctttaaaaaaaaaaaaaaaaagatgacaaagaaaaacagagataatattggagatgtcctgaattttaatagggtacatgccattagggctttttgcactaaaggatgaacatgtactggtttatgtggacaagccattataccaccagactgcaatgccagtttcctctacggtgaaaccccgtctctactaaaaatacaaaaaatcttagccgggcgtggtggcgggcgcctgtagtcccagctactcgggaggctaaggcaggagaatggcgtgaacccgggaggtggagcttgcagtgagccgagatagcgccactgcactccagcctgggtgacagagcaagactccgtctccaaaaaaaaaaaaaaaatgatgtatgtgggcctgtggatttgtacacatgcaataggttgtattataggagaggaatgctatgagaagagccttgggaacccaccattttgtagcagtctgtaagaaagcctgttttttgttgggggagagaagttaccacatccttcatggttgcacactgcagatacaaccttaagaaacggcccagataaaaagaggtcaggaccttgcattttggggctagtcagcaagaacatacaggggtactcagaactttaagtatattgcctctcccaatactgtacaccttaggcaactcccctcttctctcaattatcagcaacaataagattgcatactaatcttctatttctgaggtgctatctttttggctgttttgtactttgggtggtaccattcttataatcctttgaatagaaatacttcatctagattttctctttaatttaaaagaaaaacacgtatcaagggctttagatatataaaacttaatgaactgtgatttctaagttatctttaaactattgactaagtgacagtgaaccgagttattagataatgaatattagcagtgttttaaataaaaggggaaatagggtgatatgttaaactgaagcccagagaaaacctacgtaaagaagtgattcttaatcttttttgggtcaagaatatctcccgggccagtcacggtggctcacacctgtaatctcagcactttgggaggcctaggcaggtggattgcttgaactcaggagttcgagaccagcctgggcaacatgaaaaaaccccatctctacaaaaaatacaaaaaaatagctgggcatggtggcacatgcctgtggtcccagctccttgggaggctgaggtgggagcattgcttgaggccaggaggattgcttgggcctgggaggtcaaggctacaatgtccaagacaatttacagttgtctttttttacaacacagaaatgatcttccagtggtccccagctcaaagaggtctgctgtttcagctccaaagtcaaccaaaggcaatggtaaggatatattcattttactgtactctcctacggtaatgggaatgtaaaatggcacatccattttggaaaacaggttgacaatttcttaaaaattataacttacacctaaaatataatccagctttttcactgccagctgttcacttgaagaaagtaagcctatattctacataaaaacttggacagaaatgtttctagcacttacttgtagtagccaaaatttgaaacaactcaaatgtccaaaaactgttgaactgaaaaactggttgtaatatatccaaacaatgaaaagctacacagcaataaaaaggaatggactattgatacaagcaaaaaaataattaaaataaactcaaaataaatgttctgaattaaataagccagagcataagagaaatagttcatactgtatgattctattacacagttgtagacaatgcaaattatagtgacagcagctcagtggttatgtgggacaaacgggaaggaagcatttaggggaacaggagaaagagattacaactattatgtttcatactctgccaatatgattgttttgaaccggtggtgtattattggtatacttttttatttttcttagaaatttaataatatttttcttgcaaggaatattaaaatccattcttggactctttgtaacatcatccacagaattctaaagacttgtctataaaaattccatctcaacttttatctttctaggcagaattatttcagggtcattcccaaatagaggttcttaaatgtatttacctatatttgtttctttctttgttttgttataaagttttccaaactctaccgtatttttctcagtctcttgaaaatataatttaatgaatgaagttatatttaaatatgtgatgttttagctgtaagtgaaatataatctccttttttaatatattgaatttttgtaatgatagctaagaattaaaattaacatttggtttaaaaatacattaaaagttcttttctgttttatccataatttattttcctgtgttgaattgatagtctttttgaaatcagactttaaaaagcttactaccttcttttaaatagtaaagtgaacatagttaagcacctgtgatggatcacccattcagtgcgaaaaattataatcagtgtatcacatgaaccattcagcccaaactgagctttgatgtgaactattttcttttaagaaattagctttttcctcacacctgtaatcccagcactttgcgaggccgaggcgggcagatcacgaggtcaggagatcaagaccatcctggccaacatggtgaaaccccgtctctactaaaaatatgaaaattagctgggcatggtggcacacacctgtaatcccagatacttgggaggctgaggcaggagaatcgcttgaaccagggagtcagaggttgcagtgagccgagatcgcaccactgcactccagcctggcaacagagcatgactctgtcgaaaaaaaaaaaaaagaaaaagaaattagctttttccttgggataaacccaaaaatattagaggtttggaatcaaatattattccatttatttggtttttaatcattttgtaatatgaattatttttgtgtactaataaaaataacaacatcccagaaatgtgagttttctttaattattttgatgtccctcttgtggtttggattggctcatccccttacttcctatattgtcctttcaggttcctacagtgtggggtcttgcagccagcctgccctcactcctaatgattcattctccacggtaagaaaaagcccaccctctttcatgtcatacctccttatctgaggaactgcatgtttgtgttttgaaccaaactgatttcatatttaaatatttgtcttctttagatattcatattaatagtaaggctatattttactgaactaataggccttgctaagtaaatcatacaacatagagcctcacataggtaaccgtacatcatttagcacacactcagcttttaaatacactaaccagttaaatagataactttagtgcggagatttttcttattaatgtgtaaaattcttttgattgtctcttagaccatgggaagagaagaataatataattaagagtggaattgttcctttgggctatttttggcgagtagtaaccttcaagttcaaatctgtgcaatcagtgaggaaaaaacagaagtagcaaaaaaataaataaataaaaagtaggtttacttgcttttgaaagacttagaaaatgctttaccaaatgattaaatgagagagctttaatcatttaagattagcacagagaaatctaggggtgactaaacaaaactaatacatagttaaattccatttcatgctctttttaagtctacttttatgcccatttggctaacatccctttttgtggttttcttcctggtatgtaatatacatttctacagtgatcagagctagatcttcatttcatggaattgttttattccacatgcatcccatacaatatgttctgaacttcaatatggaatggctttccatgtaaaatacagcgctgagggattgctcttttattaatccgaaagtcttattatgtcaacatgagctggctttagtgtgggaggagaaaaataatttcatgaccagaattccaaaattctacacctttcatttcattatgttgtctcacacttgtgatttggtctagcaagccatgaaaagataattacagcagaacattttaaggtagtaatgattgagacacaaaagcaaaaattttttgttatttgtatgtgttgaaattgagctacagcaacactcactattctctgtttattcagaatgtcttcaatttcacatagccaaagcaactgaattttcatgtatttctagtaatattcacactgtatagtgctcttctttttaagtaatcagtatgttgttgaaagaaagaagagttgagtttttgtgaaattaacataaaaccctagaaaccaggacttttgctgttcatggctgccagcattttttggttggagttaaaatcttccaggaagtctcccaaacaatactgtgtccttgaatgctaatatctatactattaatttctcattgagaatggagtttcataatccagtgatgctttttgatattatattaccactatttattttttaaaattctattgcatctaccatgtgtactttttatcttaatagaatgagtgaaaccttgagagcaaagcacaaccttttatttgtataaaattattttaatttattccaagcatttatttttgcatttttttcaagtgatttttcttttgataggctatgctccatgaagtgctttacagttgaacattgcattcaaaatttacattctattcaataattattctattgttatgaattcattatttttcttaaatttatatgagacttagactagatttgaaaatctttatacctaatagattatcaggtcactaaattggagactatatccatgtaatacactcacaagtacttgaaaagttggtattttctctttccctcaacttctaagctttaatagtcctattaaacttttttaaaattgtatgaaagacaagtcttataaaattgcttcaaaaaagagatgtctacagtcagatattttaagaagtactacataatagagttatcttttggcaactcaaagtttatattagcaaggactgtgaaaattcctggaataaaaattttgagttaatgttgtttcacctagtatttccagatatatttaatgatgggaagccccatgccctatgcacatttaattgcactgatatttcctttcaaacactgatctaaggtggagagatgtaaaatggatcttgtactaagaaagaagaggagagagacaatgtgcagtcccccgatcctggaagttagtaaaatactatctgatgatttgctttggttttatgctttaggttgctggggaagaaataaatgaaatatcgtaccccaaaggaaaatgttctacttatcagataaagggatcaccaaacttgactctgcccaaaggtagttttccaaatcagtcatctaattactctaaatgccctaataattcaggtaattaaaaaaaaataggtatcctcttttctttgctttatatgttactgtagctttaaagggaaagattattggtcaaataaacaaaagaacaatatataaatgtcccagtattcattctcgtctctgagactaattttttttaaatgattgaaaagatagctgctgtgttttacagtgtttcttgtattttgtgaagtagcaattcacaggctacctaatagtttagaaaaagtatcttgaggatgttttgtctgatctattatatccttaatcattgtaacataactttgtttctttcataaattaatacattgagagtcatttaagaaaataaacattaaattattaatgccttgtgaaaagccgtatcaccaacattgattttagtttattctttgtaatttgcatttgtgtggtcttccatcatagcagccagggtagttttagaactaaaaatgactggatcacattagtgtaaactacttttccagtcattgctacttttaaaattggttgcttaaaatttgaaagcacctagcaaattctgtttaacaccttgtccctttctcgtgtcaatatttttaaagtaaaaccccatgtaaattattatttttcaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacgtgaaccagatgaataaattggtatactatggagtacaaaaacgtctctagggagcattttttgagtaaatatgtaatgcattagttcttcttctgttcctcattcatgtgtaatatttcagaaacaaaacagaatttgttatctcctattttttttattttccatatttgtaagtgggttaccttattagtgagatctccaaatgtatcatttatatcatggcttttacttctagtagggttagtccaaacattttcccccagccattctcattttaattttagtagataattttaaccagaaattttataccaaaatgtacttgatcatttcttcctaacttttctagttaaaacattgaaactatttatggatattggtttatacactgccttcttttgcaggcaaatgaaaacttttctacttcctcaatagttttataaattcctcttggcctatatattcctctctcaggtacattaaagatgaatgggaagttatcagaagagagaacagaagatacagactgcgatggttcacctttacctgagtattttactgaggtaacaataatacctaaacaacctaggatatgacagcttgttacaattatgggtttaacccagaaggtgaaataatcagagattctttcctgttttactcaaaaattaaatttaggaggaaaacggagattaatttcatgtgttacattaaagtgtcatcctatcctagtgaaagaatcattacacaaattttctcaaattaaaaaaaatagaaaaaaaaacaattagttttcaaaaatgtaatgctaaactttataaattattctttaaaaccttaaaacttaggatcttctgggatattaggctaaggaaaagcatgaaatagtagataaattatatttcaggttcttcaagctcagcatcaccctatgtatacaaatctgaccttgcttaatattctgggataattctcctcattatccttcttagtcttcctacttcatatcttcaaaattattaaaactgtgctggtttgaatgttcttacactagttatcatgcatgcttatacttacacacaatctcatccatacatgactgttcattaaatatttacaaataatgtgtatatatacaaggaagcttacggctgataagtatgtatttctcaagctacaagaataatcatacaaatattagatatctcaaaatgtggcattcgctagtggtttttcttaagatgctctttcatataatcagaatattaataattacagtaaaaataggctctttagagaagattttctgaacattttaagtcatgactttatcacatttttattaatatttaatagtaatattaaaatgccccttaaaatgtatgttgtaatgtcttttaactaagaaaataaaaatctttaattgccatttcagaaatgtgatgtaggccgggcgcgttggctcatggcggtaatcccagcacttttggaaggccgaggagggcagatcacttgaggtcaggagttcaagaccagcctggccaacatggtgaaaccctgtctctgccaaaaatataaaaaattagccagatgtggtggcgcacacctgtattcccagcccctcgggaggctgaggcaggagaatcacttgacccaggagacagaggttgcattgagcggagatcatgccgttgcactccagcctgggcaatggagcgagactcagtctcaaaaaaaaaaaagtcatgtcacatgctttttcttttaaaaaagtaaggaaagcttgttaatatagattctcatttatactgagctatgactgttttatggcagaaaacttctttcaagttatcttttttttattattttcattatgaaaatattacatccttattgtaaaaaagtttccaacagaatcttcaaaactgttaagtcctagccgggcatggtggctcacgcctgtaatcccagcactctgggaggccaaggtaggcggatcacctgaggttgggagttcaagaccagcctggccaacatggagaaaccccgtctctactaaaaatacaaaattagccgggcaaggtggtacatgcctgtaatcccagctactcgggaggctgaggcaggagaatcctttgaacctggcagacggaggttgcggtgagccgaaatcacgccattgccctccagcctgggcaacaagagcgagattctgtctcaaaaaaaaaaaaaagtccctttttaaaaacatatttatcttattcatctgaggtagctattgttaaaaattttgatttctacctttccactgtgcatatcaaaacataaatatttgtatacatacataattttttaatatacgttttatcacatggttctgaatttggttttcacttaacaatcattaccctctttccatgtgagacgtataaatttgcctcatactttttaaagccttcctatcattttattgtaaggttataccataatttattaaattggccatctgttaatgaattttagatttcttatcaataagaggaaacaaattattaggaactatataattgtcttgccactggagtacagatagatcctgcaaatacatgcattgagaatacattttgggctagataaattagtgcttcctgaataaatgggacttttgctttagaatctgttttaaataatggtaaacaaagcaaagaaaatgagggaacaaatttaggaaaggagtaacagggatcttagattaaaacatttaaaaattttatttgtatctaattctaggaacacgtttaaatcactatggcaattatattcataagcagacaaatttaaaatttgcaaatatgactaatctcccctagctgaaaagaagaccaagctggtattctggaaaagttttctgtttcatcttgtatttctagaatattacctacattttagaactggctagttttaaaaattatttagaacttctgacaataatcttttgtaagttcttgaaatcaccctaaacaaattgtatattatttactgaattggttctaacagtatattctgtaactttgaaagttttatcatgtggcaaaagttaagatgctaaccattggtattacaaaagtataggaatatcttcttacagaagaaagattatacctctgatagctatttatacattcattgtatttcttattcagtattgtaattgtactctttggtacctcttagtgaagtacttcaggtcaatgcctgtgtctcatttaagaatgaaagaatgaatgctaatcgtatacattactataaattattgtctacagtttcaaaaccattcagctattgaactcatctgactaattttgctggggataatagggtaagaagaggtgttagggtttctgtcctaaatttgcttgtccagtctagtagtcagcttgagggaagtacacatgtaaataagtaaataatttttaaaaagctatagaaacatattctgttaaatgtttatatggagttcagtgggacctacaaagaaggggggaaatggtaggggctacacaggagtaggtggataaagttattaaagctttctaaagaattagcatcttaaaggtatttgatagttaagctaggaaagagcattccatacataccgtggagctgctttagcagaggaatgaaggcatagatgagcctggaacattcaggacactaagtcattgcgagtagggtatcacagggtgtcttgaaagctaaacctaaaaagataggcaaggtattagttcatgaagtgacttacatgccatgccaaggaatttgatctttccacatctcttgccactgaaatggatcaatatgctttctaattctggttattttttaatggctttaatttcttcaaacattgtcttcttatgtagtgtttttaatttcttaagcaaaaacaaggcaaaaacttttagtgactctccatcacctgaggataatcctgcttgactggttggatcttaggactggctttatgggcattcaaccagtgcaatcacacagaaccctgtgcttgtaagagcctcctactcctaatatgctatagtgctgtgctatcaccaacttgaagttcttagtaagtttttaacaagagataccttatttgcatgtgactcttggcactacaaattaggtagttcgtcctagatcaaggagatgtctcctctactctcaagttactggatctggattccttgagcactaggattgtaaaataaccttcaaaggggctgaccacgataaaaaaaaatcttaaatatattcagtgaggcagtaccacagctgcctcctcttccaaaggtccttcagtccatagtgacaagaaactgaaggccaatcttcttaacgcaaccctcccccatacacaagtgaactttacaaaaatagtggtaattggttaatacaggtatcactgtagcttttttttttttttttgagtaacagcaagatttattgtgaagggcaaaagaacaaagcttccacacacagtgtggaaggggacccaagcaggttgccccactgtaacttatttctaattgagctttacctcaccattttcatttaataattgtgttattaaaattttcatatttataatagcacttaactcttataaaaggctttgtactttctaaaatcattatacacatactatattcttagaccaggattgtaatggggaataagaaatccaaatgactttagttggaaaaaaattttaatccagactaaaatgagcagcttctcgaaagagatgagtttccttttagttgacagtggattaaaaccttttttcttctactgtagaacttctacatttacatcaactaaattgaaattattatcagggtaatttaattatggtactttttaactctacaaagtctgtaactgaaaggtcatattacaggtgtcatttttattaaatggatgaaataacctatgtcacagacataagtgtgtgtgggcacacagtggtgaacagatcgacatgattcctgccttggtagagcttaatgatggagaggaaaggagaaaaaatcaaacacacaaatagatatgtaattacaagttgtgttaaggtctgtgaagtttgtttgttgtttttaagtgccacacacacacacacacaaaaagaataaccaaggaaacctgctttagattgggtggatagaaaacatcttcaggaggagaagacacaatgctgaattttttagtaaggattcacccttagaagggctttgtggtaggaagagatgagtgattttgaagaactgaaagacccatgaatttgaagccactgggtaaaggggagattataaaagtagacaggggccagataattcagggccttcaagggaatttcctatttgttaagaaaatttgtcctgataaagattcaattgtataatttaccgaccatttaagaatacaatttgggggtggtcacttccaaaatgaccgaataggaacagctccagtctgccactcccaacgaaatcgacgcagaagacaggtgatttctgcatttccaactgaggtgcctggttcatctcaatgggactcgttggacagtgggtgcagcctacagagggtgggctgaagcagggtggggcgtcgcctcacacgggaagcacaaggtgtcaggggatttccctttcctagccaagcaaagccatgacagactgtacctggagaaatggtatacccctgaccaaacactgtgcttttcccacagtcccagcaaccagcagaccaggagatactgtcccatgtctggctcagcgggtcccaagcccacggagccttgctcactgccagcgcagcagtctgagatcaacctgtgacactgcagcttgaccagtggggggcatccaccattgctgaggcttgagtagctcacagtgtaaacaaagcggccgggaagcttgaacagggcagagcccaccgcaactcagcaaggcctactgcctctctagattccacctctgggggcagggcagagcagaacaaaaggaagcagacagcttctccagacttaaatgtccctgtctgacaactctgaagagagcaatggttctcccagcatggcgttcgaactctgagaatggacagactgcctcctcaagtgggtccctgatccccgtgtagcctgactgggagacatctcccaggaggggccgacagacacctcaaacaggcgggtgcccctctgggatgaagcttccagaggaagcatcaggcagcaatatttgctgttctgcagcctccgctggtgatacccaggcaaacagggtctggagtggacctccagcaaactccaacagacctgcagctgaggggcctgttagaagggaaactaacaaacagaaaggaatagcatcaacatcaacaaaaaggacatccacaccaaaaccctatctgtaggtcaccaacatctaagaccaaaggtagataaaaccacaaagatggggagaaaccagagcagaaaagcagaaaattccaaaaaccagagtgcctcttctcctccaaaggatcgcagctccttgccagcaagggaacaaaactggacagaggatgagtttgacaagttgacagaaatagacttcagaaggtcggtaataacaaactttcccaggcaaaaggagcatgttctaacaagtcgcaagaaagctaaaaaccttgaaaaaaaggttagatgaatggctaactagaataaacagtgtagagaagaccttaaatgacctgatgaagctgaaaaccacagcacgagaacttcatgacacatgcacaagcttcaatcgccgattcgatcaagtagaagaaaggatatcagtgattgaagatcaaattaatgaaataaagcaagaagacaagattagagaaaaaagagtgaaaagaaatgaacaaatgctcttagaaatatgggactgtgtgaaaagaccaaatctacatttgattggtgtaccggaaaggacaggcagaatggaaccaagttagaaaacactcttcaggatattatccaggagaacttcactaacctagcaaggcaggccaacattcaaattcaggaaatacagagaacaccacaaagatactccttgaaaagagcaaccccaagacacataattgtcagattcaccaagggtgcaatgaaggaaaaaatgttaagtgtgcagccagagagaaaggtcaggttgcccacaaagggaagcccatcagaataacagcgatctctcagcagaaagcctacaagccagaagagagtggaggccaatattcaacattcttaaaggaaagaatgttcaactcagaatctcatatccagccaaactaagcttcataagtgaaggagaaataaaatcctttgcagacaagcaaatgctaacagattttgtcaccaccaggcctgcctaacaagaactcctgaaggaagcactaaacatggaaaggaacatccagtaccagccactgcaaaaacataccaagtggtaaagactatcgatgctgtgaagaaactgcatcaattaacaggcaaaataacgagctaacatcataatgacaagatcaaattcacacataacaatattaaccgtaagtgtgtatgggctaaatgccccaattaaaagacacagactggcaattggataaagagtcaagacccattggtgtgctgtattcaggagacccatctcatgtgcaatgacgtgcataggctcaaaataaagggatgggggaagatctaccaagccaatggaaagcaaaaaaagcaggggttgcaatcctagtctctgataaaacagactttaaaccaacaaagatcaaaaaagacaaggccactatataatggtaaaggtatcaaatcaacaggaagaactaactatcctaaatatatgtgcacccaatacaggagcacccagattcataaagcaaatctttagagacctacaaagagacttggactcctacacaataataatgggagactttaacaccccactgtcaatattagacaggtcaacaagacagaaggttaacagggatatccaggacttgaattcacctctgtaccaagtggacgtaatagatatttacagaactctccaccccaaatcagcagaatatacattcttctcagcaccacatcacacttattctaaaattgaccacataattggaagtaaaacactactcagcaaatgtaaaagaacagaaattataacaaactgtctctcagaccacagtgcaatcaaattagaactcaggattaataaacttactcaaaaccacacaactacatggaaactgaacaacctgctcctgaatgactactgggtatataacaaaatgaaggcagaaataaagatgtcctttgaaaccaatgagaacaaagacacaacataccagaatctctgggacacatttaaagcagtgtgtagagggaaatttatagcactaaatccccacaagagaaagaaggaaagatcttgacagcctaacatcacaattaaaagaactagagaagcaagagcaaacacattcaaaagctagcagaaggcaaaaaataactaagatcagagcagaactgaaggagatagagacacaaaaaaccattcaaaaaatcagtgaatccaggagctagttttttgaaaatatcaacaaaatagactgctagcaaaaagtcaaattgtctctgtttgcagatgacatgattgtatatttagaaaaccccatcgtctcagtccaaaatctccttaagctgataagcaacttcagcaaactctcagggtacaaaatcaatgtgcaaaaatcgcaagcattcatatacaccaacagtagacagagccaaatcatgtgtgaactcccattcacaattaccacaaagaaaataaaatacctaggaatccaacttacgagggatgtgaaggacctcttcaagcagaactacaaaccactgctcaacgaaataaaagaggacacaaacaaatggaagaacattccatgctcatggataggaagaatcaatatcgtgaaaatggccatactgcccaaagtaatttatagattcaatgctatccccatcaagctaccactgactttcttcccagaataggaaaaaactactttaaagttcatatggaacccaaaaagagtccacatagccaagacaatcctaagcaaaaagaacaaagctggaggcatcacactacctgacttcaaactatactacaaggctacagtaaccaaaacagcatggtactggtaccaaaacagatataaagaccaatggaacagaacagaggccttagaaataatactacccatctacagccatctgatctttgacaaccctgacaaaaacaagcaatggggaaaggattccctatttaataaatagtgctgggaaaactggctggccatatgtagaaagctgaaactggatcccttgcttatgccgtatacaaaaattaactcaagatggattaaagacgtaaatgtaagacctaacaccataaaaaccgtagaagaaaacctaggtggtactattcaggacataggcatgggcaaagacttcatgactaaaacaacaaaagcaatggcaacaaaagccaaaattgacaaatgggatctaattaaagagcttctgctcagcaaaagaaactcattaagagtgaacaggcaacctaccaaatgggagaaaacttttgcaatctacccatctgacaaaggactaatatcctgaatctacaaataacttaaacaaatttacaagaaaaaagcaattccatcaaaaagtgggcaaaggatatgaacagactcttctcaaaagaagacatttatgcagccaacagacatatgaaaaaatgctcatcatcactggtcatcagagaaatgcaaatcaaaaccacaatgagataccatctcatgccggttagaatggcaatcgttaaaaagtcaggaaacaacagatgctggagaggatgtggagaaataggaacgcttttacactgttggtgggagtgtaaagtagttcaacctttgtgaaagacagtgtggcaattcctcaaggatctagaactagaaataccatttgacccagtgatcacattactgggcatctacccaaaggattataaatcacgctaccataaagacacatgcacacgtatgtttattgcagcactgttcacaatagcaaagacatgaaaccaacccaaatgtccatcgatgatagactgaataaagaaaatgtggcacatatacaccatggaatactatgcagccataaaacaggatgagttcatgtcctttgcacagacatggatgaagctggaaaccatcattctaagcaaactatcacaaggacagaaaaccaaacaccacatgttctcactcataggtgggagttgaacaatgagaacacatggacacagggcggggaatgtcacacaccagggccttttggggtttgggggcctgggggagggatagcattaggagaaatacctaatgtaaatgatgagttgatgggtacagcaaaccaacaaggcacatgtctacctacataacaaacctgcatgttgtgcacatgtaccctagaacttaaagtataatagaaaaaataatacaatttggcatttctttctaattgtagcaaactgctcctgctgcagtatttgaatctctgaaacacaccatactcagttaaagtatgagttgactaatctttaatgataaaggggcaatatattataatctaacatatttgaaactactaagattttcttgaagctttttttagattttaaaattgaagtagaaaagcacataccaaatgtgcatatctaaataatcattaattcacactttcatctttttcatctttgtctctttcctattaatatttttaatataagaaatgaaggccaggctggcttcagtggctcacacctgtaatcccaacactttgggaggctgaggcaggagagtagctcaaggctaggagtttaagaccagcctgggcaacatagtgagatcccatctctacagaaaaaaaaaaatttttaattacctgggcatggtgacatgcacctgtagtccctagctactcaggaggctgaggcaggaggattgcttgagcccaagagtttgaggttacatgagtcatgattgtaccactggactctagcccaggcaacagactccatctctttaaaaaaatgaaaagccaagatgagtgtgaagttacctaagtgggagcagcaaagactgttgggccactgatgcctcagccactgtttggagtgtattaattgaatgtcatatgtgtctttgtaatataaggatgaacaataacagtaaatataggaaataactaacaggaaaaaaatagtatgcgattttttttgttacaatgggctgatttgattcttatatatttttattgtaggccaccaaaatgaatggctgtgaagaatattgtgaagaaaaagtaaaaagtgaaaggtgagaaaataattttcaaagtatccataatgcttctgtctatctataaatgctctgaagatttccatttgttttccagtataaaataagcatagttgagtagattataaaactatggttgaatattaagaatttttaaaattttcgggccaggtgcggtggctcatgcctgtaatcccagtgctttgggaggctggggcgggcagatcacttgaggtcaggagttcaagactagcctggccaacatggtgaaaccctgttttctactaaaaatacaagaacccaggcatggtgtctcatgcctgtaatcccagcactttgggtggctgagatgggcagatcacttgaggccaggagttggagaccagcctggccaacatggtgaaaccctgcctctactaaaaatataaaaattagctgggtgtggtgacacatgcctgtaatcccagctactcaggaggctgaggcaggagaattgctggaacccaggaggtggatgttacagtgagccgagatcgcgccactgtactccagcctgagcaacagagcaagactctgtctcaaaaaaaaaaagaaagaaaaaaagttttaaattttttgttacaaggaggttctagtgacatgtgaaaatgtgtttattatactattgcttcaagaaagcaatattctcttaactattggaaaaaatgaatgaaagcgtgaccctaaatggaaatgtggcaacaatcatgatagtgactgtcttcacctattgggttatgggtcatttatttttcagtttctctatttttctatacttcaaaattttttaatttttaatgagaaaatgaaaccaaaaaaagtaagaaacccacaaaatatgttttaaaacccataaaaatatttttaaacaatttctaattataaagtaaggtctttttttacaaaaatatatatgagggaaagggtttttatctatgaggggacttcaaaaagttcatgaaaaaatagagttaaaagataaaaatataaaatataaactttattaacataagctccatcaagtttagcacacttttgtaggtgatgataccagccatttagttaatccccaaaaaactgaaggtcctgcaaatttaaccatatcaatgcagtcttttttacattaactgaagaaaaatgcatgccctttacagattttttgagattgagaaacaaaaagtcagaaggagccaaataaggactctaagatggattcctggtaatttcccactgaagctcacaaaattgccttgtttgatgagacgaatgagcaggaacatagtcacacaagaggagaactctccagtgaagctttcccagacatttcatggatgtagagctttttaacccagcaaaattagtgttgtcacccacagtgagttagaacagggggaaacatctgtcataaaagcagcgtaattgctgccctgttgacattttgggagcattagtccatgtcctggtgtatactaatgtcatcagatgaaagtactctgctttgttccccctgaatatcagaaagttaaaaacgtattcaggcttttacgtaatcctttttcacttcaccttagcactaaacaccgttctcctacctagtttctctttcctagccatccaccttaccaaagagggcatctgttatgcactcccaaaatattgagaacttgtactgggtttcattacattaagtgagtgcccaggtacaggagtgtccttctggcctcctgttgtagcaaaaggctatacccatcaatagagacttctttaaataaattaagatacattcatattttgcagtagtgggcagatgctgaaaagaaggagaaagagctatatgccggtacaattgtaatcactcatccatgttgaaggatagaaataaaaccaccaccttctccatcctcaaatggactccttcagtttaaagttcaaaaacgggatctgtccaaggataaattttaaaactgtattaaaccattctacatctcagttgtttacatctaccaataaattttaagaattgtggctttggttttcttagacattctattttaaaatactataataattgtagagaaaatcattcagggccatgtttaatttgagtacaaaaatgaagaaaatgtttcaaatatgttttgttttcatagcttaattcagaagccacaagaaaagaagactgatgatgatgaaataacatggggaaatgatgagttgccaatagagagaacaaaccatgaagattctgataaaggcaagaattttaatgacagttttttcctcaaaaataatgaattggaaaaatgtttttaagtgattttcagactatatggatatgctgttttaccatatgtatacattatttgcttttttttttttttttctttttttgagacagaggctgggagtccagtggggcgatctcggctcactacaaccaccacctccccagttcactacaaccaccacctccgcagttcaagcaattctcctgcctcagcctcgagtagctgggattacaggcgggtgccaccatgcccagctaatttttgtatttttagtagagacagggtttcaccatgttggccaggctggtctggaactcctgacctcagatgatccacctacctcagcttcccaaagtgctgggattacaggcatgaaccaccgcacccagccacagtatttgcttttaaacataaagttaaatcatgtagacaaaaatcaatattcattatattaccagatatttgcacagttatattctaaaattctcagtggcttggagtaaaacatgcaaataaatgtatacatactttaagtggaaatatgaagtcataattttgccattctggaaggagaagtcaaggggcacttttttttttttttttttttttttttttgagacagagtctctctctgtcgtccaggctggagaatacagtggcacaatcttggctcactgcaacctccatctcctgaattcaagcaattattctgcctcagcctcccaagtagctgggattacaagtgtgcgccaccatgcctggctattttttctgtttttagtagagatggggtttcaccatgttggccaggctggtttctaactcctgagctcaggcaatccacccacctcggcctcccaaagtgctgggattacaggcgtgagccacaccgcacctggccagaattattattatcctagaatcccaacctcatcttttatgatcgggaatcaattggtctgtttcactattactgccttttcattttattactgagccaatggagaaatgaaattctatccagtgtttaattcgtcttattttatatcaggaagtgtcactataatgaaagaacacggttttgtcattcaaagcaaagtctattttttttttttttaagaaattaacagcttaggctgggcgtgctggcccacacctataaccctagcactttgggaggccaaagcaggctgatcacctgaggtcaggagttcaaccagcctgaccaacaggcaaaacctcgtctcttctaaaaatacaaaaattagctggtcatggtggcaggcacctgtgatcccagctactcgggaggctgagacaggagaatcgcttgaaccccagaggcagaggttgcaatgagccgagattgcgtcactgcactccagcctgggtgatagagtgagatcctgtcagaaagaaagaaagagagagagagaaagagagagaaggagagaagggaagaaagcagggagggagggagggaggaaggaaggaagggagggaggaaggaagttagtttaattaacactttcttcacttggctagactgttggtatgtgtacaacatgcatgtccagcactgtagcccttgctcatccacccagcctttaagttcctgttgcactgacatgcagttctgtaaaagttatttcatatgagtaaattttgtattcccagccaacctctgcccgagctaaatgttaaccttttaggtgtcttgtatagttttgtgtccctcacagtgccagcatcattgctgcctatatcttagctgcatcatcaaaatgctttaatcagctgattgacataattaaagctacacttgtgcagtctatagcaagacgtttcccttccctttttctaggataacagttgccttcaattataaataatttccatacagcaggtactaaattagacccatagctcttctaagatagttgactcaactcccaaagaattcaagggaattctttatttgcatggagaaaactatcgaacaccagggataactggccctgagtgccaaggatggatggtgaagagagaaatcagtgttcctggagtaatctcccatattaaggaatttctgaagtgtctctcttactttcaccatgtgcttagaagctaatttaaatgaaaagtagtaacagaattaaatttgataattttttgtaatgagttcctgaggtttttttggggggtgagggggcaggtaaaagtttaagttgcatgtgttatgcagattagaatttcagttacagctaagcatacttgtaaaactttaggacagcatttctcaaatttgagaacctaagaagcactgagaatgtttatgaaccagtttgaataacatttaatgccattattttagattatcagtctctactagtgccagggtgagcaacacattgcaattcaaggcactgaaataattcagtgtttagttatgagttggttattcaggtgatctagaatgtgctttttatattatcttgaaattaaaacaaaatttttaaatgcttatgtagaaatactggcctccatgggtcagcagagcccagtttaagaaaaactaagctaagaaatatctgaaatatgtttggttttctgcaatcaagctgttcgtaaaaagaatttatatgttttacttatggtcacattttagtgtaaaagtattgaagcaaaggatattgtcattataattctcaattacctactaaaatgatggttccattggctctgttggaacaatttaaaggtatttatttaaccaaaagtctgtttttttaaaataatttgttagtcttaacacataccaattttgtatttgtttgatgtgctgcaattttttcatcttttcccattatttataaaggctttctgtatatatgagatcaagattttagtgtgtgtgtgtgtgtgtgtgtgtgtgtgtgtggtgtgtaaggagtcaggggagcataacttagagaatattgtgaagtttgggattcttcagaaaaattcatcttctctcactgtaacagagttctgttgttgaaagaatcccatttactattatctagaatacttatttttaaaaattgcctacctattatgttgtttctgaaattctgagaactaagtacaattacctttttatggctggttttgcagggaaaagaagcaagctgtccccaggctgcccatgataaaccccttatcaaaaatttttaaacagtgccatatgagtcaagagaagcaaaaagaaacaacataaactcctttagaaactataaataaatgagagccaagagccttaaaaacttctgaacgtcagtgaggtatctccttaaaagctgggtgtgggagtgtgctagggctgactttcctgtgttaattgtagttatcagcctacctattaattctattaccttattaattctctcatatttaaagactttcccttttgtaagatgcggtgagaatgggctgaaattagttcatttgttagttaaatctgttttgggggaaatattattagttgttgcatatttaaagacttttctggccaggcacaatggctcatgcctggaatcccaacactttgggaggccaaggcaggtggatcgcttgagcccaggagttcaggaccagcctgggcaacatagcaaaaccccatctctacaaaaaaatacaaaaaattacccaggcgtggtggtgcttacctgtagtcacagctaccaggaaggctgaggtgggaggatcgcctgagacaggtggttgacattgcattgagctgtgattgtgccattgcacttcagcctgggctacagaataagactgtgtgtgtgtgtgtgtgtgtgtgtgtgtgtgtgtgtgtataaaataaaataaagaccttcttagccaggtacacacacacatatacatgtattttttatatatacacatacatacatatatatttattgtgtatatatatacacacacatatatacatatatatttattgtgtatatatatagaatatacacacacacatatataaatatataaaataaataaaataaaataaagaccttcctagccaggtgcagtggctcacgtctgttatcccagcacttggggaagccaagacaggaggatcacttgaggccaggagttcaagaccagcctgggcaacatagggagaccccgtctcttcaaaaatatttaaaaattaaccaggcacagagggtgcatgactgtggtcccagctacttgggaaactgaggcaggaagatcccttgagcctggtagatcaaggccgcagtgagctgtgattacagaactgcactccatcgtaggcgacagaacaagattctatctctaaataaataaatagactttcccttttgtaagatgaggtgaacataggctgaaattagttcacttagttaaattggttctggaggaactgtttttaaattgctgtcttcctattagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggaggtaagtggcttctgccaatgattctctcccaaagtgtatgcatttagtttgtaaggaaaatgtatctttactggcccaagattagaagaatttttgaaaattttccaactctaaaagcaccaccttatcatatctagcagaaaattaatttttctgattaggatcccaataatagtgatttaaaggaatcactttaactacttggaacttgatacatttccctgaagattatccttcctgcctcatagttaaggtaaaaatgtttaaaaaaaaaaaaaaagccaagtataaatttcaaccatgcactaaactttataattagtgtattgtagacgtgtttcatcattaacagaaggttctaatttaatacagctccaagaatgtgtgtcctagttcaaagcagcaatggctcagagccctagctcctgtggtctcatggtactgtccatatttaccactagaaaagagagtggttttgaagttgaccttgcccctcttcctcaaaccatctgcttatttgcctacttcctaagctttgtagccactaaaaggagttaactttaataagaggttctgctttgtgcttgttgctttgtatatattcctcaaaatattaattctgttatagattgtgaaactgaggctcacagtaattaaggtatactcttctcatcgccatgctatggaatgatttgttcttcaagttcttagatttaaatgtcaccatcagaaaagttccatcacaacccttacaaagtagtgtttataaggatttctttaccacagcagcttattgatttcttcaaggcatatactacaatatttgtttacttctttattgtgtctttctcccaataagctgtaaaggccaggagagccaaaatcttatcttcttgctcaccactgtattcccatcacttattacagtaccttgcatataatgagcatgcaatatatattttttgaatgagcgaatgaatgaaaagtgagcaagagttgactttagaacctaggactatctgaccacaacaccactaccacatggaatattctataacccttacagactatactgtcaataaattgtgctctagctcatcactttatggcagagttgggtttttttaattgtatttttttctaaaatataaacacttttaaacagaagttaaaaattaagacacaaagttctgtctcataaagttgactacaacgtgttcaattaaaagatacttgtaacaatatatttcaatgctgacttaacaaatcactactgactttagacttatttaggacatctgtatttaacactcagaatcagccttaatcaaccaattttgcccctacacatttaaagtatttgaagttattactgaattactgcttatctcaacaaatttatttccatgttttgcttacagaatcttcaagaattaaaacctttggatcagtgtctaattgggcaaactaaggaaaacagaaggaagaacagatataaaaatatacttccctgtaagttccagtttggcttcagatttaatatgtgatcagtataatattaatggattaaaattttttgtgtttaacttacctatccctcacataaccgtgtgcatgtgcatacattcacagatttatatcagtaacaaatacattgaaatattccgtgtaaatccccttttaaattatgtaggtattctgaaaatcagttagaggaacctgaaatatttgataggatattcctgaatttttactagtatacagtattagaaattagtcggtgatgccaaatcattaattttaaaatctttttaaaaataggaactggcttctggatgaggattttcttggttggattcatttatcacaaccaccatcaatttattccacttatttttagtttagagaaatatctatggtaatgaatagctgtatatatatgcatatgactacagtggtactaccagcctacattagacatttcagataccagaagggaacaaaagcaatcattttggcccggtgcagtggctcacacctttaatccctgcactttgggaggccgagggaggcagatcacttgagatcagaagtttaagactagcctggccaacatggtgaaaccccatctctactgaaaaatacagaaattagccgagagtggtggctcatgcttataatcccagctacttgggaggctgaggcaggaggatcgcttgaacccgggaggcagaggttgcagcgagccaagatcatgccactgcactccagcctgggcaacagagtgagactccatctcaaaaaaaaaataggaaaaaaaaaagaaaagcagtaatttttacatgtataaaaatcacatgtaaaaaaatcacactgtgattttttttaattatgtatgaatgtgtgtgccaaaatactgacctctagcaaattcttataattaccagccacatgtatatatgttagcactttggattataacatatgacacactgaccctatctttaccaagaaaccataaatctaaagataaataataaaaaaaatcaatagtgacaagtcacatgataagtaataatgcaattgtatttttctaatccagatagaaagtacaaattcattttggaaagcttcctgtaagaaatgaatcttagacaacatttaaaaaatggatcagatcactgtttggcataaagtatatgggagttattttagacagcaaaatggccagttgaatatctcaaaatcagaataggacaagccataaatccaaaactaatgagtggatttactcccacaaaacaaatgaccagtatggactaagagaaagaagtcaagtgagaagggcaattggtaggggattttgaaacctatcattaaaaggttttagtttggtaatcacagtaattaccagttaaatttatagatatttgaaatagaaatagaaataacttctaaggtatgtaatacatataaatttattctcttagataaatcttagacaatataacctcagtgaatgatagcttgtacatacttttcactggagcagcctggtttaaaaaattacattttgactatatgaaattataataaaacaaagataagggcctttatgcctggataataaaatgagctgttattttctttattgtgttaatttattgttttggctgcttattaaaagaatataattttattaggtgagtgagagttaattatgccaataacatttgcaatatatactttaatagtgttattgtaatactaaattgtgttctatgaaaaattttttggcattgcctttcagtgctattattattatcatcatcatcattaaaataatgatggagaagtaccagttgtttttctttgtttctctagttacttattaggcaattctaaatgcatttattaacttactaattttaatttcaactaaatctatgtaaataataccaaatttcatatgtcagaaactcactaaactaacagcttagatacttgtaacatgagcaaaaagaataaacataaaataatttggctgtgctacaatttgaaaatatacttctattaaaatacgttggtgatttcatctgtgactatgagaatttctcatgatctttgactcatgcaatttgtaagactcttgtttaaaatgcatgatatggatggctctgttttgtggtggaaaattcacagatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcaggtaagtgaatgaaatctttccctgttggaaggtgtatctcctagttgtaatccaagcctggactctttccgtgattgcaccaatgttatttctagataaaagacagtgacttcctagttcccatgcaatggaactaatgctagctattttttctttatgtaatataagtttaaatgtgactgtcttcatgaattctgccagtttcctccagtatgtcctctactaaaatggaaatgaaaatgcaggacttttaatgtgattatcatccttggtgatagcacaaaatggctcagaagttgcatgttggaaacttgtgtttttatggtcagacctctaagtagactcattgaaactacttttaaaatctttaagtagaaaatattccctcataaaggcaacttaacatatttaggaatacatggataattttagcataaacagttgttattcagatcattcatactgcagttacctaaccactggatcaatctagcttgaattagataagtggcaatacctgaagtaaagctgctactgtttcctcactctgtgttctccctcaccttactacacgcctgtgcacagtatcctagctagatgtgagtaatgtttcccatagaaatttagctatcttaaggaaacagtgattttacttttatagaaacaaagcatatcaattcagttctattggtgtcatgtaaatgtagcctgagaatttctctcataatttttgattcatgattttttattgatttacactagcttacctattacttaggctagcacagttgttcaatattcttccagtgatttatccacttaatccacacatttttatagaactcaacccctttatagagatttggcagtcaacaacacagacaaaaaatatttctaacctcatggagcttacattctgaagaggaaataccagtattgatagtgctgtggaaaaaaatagagaaggacaattggctgggggagaatgagaagtatgtcgtaattttcaacaaggagtcagggaaggtatgagaaaatggcatttgaggaaaaatgtgaatgagttgagtgagccatggagggaatatctgaggagaaaaccattccagtcagaaagagccagtacaaaagtcctgagaccaaactgtgcacattgtatttaaagccacagagaatcatttggcttgatgaaagtggccatggggaaagagaggaggaggtgaggtctaagaggaaacagggccagattaggtagtgttgcagtgactctgacttttatctgaggtgcatttggaatggggtcaccagaaaaggttgttatcaaaatgcaatttgtttttagggtttccaaaaagtagtttttatcgatatttaaaatgtggatctagcaaccttgttgatagaggccttccatgtttttcttaatagagccatttagtttcttccacttttcctttgatctgatcctatagacaagccaaaatttgaaagcacaatataatattaagaattaattgtggccgggcacagtggctcacgcctgtaatctcaacactttgggaggccaaggtgagtggatcagttgaggtcaggagttcgagagcagcctgaccaacatggtgaaaccccatctctactaaaaatacagaaattagctgggtgtggcaatgtgcgcctgtaatcccagctactatgaggcaggagaatcgcttgaacctgggaggcggaggctgcagtgagccgagattgcaccactgcactccagcctggacaacagaacgagaccctatctcaagaaagaaaaaaaagaattaactgtatgtgaacaatataacatgtcatgatccacttattctgttatacaatttcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgatgtgagtacaagatattggctgagtaagcatttgttcagaaataatgatggagtctaatttttgataatgtgttgtgatcttgggatattttaacttatgagtttatatgactgccttcattttcttcttatattattatagaaaattgtatttttgtaaacattggtattcaaaactacatagaccgtgatcaacaaaaaataatacttcaattttatacttgttttactgggtgttttttaactgtgtgctcagaggccttttatgcagtatttcattttaccctttatagtctttaggcttgtataagatagtattgttatcacactttaaagatagaaataattgaagcacaaaggaaagtatttttttaatgaaaaagcttgtatttttgtattatctatgggtaaaaaatgtatattttattataaaattaatgctaagtagtttctaaacaattactctacataaaaaaattactataagagtataatcttacttttgaactcaaattaatataaaccttatttaaaattttagaatatcttaccatagataatgtgtaattaaaatcatagtgtcttaaaaagaattttagttaaaagcactttacacactagctgtagtaatttaagtaggatgaaaccaaatagtctttttttccctcatttccaactgttcaatgtcagctgaagtcaaaagatcttttttaggttggaaacacctttagcggaagagcagtgtgcaggaaaaataatttacctttttaaattgtaatattagaaattagtcacacttcagggggaagatgatttcttttctttgggggattttcaaatagattaaccttccctaattcctagaaagataaaaaataagaataccaagtgatgacaaagtccattcgccaagtcattttgtccaggagagtttcccaagactaccagaaggggaagaagagtgggatacagaattttacataagcctcccctctgtgatccttttgagattcaaatccagttatcctttgaatctaacacatatgtggtttcctctgacagtttgacatctctgatttggtgcgctgcatgagactacaaagacacggaatggttcagacagaggtgagtcatggctgggcctcctaatgagaatttttgtaaagattctaatattttttaaggttcttattaaaccatttttcttttttgagagttcccatgttagagcataaaaccaaacatttactgcagtgaggggcatttttttttaaatgaggactaattcagaaaaaaattaaaatacttccaagctttttaaaatgttgccttttaatttaaaaatgcaatatctgcactgaagagattacagagaatgggatagcatgctggggacagagtttgagaatggtacaaaatactatgtaattaatggcattccttccctatttccaacctgaaaaagagatagaaggtaacattcttgctacagaaattccctgagaagtaatggattcatcagcattgactggaacacagcaaggcaggctggagttgcttagcttcaagaagacattctgtaaggagtgtgaatacatgggtccatttatcctcttttgatgattttcgtttctcttacctgaaaggaaaccatcacccactgacacaatggcgtccttcacagggagtgccgtatttagagtgtctgtcttcactgaagagttccacaatcctctttgtttataatggaagagtgggggatgtagaagccgttttcaaatatccataaattaacatttctctacctcttgaaaaatagggaaatttgctatctttaaaaattagcatttgcctactttcctttcataaacctttttaattcaacttgtcttctaactattaagctgatttataatcacgctttttaggtaaggaaaacattttgattgttataagcagcactttacacctagaaagttcattcattcatttgttcattcaacagatatttattgagtgcttactttgtattaggaactcttctaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaggaactcttctaggtgcctggagcacatcagtgaataaaacaaagatccttgctagaataacaaagatattcttgcaggatactgataaggatggaagaccatagacatgttaaacatgtaaattatataggatccctgaaagtggtaagtgctttagagaaaagaaaaatgaaataggtaaagggaatcagtcatggcagattgggggtacgattttaaacagggcggcaccattggcgaagtaacacttaagcaaagatttgaaggcaaaggagagggtcatgtagatctctggggacaagagcctttcaggcagagggaccacctgtgtggaagtccaagggtcttgagtgttcaggtatggtcacagccaatgtggcgggcagggcacgagagaaggaagagtgaaggaggaggtgaggttagaggggaggtgacagggtccaggactttggcttttctctgagtgaaatgggagcctggagtggcagtgatctgactcacattttaaaggactactaacctgctgtgttaaaatgacaccaagtctggggaggaaggtgtagtgttataagcaaagagatcaattaggtgacaagcaggggtggctacagctggagtggtaagtgtggacagagtgaaagaaacaggacgtgatgtgaagtagatttgctaatgggttgtatgtggtgtcagagaaagagtcaaggatgaatgtgtggaaaagttaaaatacagataagcaaaaaagaaacttaaaaggccacttgtattcctactgtcagagagctgttaatgtttttaggagatgttcttatattctttgtcctaaacacatgtgcacactccttcatgctcacacatactatatataaaatagctcacacatgtagctattttaaatgagattcaactgtggttgttgttttattacttttcatttaatatattgtgagttttttatttgcagactcaattccttgccaaaaaaagtcagatctctgcaccatcaacttaatagaaaataatttcaccaaaggagttcattttcaaagaactttgattttcatgcttttgttccaaaatatttaaagacttattttttggtttgtttgtttgtttgttttttgagatggagtctcactctgtcacccaggctggagcacagtccgtgatctctgctcactgcaacctccacctcccaggttcaagtgattctcctgcctcaccttcctgagtagctgggattacaggtgcctgccacctcactttagtagagatgggatttcaccatgttggccaggctggtcttgaactcctggcctcaagtgatccacctgcctcggcctctgagattacaggcatgaaccaccatgcctggcaagacaattattttgaatagcttcttaagctgttaattttttgacattttaaaacatcaaaatgagctcaacaaatccagaagaaattatgtaggaaggttatttttccactaagtataatcaaagcacaaaaaatattgtagtggcccaccaatcaaagacaacttcagttagcactctaggatagttccatcccgcatccctcaggctttttcttttcttgttttgccaatctggtttctattataatttttataataccacacaattctataccctgcttcttttttttttttttttttttttttttgagactgagtctcactctgtcaccaggctggagtgcagtggcacaatctcggctcactgcaacctccgcctcctgtgtcaagcgattctcctgcctcagcctcccaagtagctgggactacaggcgcgtgccacgacgcccagctaatttttgtatttttagtagagacagagtttcaccatgttggccaggatggtctcgatctcttgacctcgtgatccacccgcctcagcctcctcaagtgctgggattacaggtgtgagccaccgcgcccagcctacaccctgtttcttgcattcaacattctaacaaaatttttccatattttcaaaactcatccaacatcacttccaatagtggtatagctatatatatataatatttacattatacatctaaagtattctatctcactttttttggccataggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatgaacaagccaaaactgtgtgcagacaaattagacattttcagtgtgttatttttcaacaacacctaggcccctgggaagacaaggacctctagacaccactttccatctccctagttggcctcagtcatgacagccatggagagtagaggtgttgtcagagatcctgatagatcttcactaaatactgatgtgggggtcatgtactggcttaacagtagctcagaaattcagtctttcttccttctacctctttgtgaatgttgcccacttattgagcccaatttatatataaatcagaatattttcaagtcctagccacagtactcaactgaccaagggctaatcaaagaaaacatatcaaactacctggggggcgggggtatatttggttctgcaaacaggaaggaaaagagattgacttcaaagctgctttagcttaatggttctctgttctcagtactaaattcatttcactaaattctaattctaacagtatttctccattcagccacgacactgtaactggatggatgttcttgaccatgagttgtccaggttcttggcatgttgaacaaagaattgaacaaaatgctcagacaaagcagtggaagattaaagcatagatgttttgaagtgaaagtacactccacagagtggaagtgggcttgagcacatggctcaagagccctgattataatgttcctgggcttttattgaattacaagagcatggtaacacccctaagtaccctttagaggcctctgataggttacaccctacacaaatgaagaattcagcccaggaccaatcagaggcaggattctgcccagaaccaatcagaggcatcctgcctgtgatgtataagcaaatgaaagtttcagaatggaccaattacagacatacccatttgtgacataggggaggggaggttcagagaggcatgggcatttggcccctcattacttggtcctggaaaggtggggttttcctcttagtccaattacaagaaggccttgggcttcctgtctctagactcttttctgcctcaacaccattctaagacccaggaaattgcttggctcatcctcataagactgcaccagttctgagctagttgacttgaatttccaaacttaagtgcagcaatttgctgggacctattcccgagaatctggggctatttgaaggcagaagacagtatcaataaacataaagccccacagtaactagctaaagccccagcagataagaggcttgggtcctacctcagaattggctctgaatatggcaagagaagctttaccattcccacttcaatcagaagagtattatagattgggttgtagccggagatttcatttgaaaaaaaggtttctattgctttaaatgacatttggaaatctcttttctgaaagagttggaatcatgaggccttgttttcctgcactggcatgtgaaactaggccagcagagcgctgggggccagtacagctggaggtgattagctcgcatctgaagtcaacatagatgggagagggtggagctggaggttgctttttctggaacgaatgtcactaggaaatggaatggggggaagaaaatgcagatttagctttatgacctatgaatggaaacttcatgatggtaaatatgttactgccctcagctgggatctggctgcaccagcatggaatggtatgagccacttgcaagggccagtctggttagaaagcaaggtgaggccacgcagctggggtggcacatggaaacactcatctcaaattaatgaataagtacaattcagctcttaacacagcttgtattagctaagtgctagaaaatataaactgaagatatggaatggcttaaacgtaatagtttatttctagtttatctaacagttctggaaaagtgaacagcttggcaatcagatctacttggctcagtttttagcccgggctgatgaaagtactgtaatcaacacatagcttccaaggttgagaatcgcctccattccccacgaaggattgcctatggagaggttttacgagccaggcttacatgcaaaacacattgctgtcactcattccatcagcaagaactggccaaatgattgccagtgacaactctatgctatagaaggggaagcacatattgtagtagaatatatttacaaaactgaactcgttattattctaaaagattgagtatcttagtgtagtcctgagcattgcagaattagaaacaattttatcccaaaatcaaaacttcagtgcatgtcattagtagagataattctgaattattatggcaaacaggaaataaacagctgttgagaaaagattcttttacatcagtggtcccagatagcctgccagattttttggtttaaaaaggactagttatctatatgtaatgtgataatccaataaatttaaaaaacagcttaatacacctatcttccagatacagacaccttgataatgataggctttccattttacataattcagaaatattcataattcagaaacattgtaatggtagagataaatgtaataaattataggctgacctgcataatattttaaagccaatcgaaactttactgtatcaatttgggattatatttgactgcaagtaagcaaaagcaaccaaacaggcctacaagttgtaaatcaataagtatgtgagacatgtctcaatttagaagtttattttgccaaggtgaaggacatgcctggaagaaatgacatggaatcacagaaatagtctgtggtctgtgcctttctccaaagatgaatttgagggtttcaatatttaaaggagaaaagtgagctggaggggaaagaagaggggtatggtcacatcactgaacccacatgttgcaggagaaaaggagcagatagggaaatagttatgtatttatcttgcactcagcacatagataaggtgaacgtagagtaactacctgtggagatatttaaccttttatctgtagctatctgcttaggaacaaaaggaaatgcagtttcttgcatgactcagctttcagcttcatttttttccttttggcggagtgaattggggtcccaagtttttattttcctttcacaaattctagagggcttagagtttattttctttccttaagaaaccaagctcagaaggcagttgctcagaagtaggcagttaattctatagctcaagaatgtcaacagcgctataaatatccttggcctttccttggcctggaagtggctgccacagctccagctattatatccacattccagaaaagaaacaagaattggcaaggaaaatgggtcaaacagtactagggcaagaaagcaaaatttcccagaagtcaagggcagacttttccttctgtcttagcaaaatctgtcagatgcccatctctagcttcaagaaagttatttttagctagatgtgttgctgtctagctatgaacaatatcttgattctgttcataaggacaaagacagcaattgatactgggtcccagcaagtagtgtgtgcctttccaattctgcctcagtttccaccattccgtataaggtagcgaacactatgccaatttttcaagatcttcatacatatttagaagattctgaatttgtaactattgaggagattcactgataggaagtatttaaaagtagtcttcaatttttacaggtttagagacatagttttattcactcaaccaaactataaccatattccaaaggttgtgctaagcaaaacctcaggacactgataaaccatgttgctgatttattagcttacaaggaagctataggtgggtctaacagaatgaggaaggctggacattcagaaggggctcctcctgctggggaaagtacatgtcaaggccaatgggaaggttgcctagagaccaacatgtcattcattaactgggttaggctgaatgatcctcgacgcaaagggtatttctgattacacaagaaaaaagtaggggatgtaacaagtattgatcacttatggattggaccaggtgttttcaccttgcctcgttttcaggttgttcaggattgaatgtgttatcaaccttttttagagaggaaactaaaccccagagggattgtcacttgcccaaagttgcccagatacccaaggtaaacgttcaatttcagctctgactgacttcaaccaatagctgtggaggtctcctagctattaaagtagaatgcaggctgggcacggtggctcacgcctgtaaccccaacaatttgggaggcccaggcaggcggatcacctgaggtcgggagttcgagaccagcctgtccaacatgggtgaaaccccatctctactaaaaaaaaaaaaatacaaaaattagccaggtgtggtagcgggtgcctgtaatcccagctactcgggaggctgacgctggaaaatcacttgaacctggaaggcggaggttgcagtgagctgagatcacgccattgcactccagcctgggcaacaagagcaaaactccaactcaaaaaaaaaaaaaaaagtggaatgcaggcagccctgacacagcctgtgttctctccactgcactctgctgccacgaccatccagctgcctctttcctcttagacatggactcattctgcttaacatgatttctctggccccacttctgagtttcatataggtcccagcttttattaactcatgattctttacatcaattagaatgcaacttactcaaatcggacttttttccagttatattttttgttctaaagataacgtggccttctgaacatcttcactatttcaagttcttgtcagtaacatgtttacaaaccatctatggagatggccatcttctgatgtgttgtttctatcttaaaggatggcctttggtatccctcatccttttggtgtccctcatccttggaacgtcctaactgttgtaaatactgaccatattgttaagctttcagaacagcattaaattttaccattttgttttaggtgtctatgtggagaaacaatttagaaattcattttttgtggattctttaaaactcatggagcccgggtacgatggctcacgcctgtaatcccagcactttgggaggccaaggcaggcggatcacttgaggtcaggagttcaagaccaggctggccaatatggtgaaaccctatgtctactaaaactacaaaaattagccaggcgtggtggcacgtgactgtagttctagctactggggaggctgaggcaggagaagaattgcttgaacctgggaggtggaggttgcggtaagctgagatcgcgccactgcactccagcctggatgacagagcaagacttcatctcaaaaaaaaaacaaaaaacaaacaaaaaaaaacctcacggtaatactcattttagagctggaaatctctgttacttgcaactctcctaactgtgttcattgcagtgatctattcccctactagactataaactttgtgagggcaggagccatgtcccatgtgcctgaacatagcacagactagcttctcattatgtaaacatttatcatatggataaaggggactctccgaatagtaaaccaacagttgagaattaacaagtcacaaatctgcatagttcttttccatataaaaagtgccgtggctctaagacctaatggggctccttctgtactaccacaaaggctttctgaattggtggaaaatacaataatcattgtcattgcattaacccacaagttattgggaatacttacaaaataacattataaacattaaatctcaaaacactttctcacacatttcaaaacttacaaataagaatagacacaaaatggaaccagagtcccaacaaaaacacattatataggaagttatgtgataagggtagcatttcaaatcagtagataaaagaataatgattcaatatatgatgtttggataattaactataaaaaaattagattattatgccatacaggaaaaattcaaaatggaataagtatgtatgtatttgctccatcacagtattagaaaaacatatgggaaaatatttttaataatttctagtagaggacagatttacctactgccaggcatcatgtattgcatgggaagacaagaagtacacacagcagctagtaaatatgttgtgtaagcccccagaaagaactccctgaaaaggggccaaatacattctcaaaaaaagattctatcacaattcacaatccacacaaatatataaatatgctaacatttggcagagatcagagcaaaaaaaaaacattcttaataagattaataagctgaatatattaaaaaaataaaactctgtattgcaaaagacatagagtaacaaaagataaacgagtaggtaaaatgttgacaaaacataggacacattgtcacttatcattatggttcaaaatctatacatcaaaaaggaaaagatacaatagaaaagcaggcaaaggacataagttgccaagtgattgtgaaaaatgctttagttcattcagtttttaaatgaaattttgttttttgttttttgtttttttttgagatggagtttcgctctgttgcccaggctggagtgcagtggcatgatctcggctcactgcaacctccgcctcctgggttcacgccattctcctgcctcagcctccagagtagctgggactacaggcgcccgccaccacaccaggctaatttcttgtatttttagtagagacaggatttcaccgtgttagccaggatggtctcgatctcctgacctcgtgatccacccgcctcggcctcccaaagtgctgggattacaggcgtgagccaccgcgcccagcctaaatgaaattttaaatgagatgttttaaccaatcaaaattgatcattcatttgactggtgagactgtgggaaaccaggccctctcaggcactgctgtacaacgttgccagatagcaatctgtcatacatttcggtaagcaattggcttggaaattcaagtcacaggaagtgagcctacagaaatacttgcacctaaaggcaaaagtgtttgtaacagcactgtaatactgttaagctgaaagctatctaagtgtccatgaataaggagtggttaaataaattacagtccttccacacaatagaatacttccacatcactactatactaaagaatgaggtaggtcaacacagactgacactcaaagatgttccataatgtgtcatcaagtgacttacaaaacaatatatggaatgatctcaaggttcttaaaatgatacagtttacatacacagcttagaaggatacacatgggtctttctttttttttttgagtcagagtcttactctgtcacccaggctggagcgcagtggcgtgatctcagctcactgcaacctctgcctcctgggttcaagtgattcttctgccacagcctcccaagtagctgggattacaggtgcatgccaccatgactggctaatttttgtatttttagtagagatggggtttcaccatgttggccagactggtcttgaactcctgacctcaggtgatctgcccacctcagcctcccaaagtgctgggattacaggcatgagccactgtgcccaaccatgtgtcaatctttagaaagtgaaaatacagggcattccatttttaaccgtatgtgtgttttaaattctttccaagcttgtgttacatctataatcaaaatgattttcaatttcttaaaaataataatcatttgagaaaactgccccatttattataagagctatttgttctcctctcagtgcacctgaggacctgcccagagtcaagaagtcacataggtctgcgtcaccctgcagtatgaggtgacatctcctctacttagagttctaactcttgttcaattaaaatccacaacgtggctgggcgcagtggctcatgcctgtaatcccagcactttgggaggctgaggcgggcagatcacttgagaccaggagttcgaaaccagactggccaacatggtgaaaccccatctctactaaaatacaaaatattagccaggcatggtggcacacacctgtgatcccagctacttgggaggctgaggcaagggaatcacttgaacccaggaggcggaggttgtggtgagccgagattgtgccactgcactccagcctgggcaacagagcaagactctgtctcaaaaaaaaaaaatccacaacataaggataagttcccctaatgaaggattttacctactgccaggtactatttgctgcatgggaagacaagaacatacaaggcagctcattgatacgttatgttaacccccagaagaaactccctgaaatgggaatctccaaaagtgatcccatcacaattcacaatccacatgaaaatataaatattctaacattgaacacttaaatattcacactggccctaccaacaagattcatgtgtcagctgcacactgtctttactggccactgaaaaagaagggggccagtccagccagctagtccctgctattcacatgaagtgatgtggccaactggctcgagagccctgtggcaatccattggccctggtggcccaggagtgatggcaccttcttcattcacctccaagaaggcattggtctctctggaagaagtcgatttcctcgtatggcagacttctgtgcaacctgagttcttttttccatgtttgttcttcaatctcctcttgtacgtctgatatgctaggtgttaaaacatacaagtattaacaatcactttaacaaagagtctaatttggtgacactgtacacttgtcaatccttcaggtgtttgtttcagtggcatcatgtatgtataaacacccagggaaaagaagggggaaagagagaaagctatagaacagaaggattcagtgtatcagaatggctcttttgtctggatgaaccatttgtgattgaggctcattcatcaggttgctgacagcttacacactcatatattcattcattcattcattcattcattcactcattcagctagtcagctggcaaatactgcgagtgcttactagaagtaggacactctcctgggttctgggctagagctgggaatgagccagaaatgatgcttgcttcagtctctccatgagaaggaaagaaaacttgggtctgagaccaagagtttgactctaataggatttatcttatctgttggggaaattaagccccaggtattcctgatattgttatattgattgttatatctgtaatcagtatataataataacaatcagcaatcagtatataatcagttctatcagtaatcattgagtcttactcagacccaattccctaacagcagcaaaaatttaccatggcccaagattaaaatatatatgtgtatgtgaacatatatatttttttttttctttttcgacttttagatccatgtgcatgtttgtttcctgggtatattgtgtgatgctgaagtttgggaaacaaatgatcttatcacgcaggtagtgagcacagtacccaacagtttgtttttcaaccttcgccccctccctccctcttctagtagtccccagtttctattattgccatctttatgtccatgagcacccaatgtttagctcccacttgtaagtgaggtatttggttttctgttcttgcattatatatatttttaaatttaccctctgtgaacaaacataataaaagactccaaagtaatgtatatttggctgcaatcacatgtgcatacacatatatatttcaatatttgtatatgtgtaatatttaatatttgaaaaacatttcacagccattcagcacaagtcttagtcacagaaacattgaaataacttggcatttgggagacctcaaggcttttaatgagacctaacaaatcaacgcttaagtgcagcaaatgtcactttggagctcaatgattgctcatagagatcttgtcttaacaagttacgaag

SEQ ID NO: 203 - DNA, 85538 bp, Homo sapiens
gatgacaacaaatttgttcagttagagaatttctctcctactcaagaaactgattttctaccacctactaagattcgttcatttttccatttttggagaaactcttgaggtttaaacatctacccccaaatattctgggaggtttcatatataatattaaattaattgcagtattttaccaagttctaacagatgttcacaattttgatatttgaataaaagttattaagatttagataacttttgtttagggcattagtgataggatcctgagacatggatattttactttaaataaaaaatattatattttattagttttcatgcccttaggacttgcatatgaatatgaaccagaggtagagtaaccacacttcagcaaattagtactcctgaaggaaatctcccatctcatattaggcaatcatatattaggttcaataaaattggaataaacagaatcactgaactgtagccatctagaatgttttaactcaacagcaagagtctagtaaaaacatgaccaaatttgcaggattgggggaagaaacagcagaagtggacaaactgccttagtgtttttatttacctgcacagaataaaaacgcttatattaggctgggtgcagtggctcatgcctgtaatcatagcactttggaaggccaaaatgggaggactgcctaagctcaggagtttgagaccagcctggggcacttagtgagactccaactctagttaaaaaataaaaaattagccgggtgtggttgtgcacacctataatcctagctacttcagaggctgaggcaggaggaatcgcttgagcccagagggttgggaccacagtgagctgtgttcatgccactgcactcctgcctgggtgacaaagtgagactgtctcaaaataaataaatttaattaaataaattttaaagctgggcacggtggctcatgctgtaatcccagcactttgggaggccgaggcgggtggatcacttgaggtcgggagttcaagaccagcctggccaacacggtgaaaccctgtatctactaaaaatacaaaaattagccgggtgtggtggcatgagcctgtaatctcagctacttgggcagctgaggcatgagaatcacttgaacccgggaggcagaggttgcagtgagctgagattgtgccactgtactccagctcgagtgacagagcgagactctgtctcaaaagaaaaaaaatgttaaaacttattttataacttaacccctaacttccccctcccagaaacctgctttctcccatgattgctgtgtttcttccaactcagatagtgacaactacattcctcaggatgaaaactttggcgtccttaatccaatctatctctctctttctcaccccacatataattgatcaggacatctgttgactctatttttaaaatatatacagaatctgacccctttccatcacctccattgctaccatgttggtccaaagcacaacaatttcctgacaggttttctggaatagcctctcaccacagcagtgaatgactcctttaaaatgaaagccacataatgtgtgtcacaactccactcaaaagccttcagtggctcctgatctcaatcagaattaatgtcaaagtccttataatgcgcttccaggtcctgccacgcagccctttgtgagctttccaagactctcgctaatcttccctttgctcgttctacttcagcctcacggacctccttgcttgttcctcctcaaatatgctcagtgtgttcccagcttagggcctttgtacttgcttatcctctgcctgaactgctctcctacagatacgcataggcatccttccctcacctcctgaagcctttgctcaaatgtcaccttcccagtaaggccttctttgactaccctatatgaaactgtaaacactctcctccagctctccttctccccgtcctctgctctgattgtctctatagtacttaccatcttatcgtatatttaatcacttattgtctccctcaggtagaatgttggcaggaattcttatcttcttctcaaggagaacctggcaccaagaacagtgcttggcactcaacaggtgtccaataaatatttgttaaaggaatgaatacatgaaaactttattcagaaaagctgtactttccgatatttatattgtcacctgacctattctgaaaatgacttttcctcctgccctttatggaaagactggtggaacctctgccaaaacttgccatgggcttttccatccaaattcttgtgcgtttcatacattagctttaagtcagacagaagcagaggaataaagctgaaaagtgaagggtaatttgaaaaagatgtagaaaacagaacatacaggcaaagacatgagccagaagaaaacatgatctcattagagttagagtcaagaaaatatcattcactccttatgaagtcacttggtagagacctattttcccatattatttctgatagcctctgatgcatgcaagtttatgttggtagcatacgtcatgtattagattcatggttggcacatggtctttcctttaggctcctaaattctgagacagaaagatgaattttgcatatactgtatgtgttcgtatatgcacatatgtaaataacgtacaaataaattgatcaactttagtgttttaaaaatccacaaacaaaaaattagcaacaaaaacagattcgtagacttgacttagttcctcaggccttgagtgaaagaaataattatgtgttatgtgtcatcctacctgagttggaatttgtacaggttcttaacagaggagggtagagaggttgggagagaagaggagaaagactgaaggataaagaaggatagaggctggtactgacaaggaaataaagacaaatgtttgcttggctttaacaaggcaagtgtttgggatatcacttaaaatgaagatttgaggagaaagaactactggatgatactaaggactatacataatctctatatttgtttgtgttaaaacattacatccttaatattttttttcaaaataaatatgtaagacataggagagagctaccctatatttaagtaaaacattttggcaatttaacaacttattctttcagcaagtcctgattgaaggctagctctgttcccagcactggagtgggcattaagtggaaacaaaagtaaaagtttctgttcttaaatagcttactttttttgtttgtttttggtttcctatatcatgtgtgcaataaacaactcaaggacagttctgaagcaatgcagggtgatttaagaaaaactgaacaccttcaaaagcgtatcatagtaactatgttatatataaacatattacttgtaaaggaactatctcagttattcccacgatcttataaatgctcaatatgtgttccttgtgtcccacagcagacatcaatcccatggtccactacagatcctttgtagcctagcaacatggatggcagagacagcagttacaatgtcatccttcatttcctcaaaaccagtggatacaaacatgagcttcttgacatactgcatgctcatatataataaatagttctgtgagtaataaatttttgaagctacccattcttttttaatcactttgtacaaaagcaaatgcttgaggctgtatctgtgtatataaatgccaaaataattctaggtgaaagagtagtacaagatgggattaggaggtggaggtaggtaagggggatttgtccacttagagaggcatctcaagttgagctacaagggaaggatctggattggcctctcagagaggaggagtattccaggctgagggatcaacgtgagtcaaagcaaaaggaacacctgtctgatggaggggaaggagactggcttgacgggagtcatggaggatcagtatagggactgctacagataaattgatattataggttgactgctagagggttgtcaatactcatctggaatttatagagtttcgtctgatggcacatagaataactgatgattggagagtagggaaatgatttgattaaaatgtttagaaagctcaatcaagttacagaatgccctggagtaagatgagtcagtccatctcatcaagatgaggataaattgtaaatcatggtggactgttgcattttgggtgagttgctgcaggactcacagttttacccaaccatctacctgattctaggtgatttcaatgtccctgaagatgaatcaccaacatctcagccttgaggtttggttgttcatctgtattccaacagctttcccctcaattccacttcagcaacctattgacatcgtgaccccgaaccatgtcacaaagcatggttcacaacattttccattgctcaaaccaaactgataaccccttctccaacatcaacctctgatccatctccctgtttcattctccctactcctatgacactgaagttggacctaaccaagtcttctagtcactgtacacctccctcttctaacttgagtccttgaaagggttccttcctttcctactcagtgtggatatgcagctactatcttactgcatcctcgaaccccttgttccttggctgttccagagaaaacctccaagtctggatcaatctgatctacctatttttagtaccataaaatattatgggccaggcatggtggctcacgcctgtaatcccagcactttgggaggctgagcccagtggattgcttgagcccaggagtttgagactagcctgggcaacatagtgaaaccccatctctatttaaaatatatatttaaaaattaattatggttaactgcttcagccatgtccccagtgccactgagaaatcttccttttctgttctgaagagaggcctttctcaatttttactatactccataccctttccatatattctccccttctttcacataaagaggtctcagctgattttgaaagggtggtccactcaagtggactttgaagtcttcggtccagaggttataactgtttagggtacacccagagttagcaatgaaataagaaaagaagacagagaagtgaacaaggaagtattagaagcagcaggaaaaaaacagttacaaaaagaccatggaggagaggatttctagaataaagcaatggtaactatgtcaatgtaacctgaaaaagtttgaggactatcaaaagactactggatttggtcaggaagtcatttatgacaacagtttctgtggaatggtaagaaattaggacgcaggagaataactgtggacacaagaggacaagaaaaatacaaaggcaaggagtccaggttatgtatccaaaacattagatatgaaaaagaaatcgttcaggaatcagaatagattacaggatcaaataaagacttattggtttttttcaagacagatttgatgacataatggagacagagccaatgcagaaatgttagaggaatgataaaagatgataaaaattgagtcaagctggctgaaaactatatgaaaacggacaatgtcacagacaaatcagagcaaaattttatcttcctgttttagttaaatctttgcctctgaagagatggtaactaactgtgtgactaagccctgcagggacttggcactgggactctcaacactcacatgcaagctagtcttactagatagaggagtggccttcctagagactagcattcatgatggtagatccactttagtcgtcatctaagttaggctttctgcagtagccaggaagcttcccctgactccatttaaattagtgcctctcaccacatacttccattacatctttaattctctcatgagctttagtaagttgtttattctccactggactgtaaaccctgggagggcagggactgtacctgctctgttttagctccaacacccaacacagtgggctagtacttagtaggcactcaaataccagctgaataaataaatgcttaaaaattattacatctggcctaggatctattatatctatctgggatctggtgctcatgatgcatgtcaatttagatgagtaatcactcttcaaaatactgtcagaatggtcttttcccgggaaaatgctgcatgattttgaaacatgtggtacacgatgaattgaatatggcaagttgctaaactgacacgcagaagcacacacctgaaatgatttaatggcactttcaaattaaatggtactcagactcaaaaatacatatctcaggcctggaagagatgtcagaggttatctaacacaatctccccttcactgaatcctcaaacatattgttcattagcctaacattaagtgaccagttagagtccattaaaatagcttcagtggtagaaaacacatctctataagaacacccagtccacttttggatggactagtcattagaaaattcttatttgtgatgcacacgtagttttcacccattagtccctaggtcattgtaactacagtgcagtctttccaacatctgaggaaggccaccatatcctctcccaaggcttcttttcacaactcctttaatcctcttcatgtgatactcatggcatttgaaacgaagtctacacacctgttttcttgtcattcctacttaaatggtatcatgagaggcaacagaattatgaaaaaaaatactaaaaagtataaaattaaggcaacttacatagtcacacgggaataaaaatagcagagtatgtgcaaagtggagatctattcatatttcttttccatctgattatgcttgactcttaatactctttttattctaaatttgaaatatccttacctttatccagtgttccacactgtcaggaccaaaagtaggctgtagataacatatatatgatatcaatacgcagcaatatctttatcaactttgccatttaaatctatccttctgactaaagcatatggaacagtgtcctttattatttccccaaagcatttcattagaaagttcagcatgattagcaataaaagacacagaatagcagtatgaggagaaaacatgaagccttcctgggacactgattgtttttatttcttgtctaggtccaccttgatattgtgatttaattggtctgggataggaccctggcactgctatttttttaaacctccttagggttaagagtcaagatatagaaatgctaaatataaagctactcattaaaaaaaaaaagcactgattaattagccagattatccaagtaatctttagcttaaagaagggtgtgttcctctccttactcctttcataagtagcctgtagcaagaggctttctcatcttacccagatcagggatcttgtttggcccaataaaaactgaaggttaaaaaatctgacttctactgttttacaaagcagaaaatataaatttccacccagatcagtcaggtattaatctgaaattagaagtaaaaccatcagggcatttcctttcttcactctctgtaactcctagaagcttggagaattccctctaatagtcacttaacaaatagagttatcttctttgccaaaaatgcaggtgtgttttggccgggagcagtggctcatgcctgtaatcccagcactttgggaggccaaggcgggcagatcacaaggtcaagagatcaagaccatcctggctaatacggtgaaaccccgtctctactaaaaaaaaaatacaaaaaattaaccaggcgtggtggcgggtgcctgtagtcccagctactcaggaggctgaggcaggagaatggcgtgaacccgagaggcggagcttgcagtgagccgagattgcaccactgcgctccagcctgggcgacagagcgagactctgtctcaaaaacaaacaaacaaacaaacaacaacaacaacaaaaactggggaatggggcgagggttaatcaatctgacttttactgttttacaaagcagaaaatataaatttccacccagatcagtcaggtattaatctgaaattagaagtaaaactatcaggacatttcctttcttcaacctctgaaactcccagaagcttgcagaattccctctaatagtcacttaacaaatagagttatcttcttcactaaaaattcaggtgtgtttttaaaataaggggatatcctgatgatttgtcattggagcactaaatctcttttggtttggcgttcccagttcatgaattgcttcttactcaaatatactctttaaaataataataataataataataataaaataaggggatatctaaactagcatactgacacatggaggtgggaaaaatataatactctttcacttacctaacactttaccttcaaagcatcttactgataactaacgcagctgtactgcttaataattttgtcactgcaacaaagaaagagctgatctaattaaaatacaactgaacttgaagaagccctatgtttttacctttttttctctaggcagtaataatgagcactagcagcaaaaatccttccttttggagtcctaagaaattattctaaatttttacctttcatcatcaagtccatatctatatcctatcttggatccaatacattatgcaactgatgtattgaaatagcagcagcctcagtttccaagtctccctgatgcttcagtctgtgccctctagtatctagggcaacatatttgtcatgtggaatatgtccaatgcatttagctggtaaatttagaataaatcgcaagaacaatcgcctggggccctcaaaaaggccacatacatctacagaatattatttaggaaagtataacttaagggtgaaaacagctggtgaaactgctctgtagctgaaagctgagaagcttctccattttagtactctcatttagattttaagcatctttttggggactgttaaaaaggtagtctgtggaaagcacacggtgcaactgtgactttgcacatgtcacatatgtttcaagtttaaaatggggttattatttttttcttatcttcaggtgctaatgcatccaaatgggtgatagatacggagagaatctattttttgaaagttggttgaatttagaaattactatgtgaatcaagtattaatgtattcaatatccatttgcactcctgagtttatttagatactttacgtaaaagtgaaggggcaggaatataggcagggtatttaatgtgaagctctctcccgttaataaagatcaattaccccaagatttgcaaaaaaaaaaaaagagagagaaaaagaaagaaatgtgcgagaagtttcctaaaatttaaggtagggggaacggagtttgcaaactcctttcaccccgatgggcattagcagacacctccggttttagaaaagcgttacaaacagttcttccacgatgctgcccaccaaagccgtaatgtgcccagaccccagagctcctagagcatttcactcagggtaatgctggctttggggcggtcaaggcaggggcgtgtcagctcaggatgaagaggcaggaagcacagacgggccgcgactggcttcctgactgcgccgcgccttgggaaagtccccgccctccaaagctctcgattgggatcaccttgggactcggcttccttgtgaaccgtttccagcgattcagccccatccttttctttgagaaggaccttccctgaggcgccaggagcattttccaagttcgagcccgaacctcggccaaagctgcagcaaccgcccttctgcccgggctgcctccgggtcacgctgggaattgtagttcctccgcccgcaaggaaagcaggcataggacaccgtcgaaccaccactcccacgaggctctgcgcaggccgctcgcgttggctcagttaccatagcaacggcagaggtccctcgctcttgccgtcatcaaggctcgcttgaatgtcggctttgctttttttctggcgcccagtgatgacgcagtactccctgattggctctgcactggaggcagtgattttggggcagagaattttgcaacacgtggtagtgaactgtgaggagtttgaggggtctgaagactgaaagagtcgaatggtttgttggcaggtaagtgcccctttgccctgctggtgtgggagctgctagagatggatgagtcacgtcgcgtccagacgcttcctggttgtgttgcagtaacggtgattgtactcccgccatgtctcctctgcttcccttttcagggtgtcctggtggattggtttctgtaagttcagattctcataaatcgtgtgagcgtcgccgacacctctgagataaaagggcccctttcgactagcctctgctgaaaggtagagttttcaggaagtttttattccgaactgcccatgggagggtgggaccgtcttcaatctctgagccaggtgcctagggaggtctggggccatggagatggcccatggagcaaagataaatccaggcttattggcttagccgaggtgtttccagagacagcccatttaggggtgataaatgggcttataaagcagagtaaagatttagaacaggagttttgaattcaactactttgtggctatatgaccctaggcaacttgtttaataactcagagaccctgttttctcatgcaaaatggggacgataatacctgaatcactggagtgttgtaatgattaaaaataaatgtatgtgaagcattctgccaggaaatgtaaactaaagttgatttgaaattggtgaaaatgaagttagggaagctatgccctcggactgttgcagcgatcctaggaccagctctgtaactggtctgtctgaaaggcggttgaataaattgtgctcatacaaactatgcagtaccacgaagtagtttttttcaaaagggtaagttagctttatgtctcttcttcaggaaagacgtctaatgtttattcttgagagaaaagcaaattgcagagaagtgcatatattatagtataatatgtttccatttttgtaaaagcaaaccctgaccaaaacactccctcccatatgcaagtatgtttaaatatttgtatgagaatggagaaagattgcagagactgggaggatggattagaggcgggagggagaaagggaaaagaagaagaacactatagcaaaatggaaactaagattataatgtgcttgtgtaccagatggaacttctaataagctcccagcctattagagtacagcgctgaaaactagacttcaataattaaagtccttgctctgccacttaccagctggggattttatcagcctcagtttatcatacataaaatgcagataataatggtatctatattatgcatttgatctgaggattaatggagtgaatatataaagaacagtgcttaatacatagtaaatacccgataaatgttagttgctattattgtctttctatatgtgaaattaatttaacttttattgtgattactgacatttggaattctaccatcttattttgtgttttctatttcttttttttggtctcttttcctttcttgccttttattaggttaattcatttttctttatcttcccacttccctctccagtgagtttggaaattatgcattctgtcattaatcgtttaacagttacttctgaatttttaacacacatactcaacaaagtttaacgtcgtcgttatctctttccccctaccaaatggtgtaacgatttccgaatgccttggaaaaatcttcatttactgttttctagaattgtagcgttcttcatttcttttttttgagacggcatcttgctttgttacccaggctggactgcagtggcatgattttggctcactgcaacctctgcctcctgggttcaagtgattctcctgtctcagcctccggagtagctggtattacaggcatgtgctgctacacctggctgatttttgtgtttttagtagagacggtttcaccatgttggcctggctggtctcgaactcctgaccttaggtgttcctcccacttcggactcccagagtgctgggattacaggcgtgagccaccgtgcccggccagcgttcttcatttctgtgtgtcatttctgagtcagctcaatgcaccacattgtttaaaagtccttcagtcatttttctatgcatatactatgattatagaaagtgtacatgtgtgggagagaggggtaagagatgctgatgtgtacttatatatacagctttcctttcacaaaaaatatgaccatcttttgccttaggaaattttggacatttccatggcagtatgtagagaatccagctaggaaacatttaaaaatccattctctcctgataaatgaagagtggaggtggtgggtcgcactggaagtgttaggacaggtacggtgttgccagaagtgcagggaatctttgttagtccttgtaaaggtacagatccactgacagcctgtcatttgtctttacactcttaagggtttttccttaagactttctcaggaatgccatctgtgacaccagaaatattagagcagacccacaacaagtgaaaagggaagggatcatgataaaggcaaataaaaactagttagtattttggagactgttgatctgtttcttgaactttccttggcaaaaaaggaaataatcactctcaaagcatgtttttaaaaatatgtacatgaatatgtgtatgtgtgtgtactattttattacttcatagtaacaatttattgtatttgagcctctagaaaagaagtgtaattataaaaaacatttaccataacctgaacaatgaatgaagaaaggaagacttggttcttctagctctggacaaaattccatttttttaaaaaaaatattgatttccagctgaagtatagtacatctctgatgttttcctcagattttaaaatatttgcattcatccccacaaaacagaatcactgaccatggcagtttattttaatactttttcttaaacccagtcatctgcttttgcttccttatttttctcttcgttaatatgttgagttactgtgattagggtggaacttttatgaagccccaaacaacagaagtgagtatgtagcaccaaaatcgttcactgtagagaaagccaagtaggtatttctctccagctggctgagtgggttcagtattctaagctgaggattttgaatttcatctttaaagttatttgggattaaagcattatatcacaggagagcccatctctgcctctaagaacatggtggccaatgtcctttagagttacaaaggacctctaattacagactttcagttaagaatcaagaaagttgtttcttcagttgaggaaagagtgggaaggggagatgagagggaaggggagatgagaaagaagagagaagatgccttcaggactgagtggatgattaatcacacttgagactcgtttgttaaaagatgggaacttctagaatatgttcattctttccttacacaaggatgaaactaagaagtctttgagagaaaggtaagtcttggaagccaatggtctgggcttccaggtctggctgcctttatactcttagagaatccttgtgtccaaccttggagaatctgagattggttgtttggtcatcttcgcttatctgtggggaatatgttccaagaccccttgtggatgctggaaactgcaaatggttccaaaccccagatagataggtaggtaggtaggtaggtaggtagatagatagatagatagatagatagatagatagatagatagatagataagatagattagatagatagattagatagatccaaaccctaaatagatagacagacaatagacagacagtatgatgtttcctatctatacatacctataataaagtttaatttattaattaggcacagtagtagatgttagtcacctcggcaaacagtcttttttcttttcctagttggagaactttaaccttttctcataagggatcactttatggcttccctttggcatatccgtattgccagcatcacaactcttgtgctgtggggccagtcgtaagtaaaataagggtaacttgaacataagcactgcaatacagtgacggttgatctgatcaatgtgacagctcctaagtaactaaggggcgagtggcgtctacagtgtgaagatgctgggcaaagggatgattcacgtcctgggtggaacagagcaaaatggtgagagatttcattatgctactcagaatggcatgcaatttcaaacttatgtttatttcaggaattttccgtttaatatgtttggacctcggatgtccatgggtaactgaaactggaaagcagaactgtgaatgggggtactgtgttaagaaaaccgatgggtttccttttagttgcctttatgtaccttcttcttcccattctgattctatgcttgcatggcatatttggcttcatgtattgcattctatagggcaaacatgccactgactgatccactttgcttttttcgattctcagagtaaataattgtgcatactgattttattgtttagtctctgaggttgataggtttgagcctgaccctgagtgatggctctgtgctgggtatatagaaaagatcaggctcagcttaccaggcagaagcctaaatcccttaccagtggccagccagccctccaagcagtacaagactgtaaggcactggagggagcagcagcaggtggctaatctttgagcccctgtgtaattctgttggcacaggttaaagaacttgacagctgctttcttttatctcttttctttctctttcttttcttcttctttgtttttaagacaggatctccctctgttgcccaggctggagtgccagtggcgtgatcatggctcactgcagtctctgcctccctggcttaagggatcttcctacctcagattcccaagtagctaggactacaggtgcatgccaccattcctggctagtttttgtattttttgtagagacagggtttcattgtgttgcccaggctgctcttgaactcctgggctcaagcgatctgcccaccttggcctcccaaactgctggaattacaggcgtgagccaatgtgcccaaccaaagccactttctttttatgactttccacagtgtgttctaggggaaaaaaacaaaaagatgtttcatagatttcacatatacttttgaaaaatcttgttattttcagtggccatggtatgctgcaggatattctaaaaaaaaaaaaaaaaaaatctgaatgcatctcctagcatgttaaatttactctcacataaaagccataattggatgggtgcagtggctcacgcctgtaatcccaacactttgggaggtcaaggcaggaggatcacttgagcgcaggagtttgagaccagcctgggcaacgtagtgagactccatctctccaaaaaaagttttttaattagttaggtgcagtggttgggcacctgtggtctcagctacttaggaggctgaggtgggaaggttacttgagcctgggatgtcaaggctacagtaagccgtgattacaccactgcactccagcctgggcaatagagtgagaccttgtctcaaaaaaaaaaaaaaaaaaaaaaagaataaaaagaatacaggccttttgcaggaggcccaggttctagacaagcctatgactaagcaggcctagtctcagactgattacaataaaatggcagaaggggtgatgtggtgatgaggaattcccaggtaggggtctctggtagtaatggaactctataaactattttcagtatttctaaagtctaatggtaattatacaatactgggatattaagcacagttttactaaagcaatggggtttgttgtttttacctggaattcagttaacacaacatggaaaagcagattatctcatgcttgtcagaagctttggttgtcagtcatttgtgtcatttattaataaactggagaaacgagagcataaatttgatgaggagagataataaaagtaacattctagaatcctatacttcatttttcaaacgtattagttttacccaatgaaggttcttcgtgcctttatatgaatttaatttaaaaaacactgttcatgtgtgtacatttaaactctttacatactttacacagctcagatgagagagtatttttggagtaagatagaatttttggaggagccagcaagttcttgtctctagccctttctgaaatagcttcgggcaacacagtttcttccgttctcagacgtatgtgatagtaggaaatgcgtaagttactgcagcatttaaaaattctggtccgtttaattttcattagttcttatttgtgtttcaagaaatctagtgttccatattggttgatttcaatattcagtcagaacaacaggtattgattcatgaagctttgaagtacatttctcatctttgtgcttccccctgcttcaattctccagagctacttagattacaaaagtctgtcttaaatttcacattagaactctgttggtttaaaatataaaatacatttttatcacttgaaatcagtattatctgataaataaataaagattacaattcttttatattttctacagtatgcttttattagcttataagtatagttttacagttttcttaaatgaaccttcttgttttagcagttttaatgtgtaacaatagggtatgtaaaaaaatagcttttatactatttattaaaatataacctttttttccttaccagtctccatttatgtgggttctaatgacacttatttgtatgtttctatcttagtgataacttgaaataatgatctcatagttatagaaaattgaccaggctttcatcaaacacttatattagtttttataatttgtgtttagcataaaatctcttcttagaccatatagaaagtagttattctttttttttaagaaagtagttattcttatgtctaagattctaatgacaaagatggctattttatttaaatttaagaatttatgtctcctaaaaaaaagtaatgtttttattcttgaatatatttaactaatgatagatatgtcttatttatttggtgacattttaacaatggttgactttcagagtatggtatgctataatgcttaagaaaatgggatctggccgggcacagtggctcatgcttgttacctcagcactttgggaggctgaggtgggcggatcacctgaggtcaggagttcgagaccagcctggccaacatggtgaaaccccatttctactacaaatacaaaagtcatctgggcatggcggcacacacctgtaatctcaactacttgggaggctgaggcaggagaatctcttgaacccgagaagcagaggttacagtgagctgagatcgcttcactgcactccagcctgggtgacagagcgagattctgtgtccaaaaaaaaatgaaagagagaaaagaaaagaaaattggatcctctctgatagctcatttgtcaactaataaaactgggcctggcccagtttttaagaattccagaagatatggtacttgctgtagagatgtaatgaagtatttgtaaaatgttggtatgtctggtgacatttagccgatgatgtgtgtgcttatcaagttctgtagtgcattttaaaagtggaacccagtattttgcttcactgaatactaaatcatttaggagcacccaacaagtaattgataatgttttctgattttttttccctgtatatctatagaagttagaaagtgtatctttatttttttctttaaacacatattagtctttcccagttataaaagtaatgacactttgcttatggattgcgtgtatgctccacacagtttctcacttctgtttggataccatataagaacaaattgggaaataatccgacctcagagatctgtttatgttttgacatttatttttccatatattttcataaacaccaggatgctcttttcttcacttaacagcattattaggaaaaaattgctatattgcttagccttccctcaaattggagaaagaaaaaagtggattatatcaataatcagtatggcctaagcagtgttactgttctctgtatacattttcaaggctgagagagccttggcttcatggcattctttccatgattagtctttctaattctgttctttcatttgtttggttttcatcagctcagacaaaaattccatgactaaatttaaaattagttgatgccaatatgtggttctgggaccttagggaagatgtcttattctctttatgtcttttcccattcccccgttcctgatatctatgaaaatatttagactggaagcagtaataagcatgctatcattcattttcctgaagattttttttttttgcaaaatgcttggcctctaggtgttgtgaagctccttctatacttaatgctcttttcttgacaggacctagaagaatcccttaggatgaagctgagtcttaccaaggtagttaatggctgtcgcctaggaaaaataaaaaacctgggcaaaacaggggaccacaccatggatattccaggctgccttctgtataccaagactggctccgccccacacctcacccatcacacgctgcataatatccacggggttcctgccatggctcagcttacgctgtcatccctgtaagtgttagaaccaatgattcaagtatcaactgtggcagcagcttagttaccttaggtgcaaaaaagagaaatatttttttttgttcatatatataaattgtcgattttcataatgaaatcagaagagaggtttcaaatattatacatcttctggccctaatctggaagccacaggccagacctatatgttagatctgcttcacttttcctccaaacctacagtcccatactgccatgtcgccactgctcccaggggtgacagggcggggaatgttctgtgagagctgcatttggagttcaggagctgttatcatgcaccagcctcaaagttttttctgcctttgcacatatacttgctaatactactttatggaaacagaactaaagttagatcattttgtgtaatgtatatactgactttatacttaattgaaaagcctactatatgaccaattaacataatagtctgcagcgttgtgttaacaacagagattttaaaggggcaagagaaggaagaaaattcaagtattctgaaggagttgatctttgccagtttcatgtctcacagaaccactagcaagttgaaggccttcgttctggctaatgaacctagcctaattagttagaactcttgaataatggtgtaattcaagacagcatttaccatgatgtaacttatttgggtgaggagaagagggctccagttgtacagagtatttacagaatgacacattattatgttatgtatttttctgttttgcttacagagcagaacatcatgaagtcttgacagaatataaagaaggagttggaaagtttataggtaaaaattaagttacttatatgtgccttgtgatgtgttaatttggagtttggaggtgctgttacctctttgatctttcattcatatgtttgtttattcataaatttaataagtattatttgaacatctaagagccaggcattggcaagtcaagattgaataggaaacagttgctgctctcatggaatttggagcctagctgggataaagatagagaattctagtaaaaattgtggttactgctttacaggattagggatatgtatggatatcatgacaggccagagggcagagcatataacctgctctagggtatatgtgcaaggtggtcagaataaaaaacggattcttttttttgtttacgcctccataaaaacccagagaaaggattcttgagagagaagttgaggggcattttagctgggtcaaggaagagtaaaagttacccaggttaggagtgggagcccagacaggtgtggggcagatgctgcaggcactgagtatctgactcagcggtgagaacttgcatggggcattcgtgagctccaaagtagtctcatcatgcttgaacctcaaacatgcaggggaggatgaagcgtttgtatatggctgtattctgatatgttaatattatcctttattccagaaataggattttatatgcagatgtatgcatctatttatttataggaaaagcttagcagtgacagctagaacatcagttcttctatacaccgctttctcctaacgctttttctggtatctaggactcacttgaatgaaaatcctgtttccattggttattcagtcttctgcttctgagagcagctgcatgatgtcctgttggttatcacaaagccctgtattttagtagaggaatttatggaatatcattctccttgacctgagcccaattttaataaccagctttaaagtatacaagcatataattaaatgaaaatagctaatgtaggctttctagagataattgtaataattgaaattatggaaaataaagtgaaaaaactgcagaggttttacacttgcttttttttcactggaatcctgttttattttccttaacgaaaatgtgggctagcatatgatatttaggcacatggtttactaaactttttttgcattttttaaaaaatgattgtctttttgactgaagaacttaagaaactgtcatcgtgaatcaatgaaacttactaagaatgggatccatttgcagcatcctatagcttctctaaaattctgcccctagggacccatgatattattgagatttattattagtgagatcactttgtgggcatatcattttatctttgcggtagctagttccccttggatggtacctggaataagcatatttgatagtaaattctttaagtaaagtcaaatgagatcaacatgtcactaaatactttcattgtatattgtgctttaagatacatctttcctttgtagcagctcagtacctatttattagacgtgaagctttatatttctttctttagattagtaatctttttatacatattgataggccttctctaattccaagttcagatacaacctattgacagtgtttagagttgctttattcagcagtacacattgcgaagctgctccctgctataatacagtgtcattgttgatgtaagcactttcaagggttcttttttgtgtttatacaggcatgccagaatcactcttgtactgctccctgcacgatccagtcagcccctgcccggctggttatgtaacaaacaaggtgtgttttcagaagggtctccaaggctgcagctttgtcccaggaagtcagcctatggtgtatccctcagatgctcagatcccactgtctgggatgatcccttataccttttccttatttcgataattatagtgggatgggatggtttataagacttagagtagggctgcctaaggatgaggttaagatgaagaacactgtatcctcagcattttcattgttgcaaaaaaatttgagggtagaggagggtcaaatacatgccaaaaaaagaaattgctatgataggggaaaacgatagtctttcggcgccatgctttgttggatttttaacaacttcaggaagagtggggaaagttgctgatgagtattatcacatgtataactatatatagtagaatctcaatataatattgtctgctgggtctacagccagagattttgtctagtgaagaacagtatcaaaagcacctcattaaaagtgttaggctgagaggtggccccattggcattatccctgaggacagcattctggcaaagcttcagtgtgtactgctactttacaaacgcaaatacttttcctgcactcactttattaatgtcagcaatatttattaattgtgcccctcagaacactgtttttactcattctcctgttttaagtttctatttattttgtagtttgaattctagagaaaatactttggctgggtatggtggctcatgcatgtaatcccagcactttggtaggccaaggtgggtagatggcttgagcctcaggagttcgagatcagcctgtccaacatggcaaaaccccatctctactacagatacaaaaattagccaggtgtggtggcacacgcctataatcccagctacttgggaggtggaggcaagagaatcacttgaacctgggaggcagaggtggcagtgagccaaagtcgcaccagtgcattgcattctagcctgggtgatagagcgagactctgtctcaaaaaaaaaaaaaaatactttgacttccattttctacccaaattgtaagggagagaggaatcatttaaccagtaattctgatgccttagtataaaataaaacgactatatgttggcctgccatctatgtccttgttgatctgagaagagggatctgtagggtaaccaaagatagaatttttttttccctttttttaacttttatttttgtttcgggggtacgtgtaaacattgttacataggtaaatttgtgtcatgggggtttgttgtacagattatttcatcactgaggtattaagcctagtacccaatagttaccttttatccttctctccctcctttcacccttcactcacaagtagaccccagtgtctgttgttcccttctttgtgtccatgtgttctcatcatttagcccccacttataagtgagaacatgtggtatttgattttctgttcctgcatttgtttgctagggacaatggcctccagttccatctatgttcctgcaaaagacgtgacctcattcttttttatggctgtataatatcccatggtatatatgtaccacattttctttatccaatctatcattgatggacatttaggttgattgcatgtctttgctattgtgaatagtgctgcaatgtacatttgcatgcatgtgtccttatggcggaatgatttatattgctctgggtatatgcccagtaacgggattgctgggttgaatggtagttttgcttttagctcaaagatagaatattactaatatatactctcttgaactaggagatttaagtctttaattctatatctaactcagtctagtaaacactagatattaaaaatgtatagggccctagactgtgcttttgggatacatacatgaattgggatactctagtcagacaaataaagaatggtgtaataagtgctatcatttctataaagaaataaatacaaattgatgtaagagcatagaggagtgagtgatcgattatgtccaggaggtttggagatcagattaatatgtgaactcagtgtctcaatggacacgtagtattttgccaggcaaagaagtagaagttccagcacctagaaataataaatacttgaggtgatggatacttaaatactctgacatgattattacacttgccctatatgtaagatgtctcacatgtaccccataacattatacaaatatgtatcaataaaaaaaagaaaaagaaatacggaactgtcagtcaaaaggaacagtgtgatcaaagtctgtggtatattcaggaacagcaagggttaggtaggggtggggcaggtgggataggggagagcagaagatgttagaaaagtataacaaagaattcttggtgggtagctcaaaagttgtcttatatgaccactgaaggattatctgtaagctataagatcctattacccaccatgtctggatattgaattgtcaccatctctgcagttgtaaagaagaattattgctttatcattttaattattttatttttatttgcattttactcttgctaattcctcatcattttgctccatggcagtctgtgtctgtgtggagtgttgcaggacgagtggaaatgactgtttccaagttcatggcaattcagaaggcccttcagccagactggttccagtgcctctccgatggagaagtatcttgtaaggaagcaacttccataaaaagggtcagaaagtctgttgaccgatcacttcttttcttggataactgtctgcggctgcaggaagagtcagaggtaaggctgtgccactaaccactcctttctcttgacactcttgcctcccttacattctgtgataccaccttttctgttcttcctcctactgctgtgctcctcacttctttgtctattttactctctatttttattttctttttgaaccttaagtattattgttctctaggtttctatcttaggtttctcttttcatccctttctatatgttgtccctgggcagccttcccttagttttaattgctgaataattcttaaattgtatatactatcaagattattctacttagcttcagaattatgtaattactgggctataggtaggttatgtcactagaatatccctcaaactcagaagtgaccggattcatcattttatctccacaaacctgttcttgcttttgctcttcctcaatactttatctccatttatggcatccaccaagctcctcagcccagaaatttgagcttttctttttcttttttgagtctcactcttgcccaggctggagtgcagtggtgctatctcagctcgctgtaacctctgcctcccaggttcaagggattctgcagcctcagcctcccgtatagctgatattacaggcatgcaccatcacacccggctaatttttgtatttttagtagagaccgggtttcaccatgttagccaggctggtcttgaacttttgaccttagatgatctgcccgcctctgcctcccaaagtgctgggattacaggcttgagccactgtgcctggctaagaaatttgagcttttcaagactcctttttttcattcacatttaatatcccactgttcactcttccttgattccatttgcctaaatatgtctagaatcttcccctccttattgccaccttaagccgtaactgcatcatctcttacgtatgtaattacctttgaattcttctctctgcctccattctcatttttatccaatccatctttcagccctgttatccaaaagatctttgtaaagcacaaacaagagctccttgcccacttccctaaaagaatttaatgactctccacttcaactcttacatggcatggacagcctgctgtgatgtggcctctacctactcctccagctcactgtgggctactttttcctgtgacttgcactctgacctttctgagttgcttggaattccttgaggcattagcttgtttcattctgtacacggatttccttctggactgtttcttgtttctgcttttcttatctctagctatattccctcttttgtttccacatgaggctcatttcattccatgtatcattcattttttttttcttttcttttgagacagtctcactctattgctcagcctatcaggctagagtgcagtggggcagtcttggctcactgcaacctccaactccaggttcaagcaattctcctgcctcagcctccaagtagctgggattacaggcatgcgccaccgtgcctggctaatttttgtatttttagctgagacgaggtttcacgatgttggtcagactggtcttgaactcctgatctcaggtgatccacccaccttggcctcccgaagtgccatgtgtcattctgtagaactggttcctgatagttccagggaattcaattcattctttgctacccctttaattagtatgtagctatattttagccccaatcatattgtatttcaatgatttctttatgcatttgtcttcattaaactgtggcctctttaagctcaatttctgtgtataagttgggtatcttcatcatgcagcagaatgccttccctgtcttattcactggttcctcttattctgaatgcccttcaatattgaagctctccaagattcggttgttggctttcttttcttctccatatattacctgggttagggatggcgaatgggtttcatctgacatattgtaagccctcagtaaatgtttgctgatggtgaatggttatgatggggtgaagatgaagctgtagtggtaaatcagggatactgatagcagagttaattaagtgggaaaaggattcagagaacagtagagatgagggaacagaagatagtgatcagaggagagaattttaatatttgagatcatgtatgtggagtaatcctgagcgatgatcacatcccactatggcaagcgcattgagtttgaggaacatcattatattgaatttagcaataaaaatataatttggctaataaagttaatataaatgaaataattagaggaaacatagttattctgaatagaattcacagtatatgtaacaagagtttggtgtggggacattgctgtgtgtctgggcagttagtgttggtggcttgctagtaattgttttgagccagtcattatccttgtaggactagtaatgtttgggtaagtagaaagcaggacagcgagtgtgacaaagatgattattagaaaggtcagatgagcctcaagtccctcatctgtgttgttgcagtcagcctcatcatttcatattacttctgcatatttgtgggggtttttttgttttgttttgtttgtttttttgagatggagttttgttcttgtcgcccaggctggagtgcagcggtgcgatctcagctcactgcaacctctgcctcccaggttcaagcgattctcctgtgtcagcttcctcagtagctaagactacaggcacacgccaccacacccggctaatttctgtattttttggtagagatggggtttcactgtgttggccaggctggtcttgaacccctgaccttttcattcgcctgcctcagcctccccgaatgctgggattatagatgtgagtcaccgcgcccggccttacttatgcatatttattggtcaaacgtgtagtccctctccataccctttattattgtcttgacatgattattaatagtgcccccccattcttccattttagataataaattatatgatcgtgcttcttacacccaggaaagggagtttcccgaatagtcatgctagtcgtataagcaggcaggcctatgtaactctctgctttgtgtttctgcatacatcttttcccatgattccctccctgtcttattgactggctcctcttattctgaatgcccttcaatattgaagctctccaagattcggtttttggctttcttttcttctccatatattacctgggttagggatggcgaatggtttcaaccgaggtggtcgggtgcagcaagaagagagtcatctgttagtcacatctgctgtggaatcaggagtagagagtggtagcatcatgccaagtgtctgccattctagcctgggcaatcatgtttgtatcacacatagccttatctttaggttcatttaggttcagtggctgaattaagattgccatttggacatcctgctgattcctcaaattcagaacacacagaacagagtaatcatcttgcttcatccactgtttttctaggagtccctgccttttgctcttatcaccatctacctgtacttgcaaaacaggagccaggagtcatttgagactttgtctttatcctctccttggacaactaatcagtcaagttatgttgatcctacttcctgataggtttcaagttttatctttcctcttcatccacactgccactgccttagtccggatcatctcatctttcacctggatcattaaagttgtctgctattccattctttaatcgtactcacccttaatttatttttcacacggcagccaaagtgttctttctagaggaatagtctgattatgtccctcctgcttaaactaaagagtgagattctctcttcacagtgttccaggcctcctctccatccctttcttctactggagagccattgttgatttgtgtattttcttgcaaaacttattttttgcaattacatacacataattaatacatagatatacatggctgtattacatcagtatgatcatatattcagcaatttgcttgtttttcatttagcaatatcctgaaactctttctctataaatgcatatattgctattatctactgcattctttttaaacagctgcgtaggaagccatactgtgtatatattatgatctacgtaagcctttactctatggataaacatttaggttgtttccagtttttcattattctaaacatctttgtaaataaaccttggcacatgtgaatgagtataggagagattgttagaagtggaattttaggatccatagataaaagctggacatttcaataagtgctgtccactttccttcctaagacgttgaaatgatttttactctgtgtttatcaggttatgtacgtaccatttcccttacagtttcacctctactatgttgttatctatgttttaacctttttgttattatatgggcaaaaatggtatctcgttgtttccaattttgcattaccttactaacaaggtttagtagttcttcatacgtgtatagggcattcacatttatttgtttgaatttcatatttacgtattgtacctagatttctatgaggttgtcattcatttctttagagtattggttggagctcattttatgctgtagatatttaaatattcctccaaagagtaagttctcctttgcctttgttaatggtatactttagtagagaagttttactgattttttttttttttttttttttgagacagacccttgccctgtcatctaggctggagtgcagtggcgcaatctccactcagcgcagcctcctcctcctcggctcaagcgattctcccacctcagcctcccgagtaactgggactacaggtgcatgctgccacacccggctgatttttgtatttttagtagagatggggtttcacagtgttggccaggctggtcttgaactcctgacctcaagtgatccacctgcctcggcctcctgctgggattacagacatgagccaccatgcctggcaagtttttgtactcaaacttgtcaaccttttcctgtaagctttagcttgtttaggaaggcattccttaccccaagattgtaaaaatactcaatatattcttctaaaacttgtataaccatattttttatgtttagctattaggtccattgaatttgtttttaaaatggatggtgtgtagtagtggtctttattttattggtttgtgagtagatagtcagttgtctcaacagtttctaagttcctaaagttatctctagctaagagacttggaggtagtctaaagcaggcctggatagtcatttcacaaattaaaactcttattttgtccttttcctcttgaacctgtttagtgtacattttatttatttacttatttttcttgaaacatggtctcactctcttaccctggatggaatgcagtggcacagtttcagcttactgcaaccttcgcctcccgggctcaagccaccctcccacctcagcctcccgaatagatgggactacaggcacaagccaccgtgcccagctaattttgtttttttattttttgtagagaccaggtgtcgctatgttgcccaggctggtcttgaaatcctgggctcaagtgatcctcctgcctcggcttcccaaagtgctgggattacaggcctgagccaccacacctgatctaatttaatctaagccagaacaagactgcatatgttgaatgcatctttttcctcagtcttttcttacctgattggtaaagtatgtttttcaaagtatgttcctcagagccttaaaggttcttagggaggagggagcaccatcccctttaatgcttcaactacagcagcttcactgaggtctcttctatacattggacttccatgtaaggttcatttaaacaaaggtctcatactgaaaatggttaaaaacatatcatccttcttacctcaggttcttcagaagagtgtgatcattggagtgattgaaggtggagatgtgatggaagagaggctgaggtcagcacgagagacagccaagcggcctgtgggtggcttccttctggatggttttcaaggaaatccaacaaccctggaggctagactacgcttgctgtcatcagtcactgcagagctgccggaggacaagccaaggccagtgttcggttaggacacaggctggcctcaagggatgcagggaaggagtgctggccgattgtatattaaatagtgtctgtgcataggcatgcctttgatgttttgtttatgtcctttctgggctgagtctgctgaggtgctgaggcagactgtaaggggagtttccatcaaggctgtcctggccttgatttcagaatgtagagtagaggataattgccatttgaattatgttatttgatcctcctaagtgagagcaagtattatactgtttcccctcattcttgtgccaattacaaatattgttgttataatatggtacctggagaccaagtgtaaagtcacatggaatgctggtttaaattgaggaaagttgaggacagatctgggatgactagtgagaagatgagctccaccaacaagaacttaagaagctcttagatttgaggctggtagtgagtggtgtcaatttttgaaattgaggggactgacaacactagtaggattggttcttatgtttccataaattgcaggattcaccttgtgctgataagaaaagacgatctgcaagatttgaagctacaaattctgagtttctgaatgcagctgatatcgtattaggctacccacattttttttaatggtttgttatcttaatgtgaatattcatgcttttttcctgcatgtatattaagaagtttggttgtggggtgctgctccatagtctctagagctgttggatagtatataatatgtgtaattttactactttttttttttttttttttgagacggagttttgctcttgttgcccaggctggagttcaatggcatgatcttggctcactgcaacctccacctcccgggttcaagtgattctcctgcctcagcctcctgagtagctgggattacaggcatgcgccaccatgcctggctagttttgtatttttagtggagacggggtttctccttgttggtcaggctggtctcgaactcccaacctcaggtgatccgcctgccttggccccccaaagtgctgggattacaggcgcgattttactacttttttaaagatccaagtacaacttggaggaaagcacgtgaatcttacatacagctcaattaattttcacatgtctacacttgtgtaaacactacccagaacaaggtatttccatcaccttagccagcctttgatccccaattttaacctagttcttttgtgttcattgctccctctcctgtacttgtttcactctggtgcacataacacttcagcaccagtatttctagacattttctggacttcttcatgttaagtgctcacagatgtctgttactgaatttgaaagctggattgtttttctttctataagtgtgtagaaatgccagcttcagttggataggagttctaaaacattacatcacttgaaggaaactgtagtcaggaaaaccagcatatatttgtaagagttctgcttatttaatattacatgagccttttttttttttttgcatttctgtgccagttcatagaaaggggctataggtagtaaaacaaacataaaaaagagcagcagccagccagccctgatttagtacatctccacatctgttttcatggagtggcaaaacctggccgagtgccattaatagtctcagaatgccttacctattacaagttgagtatcctttatccaaaatgctagggaccagaagtgcttgagattttggattttttcagatcctggaatatttgcagagtacgtactggttgggcatccctaatttgaaagtccaaaatccaaaattctccagtgagcatttcctttcagtgtcatgttggtgctcaaaaagtttcagattttggagcattttggatttcagattttcggattaaggatgctcaacctgtaccttggaaaccaccatcttattccacagtgcagactttttattaatggagaaaatataaagaaagccaactagattcttagatcctatggccagaggtgaaatcctgacagcgagagttgctttgtaaattaacttatgagggatatagtggattaaaatgtctttattgcaccaattatgaaaaattataggcaaaatacagttaaaacaagcaaaatatttcagcaagaaataaagcacacagctttgcactcctaaaaaatctatatagtgtatagaagataggctataaagggctataaagtttagtttatgaccagggaggttgttcagaaggatgatagttgagaggaagctaacctttattgaacttctctctgggatcagaaactatactatgggctgggcgtggtggctcacacctgtaatcccagcactttgggaggccaaggtgggcggatcacctgaggtcaggagttcaagaccagcctggccaacatggtgaaaccccatctctactaaaaatataaaaattggctgggcgtggtggcgggcgcctataatcccagctgctagggaggctgaggcaggagaattactcccggaaggtgcaggttgcagtgagtcgagtttgcgccattgcactccagcctgggcaacaagagtaagactccctctcaaaaaaaaaaaagaaactatgtgctttttcaaatatctcattaatcctcacaacaattctgtgggggtatatattatttgctcttgtttttaagattagataactaaaactcagagaagttaagtaatctttccaaagtgacacagcagatacataaatgacagagctaggattcaagccccagtttttctggctccaaagccatatgttctttctgctgcatgttgctgtccactgcctgccactctaaccatgattggtgtttttcattattactatttttttagtgccttgttcattaaaaggactttctgatttccttccttgcattgtcctcatgtcactgttcttattcttacttttacaggctcatatctggtgttagtcggccagatgaggtgctcgagtgtattgaaagaggagtggacttatttgagagttttttcccttatcaagtaacagagcggggatgtgccctgactttcagttttgattaccagccgaatcctgaagagacacgtaagtcttttgaagtttatctcttatccttaagtttcttccatttcctgttaatttttggcttgagtcacaagacagaaatatgtatatataaagccagtcttttacaaaactacatctctgtttcttatctgtgtgctctggcatgttggcacacaaatccaggtacttaatactatacatgtagctcatcaatattaggatgtgattttatagtgaaaagaaccaagaaaaacaaaacctcctctgttaacagcctgaaaaaagaacattcagagtgaattgtgatgaaaatcataagaaaacctttgaactgcttggtaaaagttaacttgttttctcacaaaagagtttttgtctttgctttgcaaaccctatgctattaaaatacagggagactcatgatcctctgatcctagtgttacttcttgcattttttttttaatacaccaggctttgaaagctattttcctttgctaatgttgctttgaaggactgccattttcttttattatttagttatccagaagttaagaaagtcagtttcggattctaacacttacctggaggtagaaaaggagctaggatacagactttgggctggagttgcttgaagtaggttttcaggagagtgtcgcctgcccagtcttccctctggccttcagaaatgacctttcctttccttttcctgctgtccttggaacttttccttaaccacatcaaccttacatttgaataggaccagaaacttccttaaaggttcattttattcctcacaggtaactaaaatttcattcagatgttatacttttatgaagcaacttaaccattaatctaaatggaattactcctggaaacaaaataaatcaagttgatcaaattcttaaatatataggaggtcaattttactgtccttttagacagaccagaatataatgtatgtggataggtataccattaacactataaattttcacatcttcatttacaaactgaattatttccaccagaacagaggtaactgttagtcattcagtaccaggaatatgcaaagctctaaaaagaacctgatttgagttctctgtaaagaacaagatcatttttggccagagaaagccaaatttcttcatgattaggaaaaaggaaatagtttgaatgtttaaacaaagtattattaactctgtgtgtgtagtaaattaaagtcctttgccagttacatagtgaaaattccaaagaaattacttggcagcagttctcccaaatgacaagagttttctgaagtgtcagggcttaaaaaaaattctttttcagaaatagggtctcactctgttgcccaggctggagtgtagtggtgtgattatggctcactgcagccttgaactcctgaaaaaagaacattcagagtgagttgtgatgaaaattataagaaaacctttgaactgcttggtaaagtttaatttgtttaactttaatgggcacaagccatcctcccacctcagcctcccgagtagctgggactacaggtgcatgccaccatgctgggctaatttttaaattttttgcaaagacaggatcttgctgtgttgcccaggctggttgtgcactcctgacctcaggcgatcctcctgccttagcctcccaaagtgctgggattacaggcatgagccactgcggccagctgagagcttcattatggtttcccacatcagcatgcaaatttatgggaacaaaattataacagctctgtgcccagtgctcaggttgcttctcttatacctttgaccttgataaaattaccctcttaagaccacctgtctttctcctgggaccaacactgagatttgttatcatttgttcccaaaataccccttaactacttgtccctgttccaggcagttggctttttgtagagtagctggtgtttcttttgctgtgcaaagaatgtttcttcttaaagcagagagttgaagggaacaattcaggttgccatttaattctgtgtagtctgggttccctagagggccagtgtctccatatagaatacatacattaaaaccatgttctacttcaatctatttggaatataggtagttcaaagccaagtatatttgcatgtacattatgataagggatagtgataaccccaccacacacacacacacacacacacacacacacacacacacacacacacacgcaaccaacagttaacttttggtttatttattttgcccaggctggtggtgtactcctgacctcaggcaattctcctgccttagcttcccaaagttttgggattataggcatgagccatcatgcctggccaccaatgtttttaaattatttcttgatgatacgattatatgttatatacttgtaactataatttgcttagatattattgaatctctaaattgttttggtgttgtagataagaggacggtgacagtcttggagcatattgctgttttccttttcttgtgtgatttccttaggataaattctcaggagtgaaattacagagtcaaagatcatgaaataataactaaaataaaatgtttccaatggccacttcttatctgatcatcattcaagcctttttattggtttgtccttcagtactacaacaaaatggaacacaagaagaaataaaatgtatggatcaaataaagaaaattgaaacaactggttgcaaccaagaaataacatcatttgaaattaatctgaaggaaaaaaagtaagaaatttttaaaagtttggattttgctttctgacttctgaattttagtctgtgttaaaagtttatgggacaattctcaatttatgatttcataaaatattaatagttgggtattatttaggccttctcaaattcgatttcaaaaaaactctttattttcttcagatgaatttgtagacttcgtcttgtcagaagactggagccaggtaatgattgctttagaaaagctgacagaaagattaaaccaaatccattgtttggcgtcttgtattcctttagagcataataaggagttcaagataaaacaacaaagttttaaattgtagggtgcctaagccatctttgttagatacaggctgtaaatcttacgtaagatatttatctctataaagaacaaattaagatacagattgaattgaatatcccttcttcagaatgcttggaaccagaagtgtttcagatttcttttctttgttgttgttgttgttgctgttgttgttgttgctgttgctgctgctgttgttgttgttgttgttgttgttgttgttgttgtgttttagaacatttgcattatacttacctggctgaacatccctcatctgaaatctgaaatcctccaatgagcagttcctttgagcatcatgttagtgctcaaaaagttctgaattttggagcatttcacattttagattttcagattaggaatacggaacctatatcttgtaatttttgtatttgtccaaaagtggtaatcatcagtgaaccagtgagtgatttttctttgagtctgatgcactcactttagtgctggggtgggttttttgtcttacgtaaaagaagatcctatggcttgtgacttacttatgtctatctagtgatagtacagacttgagagtttatgaaagaatgtgaaaatccttgttcttacccatattctgttgggactcctttaattgtaggtcagaaatggtgatgtctaccgcatttgacttcttaaaaaatagccaaggagatagatttgtttttgtctttcttttacccttttttttctgtcatccactgactctcaaatgatttatttatgtttttaaaattttagggtaatataaatggttactactaaaattccctttatgttatagatttaattggaaattgtactattattatcagcactagacttaagtttttgagatttgtagacaaattctagcactgctcttgactgtgtgactttggtctggtcaattcttcacttttttcttttttttttttttttgtggggggcagagtgtagctctgttgcccaggccagagtgcagtggcacgatcttggctcactgcaacctccgcctcctgggttcaggcgattctcctgcctcagcctcccaagtagctgggattacaggcatgcaccaccatgcctggctaatttttgtatttttagtagagacggggtttcaccatgttggccaggcagggcttgaactcctgacctcaatccacttatttttaatagttgattaaaggtaacacctggccaggcatggtagctcacatctgtaatcctagcactttgggaggctgaggatggaggatcacttgagcccaggagttcaagaccagcctgaacaacatagcaagatcctgtctctaaaacagattatctgggcgtggtgggaagctgaggtgggaggttgcttgagcccaggagtccgaggctgcagtgtgctatgattgtgccactgcactgcactccagcctgggtgatagaacaagaccctgttcccccctcaaaaaaagttaacacctatgcagtgcttaggcctagtgtgtgcccagcagtgttcaagtcctttaactgtactaatacatttcatctttgtaacaactgtctgagataggcactgttattacctttggttcatggatgagaaacaagtcacagagagatgttaagtgacttgcccaagtaagttgtgaagccaggaatcaaattcatgcagggtagctccaggaccctccctctcaacccccatagttatcttcatctgtagaatgacaataaaaatagttatctccaagaatgaatgtgaaggttaaatgagacagtgtatgtgaaagtatttggtaaactgcaaaaagctgtgtaagtagaagtctaccatgtcttttgataataattctggtggtaagtgggaaggaagtgtcactcacttctctcctaagtgtccaacacttagaagtgtttcctaacattatgtgcttttacaatgtgattagtaatactcaacatgagtgagcgaccacatgaatttcttctgatgctcctttgtaaccccagactcggagtttgcatcagtcagagaaaaactccagggtctccctgactcattgtgttctttgttaacttttttttttcttttttgagatggagtctcgctctgttgcccaggctggagtgcagtggtgcgatcttggctcaccacaacctctgccccctgggttcaagcgattctcctgcctcagcctcccgagtagctgggactacaggcacgcgccaccatgcctggctaatttttgtatttttagtacagacggggtttcgccatattggccaggctggtcttgaactcctgacctcgtgatccgcctgccccggcctcccaaaatgctgggattacaggcatgagccaccacacccggccctttgttaacttttaaccatattgccattttaagcaggtgcacagcactgaacatttgccagtgatgttattaaccactggtaactttaccagcagaatagatagctgaggttgtggatttcttgtattccgtactttctggaatgtcactgtgacttctttcttaggtaccaggaggactttaacccgctggtgagaggatgttcctgttactgctgtaagaatcacactcgggcatacatccaccatctgctggtgaccaatgagctgctggccggagtcctgcttatgatgcacaactttgaacactactttgggtttttccattacatccgggaagcactaaaaagtgacaaactggcacagttgaaagagctcatccacaggcaagcatcttgagatcttgcaaatacaagtctcactcttcacactgagcctgtaccactgttgtaacatgggaagacgtgaagaagaaataatctgagctttaattatttatatttggatataaggtctgcttaaataaagaatctttgtaccaaactgcccacatgagggtgaagagatttcctcaaaagacttaaatgacctggattgatcagagagaattgaactgtgacctttaagacttctagactaattcttttagttgatagagattcatttagtcaaagacaaaagctttaactgtgagggcacagccttgaagtgggagtgatgagattctgagggacccatgaattggattgaggcttgaggggaaatggtgtgagacgaatgggctctggacatatgcctgttgatttgagaagaaatctggctggtttgagggtttcctttagttcaccctcatactctcaggagactcttctggatacttttgtcttccaccctgccctggcagtgcagccaatcagaaatggctcttgtgacttaactgggcttggatatccctggaatgtggggcttgaacattgctcctgtgatgatcatctgtcccaggtcacactccttcatttgaccacatggcctatttgcaacttctttttagagccaatgtaattgcctgttaggagccagaagtttgcccagctgctttcttctggttgtacagatccattgtggtctgccttccaggctcattaatagtctaactacgtaataactgaagacctatctcttgtgaagattcattctcaatgtgttcacttggacagagccctgcctggcctaacgattagagggttagtctccatcctgctcagatatgactcctgggcaattcacttaacttctccatggctgcttcctgctgaataaatagggacaggcataatggataggaatgaatgaacttttaagatactgtctagctctaaaattggaagaacaaaaagttttagattagagtcatagccttaatagccctagttgtcatcctgggagacaggcaacagtagagatatttgagagcctaaagagaggtttggcctgtgggtttttaagtggttattgaattggtatcaggagatcctgaggctggtaggggaaggtaattctttctaagttacctctgtatttttcaagttttctataaggaatacacatacacccacatgcacacaccatagtttttatacaaacagcaataacaaaaccaaaaagatgcccctttttttgtagggataagaaatacatttgttttatacttctatgctatattttgctattcaaaatttagtgggcattacttaacattgtttctaattattttgtggctgctgtatgttttatgtgttgggagcccattgtattaggccgttcttggattgctataaagaaatacctgagactgggtaatttggttttttggttttttggggttttttttgagacggagccttgctctgtcgcccaggctggagtgcagtggcgcgatctcggctctatgcaacctccacctcctgggttcatgccattctcctgcctcagcctcccgagtagctgggactacaggcgcccgccaccatgcctggctaattttttatatttttagtagagatggggtttcaccgtatgagccaggatggtctcgatctcctgacctcatgatccacaagactgggtaatctgtaaagaaaagaggtttaattggctcatggctctgcaggctttacaggaagcatggtactggcatctgcttggtttctggggaggcctccggaagcttatagtcatgacagaaggtgaagggggagcaggcacatcacatgacaaaagcaggaacaagactcagagcaagaagtcacttatcaccaaggggatggcccaggccattcatgagggatccacctttgtgctccaaacacctcccaccaggccccacctccagtattggggattacatttcaacttgaggtttgggcgggaacaaatagtcaaattatattacccatctacatggttttctttttcttagtatgggagtgtccatgaataaattcatgggcatcctcataactcttccatgaatggcaaggggtacttatggaaaacagttttccaaagatctgattgttttgaaatgtgttagattggacttgttcaaatgttcatatttttgttctatgctaaatgcatcgttaggggagtagtggtaaatattccagaatccatatgaaattcatgagtttatttatgtctaaaacactgaaaactgtgtccaatatcgttcagtttcctgggtctttttcttattagcacatttgagaaaaatattcctttcctttattgtagtaaatctattaaaggcaatagccaataaaacatttttaattttaaaaatttactgtgtttggctttctgtaaatgtagtaggtctgttaaacaaaatattaaatttccatagtaccagaaatgttgtagagatttctcattggaagaaaaaaatgtttatctgtattcattgttttgagagcttccatgataaatgtaaaatccaaaaagatatttaattatatacattatgaagattcccttatctatctttattaatctgttcttgtgtttctataaagaaataccagaggctgggtaatttataagggaaagaggtttagttggcttacagttctacaggctgtataggaagcatggcaccagcatctgctcctggtgagggcttcaggaagcttacaattgtggtggcaggcaaaggggaagctggtgtatcacatggtgagagaatgaggaggtcccagactcaaacaaccagatctcatgtgaactgagggagaatgcactcatcaccaaggagatagtgttaagccattcatgaggggtgtacccagatacctcccaccaggccccaccttcaacactggggattacatttcaccatgagatttggaggggacaaacatccaagccatatcacttacctctttaagttatgtaattatgagccttaaggccatgctagcacataataaaaataataatcacaatatggagtattttaaatgtgccaggcatcttggtaaatgcttttcatatataactattgactgttagagcatggctgtgaggtgttgctattgtcctatgggctatatgtgctagtgctagttattccctacaggaaaagctgaagccagctatttaagaactgaattttaagagggttgagtagcctgcctgagtgcctaccagatatttcaggaaagaaatagtttgcctaagggcctaccactactcagctcccaggtagactctagctccacagttatccactgtactaaataaattcttaattttgacttgcttctggtttgagggggctaagagaatcagggactgcagagaggggcctcctggccttggggtattgggtgctttaggaactttgctgcaacttggccttggcttcagcttttccagtagggaatagctagcactagcacacgtcccgtggtaccatgctggtatttgtaggtgctcaacatgggttgccattccacatcctcaaatttctccccccttcccagtttgggactgtaaccacaccctgaatggcgttgaaatgtttgggtactgtgattagttcaagtggattcaggtaatcaactggagtctgaggtttcttatatcttttgggggaggtttattttgttactccttggaataaagggaaaatattctaaaacattttttaagcaaatacttgagtaatgacagcattttaataaaaatttcaaacaaagaccatcaaagggtcaaggctagaatggaaagcaactatcttatccagggtgttttttctgtagaggcagcttggagctcagtaagaaaccacagagttaaatgattaccctgtgccttcctgattaggaacaggctgctctctgcagtttgattagtcttgcttgtaactatgggattatagcttattaaaactgacagtgctgtgtagggcagggagcctggaaggtcaaacttccatgctgagccagccaccagcaaggctctgcctttacctaaaagtttggtataattggcattcatttaaatatcctttttaatctcttcactttcttttcaacctttgtgtctcttagtaatttacaccttttctttccttgcttcttcacgaggttccctgatttgtgagcacaaaacccaaataacagtgggcaaagaatgaaacaagccagtgtaagcaatgtgaattagcataatcgtgcactcttcctcccgaaaatcctgcttcatgcccctagttcaggtataaatacacagcatcctgcccccgcctccaccaccttttattctcaaaagtgctggccaagttaaatggtcaccctaatgtgaggggtagagatgatcaaactagagaacaggtgttccagctaaatgggacagctgatacccacctccagctaattgctgctgtggctccggtgctgccagatatttcagtctttcaggagaagccaaaaatctggattttcaggtgaaatttcacaatttttaaatgctgggtcaatttttaaacaatattctgctagccaaacaaaacatgggggtgcctagtttgcaacctctagcttaaaatctggaagaagggctttggtatctttagcatttaaaaatttctcaacaactgattgcaatatacagaaaacatacctgtagtttctagttcctgcagctgtttagattcccacattaagagagcccatgttgtcccatctcctttgcagggtcaccagataactcccagaaccattctaaatctgccagaagggaaggtatgcagcatcttattcaacctattttatgcaggaggaattttaagcctggagaagaaagattaacagttggcgccccgtgcgctggctcatgcctataatcccagcactttgggaggccaaggtgggtggatcacctgaggtcaggagtttgagaccagcctggccaatgtggcaaaatcctgtctctactaaaaatacaaaaattagccgggtgtgatggcacgtgcttgtagtcccagctactcgggaggctgaggttggaaaatcacttgaacccaagaggtggaggttgcagtgagccaacatcgtgccactgcactctggcctgggcaacagagtgagactctgtctcaaaaataacaacaaaaaagagagcccatgttgtcccatctccattgcaggatccccagataactcctagaaccattctaactctgccgaaagggaaggtattcaggatcttatttaacctattttatggatgagaaattttaagcctagagaagaaagactagcagttggctgtgtctttcctcttgggagtgtcttagttcaagctgctataacaaaataccatagactgggtggcttaaaacagaagaaatttatttttcacagttctggaggctggaagtctgagatgagggagccagcatggttgaattctagtaggggccctctccctggtcgcagactgctcttgtctttccatgtctccacatggtggaaagaagggtagagagcaccctggagtctcttttataagggcactaatcccactcatgaggactccaccctcatgatctaaattaccttccaaaggccccacctctgaataccatcacattggggttgggatttaaacataaactttttttttttttgagatggagtctcactctgttaccctggctggagtgcagtggcgcgatctcagttcactgcaaactctgcctcctgggttcaagcgattctcctggctcagcctcctgaatagctgggattacaggtgcccgccacctcgtccagctaatttttgtattcttaatagagacggggtttcaccatgttggtcaggctggtctcaaactcctgacctcgtgatccacccgccttgaggcctctcaaagtgctgggattacaggcttgagccaccacgcccagccttcaacgtaaacattttgtggggacacaaacattcagtccataacaaggaatttaaacatgcacacagttctttctagttagcattttggcactcctaaatctcaccacctattttctgccgggcctgtgcccttctagggtcagcatcgatttcccagtattcactttccagtggttccttctggcctcacaggaccagctggtacaggacataagataagagctcctattgcaccttccagcattaatagcaatagtcctggatgacaccgtgaaatctcaattactgtttgtcaagtgaacgaatattctgagtagttgaggcattctcttccttattttggccaactgagtgctggttagaagtgacttgcacaacactatgtggtaggacctatgagaatgtcagtggtggttttatgtcactttatgctaggcaagctcccggtgacctgacacatttttggtttttcggattttttttttctgttacttggtaccattatcatctttcagtgctggcctcaaagcaatttcccctgctctgacaagaggaactcagagtgaactttccttttgttctcattcctcacaatctactttgagatcaggtcggagttgccaaggagttcaaacggccgatgcttcccagtgtgattcagagggatccgtgcctcctttccgcacactattcctaatgctcacctctctccctgaactgctctcgcctgctgtcggctcctttgtctgcgaaacacattttctcttattatcaccttgttctctgcctgccttggatggtttcagcttgtctcttaacatcaagatgttgctattaacagtcttctctttcttaacagcttacagtcacttccttttattcagtccttttccttttccctcccaaaccacgtaatcatctctttcagcctcaaataaaagttgtataaccatttcataaccactgctttagagttgctatcaaaaaggcacaagaagaaggacataaaagtaaggggagagaaatcaaaaggagaggaggtgagggatactccaataattgagaaacagggtgtgtgtgcatcttcagaattctcctttgttgattagccctcgagactgaccatagcaagctcagtggtctggtgaaattttcctctaatttttatggacagatgggaagctgttctcccctccgaggctctgttttccttccaaatagttaaaatattttctttgaactctcccagaatcatttatttttgtcataaatccattcacagaatccaattacataacggatatgagttttccacacccccaaaaagctaaaatatttactcacattttccagcattttccattttctactcatttattttttagttcaacaaaacttaaataacatttccatcacaattctatttattgttcccccacaatgctagctgaaaataccaactggaaatgtactccattcccacatagtaactgcacttcaaaagacaagagagtgacaaagtatgtccaattttttcttttttacacttgaactgattttggttagactctccagttttacattgttttttgtagaaagttcagtcatgttgaaaaagtcagttccactttatattttttccacctaaacattcacctgttgccacaaatccaacgtgtctaaaaccaaatttactatcttccttcagtcagactagttctgcacttcaacttccttgcacctggcttccagccaaatcagctggaaaccttactccttggatgaatgaagtaatacatagaagggatgggtataaggcatttcaaggaggatcagcaagacttggtgactgactcagaggaggcagttaaagcctgactcaaggaagattaccacccatcctgcccctcacctcctccttgtcctcctcaactccactctcttcctgctgtaccaaggctaaactggcagcctgaatttctagggccgccataatctgaacctaaccaattgccgtggacttttccacttttcctaagtggttatatcctaatcctacccattctcaaggtccagcccaagaaccaaaccttccataaaaacttgcttttctagaattctagagtctcaagattggaagaggagaggcttctattctgatttcctttgttcataaaggcaccagcaaccagtgctctaggcatctgatttaatcagtgcttcagttctgtgagcctcatcttccaaccagactatcagctctgtaagggaaagataatccctcagcatttgccgtgtctgcaccctcacccctgccccactgaaattaagggagaatgtgtgattaattttcttctcatcatgtgtctgtagtatgttctctacttctccatctttaacacatcactttatccgtttcttttttcattataatttgttcaattctgtctgtgccttatccattaccttcttttttatttttatttttatttttttaagatggagtctcgctctgttgccaggctggagtgcagtggtgttcccggctcactggaacctccgcctcctagattcaagtgattctcctgcctcagcctcccgagtagctggaaccacaggtgcatgataccatgcccggctaattttttgtattttttttttttttagtagagacagggtttcaccgtgttaaccacgatgctctcgatctcctgacttcgtgatccatccattaccttctttattgctcatggcaaccctctgaggttgacattatcttttccaatttacagaggagaaattgggctgggtgtgatggctcatgccttagttccagcactttgagaggccaaagtgggaggatcacttggggccaggagtgtgagacaagcctgggcaacaaagcaagacccctatctctacaaaaaataaaaaataactagctgggcatggtggtacacacctgtagtcctggctactctggaaaccaaggagggacgatcactcgagccaaggagtttgaggctgcagtgagcaatgaaccccagcctcagtaacagagcaagactgtctcaaaaaaaaaaagacacaaagcaagggatccaggatttgaactctgaactcagcactatgactcaaaagcccaggattttccccattttaccccggaccttcctaaattgtgtttttcttatgcagagcatctgctctccttcaagaacaacgaccaaaagtaggtggaggcagctgggcgcggtggctcacgcctgtaatcccagcactttgggaggccgaagcgggcggatcgcaaggtcaggagatcgagaccatcctggctaacacggtgaaaccccatctctactaaaaatacaaaaacaaaattagccgggcgtggtggcgggcgcctgtagtcccagctactttggaggctgagccgggagaatggcatgaacccgggaggtggagcttgcagtgagccaagattgcgccactgcactccagcctgggcgacagagtgagactccgcctcaaaaaaaaaaaaaaaaaaaaaataggtggaggcctatcccaaactgaacttttgtgtactctgaacctctcctatttgccctctgggctacccccataattactccgtggtattaaggactggtaagttgggataacttattaactattcctctttctatttgtggtctcagaaatctgaactacattttaatgataagagggctgaggagtgacccagagatgctaattttgttttggttaaaatctcatacattcgcatataaatgaaaagcaaaaggacgtttaaatcgtagaaagggaaaaaaatagcttagtctttctctttgtcagaaagaagcttctttggtaacacatagtgtatgattttagagccagaaggaatgttacaaattatctatccaaccccttcatttgacagaggcagaacccaggcccagacagtgtgtgactaacccaaggtccaacaggaaatgagaggcaaggctagaactagagtctaggtttccttttccaccccaattcttctctgagtccttatctcttgttctgcctctattcagcctcgttggtaacttgtacctcacaaactaggtgtggtacagacattattattgctactctgacagtgactatagcctttctggctgctgggataacagtgattcttgaacacagagaccattctgtttgtagatacattttaggagacttcgttattatgactgtggatataatggaatttggaaaaagatgtctcaaacccagctcagaaagatatatagaccaagccctttccaatatattatgccatttataattccctccctggcctatgcccctcctataattatactttaataatttttgttggttgctggtttttatcagaagaggggaggaagtgagcatcttccagggcctcatcaggagatcctgtctttttctcacaggtccttgatagtctatggaatttgtcccagccgataagcacatacaacccaatcttaatcagggacttcccaatatattggtaccaaggattttgctcatttgtgtatgtcttccccatcctaattctctgatacttagaattcatttattcacctagtcaagaaagattaatccactgccaactaagtgtcaagtgctctccagacactggattaaatgacaaaaaccctacttgccttctcgcaatttatagaccaggagcaaactccaaaattacgtatattctacatagagttagaaagcttcactttactcatgtagtctgtcaaatcaaagtccaacctaatgtaaccacccaatgggttctccttgcccactgcccagagagagctgatttaagacaggggaattggaatagagaaagagtttaattcatgcagagcctgctaaatggagaccagagttctgttactcaaatcagtctcccccaaaatttggagactcgggtttttaaaggataatctggcaggtaggggaccagggagtgggggtcgctgattggttgggtcagagatgaaatcatatggggtcaaagtggattcgtcttactgtctcctgctcctaggtgggattgcagtgctggttgagccagattactggtctgggtggcaccagttggtgcatcagagcacaaggtctgcaaaatatcatgagcaccagtcttacgttttatgatagtgatgttatccctaggagcaactggggaggtttagaatcttgtggtgtctagccgcatgactcctaaaccataatttctaatcttgtggctagttagtcttacaaaggcagcctggtccccaagcgagaagagggtttgttttgggaaagggctgttattatctttgttttaaagttaaactataaactaagtttctcccaaagttagttcagcctcatgcccaagaatgaacaggggcagcttggtggttagaagcaagatggagtcagttaggtcagatatcttgcactgtcataattctcccactgtcataattttgcaaaggctgtttcactaagagatgacagaaggtggaaaatcaccacatgacagtatctatgggtaaagaaaatcaaaatgttagtggtttacatttcattatctactcattattaaggaaagaactacagaccaaattaatgagttgaatttgcctcttagctgccttgattagctcaacattaattctgtttgagtgttctttttccttccctccctcccttccttcctcccttccttcctcccttcctctctctctttcttttcttttcttttcttttgagacagagttttgctcttgttgcccaggctggagtgcaatggcatgatctcggctcaccgcaacctccgcctcccaggttcaagcaattctcctgcctcagcctcccgagtagcatgcgccatcacacctggctaatttttttttttttgtatttttagtagagatggggtttctccatgttggtcaggctggtcttgaactcctgacctcaggtgatctgcccacctcggcctcccagagtgctgggattacaggagtgagccaccacgcctggcctctctttctcttcttttttgagacaggtttttgctctgttgcccacaatggagtgcagtggaatgatcttggctcactgcaacctccatctcccgggctcaaggtaatcctcctgccccaaccttcccaggagctgggactacaggcatgcgccaccacaagatggggttttgccatgttgcccaggctgattttgaactcctgagctcaagtgatccacctgcctcagcctcccaaagtgctggcactacaggcgtgagccactgcaccccgccctgagtgttctgcatcttaaggttcccaacaaatctgtaagcaccctagaagtatgattgttcccattttatatttgaggaaacagggctgaaacagtcaagtaactgttttaaataattctgggctgggcacagtggctcatagccaggagtttgagaccagcccaggcagtatggggagaccatgtctccattaaaaaaaataataataataatagtaaaaatagggagtttcagcgcctactctggctcaagaggctgcctgataaaataacaaaatgaataaaataaaatcactttgacttcaggaatatctgcttgaagagcctgtgctattatttctgttctccttcccttctcactcactgtcgcctgggggccagggtaagacactgcaatgaatataaaaacaatataacctcctcactcttaataaatgtgtttctacaaagtcatgtcctgattttgtttatttatttattttattttatttttttgagacagtcttgttctgttgcccaggctggagtacagtggtgcaatctcagcacactataaactctgtctcccaggttcaagtgattctcccacctcgacctccctggtagctgggtctacacgtgcatgccaccacgcccagctagttattatatttttagtagaggtgggggttttgccatgttggccaggctggtttcgaactcctgacctcaagtgatccacccacctcagcctcccaaaatactgggattacaggcataatagagccactgcacccagccatgtcctgattttattaacacaattttgggaaaagtgatttaatcttgacatctaagaagataatcaggggagtagagacctttcctaatgacatcccatttactaaaaacctttttggagcaacatttggaaatagagttcaggaaaggaactcagactgggcagtacattcggttgagtatttctaatgatagcattgtatatatgctttaaattttagaaaataacaaagtcatttaaatccatgtctcagctggatgcagtgactcacacctgtaatcccagcactttagcaaaggctgaggcaggaggatctcttgaggccaggagtttgagaccagcctgggcaacaaagataaaccacatatatacaaaaaatttaaaaattagcctggtgatgtggcatgcacctctagtcccagctacttgggaggctgaattgggaagattgcttgagcttagaagttggaggctgcagtgagcatgatcacactattgcattctagccagagtgacagagcaagactctgtctcaaaaatcaattgaggccaggtatggtggttcatgcttgcaatcccagcactttgggaggccaaggcaggaggattgcttgagcccagaagttcaaggccagcctgggcaacatagcaagaccttgtctctattaattttttttaaattaaaaaaaaagccatgttttatgaggaggtcaggcttaacttactggagtttttttttaaaatgtgattttgaagtcagtgataagatcctagctaagaagccacatttgacatgttcatttggagattttcaaagttgccattttgtactgttcaccaatttggatgctcaatatttgttgaatggatagtctattcattcaacatgtattgcctcttactatgccccacattttttggatggtggagattcaaaggtgaaaatgtcaaggtttttgcttttgaaatcacagcttagtggatgaaataaatacttcattacaaaacagcataataatcactttgctagtggaatatacaaagaactatggtatgaaaaggtgaaagtctttctcaccttgttttctcaactaaaataagaatattctggttgataaatatgaatctactgtacttatggggacaataaaaaaaaacagttgaattggtactttaaaacacaatatatagggtgcaatgcctataatcccagagctttgagaggctgaagcagagaatctcctgagaccaggagtttgataccagtctgagcaacaaagtaagacaccatttctaccatcccccaccccaaaaaatagctggatgcttgtagtgcagctaccatacaaaaaaataggctcatgcttgtagccctacctactcaggaggctgaggtgggagaattgcttgaacccaggaattcaaggctacagtgagctataatcacgccactgtactccagtctgggctactgagtgagaccctggctctcaataaaaaagatgcatagagctttgctttaccaagggaataaaattccaggccactaataaaatggcctgaaaattcctcccagatctgaccatgttcttcccacagtgccctttttcctctctgattatctttccatcattcatcccattattcacaattcgctgactgactagtctatgggagtaatacaaaagaaaggatcattgccttctctgataaaacaaaatgcagacttccaaagtttagtaccagaaagaaagtgatattccatgagggaatggttaactgatcacagtagctcagtcttctcactctgagtgttaacttcccattgggaggtttcatatttgggttagcgccatctccaccatactagcttctcccctaggaacactctgattcaagctgggttggaaacatttattttcttccctgagagtagctgaaatttcttcatttttttcatataacagagtagatttagagccacaatctttttttttttttttcctcagcagtagggtggcagaaatatcatccacaattggacgtctgcttcacagtcagaggaagcattctagccattgttataacctccccttgggtcagaagtgattgacagtaataacagctaatcctaattccattatctcatttgtagtgggttcaatgaacaagaccctctctattcttcaacagtaacattaaacagaaagctggtgtcattttcttagtttcaaccaatcagctcatagccaatcttgtgtcttctgcattcttattcactccccatacagacatcactggattattttgatgcaaatcctagatgttatataatctcattcataaatatttcaatatgcatctaaaagataagggctctctttaaaaacttaaacacagtactgttattatacctgaaaagaaataataagctctcactataaccaaatattctgatggtattcacgtttcctccatcatctcataatttttttctgttagtttgtttgaatcagcatccatatggctactcagtgcttgaattgcaactagtctcaattgtgatgtgctgataatgtaaaaatacaacacatttccaaaacttaacagaaaaagatataaaatattaattatttttacattgattataatcaatcaatcaattgtaatttcaatgcttcaatcataatttcaatgatttttgaatatgttagattcaataaaaatatgttaaaattgttttcacctattcatttttacttttttaatgaggctagtagaaaacttaaaattatacatgtggtttgcattatatttctgttggatagtgctaatctaaaggattgagcaggttcaggtttgattttttttgcaagactgtttcataggtgatgatgtgttattccatctggaagtacacaatggtgggccatcttttttgtgctaagattgatcagtggtccaggtattacagctggatacatccatgttaagtacatcatcaactttaaatccaatgattgaacatttatttttaatatatttgatatcattctatttcctggtttgtatactgatacttaaaagccttccatttataattttccatttaatgaaaattccatatgaatattatttcaaatatactatagatctctatatatgctttggactaatgctctccaacagaactttctgtgatgaaggaaatgttccacatgtgcactgttcaatatagtagccatatgtaactactgagtacttaaaatgtgtctagagcaactgaggagcagattttaattttaattaattaaatctagatttgaataaccatatgtggccaatggccactgtattggacaacagctctaaactcactagccttcagactttcattaaaagctcgaactaacatacttttttcccttcttggaagcttcatacatattctctgctttgcatggaacaatattccccagactaatttcaaggaaatctcatttctatcctagaggcctcttttacttcctcagatttgtttcttactttctcagagtgatcttccctggctcttcaatctacagtaacttagtgtttcctgttatttttttctcataaaagcctccttgtttaatattgacccaatttgtaatcatagttatacacttatgtgtgtgcatatttatttaatgtttgtcttttttttttttttaagagaaaaggcatacaaatttattaatatacagggctggggaccacagaatgattaccccaacccctcagtgggttacagaagattatatatcctttctcagaggcaaaagaggagatgggtaatgtagacaattctttgaggaacagtaaatgattattagggagaaggaatggaccagagagacagaaattaacttgtaaatgattctctttggaatctgaatgagaccaagaggccagctttatcttgtggaagagtccatccaggtgtggttgcattcttcagtctctgcagtagataatggggtaacagaaggccattgtgcttcttttggtaagaagcttttttttgtcagatcaggaaattccagagaaagtcccgccttggcaagtttacttagcgctggtatacttggtgatggccttggtgccctcggacacggcgtgcttggccacctcctcgggcagcagcaggcgctcggccgtctggatctccctggaggtgatggtcgagcgcttgttgtaatgcgccaggcgggaagcctcgcccgcgacgtgctcaaagatgtcgttgacgaaggagttcatgatccccatggccttagaggagatgccggtgtcagagtggacctgcttcagcaccttgtgcaagtacacggagtagctcgccttgcggctgcgcttggtttcttgccgtccttcttctgcgccgtagtcacccacctcttggagccctaattgggatcaggagcggactttgttggctctggcatgtcgagggcgcactacaggtcgaggtgaactaacagcagctcgagaaaacgggaattaatttaatgtttgtctttactaccaaactgtaagtttcgtgagattaggaccatatttgcatcattcattattatgtctctgggacccagcacaatgcctagtacatattaggacttcaataaacaaatgcaaagtagcgcatggggctgcagccacagatctcctgggctctgggtctgggagcaggcagtggcatctgacacttcatatcccttaaagaagacaaaatgtattctatgacagatagggaaccagagccagggactagagtgtgactccctgacttgttagaggaggttgggaaaaatggccttgactatcttcctaggcagaggcgggcaaactatgcaccccagcccaaatccagccctctgcctgttttggtaaataaagttttattggaacacagttacatactttttttttttttttttttttttgagacagagtttctttctgttgcccaggctagagtgcaatggcatgatctcggctcactgcaacctctgccttcccagttcaagtgattctcgtgcctcagcctcccgagtagctggaattacaggtgtgtgccaccacacctggataattttcgtatttttaatggagacggggtttcacaatgttggctgggctgatctcgaactcccaacttcaggtgatccgcccacctcggccttccaaagtgctgagattacagacatgagcctctacatctggccagaacacagctactttcattcttttacatattgtctatggctgcttttgcactacaacagcagagttttagtacacgcatgcactgcataacaatgtttcagtcaatgacagactgcgtatatggcagtggtctcataagattataatggagctgaaaaattcctattgcctagttatgtcatagctatcataacattctagtacaacacattactcattactcatgtgtttgtggtgatgctagtgtaaacaaacctactgcactgctagtcatataaaagtatagcacatgcaatatgaacagtacataatacttgataacgattataaatgactatgttactgatttatgtattgactgtactatactttttgttattttagagtgtgctaatttgactgataaaaaaagtgttaactgtaaaacagcctcaggcaagtccttcaggaggtatttcagaagaaggcactgttatcacatgagatgacagctccatgcatgtaattgcccctgaagaccttccagtgggacaagctgtggaggggaaagacagtgatatggatgatcctgaccctgtgtaggccaaggctaatgtatgtgtttgtgtcttagtttttaacaaaaaagatttaacaagtaataactaaactaaaaaaaatttaaatagaaaaaagcttatagaataagtatataaagaaagaaaatatttttgtccagctgtccaatgtgttaaaaagtatcagtaagctaaggttaacttatcattgaagacataaacataaaaatgtttttgtaaatttagtgtagcctaaatgtgcagtgtttataaagtccacagcctacagtctacagtagtatacagtagtgtcctaggccttcatattcatttatcattcactcattgactaacagcaacttccagtcctgcaaactccattcatagtaagtgccctaaacaggtgtagcattttaaaaggtacagtaaaaatataggataaaaggtttttaggacactaatatgatttttttttttttttttttttttgagacagagtctccctctgtcaccaggctggagtgcagtggcacgatcttggctcactgcaacctctgcctcctgggttcacgccattctcctgcctcagcctccctagtagctgggactacaggcacgcaccaccatgcacatttcacactgatctctgccctcatcttcttgtggcattctctctcttctctctttctctgtctctgtgtgtgcatgtgtgtctgtctgcaaacttcccctttttataagaacaccagtcagattatattaatgcctactctaatgacctcattttaacttgataacctctgtctccaaataatgccatattctgaggtattgggggttagggcttcaagatatttttttaggagaggggatagaatttaactcataatgatgaaacaaactctaatctatataaaattgaagactgaattagaaagatgaagagagtattgagaaattcacccaaaatataccccagagagacaaaggtgtgtgtgtgtgtttgtgtgtatttattctgaatacatagatgtgtatttgtttatttatctatttacttcagttaagatacatgaaggatagattgaaaggtcccaacattccagcatatctaatagttttattgtagaaggcattggtggctgcctacccagttgccattgctttttcgtcatccttaatagcagaatcttgatttttcttttcaggaagacaatgtgcctaactaaaaatacttaatttctcagcctctcttgcaacaaagatagtcatgtgaccagttctggacagtgaggtagcagcagaagttcctaggctgaccattcttttcttagtacaaagtcaaagtcccattaggagaaagtgcttcaccccatagtgctttgcccactgcccctgaccttaagacagaagtcccagttgatttttatagaataatttaacaaaccttcaacaaacagataatctctacctttcaaaaaatagtgagggtgttctcactcataggtggaaattgaacaatgagaacacgtggacacaggaaggggaacatcacacaccggggcctgttgtggggtgaggggagcggggagggataggattaggagatatacctaatgtaaatgacgagttaatgggtgcagcacaccaacatggcacatgtatacatacgtaacaaacctgcatattgtgcacatgtaccctagaacttaaagtataataaaaaaaaaaaagaaaaagaaaaatagtgaggaaaagcactcaattcattttatgaggttattatacttttgtaacaaagctattaaaaaaagaccagtatttctcataaatacagatttaaacattctaaataaaatgttgtgtgtgtgtatacatatgtatattatatatatatacatacattatttatatatatatatttccccctcaccccatggccaagattaattgatcctaagaataacatacaatcaattaagaggaaaaaatatggtcaatgtaatagatacagaaaatagaaagcacgtttgataaaccttatgcattctcatacttactcatttaaggggaaaaattagcagaattagtgttaggaggagcaagttgctattatataaagtgttccttttatagatgacatttgagtagaagaggtgaaggaagaaagccaggcatgctgatatctgggggaagaatgttaggaatatagactttaagatggaagcatgggtaaggcttttcaatttatgtagaaacaaccaaccaaactcttagcacctatggatagaagacaatactcttaactgcacaaaaagtatctatcaaaatcttacaaacattaatgatgaaactttattacactatattgtcacaaccattctacattctactggacctacgagacaatgcaataagatgagaaataatggaaggtataaaacttacaaagacattccaaagcagaccttatttgcagtcaacatatttgactacataggaaatctaagagaatctacatgagttaatcagaaagtcattgaatgctgctagatccaagatcaatataaaaaaattgtatttctatataccagtaataagcaaattgcaactgtaatagataatggtatatcatcaacaatggcaataaaactgtaaagtgtttaggaacaaatcataccctttagattagcaaattaagtagttaatttaaaagattgaatacaatgtggataaatgggaactttcatatactgggaatgggaaagtaaattaatgcaactgctttggagaatgcattagtccattttcgtgttgctataaaggaatacctgagattgggtaattttttttttataaaagagattttatttggctcatgtttccgcaggctgtacaagaagtgtggtgccagcatctgcttctggggacagcctcaggaatctttcaatcatggaagaaggtaaaggcagagtcagtgcatcatatggtgagagagggagcaagagagatggggggacagcccagcacggtggcttacgcctgtaatcccaacactttgggaggccaaggagggcggatcacttgaggcctggagttccagaccagcctgtccaacatgatgaaacccggtctctactaaatacaaaaattagccaggtgtgacggcgcacgcttgtaatcccacctgcttgggtggctgaggcgggagaatcgcttgagcaggaggcagaggttgcagtgagctgagatcgcgccactgcactgcaacctgggtgacagagcgattctccctctccagagagagatggggggaagtaccacactcttttaaacaaccagaactcagagaggggaactcactgatcaccaagggtttggcactaagccattcatgagggatccacccccatgtgcacagttcacaatagggttggtgctcctatgagaatctaatacctttgctgatctgataggcagtaatgcttactagcctgctgctcacctcctgctgtgcagacccattcctaacaggccatggaccagtaggggtccgtggccgagggactggggacccctgttctacagaatgttcagcacacatgctcaaggatacttatgcaaaaatattcattgtagcttttcaaaacaataaagatttgataacaaagtaaatgaatatcacaggaaaatactatggttgtgtagcaaataaaataaataaatgaactacacttacgtatatcaatttatgtgataaaagcaagtttcacataaaaaagaatagtgcttaatataaagtttaaaagcatgaaatccaatattatagagatacatgtgtatgtaacaaaacataaagtacgatgaaaaggggtaaacatttggccgggcgcagtggctcacacctgtaatcccagcactttgggaggccaaggcaggtggatcatgaaatcaggagtttgagaccagcctgaccaacatagtgaaatgccatctctactgaaaaaacaaaaaaacaaaaaaacaaaaaaacaaaaaaaactacaaaaattggctgggcgcggtggcaggtgcctgtaatcccagctactcaggaggctgaggcaggagaatcgcttgaaccctggtggcagaggttgctgtgagccaagatcatgccactgcactccagcctgggcaacagagtgagactccatcttaaaaaaaaaaaaaggggtaaacatttaatgccagaaagggatttcttatgggcatgggaggaggaaaatgttataggagtttacatatatttgtaaagtatcccttcttttaaaagatttgaaatgaccaaatgttaatgtttgataaagctattagatacaggtattcttttaagtattctgagcttttgatatattttataatattttcaaaagtgagatgatcttccaggaagctgacattttttatctcatggaccacatctagtgttgcagaacttagggtttctgcccagtgagtactccaattctctcttagttctctatctcccctttgggagttagtttggtcaaacctgtgtaatcaccagggaagcacaacaaaagccagctatttatttgttctccctatggcttttctttttttttttccccctaacatgaattaaaactcgtgttctggtttctatccccatgacgttgctcatcaattgacattattaagcaaatacttcaagaactttgaaatttctcttccaattcctcagggcgtggcgataattgtgagtggaaagacagtgaggtgggattaccaggcaagcttttgttttcttcttgattgaaaggatttactcctctttttagcttctcattgaatcgtttctttctaacaagtatctcacagcttttctctctcttttcctaaagcacaatttaatttatttttatctgataaggcattttttaaacttcccttctatgtctactccacatagaacaactttgcttatcctacagaacctttgcgtcctcattttaccttcctctgcaactcttgagcaagccccgcccttgtctccacgccctccatcttggtctcccagatgtctttgtctttattatattttcaaaagtgaaacaaatcagttaagaagacagtgatatttctgtctctcgaaaacccatttccttggcctttcctttctctttgtttgggtgggaataggacaatttttgatttaaaaaactcagagttcccagctcaaaatcctccctaaagttaattcattcctgcccagttttatgttcaaaaatcctgtccttgattttttaggcagcatacctatgattaagcatacacagtgaatatccttttacatatgaatcatgctttccaatgtatatttctttgcacattaattttttccccaatagttctgtgaagtagacaggacagagagaattgccctcattttactcctgaggaagcagaggcatagagacatttactccttagagtttgtcagctgaaaaaggtagactttaattgaaggcgatagaagcaggacagttaggaaacggaaaagcccggctgccaggggttacggacacaggcaattccctatgaaagtgctttcttcacttgccttcactcaccagatttccttgaggcagcgggtgggtgagtatgcctggtatgataaaggttcactccaatacatgaacagaaagtatttcagttcaacaaaagcagagcctgggagagaaacccagggggtttacaccaattctggaaggaggcaggaaacaagcagaggggaaaaggacagaaggaaagtgaagggggaaggagagtaagtgacaaaggaggaaaaggtgtgaaacaatttgctcctagtttatgaaaattcctctttgaaaatgagataaagaagtaattatttgcatcacaaattaactcttcacttcaaaagagtagttaccacaggtgtgattctgcaatgtgagactttaaaagaacatgacttgggagaggtgggagatttaaacaataaaatcctgattataatataataggaaataattccagtgataaagggggagacagctaaagaaggaggtggttatacagggagctctctgcagagctcaggctttgaaaaggacatgaacagaaagcaaagggaggggattatagataagcttgaacacaaaagactatcatgaaccttcaagaacagaataaaggaggctaaagctgagctttacaaaaaagcgctaaaggctgcattacttagagtaaagagaagcacaaacatggagcaacctgctctttgaggaagtaaggttgtgtaatgtcaacagaagttcagcagtgcttacttttttttagtgttcattttgcttctgtcttctcctaggtgcaaaaagtagttgtaactgacatttctcttagagagagactgtatttgcgcagaaggagcacactgatattatcccactagggaaagggacagagatccccagagtctcagcctcaaagataggagaagacttaggagctccctggccacatttgagagaaagatggtgaaaagcaagtataggagcaacaaaaccaggaagacagtgatctaccacaccccccttccctgctctgctcaaatcttgtgtaattcttctaaaacttgttaattgctttgtgtgagtgaatttcccatggaaacagaagatgaaactcagcttggctccctagggcacatggtgaaaatgacagccaactttcagattaaggagccaaaggaaagagacgtaaggatatacaaccttcaattttttctttgtttgtttgttttgagacagtcttgctctgtcacccagactggagtgcagggtgcaatcttggcttactgcaacctctgcctctcgggttcaagtgattctcctgcctcagcctcctgagtagctgggactatacacacataccactgcgcctggctaatttttgtatttttagtaaagatggggtttcaccatgttggccaggctggtctcgaactcctgacctcaagcaatccacccgtctcagcctcccaaagtgttgggattacaggtgtgagccaccgcacctggcctggggtctggtattttaggacaaacgaataacatggctacatccaaagaaaagcgataatctgttgggaattacagcaaatgggagaggtgcctgaaggctgaaaacttttcacaaaggggaacagaatagattctatcaactagagagcaataaacaagcattgacatctattccactgcaaatgattaattcaagactaagccaatcatggtattccattcaccttgctaggatggattgctgctgtgatttaaacctggttaataagataaaagggggagttttgggagtattgggcaaagaaattacatgaggagaagagtggttctgcagttactgagcattgttgtgacagatatgactcctagaatggctccatcattacttatggaggtgaagggtggggagccagctcgagagcaaagcaaacctctggagttagcagacgggagatggaaagagcttgaatccatgatgactctgctaagccactgaatctgccagtctgaagctcatacttcatatagacttcttcatgagtgagtaaaataaacctcattgttgaagaaaatctgagtcagggttttctgatatttggggcaaagacatattctaactgatacaacgatatatttagctgaaagagtatgtgatattctgtgcaagtcctacaaatagcgtatgacactgactctgacccttaggatttaggcctcagtgttttttcaataacatgacaacattccctttaatatattcttccatttggagataattcaaatctcaagggaagtctaagacagtagctattgtaattaaaattcagtgactaagcaggctggaatgctaggataaaaccaacaagtcgaatagatgatgaatacaagatccagcattggttccaaaaatctacatccaaagttcaagaccaggcacggtggctcatgcctgtaatctcagcactttaggaggctgaggccggggggatcatcttgaggccaggagttcgagaccagcctggctaacatagtgaaaccctgtctctactaaagaatacaaaaattagccaggcgtggtggcacccacctgtaatcccagctactcaggaggctgaggcaggagaatcacttgaacctgggtggaggaggttgcagtgagctgagaacacgccactgcatttcagtcttcatgacagagcgagactacgtctcaaaacaaacaaacaaacaaaaatacaaaagttcaagacttggtttaatataactttagtggaaaacatctgagaattttagctgagcacatgtagcagatgttatagtctactgcctatagtcttacatcaaaactaaggcagttattcccccagctgaggggagtgttggtggcttatggccagtggctctcagctaagtccctgtccaggactggttctcagctgaagagaaccatccctcttaggttgtgcctcctccctggagacagatacttcttataactcagtaatatgggcatataaaagcctgttttgtatgcctaaagccaggacaagtttgaagggctatcccagatccagagacccctatgggactgccaaagtccttgttacaactgactcagagtcccactcctcttctgcccagtcttcctttatcctacgtgagtgttgatcctcaagttccgataaactttctgcatgtgaatctccaactcagagtttgtgtttgttagggacccatgtcatcatggacctcctgttgaagtgaggtcatatgggagccaggtagtacatgtaacattggcttaagtgtgactcatggtgggtcgttttcttagttcccaaatgtgtaaattccaatttgtaattgggatggacatatgtagcagttggctgaacatcgttgtgtgcttgaccctggagaactagtgtaacggggaaggccaagtgggagcttctgaaacttcccctcaaggcaagataataaattttaaaaatgacggtagatggcatgacagaaattagggtgaccattgaagatctagagaattcagggctgatggtctccactaatgcatcagtctgtcccctccagaccctggaggatgacagtagactgccacacagccaactaagtggtagcccctaattgcagctgtggtgccagatgtgatgtctttaacatggcctcaagtatatactatgaggccatcaatctggtgtgtttatgtgttcatttccatccctatcagtaaggaagatcagaaattcattcacttgggaagaacaaaagtttacatttactgccttgcctcatgactatacagattctcccatctgtggatataatactgtccaaaggaagctggaccacatggacattttgcacaacttttcattagtttgctacatctgtaacatcatattaatcagaccaagtgaacaactggcaagggctttggaagccttggctagacacatatactccaaagggtgggagattttaaaaaatactataaagattcagagactttccacattagtaaaatttttagaggtccagtaggctggggaatgctgagacatgcacttcaaagtaaaggacaaattattgtaacttgcatttcccataactaagaaggaaacccagcaccaataagcgtcttctggttctgaaagcagcacatttcacactcagagacactactctagcacatacgccagctgaaacatgagtctaccagatttggagagagcccagagcaggaaagggctctgcagcaggaccaggcagtagtgcaagctgctctgtcatatgatgattttggtcacatgatgtggtagagcctacagtataggaggtatcattgatagaaaaaggctgtgtacattttatggcaggcctcaataggcaaacacaaatagacccctaggattcagaagcaagacaagcaatttgcagcagagaactatacgtttagataaatattcctggtgccctactggttcctagtaggaacacagcacccaactatgggatgccaagggtccacacagcaaggactgcccattgcgaattctgacagacccccaaatcatgaaggcaggcaggcctaccaacaattgtaaggaaggaaatgatacgtttgggatcaggcattagcagagccagagagcacaaataagttgcacgcatatgtggcccagactactaggtcatccatcacatttgcactgatgcctcacccttagctcacacttacggcagcataaagtgagggcaaaagctgagtttgatttatgtacgggtaagattggaatgtagtagcaagctaaaaatagactattgctatataacaggaccacatccttagcgtgtcccagaaaattagggatgagagaaattcttcctaatggataaagcatcagatggtgcctttgtcgagagaaatactctgagataagatatgtatcacttataggcagtagtgaattatttggacagttgactctatacaacctgggaagtagaatgtcttagccagttgatgtcagccagctcctatcagtgctggcacaataggcacattaatggaccatgggtaaggaatggagacaccatcctaacaagactaattgactttatttttattttttttgagacggagtttcactcttgtcacccaggctggagtgcaatggcaccatctcggctcactgcaacctctgcctcccaggttcaagtgattctcctctgtcagcctcccaagtagctgggattacaggcacctgccaccaagccctgctaatttttgtatttttagtagacatggggtttcaccatgttggccaggctggtctctaactcctgacctcaggtgatctgctggcctcggcctccaaaagtgctgggattacaggtgtgagccgcagtgactggcctaattgactttcttaatcaggagaagatagctcttctcttacatgatggcgacagaaaagaatactcccttgcctaattttgatgataaatggataagtacaacaaccatgactgagaaacagtggtggtgatggaagctatttataggcccaacaacacgtgctctcacttgctaaggctgatctagttactgccactgctgaagatccagcctgacagcaacagataccatcactgagtctccagtatggctccatccctcaagaagaccaaccagcttcttaatggcaaattattcttcttaatgacaaaatgggtcctttccaccatgtgattccaccctgtgattttgatacgaatggacacttatcctattcatacaacttcagctagacagtgcctatgtagcatttgatccactgaaacaggatcctgccaaacattgcattggactaaagtaactgcttatgttaatggaagtttaaccttaattacttccttataggccttaactccaaatacagtcacattgggggttatagattcaacatatgaattttggaaggctcttcttttcccagaattgtctttgctgaaaatcaattgaccataaatataacgatttatttctggactgtcaattctgttccattggtctatatgtcttcttactgcaaataccatactgttgataactgcagctttatagttagttttgaaatcaaggattaaacattctccaactcctttcttcccacgcatggaaaatcactgatctcttttctgtctctacagatttacctattctaggtacttttctttttaaacagtgtcttttggctattctaggtcttttgtacatctatgtaaattttacaatctgcttgtcagttcgtgatgaaaaaggctggtggaattttgagagggattgtgttgtctatatatcaatttgtagaaagttgccatcttaacatattgagttttcaaatctcagaacatagaatgttagaggtccctgttcttttttaattttaaatttcttttcataatttaaacattttttctattgaggtaaaattcatatagataaaattaactattttaaagtgaacaattaagtggcatttattacattcacaatatcgtacaacaactacctctatctagttccaaaatattttcatcaccacaaaagaaaactgtgtacccatcaaacagttactcctctttcctttttctcccaacctcggacaccacagtcttctttctgtctctatggatttacctgttactctgaatatttcatataaatgaagtcatacaacatgtgacctttgtgtctgacttctttcgttagcacagtgagtgtcttcaaggttcattcacattgtagcatgtatcaacttcattccttttgatgaccaaatgatatcctattatatgtatataccacagtttgtttattcattgatgaatatttgaattctttctaccttttggctattgtgaatagtgcttctatgaatatttgtgtataagtactcatttgaatactttttttaattatttgtggtatataactagaaattgaattgctgggtcatatagtaatgctatgtttaaccttttgaggtaaagatccttgttcccatatgtcctctagggcataaaaatcccattaagctctaaattatggtttccacctagtcatttggagctcctcatgccaggagacaaacaaccaacatcatggaaaggataattaaatcttgatcttcaggagaaggtaggaatgttgtacagtgggaaaatggaagaatgcatttcgtacttgggtgattcactgaggtgtctctttacatctctttgcctaattttgatggtaaatggataaaatgcagcaaccataacttgagaaagtcaccatgtctctcagagccactccaccactgtgatggctaattttagttatcaactagactgaattaagggacacccagatagctggtaaagtattatttctggtatgtctgtgaaggtatttccggaagagattggcatttgaatcagtagtaaggaagattcctttttacccaacatgggcaggaaccagccaatcaactggggatccagatagaacaaaaaggcagaagaagggtgaatttgcttgctttctcttctggagctgggacactcatattctcctgtccttggacatcagaactccaggttctctggccttcgaactatgggattgcagccgtggtttcctaggttctcggccttgggccttaggcccagagttataccatcagctctcttggttctcaggcctttgaacttggactgagctaagctaccagcttctctggttttacagtttacaaatggtgtattgtgggacttcttagcctccataattgtgtgaaccaatttccattataaatctcctttcatgtatctatatctacacatatcctattagttctgtttctctggaaaaccctgactaatacaaccacctagaccagtagagtgctagtcaatagtgaggagaatctggaatagatcgtagaaaagggtgatgatgagaattactttggctctaagaccagctgctgtgacagagactacagtttgtcccactaaccttctccaggaagagataccagctagattcctgataaagctgtttctagcatttattatttgaagaaactagagccaagtggcatatagtgtagactacagtggatgctgtgatgtgctaccaagatcttactgaggaatttgttcccccagttgttgggagtgttgacagccaaatgttttcaattgaagagagcttctttgtctaagcatgccttctgccagaggcagcccccatttaataactgtctggggccataaatgccctgccctctacagagctccctgtgggattgtctgagttctctgtgtgactgcattatagtacaactctttcctgtgctgaaatctacttccttcagtctcctataggtgttgatccctaaggcgtacctcattaaacttatccattctccatgcaaatctccttctcagagtttcaatgagccctaaaaagtcaatgcaatttgagttgggtcattaaaaactgaatattctaatcatgggaaataatgagttcatggcactctgaactggttacacaacatttagaggattgtgtcctatttgaggtctagtatttttattttaagacggagtctcactctgtcaccccggctggagtgcaatggcgctatcttggctcactaccagctccgcctcccgagttcatgccattctcctgcctcagcctcccaagtagctgggactacaggtgcctgccaccacgcccaactaattttttgtatttttagtagagatggggtttcaccatgttagccaggatggtctcgatcttccgacctcatgatccacccgccttggccttccaaagtgctgggattacaggcgtgagccaccgcacctggcctggggtctagtattttaagacatactaataacatggttacacccaaagaaaagcaaccaagatggatagtgtaagaaaatattacatcaagtagaggtaaagcaatggaagctttggagaactgttttaatcccacaaagactgcgatgaggaggaaagaatagagatttctgtgctagaggagagaataggaaccaaaaggtggattttataaggcagcagatttgggtttaatgaagagaggaattttctaaaggatgacctgtcatgtgtcttaggaagaagtgagccagcttcttaatacagctagatgatcatgggtcagagatgttctagagagaatttctgcaattactagcagactgggctcaagtctcttccaactttcaaatccaacgattgtaggttgtgataaattacaggcttcttgaaagtctttcatatggagtcttagggaatctgtccaagcataataaaagactcaattatatcagtttttcttaaagagaaaaaatacccccatcactattagtcagtctggactggtgctgcatgaaataggataaatacaggattttcctttttcactttccccaactccaatgagtttgctattaaattcctttttttaagacacagaagcaacagattgtctttgtacaggtttactttttattagtaaacatatttacaggtttttagggctcagaagataattcatgtccttctagaattatttttagcctgtcttatcatagccttaggaatccagacttaccatatttactgataagaaagttgagctttagtaagtttatagacttgacccaggccatcaaacagactacacgccaatgctggaagctgacatcttgtattctgaatgaaacagcctttgcacatttcccctagtcatccaaattccaagttctcttgcctgtcataccactctcactatattttatggattgaattgtatctggcaaaaagatttgctgaggtccgaatgcctggtctttgatcctgtgttgaaaaagggactttgcagatataatcgagttaagataatgtaatattgcgttagggtaggcccttgtgattagcctccagaacggtgagagaatcagtttctgttgttttaagacatccagtttgtggcattttgttatggcaaccctaggaaactaataacaccatatccaaggcattgcacccaggcaggaagagatggaataagaggaaggggtgtcaggctcagatttcacaagggacaaagacagaaagtcttaaagaatagatgtgttctgctcctcattttctggccggaagaggaacacagtacccaagttagtctttagcaagcaagtatctgccaccatcagcctgggtattagagcataacatacttgtgcactgcactgtgtaagcaggagaaggtgccctgttaggtactatccatttttctaacaatcagactacaaagtcagccaagtatcctgggcacgtatagggaataaaagacaacagaaaaatcagattttctgtgagagattgaaaacactatgccaagtaaataggctctgggtgggctgtgaactagacagatatgataggagtagttgcttagggtgaaaataataatcacaagagtaccaatgataataataatctcttacatttggtagggctttacagttgacaaaacacttctgctatggtttgaatgtttgtgttgcctccaaaattcatgctgaaacttaatctccaatgcaacagtattaagaggtgggaccttcaggaagtgattaggccatgagggctttgccctcatgggtgggattagcttcttataaaagggctacagggatctacctgtgccttttgccctctgccattttaccacacgaggacacagtgtttaccccctcaggaggactcagtaacaaggtgccatcttaaaagccgagaccaggccctcaccagacactgaacctgccagcaccttgatcttagatttcccagcctccagaactgtgagaaaataaacttccattatttataaatttcccagtctgtagtattttgttacagcagcaagaatagactaagacagcttttaatatgtgatttttatctaatcttcaaatatactagtaaggaagatcgggctgtggctgggcgcggtggctcaggcctgtaatcccaccactttgggaggatgaggtgggtggatcacctgaggacaggagttcaagatcagtctgaccaacaaggtgaaaccccatctctactaaaaatacaaaaaaaaaaaaaggaagatcgggccttcaggtcactgttttactcacgaggaaactgaagctcatggaggttaaaccacttgcccaaagtaacttgtctgtgctagcactagaatgccagtctttgactcatttctgttcattttctttcccacagggtggtcagaaccaccctgggttcagcccagctccctctctgggacacatgtatccttggaggcctgtagccaccactcactcctctcagtgccctgcagactatacacaaagcaggagtcaatgcacaataatggagatggggtgattaattgaggtgagggtgggtggaacaagaggtcccaggtcttgtgcttggcacgaactctctggttctgcctctgccaatgtgtgctgcagacagctaagctgacactggcatcacctgcactgagtctctgtgtcatgaggtagtcatggaaactcactccttcctaaggtaatgaggagacaattaggtagaaatgagaaatcgagttaattgcttgtcatcccctctctgctctctgtgtatttattcaaattaagctttttcagttttctagtgtcagcagataccaatgatcggagcacaggcttgggagccaggacctccaggaaacagccagtactgcatgaatcacttgcccttcctgcctctttgtttagtcctgacccaagcattcaggaaaacaaatctctttgcctgacctcccttggcttctgaccgaaagtctctgaactgacttaattttaaccatctctggctccacatgcattcagctagtcattcctcttcctttagagaaaaagggaggaattcaaattaaattctacatttgtggaaatccagtgtaactcagagagatgtagttaaataaatcagtgatggacgttttgtggtgtgtattgtccgcatggatggtaaggaggcaagacctagaggtcatttgtgagtagggcccccataggctcagctgccacttgagcagagcaggaaaagatctgccaagatcacaccctttccttccctgtcctttccgtagggtctcttctctacagcaagatggaattatttgaaattcctttcatggtccttgcttctacttatctttagctcttcagaggtctgctctgtctagaatgcctttcctacttttttattacatctcaaccctggcaatacttgtccaagaagccttctcaaggctgaatatggggcttccaagttcatgaatttcaagaattcgtgggtttccaaacaccatgaattctcttttttatagacaacaaggagttcatcactgtacgcctaaattctactgtgggctagaagcttctgggggcaggaaccatgtcttcttttttttttgagatggaatttcactgttgttgcccaggctggagtacaatggtgcgaccatggctcactgcaacctccacctcgcaggctcaagcgattctcctctgtcagcctcccgagtagctgggattacaggtgcttgccaccacgctcggctaatttttgtaattttagtatagacaaggtttcaccatgttggctaggctggtctcgaacacctggcctcaggtgatccaccctcctcggcctcccaaagtgctgggattacaggagtgagccactgcgcccagccagccatgtcttttttgatgatgtttcccagtactaagcacaatgcctgacacatagaaggtgatcaatcaatatttattgaataagtgatggatttagaaaatgagtaatggatagagtattagaggattgtgtcctggaagaagaacatatttatgtaaggtctagggttcaatgtttgttgtaatctacgtggatttccatgctatttgcattttacccaaatagtgtgagcaactatgagacttctttgggatccagaatagatctgccccaagaattccgctctgcttcattcaggccaacctctctcctgggatttttggccatgctggctctgaaggtagtgagctctgagagtaagtgtgtgggttcatgtggggactgtagaggcagaggaggtagaatgaggagtctcaggatgaagaggctgaagtgctagcttggagattcgtttgggattcctgtaggaagctcttcctggatcagaagaaaatgcgggaaaaaagatgttgtctagaattagggataatagacactatctagaaaaggggtggctcgcagtttaatggtggaggtgacaatataacttttactttgtatctgcatgaagtttaccgtttttatagggcccttaggaatgcagcaaaatagaaagagtacagaactaggattcagcacatttgagtgccaggctgtcattaaccagctaggggacaacacttctgggcctcagttcccttttctgtaaatgaaggagagggcagacccaaatacgctctaaaaactgttccatgattctataaaaatagatgagtttcccgtgctaccattttagaaactggatgtggcaggaaagtaaattaatgtcttgggttgggttcttaggaaagtttggggtgcaagtggatggggtaggatgaggctgccccagggatctttgttccatctttttcttccccactctttctccgttcccctttacctctctggtgggaggcaatgtgctgtagtggcaaatcgcctggacttggaaatcaaacagagacacattttaatccatgctctgccacttactgactgtgtgtgacctggggcaaatttcttaacctccctctgcttcagtttcctcatctataacatggagtttgtcttcctgaaggctatcataagggttgaatatttgatgtgaaaaaaggacacaggaggttcgttattattcttcctcacaaatataccaatactgatgttgtttatggttttttttgttgttgttttttgagacaggtctcactgtgttgcccaggctggagtgcagttgtgcaatcatggatcaccgtagccttgatctactgggttcaagcaatactcctgcctcagcctcccaagtagctgggaccactggtgcatgccaccatgaccagctaactttatatttttttgtagagacagcatcttgccatcttgtccatgctggtctcaaactactaggctcaagcaatcctcctgccttggcctcccaaagtgctcggattacaggcataaaccactatgcccagcccgttgtttatgtttatgcctttagaactctggttttgacatggaattctatgatcttttactccaccgtctcatccattttctgtttattttgcatggaaaaacctggaaatcatctatttttacttttgcagattttaatcatctcaagtctcagcttagctcacaccataaacctggatgagctgggtggcacaaggtacaagaactaatgggcagacagaattttcccaccaagttacaatataaacattattataggcatttaaaaaatgctggcattggccgggcatggtgactcacacctgtaatcccagcactttgggaggccaaggctggtggttcacctgaggtcaggagttcaagaccagcctggccaacatgacgaaaccccgtctccactgaaaatacaaaaaattagctggacgtgatggtgggcgcctgtaatcccagctactcgggaggctgaagcaggagaatcgcttgaacccaggaggcagaagttgcagtaagccgagatcgtgccattgcactccagcctgagcaataagagcgaaactctgtctcgaaaaaaaaaaaaaaatgctggcattaaaagcattcacgagtaacaggtaagcaactcactgagagtgtgtgtatttccttattatatatttaaggacaagaggaataaagacagggcaagggaggccttggattccttgtaaagtcctagtatactttaaagttttaacagcaggctgggcgtggtggctcacgcctgtaatcccagcactttgggaggccgaggcgagaggatcacttgaggtcaggaattcaaggccagtctggccaacatggtgaaaccctgtctctaccaaaaatataaacaattagccaggtttggtggcacgcacctctaatcccagctactcgggaggctgaggaaggagagtcgctagaacccgggaggcgggggttgcagtgagctgagattgtgccacggcactccaacctgggtgacagagggagactccatctcaaaataaaaaaataaataaataaagttttaacagcattgcagcaggtatctgtcatggctacacactaacagctcttaaaagtaaatttactgaagttcaggatgtttcataaattatctataaattgtatcttgattctgcaatcaataaaaatagcttctgtaggtgagaagttaaatggcgagaatattcaggttccttctaaatgtggttttgaataacatttacaaattatttctgctatacctttaatctcagttgttggaggggtgacgtttaggatctgcaccaggactttgcaaagactgtccatgtgatggctttggacagccaccccgcctggtgccacccatcagtcctgaggtcctctggcagtccaggtgagttcctaccccccttagacaagtaaatgggcaaatataaaagcaggaaatgagctccctgagggcaggagctgtgttattcattgttgtatatctagaacctggggaagtggctggcactttgtggacactacttagtgagtctcagagtctgagagtacagtcacacattgtttaactacagggatatgttctgagaaatgcatcattaggtgatctcattgctgtgcaaacgtcatgtagtatacttatacaaacccagatcatatggcctactacacaatttaggctatatggtgtagtctattgcttctaggctataaatccagacagcatgtaactgtgctgaatattgtgggcaattgtaacacaatggggagtatttgtataactcgcgtagaaaagatacagtaaaaatatgatataaaagacaaaaaacggtgcacctatataggattcttaccataaatggagcttgcagactggaagctgagttcagctgttaagactgggttagtcagtgagtgagcggtgagtggatgggcaggcctgggatattactgtatgctactatagactttatcaacactgtacacccagactacactaaatttattttaaaagtttttctttcttcaataataaattaatcttggcttacagtcccttttttacctataaacttaaattttttttgacatttttgactcttttgtaataacacttagcttaaaacacaaacacactggatagctggacaagaatattttctttctttatgtacttactctatatatttttttctattttcaaaactattttttgcttttcaaactgctttgttaaaaattaagacataatcacacacattagcctaggcctaaaccgggtcaggatcatcaatatcactgtctcccacctccacaccttgtcccattagaaggtcttcaagggcgataacacacagggagctgtcatcccttataacaatgccttcttctgaaatacctcctgaaggacctgcctgaggcagttttatgattaacttttttgaaataagtagaagcatactctaaaatggtgaaaagtttagtatagtaaatacataaaccagtaacatagtcatttattatcaatattaagtattacgtactgtacacaattgtatacttttacacgactggcagcatcattttgtttataccagcatcaccacagacatgtaaataatgcattgagctatgatgttgcaacagctatgacatcattaagtgatagaaattcttcagctccattattatcttatgagaccaccgttgtatatgtggtccactgttgcccaaaatgtcatgatgtggtccactatattgggtccctgttaagcagaaatggagatgccctgggtaggaaaatttggtagtgttatgaaaagcatatctaaggtatgttctgaaccataagtttcaacagtgaaactacaatgggatgtgtcattccgtcttcagaaaatatccccatcttgaatgattctggaagttgagactctgagatttcctctagagagtaaaggaatggaatcagaaagccttcttagctaaagctaaaatacaagggtagcaaagtttgaaatgaagcccccatcccaatgtgggacagtgtttctcttggtgtgagaaattcacctcaccaaatgtagcccatcggattctacagagaggtagaagcactggccttgccattcacagttccagatacagtgaaggaaagaaatgaccaagaggaatgggcccgtaaaagtacaaggttagcctgacagttaattagaggtttgaaggaagacagactggctgttctagaaggtggtttactggctgatttcaaggacccctgcaagttgagaatgatgagatctgttcattttccttcagtgtaatgaatcatgcctctgatgacaattttgtgtgagtcatgttttatcagcttctttctgaattattgcttatcacttggaagctccccagtcatttgaagattgtcagaatgaagtcagattttagctggggaggtagaatattctgttttggaggacacatctggttatacctgacaagcagggacatcctggctccaggaatcttcttcctactgcatgccggaggacactgcacagtctttctgagtgggccaacagcctggcagctagaaatgggtacaaagagtgttccctcttctgctccctcagcaagacaggatcttgaggaaggctttccggaactcgatattgaaggtggtatagatcacagggttgagggcgctattcacgtagcccagccatgtcgtggcactgtaaagctctggggacacgtggcatgtctggcagtgggtattgagaacatgggtcaagaagaagggcagccagcagacaatgaaggcccctaagttgccaaataagagagaaactgggtaagggatttgcttactccttttgttataacatgagaatgactcacggttgtctactttatgccagccactaagctggaagttttgcatacccacttacttttttttataacaaccctaggccgggtgtggtggctcacgcttgtaatctcaacactttgggaggccgaggcgggtggatcacctgaggtcaggagtacaagaccagtctgggcaacaaggtgaaaccctatgtctactaaaaatacaaaaattagctgggcgtggtggtgcgtgcctataagcccagctactcgggaagctggggcaggagagttgcttgagcccgggaggcagaggttgtggtgagccaagattgcgccattgcactccggcctgggtgacagagtaatactccatctcaaaaaaaacaaaacaaaacaaaaaaaacccaaccctatgaaataggtgtgattagccaaacttttttaggtgagaaaactgcatgctaatgtctttcattcactttggcctttgttactaaatcagttttctagttgggtctctaggtagttctttactagtctttttctttttcaattcaattcagacgtttatttaatgcctacctatgcaaaacatgatcctaggcactgataggtatgaagaccttaaagatgtgactgacatcgttcctgctgttgaggagattacatctaggagttctagtaaactccctgatacaggagagagttggggtttgtcagtgacactgaacaggatgaactgccttcactaactctatagcatacctgtgatttattcatttttaatttctttatttaaataaagttcaggctgggcacagtggctcacacctgtaatcccagcagtttgggaggccaaggtgggtggatcacctgaggtcaggaattcaagaccagcctgactaacatggcgaaaccttgtctttactaaaaatacaaaaattagccgggtgtggtagcgcatgcctgtaatctcagctacttgggaggctgaggcaggagaatcacttgaacccaggaggcagagaacccagaactcaggaggctgagatgggaggattgcttgatgccatgagtttgagaccagcctgggcaacgtaatgagaccctgtcactacaaaaaacaaataaaaattaaaaaaattagctggtcatgggggcatacgcctgtagttctagctactcgggaggctcaggcaggaggattgcttgagcccaggagttcaaggctgcagtgagctatgattgtgccactgcactccagcctaggcaacagagtcagaccatgtctcaaaaaaacaaaaaacaaaaaatcttgattgtatgcattatggaaagcttggtaaatacagacaagtaggaaaaaaggaataagcacccaccactcaaagacaatcacttttgatatattggtgaatttctttccagtcttttttactctgtatttaaaataatctagattttttttttttttttgagatggagtcttgctctgtcgcccaggctggagtgcagtggcgtgatcttggctcactgcaagctctgcctcccaggttcaggccattctcctgcctcagcctcctgagtagctgggactacaggcgcccaccaccacgcctggctaattttttgcatttttagtagagacggggtttaccgtgttagccaggatggtctcgatctcctgacctcgtgatctgcccacctcggcctcccaaagtgctggaattacaggcttgagccatcatgcccggcctaaagtaatctagattttatcataccatatcacaatagtgttttgcattcttatttttatcacttaatattttaaataactaagcatttgttaaatatccaatatgtaccagacagttttattgaatcattatcttacttattgtttgatttatgtgttgtagctccatataatggacagcgcagttaagtggcttgttcagcttcataaatttcagcctaggtcttttgaatttccaccagagttagcatttatacacaaatacttttcaattatattgtgaacatttgataagtattactgtcatcaaatttccgatagcatcttctaccagctccacttaacttaacacaacctaacccaacccaacacagctcaagccaacccaaacttaccaagcacaatggccaccatttgggttgccttcttctcccgaagtggcactccccgaggttgcaggggccccagcttcaaagatgtcgataatctgccattgctgagttttcgaacttctaagctgagcttgggcgctatggtgggactcagggaattccgagtcttctcctctcttttcaactctcctcctctttcttggaagcctggtccacccaaggcagtgtcctggcagatgctgtagtaacgcttcagctccagatgtgccgggtcaggagagagggtctgcaggtgtgacaagagggaatcttgacatttctgggggtattgtttatcttctgaatgttcctgaaagggccagagaattcaaagaaggaagacggcaacacagttgtgggaaacctacaaagggaacatctgagggagtggtgggaccatgagaagttaagggaaatgaaatttgctttagactttacaactaaaaagcacccaccatatcatcagagtgaacaggcagcctacagaatgggagaaaatttttgcaatctatccatctgacaaaggtctaatatccagaatctacaagaaacttaaacaaatttacaagaaaataaccccattaaaaagtgggcaaaggatatgaatagacacttctcaaaagaagacatttatgcagccaacaaacatataaaagaaagcttgtcatcactggtcattagagaaatgcaatcaaaatgacaatgagataacatctcaggccagttagaatggcaatcattaaaaagtctggaaaacaacagatgttggtgaggatgagaataggcacgcttttacactgttggtgggagtgtaagttagttcaaccattgtggaagactgtggcgattcctcatggatctagaaccagaaataccatttgacccagcaatcccattactgggtatatatccaaaagattataaatcattctactgtaaagacacatacacatgtatgtttactgcagcaatatttacaatagcaaagacttggaaccaagtgaaatgcccatcaatgatagactgtataaagaaaatgtgacacatatacactatagaatactatgcagccataaaaaagaatgagttcatatcttttgcagggacatggatgaagctggaaaccatcatcctcagcaaactaacat

SEQ ID NO: 204 - DNA, 118714 bp, Homo sapiens
gtattttacaaagacccggttcaaatcataatctcatctagcatttgtcctaggaaagtcttatagattaaaaatctgtttcctaagaaacacagaattgcatataatgtttcagtttttcaggagggttcctatatgcatccactatatccactaaaagcttcatatatcactgaacttggcaacagctatataagaattataattccaaacaattctttatatagttacctcaagagatttgtttatgaaacacttcaacagcaaatatctcaaggtaaaattgaacaacacaaaaataagaaactgatagaagaactctgctttagtaaagccaaactgccccctcggtaaatatttattaagcaccaagctcacatatatgtcatagaaaccgatgatgatgtaagctttggccctccccaaaaaccagcaaccaagccattcctgcgaaaactggtatttattactgaaccatgggctgctgttctgttaacaatatctgaatgtgatcctgcctgatatggttgttgatatgttgcatgacttcctaagtaactggttgttaatcacgtcaaatggaaaaataacactgccaggtgtgaggtgaataaaaactgtaactattattgtcatactcttggaagagaagccttctcactttctgatcttccttaagaagaaaagaaaataatagatacaagtctggaattctccgaccactttcatggtgttcttcaaagtgtggctatgacatttggaaatctctcattgttttagtttatttttatttttattttttaaatttatttttatgtgtttatttttttagacagggtctcgctatgttgcccgggctggagtgcagtggcgcaatcttggctcactgcaacctccacctcatggattcaagcaattctcgtgtgtcagcctcccaagtagctgagatcacaggtgcaccaccaggcccagctaatttgtgtgtgtgtgtgtgtgtgtgtgtgtgtgtgtgtgtgtgtgtgtgtgtgtgtgtgtgtgtttttaggtagagatggagtttcaccatttggacaggctggccttgaactcctggcctcagcctcccaaagtgctgggactacaggcatgagccaccgcacctggcccccagtttattcctcttaactgttctccactgtacatgttcaccttataagtgtttgtcactgattgctctactgcgtaggttctttctctcagcacatccacctttcatatactgtgttgttaggcacacagcagtaacgacgtgtccccctgccagtccgatcttcctaagtcatatcatattagatgacatatatattttatatctataatataataatgaataatatgtatgttaaatatggctaagtgaacatcatggatagacttggagatgtacagaatagagggaagtatctccagcctcaggaggcttgtggaaagcaaaggaagttcagattctagacagctagctgtgctccattttatatatatatatatatacacacatatacacacacacacacacacacacatatacatataaaaacttcaggccactgttggcaccagccagtgaaatcatttctctctccagtacctcagcccctgtctcggctgccttcctcaatccctttcagatcccttggtccttggtagagcccggggggctcctaacataatgccttagagcaattatccttgcatgcatctgccttggaggtggctctgtgatttaatagagaatctcagtctttctctggctctgtgcttgaaaaagtctagttatttgacctcatcaatttgattgaaatgagctactctagatcccatgaaaatatacgaccatttcaacattttcacagagtttagtgttttattttccccattcatttgttaactctgtatgccttaaatacccattttgaaatccatagtattgtactgaaggatccagctaattttcagcatataattattgtatgacttcataagtaactggttgttaatcgtcttaaatggaaaaataacactgctggctgtgaggggtgatttttcttttccgcttcttttccttgggtttacccagttgaagcctgtgtatgctagccacataataaatgctcattagatagtgatctgatattaaccgtatgtgaccctagtaccttgagtgacttacaattttaatgacttttaatgaatatctcctactatgtaacacctgaatgattttaaaattttaattcatttctctttagcttttcaatccctttattcttaaagtattttaaggaaatatttttgcaagtgaaactccttgtttcccagactgcacctctttcctgcattctgaagtctgtttccacctgctggctagacattgctgtctggatgttcctcaagtttctcaggctcagcacatggaaatactcaacatcatcctgatcaaatgctcctcttcgtaagtctgttattcagtggctcaatccagagacctgagaatcaccggagacttctctctctcccccttcctcccatgactcatcatcccatcaattcttcctccaaaatacatctcacatctgtttcctctcctcattccccctgccacgctgttggttcgtgccttcttagatgaatgcaatacatcttacaggtcttcctgccttcagggtctgtcctctccagcacaccctctccatgggtcacgccaacctattctcccctccttgattcgagctttgcaactactctccctttcccaccacgtgaagtctacatttcttcccatggcttaaaaggtacttcacatgctccacttctacttgcacgccatgccctcccacagaccccttcactccagccttctacatatgccacaccccctcatatttcatcttaaatgtaaactccaaatttcatgaatgaacccatcaataaatgaaataaaaatatgcatcctgactgtcccaggattgcccaaagaggagcagagttaacttggatattcagagattcatctgtgtattgaatagttggggctttgcttctgctcactaattctttcatccaaaatgaactgtttagggcatcctggggaagatgtttttatcctgctaactcttgggaataggaggaggaagtggctggcaactgaaggctggaacacttgctactggtaatcgcagcttttaacgttgcacctctttagatacttgaagaattctctgttttggttccattttgtacacttttgaaaaataatctaaagaaatgagctgtgctcatagggcttcatagctcccaagaattaaaaaaaaaaattcactcaatcaacttaattcccttttctttatcttccctccctcgttctctttctgttccactctcttttctaagctgtttcactttgcaataccttgctggtaaagagttgcaaaataatgcaatcttgacttgttttctcctaagtatttgatttaaaactcctgtatctaaagaaatacacttggggtcattaataaagaaaatctttttatctgaaaaaaaaattcccaagagttagtgggatgaaaacttttctgcatgcttcaggcagctgtcagaacgaaggaaatgaggtaatcgagaaacggagcacagatcaatgtttacactcacgcaaaaggcgagataggagaagagagagagaggaatggtcattgtgggtgtttgagctcagatgagggcccctgtgggctcaaccaggtctgtgttttataatcctatcaaatgtagagctggcataatgaattcaaaatgaatttagataaaaatgatttgtgacttttcactttaaatcaaagctcattacccagcaatatatatggctggcactctataaataaaaatacatttattcagggtaaacttaatacacagacttagaaatttaaacagcccccaataatgttctaatttattttatgttccctgaagttctataatgaaggcactaaaagttcatgatacatatgccttagaaaatagcacctgttgactaaatgcatattgaggttcagtcacattacacagaatttcagaaagacaaaggaatttagttaatgttcaggaatcgttttgtgaataataaaaggaatgccagctctggaagtaatctttgaataattcactataagaaacttgggaacagtatataatgtagaacacattccaaaagaagaaaagctctgcaaagaaaaaataaatttgtgtattcatttattcagtatacacagcacatgcctctaggccaatcacatcagttttagccttgtaaaactaagcattaaactgatgatttccagatttatctgtctgagttaatttttattgtggcaaacacagcagcaacaataaagtcaaagtttcagtggcttacacaataaacatgtatgccttgcctataggtctgtggctgttgcgtggctcttctgggcctggctgaacttgggtccaagcacgccccatgtgactctcattctggctaaggaatgggggagtaccaatgaccatgccataccacaaaagcacacataaaacctttgctgagctcacgcctgtaatcccagcactttgggaggctgaggcgggtggatcacgaggtcaggagatcgagaccatcctggctaacatggtgaaaccctatatctactaaaaaaaaaaaaaaaatacaaaaaaaaattagccaggcgtggtggcaggcgcctgtagtcccagctactcgggaggcggaggcaggagaatggcatgaacccgggaggcagagcttgcagtgagcggagatcgcgccactgcactccagcctgggcgacagagcgagactccctctcaaaaaacaaacaaacctctgctggcaggtggcatatgtcacatctagtcacattcagttggtgaaaacaagtctcatggccaaggcaaaagtcaatggagtagaaaaatatactacctactgagaggccctgccaaggcacaaggcaaaatgtgggggcacatactcttattacggggagtggaataattgggaacaataatctaatataccataatatctctaatatgctttttgagtatccacccagtttttggtctggcccgcaatcttgggtcactgcaacctccgcctcctgagttcaagtgagtctcctgcctcagcctcccgagtagctgggattacagatacccgaggatgctctcagtttcacacagaagcaagaatctgttttacttccttctaccctttagacttactttggcgtgtgtgccttgataccaccgggagaatagctgacactatttcctaatctctcaatccatcaatcaagatggacagagctgaggtttcacctaatgaccttcacaactcagattgttcccttccctgaaatgctatcaaacttttggtctgcatttttcattttggttcttacctaacttcttagtattcatatatcttgtgcatgactttattttacactcctgttaaaagatcgttttgttgggtgcacaatctttagttgtcagtaattttttctcagaactgtgagcattactacacttcttctggcttccattgctgttgttggcaagtctactaacattctaattttccctttgtaggtggtctgtcttttccctctggtttcttttatattatacaatttcaaaactgaatgtctaaatatggattcattttatttgccctgcctagtagatgttgtccttgctatatctataaattcttgtattttatcagttctagaaaattctcaataattatctcctgagatattatctcctcttctttctcactagtttctcctatggggactataattagctgtatgttgaaatttttcctgctttcctcctagtctcttctttcattttttttttcattccctgtttatctatgctgccttctgggaagtttcttcactcccttacttccatttacaacttattttctcaactatgttttgacagctctttaccctatccactgagttttaaaattttaggaacatatttttcatttctgaaaattctctttgttgctttttgatagtttcttattccttaattattcttgtgattgcagtctttaaatattttacattccataactgatcatttcgatatttgaagtacatggggttctaaatttattgctttgtttctgtcaacttttacccatatgtcctcggttgatctttgataatgagctaatatttagttgattttaacctggataaaatctaggggtttcaattaagaatatttttcttatacagtgtgcatttcttttgcaatggtgctacaggacaccgcctttcatgtctttagcctgatccttcgtggaagctttggcttagctctcagatttggacactgactcaaggcctaaaagttgtagtgctgatatctgcattttttgcaaacgaatcttgccttttacatttgttcactctgctccattgccatttcagcatttggttcttatttttgtcatgtattttccctttagactcgattcccctcattttgaagactgcagaaatgcaacaaaatttttttatgcaggagctgttacagtattttcaagtaagaagtcttttcagtgtatctaatctaccatactgccagtagtggatgtctcagggttattttttactctgggttcgtggctatgctcctaataattgagcttgccaagagttgaaattcccagacaaatggagcatgacttaaattatttaaaatttagaacatcaaagttagaacacttaagcccaggcatggcggcttatgtttataatcccaacactttgggaggctgaggtgggaggactgcttgagcccaggagttcaagaccagactgggcaacatagggagaccccacgtctacaaaaaatgaaaataaaaaattagtggatgtggtcacatacacctgtgatctcagctactcaggaggctgaggtagaaggattgtttgggcctgggaggttgaggctgcagtgagcaacgatagcaccactgcacaagaccctgtctaaaaaaagaaaaaaaaagaaaccttcatttagactttcttgatcaaaatggaccctgtgccagaactagtttgctcaactgatggacacactgtgttgactatgctgatgagatcatgtgattgttaggtttgctgtgcccacagggtgcaaataaatcttactgaataatgacaatgctataaactcacacataaaggctaatatatagctataatcacaaatacttagctagtatggctgaattcctcagattttactataacttgatttatgataaggaggctattcaagtgagcattgacattattggcctgctatcatgagcttgggattctgatgtttattattctataatttatctttttgaggacagatattatctattcatataatttgttctttgaatatcactatgtcttgttttccccaaaacagaaagtgatactaactgctaatggatcaggttttgtgaataagaggctatataaagtgaaaaggctatagaagtgagaaatgtttacaaggctatactctcattaagtagagtaagtgtttagtaaatatcttaattgaaaacattaatttggcaaggtaatgaattatagcctatataaaaaacaatcacacagttatgaaaatgtgttaaaattagggtttctgaccatttttaagtaaattatgttcttgatttaagaattttatatttaacaatggtttccaagatgtacacaaaaattacagtagaagctaagaaaatgtctgtgccctccccccatcacatagaactaggtaattagtactttcagtaaataaattcccttcaattagccagaattatattgaattgtgctatatagtaaataatatattcacatgaggttttatagtattactgctaaaagtatgggtcctaccaacaggtgactggaatgaagggatgagctgattcaggcaaggatcaataaaaaacacttgcgcagattcgaagttactatcgagtgagaatcagtttgcacaagtctttcatctcagctctgcatgaagcactccttggaacctccttaccaactgtggctttaagaatagactacattcattcactcttatttaaacacatacattatatccctgtgtacatgtcaatcatttcagtttcggtgcaaaaggctggatattcacaccagataagtcaaagttaaaacatattaaatgaaatggtatttcaaagcttgcatgctctacctttaaaaaccagtgagccaaagatgttcctattatttataattattgatttctgaaagtttgtgttaatacatttcaaagattaacattgaaaagcctaacagaaaggaataacgattcaactttttggcaatgtaaatctattgctagggctcgatatcatgaataaatcttaactaatttctttgacatcttgacatttcttatttctccaaaaattacattttcatagaaaatatatttatacttcaaatagacttatgatggtatttaattgcacttaaaaactcatgctcaaaatttcagtaccagaaactagcatccatcatctcgacagcaaaacacaaaacgtaagaaaaactaatcattcctttaagtgaaataaggcaatttttacctaaaaagaccttgaggttagtgagggaaaaaaagatgcttgaaatgtaagaaaagatcctgaagtatttcttttcatctttattctctctgttgctttttcttttgatttgaaagatcagatgagaccacatataaatatgtctgggaggtgtcttagagaacttaactcacttcttaaaaagagaaaagaactaaatacattatgtgataaataaagtattttttattgtacattctgtttgaatccttgttctctcaaaggctagaatgaaagaaagaacaaggaaaaccccgtgttttatgatttgtgacgataatagtcaccacaaggtagtttttttcagtgttgttaggacacagttaacgacaacatataagagaatctgcatcgttcagtcacaaaatcttctcttcaaatcagaactacaaactgtattctagatagatatttccctgttagtaaaatataaactcagacatggaaattctacatctttttggagaagtcttaatgattacactaggatcaacagaatcctacaaccaaaagtcaatttttatacttttaacttgtactaactatgctgttgagaaagctgctttcaggatgtaagaactaaattataattagtgttttctaataggtgtgcaatacagagctggaagcaagaataaaattattcacttcaagaaaaaggaatatgattatgcgggaagtatgtgaagtgaaaatattgtatgaatgttttacagtaattatttaacacaatgccatatatttaaattatcttttcatatgtcatttgaaaacatttaggtacatttgaatagaagtgggtgttctttgtgtatctgtcaataagtagttttttacatttgtttattgcatgaaaatataattgtaaagggtttcatagcctattcagtgtaagcctatatccttcatatttgagaacttcgatgtttggatttaaacagagcaaattgtacatgctttggaggaaaaaaatttttaagtgattaaaaaatatttcttatcagataataccaaagtcctattataccttcttttacacaccataatgaattagtgatcaagaacacaactgtagatttaaactaaaagaaacaaaaaagaaagaacaaaaaagacaggctgcatagtgacaagaatccatctcccttcatgccagtgaggttctagctgtgagcatgctcagaacatgggaggcactgaacttactacatcagaactcctgctgaggtataagaggatacgtctaataactcaattgctgtaaacctatgattgtttttctggtttttaaacatctcttcagcctcagattgattacaatgttctttctacttcatttcatcgttctgatcaatgtcaaaggtaaggttgctactttctcgttttaaatgagtgcaattcccaaaaaatacatttctatgtagttctatggcagttgtaataaatatattggggtgtttaaaaaaaaaacagacatcaaatttgcctggtatttgtcattatctttcattgcttgtagtcccacacagcctagtaatttttagatgcaacaaatttttcatggaaacaagcctttgtatgttattaaagctgtagataaaatatgtcaaaaaacaatgttgactatatcaattaaaacatagaaaacatttttggcatttgttctgaaaagtgtgacaaattaataaactaaaattgtgttttgtggaatttcaacctgttgaaatatgcccataaaattcaagtaattattagtaactatcttgcgtgaacataattaaactgggaactccaaagccacaggcagatctaaaaaacagtatctgtctctaagagtaaacctctctaaaataaagttattaaaagtctatacaagtgcatttacttagataattttcttttgtttttaatttgtggaaatttttatttcagtcaaactcttaagtttcaagtcagtaccattttcattgtaaagctcaccaaaaaataaaacctaaatcttcacttgtttttaaataaaaagatacgttgtcagcctatacattcataaacaacctattaaccacacccaagatttgctggggtttattattattcaaaaatgtttctattttaatttgtattttttcttaaagaattttgataaacctctgagaataaaggttaaaatttgaaattatttttattttctgagaaattcgttttaggttttttaaatattcagttttattaggtgaattccaagtgaatattttaaatcttgaaataaaatgcaatacttatgaggaattattttaaaacttctaacaaacaaaagatttttaaaaggcttaaaatatctaaattttattttgaatttaaaataatactaaaactttactacaaatatttaaaatctatatctccatgcacctagcatgacttttattttatattttaatatctcttacatgaaaagctaaggattaactaagaagaaacaatatatgaactcaccttgcatgcagtacagttgcaacaagcagtctatttctatatttaaggtcctacttcagaagttcatgttctatccacatttgaatattcaattttatacaattttaagaatatacagctacaaagcaggttcttaagacatgtcatagagctcatctgtgcccttaaaaagttctttaatgtacgggactataaccacagtttaaccaattttactatacttttgcttttatacataatgcatttaattgattttgcttaaaccgtttatgagatgaaaaacatctattactaaaataacattttgtgatttaccataatgtaaagtcaccctttaaactaaaaaaaagttcaattaataatttttgtttgattttatttctaagtaaaagccatatttcaaactcctagtaccaacctaacaaatatttattgattataatcctggaaatttttattttctaattttatattacttttgactactaatttaaacctttatgtttaaaatgatttcttttcaaagcaagacacattaatcaatgctttgacattttattcctacttataaaaataatagaatttgctctataattagtaaaactcttttctttttcacaacaaaattgtggacaattaaaacggtaaggcttttcatagtaaccaaagaaagctcatttagagttgcctaagagtaaaggttgtctttttaatttaaataatatttgtgatagactcttaggccagatctaaacaaaacataaaattagaaattatgtgatcgtcttttcttctctgaccatcatcactctggagtgcctaaggaatgagtgattgccttaagctacaggcactaacagacaactatgcataatgtatcttattattattacgtgtgttttatcattaatttattcactgtgtatctctgttaaccagcttcaaactactttttaaaaaacatttcttaatggacaaattaggaaccatattacatatcaaaaacatgggcttatgtaggaaattaaaagcatgaagtattgagactgctacttggtaactaccaattgtgttttgtggaatttcaacctgttgaaatatgtccataaaattcatgtaattgttagtaactatcttgcgttaacgtaattagactgggaactccaaagccacaggcagatctaaaaacagtatctgtctctaagagtaaacatctctaaaataaagttattaaacataactttaaacttttaaaaaacatttcttaatggacaaattaggaaccatattacaaatcaaaaacatgggcttatgtaagaaagtaaaagcatgaagcattgaggctgctacttggcaactaccaattgctacttaaataatttgcttaacctccaaaataggttaaccaaaaccgggcccgaacagtattttgaggggagcagtgtttgactgccccctagtggccagactcaaggcatgcctggcatggtcctttcttacggatgtcagtttcacttggccactctgacttgagaaaaggttttccatctgaattttaatttcacaactttatattcatgctgtggatagttgtgaaaatcaattatgtttcaggccagtcatcccgaagactgacctgcttgcgggctgaatgaagcccactgtgagggaggaggaaaaagattgggaacatgggagttaaaacctttagagatgtgttatctctgaagacgccagctaaatacatctcacaacagatgcttactcgtgtgttcatcttactgtgaataaatatgaccagatgtaatcaaagagttttaaggcctctcacttgaagtgacaaaattgcctgccatgtgaattttagaggcaaaattgggatgctgctttctaataggttggtatcgaaaaatggcacatttttattctggaatatagtaaaccaaataaaattcaattagcaaagaatgattttgtataaatagttatgcaacaaaaaatgcaactaatttttagcagtacatatctatttaagagcccagaatggcttggtttatttatttggtaaacatataacaacattctttgggtaaaatgagtgtgcttgtttcacatgtgaagtagtagtggcattagaggcctaattatctaaaaacaaaaaataaacctctcatatgctttactcacccgtacttccaggtttttgcatgtattttaaaaaattaagtttgcagtgaaggtcaatgttgttatcagaaaagtgctccgaagcgaaaataaaacagctgattcaacagtcatgtgataaacagacttttgagtgttttaagatgtaaaaagaattgagattgaggccatacgcagtggctcacacctgtaatcctagcactttgggaggcaagcagatcactgaagtcaggaattcaagaccagcctggaaaacatggtgaaatcccatctctattaaaaatacaaaaatcaggcaggcatggtggtgcacacctgtggtcccagctactcgggaggctgaggcaagaagattgcttgaacctgagaggcggaggttgcagtgagccgagactgcgccactgtactccagcctgggcgacagagcgagactctgtctcaaaattaaaaaaaaaaaaattaaagaattgcgattgaaaatttaactttattacaaagtaaaaagcctttacaacatgttcaatgtgattgataaagttctagtcctcctttcccatcctcccccttcccactgttctgactcgggcccccttgctcctgttcaagcctctcgcctctccttcccatctttatttattctcccctcctccctgcctctgcaggcatctgtctcagatgctctcccggcctgtcttttctccattttcatgtctcgccctcctacccccatccctatcttcttgctgtcctcacctctgaaatctcccttctgctcaccttgggcctgctcttcagctctcttgctctctgagttcccatatcctccaactctgcctttgtcctggctacatcccattctcggtaactctcacacctgctccatcctgattggtcacatctggcttttcatttccaccttggaatacatctatccctagattcgcccccttaagtattcctgtctctaatcacctcctgtctttgccgagctccctccccaggggcttcctggatcttctttgtctcccttttttggcctttgccttctttctattatttgtctctatcccacagtctcctggcccgaccagtggtcaccatgtctgttgcttgctagaatacatgcccaaataccaccaaatgaatattgtatctctgtattacttcaatactggtgtgctctctttttctaggtccaatgatttgtctacaattctaaaatccagaaagctcagaaaactgagttgatcacctttgcctacaaaatctggtcagaattggccaggagctatttagattctttatgcacttattgtaaaatttcatacactgtgctatagaaaaatgttcatgtgtttgcttagggaactttgccccaggtcagtaggaaactatatagttcatagcatgtgcattaactttctaaaattctaaaaaatgttataaattctgcaacatatctctccaaagggtttctgctatgatggtacagatctccattagccatgcccctctacagatcaccaactgttctgtgccatattattctcgagtggcataatggctattttatttgcccaaggaaattcagtgttaatagaatgtgtctgatgaaggaaagataattttaactaattctccttttctctgattccagtttattttctattcaattgctaggtttgtttttgttttttttttcagtgactatattttttatttggatcattccaactgcgtttaaagctgtctgtttggggttttataaactttcattcttatttcatgatatattccttccattagttctttgagaattttaatcacgcagagtttaaaatagtctttaaagctctatcagctgggcgtggtgactcacacctgtaataccagcactttgggaggctgaggtgggcagatcgcctgaggtcagaagtttgagacaagcctggccaacatggtgaaaccctgtctctactaaaaatacaaaaaattagccagacgtggtggtgcgtgcctgtagtcccagctacttgggaggctaaggcagaagaatcgcttgaacccaggaggtggaagttgcagtgagccaagattgtgccaccatactccagcctgggtgacagagtcagactccatctaaaaaaaaaaaaagctctatcatctctttcccaggtatgaattccccctttttgcggagccctggacattttcataaagttggaagaatgtttctcctgcacacagctcctcaaagtagtctcagaagtacttccacatagcccagggagtgttcaggtctgaactgtcgcatctcagaggttttgcctgtgggtgaaccagttccaaatctcatgcccatttgcagtggtatcaccacttctttccttgctggccatgagcaagcattatttaaatcacaatcttgggcgatcagagttattccataccccatgctttgtcaggggctgagtcccaatgcttggcttcatgcagatcccagcctctgccagttgggctgcactaagcccctttctcaaactggcattgaacccagttgcgattgtttctgcagtcccggctccctgcagaacaagtggttttacgtcctctcgcaacagtggccttttctgaattcatgttctatggagagctttctctcctacaacccaaatgttttcatgaaaaagcatagtatcagttttttctgtgtctgtggaagagtatgatgtgagagcatattcagggttttctcacaatggatgaccttgatccagaagttcagcaaagaaggtagactttgtccttcagactgtccgttttcaaagattggatatgggtgaacatacagacaccagagatctggagtcgtgaagtaaagtgctacacaaacgttaagagattaggagacgggaggcagcagagcaacaaggatgctggatttggggtcagcaaacccatgttcaagtcatagccttgaccttgactggcgtttggccttcggcataccaaataacttctccgcttcatccacaatacttacataattatcgagtttccaagaaccacttgtcatgatgtcagagacatagattccagaactccagcccctgatgattcaataggtctatggtgggtcatgggctctgcacatttaggaagcagcccaggtgattctgataaacctgttcaatggatcatacacctggaaaaactggccaaaatatacatgggcttttttttctttgagatgctaatttttgttatattctttgtatgtatcaggattgctaattggattcacctggattgtttgacacattaattctacttgaaacggtgttttaaatttgggggcaatgaggacaaattaagtatttggtaagggaatagctgaatctacattgtctacttatcaatataaagtttcttaacaaatagtatagttcaaaaactgtaattaatatgctagtttacctatagagcagacttgatgttaattaccactcccacctttaagagaaattaataaactcataagacaaatggctaaggaagaatctcttctgatttggggccagattctacttcttattcatcacctggctttctttatccaattttttattcgattatagctcagccagtagacattgaataggtcattgcctctttctctctttttctgttattcacaccttgcctgggacattctgtttcaaccccacaggctaaaaaataatatatctattgctgtagatatttctactcataatttcctttcatgtaaacccatggtatataagaaatgtagaagacactgattctctttcattctgccttaagagccactgtaaaagtattcccttaaaagcctcaaaattcaatctgagggtgagatgatagttatgtaaactttcttatacataggaaaaggataataatctacactgagtgttacaggaaaactctgttcccttatttgaagccatttcctttttggctgtttcctgtttcccactttaaaatgccactcttactgtaataactaaagttaaaattaaccacttggaaaaataaattgccctccctaaaagcacagggttgtgtacatgctgttatttttgttcattttacctgtgaattgtaagttttgaaaagaataaagcatgagaaaattacctgtgctgtgacccgattctcaaaattatatgggccaccttaccccatcctacatagattccagctgaaaaattaagagaggccctttgccaccgctcctcttccctagaaaatggcttaaaaaaaacagaagatgttgccaagcaagtttttcacttaaaaaaactgaaccattggtgtaagataaatgaaaaaaagaaaatgagcataatgcttctattacatgcactcaacccacactgacatcatcatcagcagatgtatgcccaagtttggcctaagcttctgacatggattatcactgaagcactgatgtgctctccactcctacatatggagctttaggtctttgtggctcacttacagaaacggcattgctattccggaaaatgttaattaagttcagacaacaatttttgaggcatctgctatatactaagaactgaaaacttttctagccattgagagaatcaaaattaataaattccattacttttaatggcaaaaaccacaatttattttgcaccagcttaatagtataataataatgacatgctataaatattacatagaggtatgtgcaagatggtttgggtagaaaaaagggaaagtttgtactgaggagtggttttgaaaagtctcagtaaagtttttgcaaaaatgacttctgagatgatcatcaaagaaataggaaatacagagaacagaacatgctacaatcttagtatcttaattatcttaaaagtcagagctgcaaagaatgttttcctaactgaatacaagataattgtaaaaagtgaaggagaactgtccactggccctgcttgatctgaaatcactttggatgttgtagtttgctcattttcaagactatatggtatgtcattgagaaatattccacaaatgtttatccgttttatttttcaaagacacttggattatttctggcttggggctattgtgaataattctgctgtgaacattcttgtatgaatctcttggtgcacatgtgcatgaatttctatgggcatttacctagaagtaaatctactgactcgtagggtttgcacaatttcaaacttagtagataatgataaactgttttccaaagcagctgttccaattaacactccaccagtgtatgaggatttgcatgattttacatcctcaccaaatagtgtatcattgggttttttatttttaaattacacccatactagtaatcttagtgatattttatcatggttttaatttgcatttctctgattatgaattagatttaataccttttcagatgtttttcgtcattcagatatcctctttcgttcggtacctattcaagtctcttgcccatttttctatttaccgttcatttttctttattgattagtaggacacctatacgtttgttaattacagaccctttgcaaatatcctctactctgcagcttgtctttgcactctcttaatgatgactttttttaaaagacaggccaggcactgtgtaaaaatctcgcctgtaatcccagcactttgggaggccgaggcgggcagatcacgaggtcaggagatcgagacctacctggccaacatggtgaaaccccatctctattaaaatacaaaaaagaaaaagaaaaattagctgggcgtggtgttgtgcacctgtagtcccagctactcaggaggctaaggcaggagaatctcttgaacccaggaagcagcagttgcagtgggccaagatcgtgccactgcactccagtctggtgacacagcaagattccatctcaaaaaaaataaatacaaggacgttcttaatttgtatattgtctaatttaggtatcttttcctttatgattagtacttttatttggcttttcttctttgtattctccttaatacatctatctcacagtcataaagattttttcttatgttatcttctagaaactgtattgtttctcctttcatatttcaacctattatctatctagaattgagcatcacctcgcctcactcctctgtggtacaaatgattacatatgtgtctgtcttcttccaaactttctattctgttccattggtctatttttcaatctttccaccaacatcacactgcctgaactattgtaccattataatatgtcttgccatacagataatgagtcctctctccttgttctccttcttcagtggtagcctggctcttcgtgttcttttgcatttccacatgcctttgagaatcaacttatccattcctacacacatactcctgggatttttattgagatttctttgaatctatagattgatttagggaaagaatgaacatctttaaaatattgtcctccacttatttatgtttgtaatgtctttcactaatagtatatactttacataaatgtcttgcccattttttgttagacttattcctaaatacatgaccctgttcatgctgtagtaaaaggtgtgatttttaaaatgtttcattgtctaattgtggctgaaatataaaaatacaattgactttatagaaactttgcaaaattcaccaatgctaataatttattattttaatattcacagtcatattatttatgaataatcacagttttatgtcttctcttccaatatgtatgccattaatttactctccttgtttaactccattagctaagccctccagtacaacaatgaatagatatagtaatagtggacatcatcagtctcaaagggaaacccttcaaaacctcactcatatgctgtggggttttatagataactacacttaattaaatcaagtaagttaccttctatttttagtttgcatagttattttaaagtcaggatctggcagttccatctctggagcctctcataaacggagttaaaaacaagtgacaaactgcaagaaaatatttgtgagtcacagaacagaggactaacctccctaaagaattctggttgcattgcccatttccgttttctcacacatggttcaaaacactggtcctgactattgcgtcaggaatgaaagtttcaccgtctcatcagcatgaattagatgaaagacaatcttttcaaaggaatacatttttcataaagccaaatgtattcctttgaaaagattgtcttttcttctgtaggtatagtctctctaatttttaacactaaaatactacttttctaataaatcaatgttaaaatatatggtaactcagagttttaaaatcatccttatttaacaaactaaaacattagtgacttttgacaggtttctctaaattctttaattgaatttatttggtctaagaaatgcaaaaatctagaaacctctgatctaacgcatgtcagagatagtcagtgtattgacaaagaaaatggagctgatgaattaaggagataaagaggaagaaaaggaatttttagaaaatatggagggaaaaaagtttttaacctggggacaaaggttggatgtgtcaaatgcagaaaaccaagcaagatgaggactatgaaagagccattggatttagtgtcaaaatggatgacagtgattctggtgagaagaatgtcagcggagcagcaaggtcaagatggaagctatggatttaagaatgaaagtgtggtaaagaagtggagacattgacttacttgtatggttcttctgagaaatttaattgtgaaggggaggagagtatatctcagttttacaggcaggcagatataacaggatttaggttggttgactcgtttgttttgaagatgggagctgtgcaatagagagacaaagatattgaaaatagctgggtgcagtggctcatgcctgtaatcccagcactttgggaggctgaggtgggtggatcatctgaggtcaggagttcaagaccagcctgattgacatggtgaaaccccatctgtactaaaaatacaaaaaaattagctgagtgtgttggcgcatgcctgtaattccggctacttgggaggctgaggcaggagaatcacttgaaccctggaggcggaggttgcagtgagccgagatcatgccattgcactccagcctcggcaacaagagtgaaaatccatttcaagaaatacatatatattatatatatatacacaatataggaaagaaaggaaacaatgaatgcagagtctgagaaagcaaggtcgaggtgagcacagaacatagatggaaggctttactataggaaagacaagagatcttcattctttgtgcatcacaaaagaagaatccagggacctggtctagtcctgtgcagtttccacacactcagcacgagcagtctatgtggatggtacccacgcttatgtgaggtgggtcctgcccaaacatacactgcagcctgggatgcaggtacattcgtaagttgatgggaatagaatctgggataattcccactcagaggaagaacagccagtgaaagttccatgggacatagcagtcaatgaatcagagaagaattaaaagagaggtgaagggaccaaggtaccaccttctctccacatttctcaaaccaagttcccatcgggcttccccttgcctgtctccttcacaatccccctttccatggtcttctccccttcacccaccacactgcccattctctccattcactcgcctcaggcaggctttaggaagaaggtagtctctcaactcatgcagaacgagatgaattttacatactgaaaggtaagattttaacctaaaagaatgcatctctaaaggtggagttttggcagtttaccagtcagcagaaataatacttttggaagagaagtcttccttcttcccttaaatcccttataacccaccaacagccacagcattctgtttgtgacccacataaagacacccaggcaaggaggatgtggggctgacatccatccctggtaaggatgaggttggcagtttgaaattctctttttttccaatgtaaatgaaaatgtattgagcctacactctgttccacaaagttaggcagcatttccccaaatctgtctttcaaacattaggcagtcatctgaagaaggaggggggtaatattttctgccccctcccccccaaaaaatctgtggatagggtcctgagggacttttaccagcatgaagtgtttgctttgtcccagaagaacacgacagaaaatagaggttgggagaaattccattagggcaggaatctctgaagtggaaaggaggtggggtaaatatgtgtgaatgaaactggatcaaacttctgaatataacgattgatgtggccaagaaacaccatccaggcggggagtaccaaacagttgcctgaaagggtaagattgccaagtttggaaaacaacaacaacaacaaccaccaagaggccaatttctcttcgcctaccttagcattaaagccttttaagaaagactttcctagttttctccaaacaaacaacaaatcatctatccaacaaaggtggacttttagtaaaattgactcttcgcagaagtaggggcaggctctggccaggtgcactccgctgatggagctacttctccttggcttctcagtggagccgcccgggacagtgctgctgcccccctcagagatgccagcccctgagttcttggtagtgatggacgctgtctgctttgctgactgacaacaaactgcggcacatagtaggcacttagttaacatttctggatgctaaatgaatgttccctctggtgctgcagttagttggctctttggaacagatggcaaggcttgccggcaatttctatagcccctctgaggcaccattgccatccttggtgaccaggtcgtctgacttttgttaaacaccactaagcgtgatgcactcctccttggcctatacccccctggagccatcgcccctggtgttagagccagaacatctggctgagaggatacaggctttcttcagctttatgtaggactagcattggcagagaaatagagaaagcaaaaagggacttgtatatctccatcaattcttaaactgaggacctgaaagatgattctcacctgttgtttcccaataatccagggaaagtgttgatggggagcaaaaaatagccttgagcagcaatccagttggctttaaaaggccatctaaacgtcattttaaaatctcttggcacagacacgtccagaatattgaccagaagacagaagaagggtgactactgagcaattctctgtcgtatgttcgagcctcctctcagctgtgtgtttggcagaggtcccatggaaaccactgcagaagccatcagcactgctaccatgcgggcatcctccatttttataatccccaagcttcagtaaaaactgtctctttccacttccacagagagcaggaagaatagaccacagaatacactttctacagagagctagtgattcttttttcactatgtaccaagtacagcaggggttcttaatttttatttaatttgtataatgacagagtggaatgataaatgaagtgcatggaagactaaaaaataatttctcatcagaataacagcctaaatctgctgctttgggaagcttaaattttgaaaagtgctcttccttcaattccttttttttttatttctaaatggctcattaattcacatgttcacttaaaaagttactgagcaccaagtaagacattaagttagacaatagagatggaagccacagagagaaaagggtggggaatacattgtattcatttattctccttatacataaaatttgtgctttgaaatgtcttcaggaagatgccactctggggtggaaaatggggaatgacaagaaatgcagtcggcaggttctattcgtacatgttcagtctcttcctccccttctttgtccacacttgttagatgcaactcaatcttttttctagggaaaaggaaaccatcttgatgccttttatttgtgacaattgattgcttgtttgcctctgccgcctagacgttctgcatatgtgagatgggcatttagttaggtccagccctcaaagaactcacagtcagctgggcgcagtggctcacacctgcaatctcagcactttgggaggccgaagcgggtggatcatttgaggtcaggagtttgagaccagcctgaccattatggtgaaaccccatctctactaaatatacaaaaaatagccgggcgtggtggcgtgtgtctgtagtcccagctactggggaggatgagacaggagaattgcttaaacccgggagggggaggtttcagtgagccgagattgtgccactgcactccagcctgggtgacagggcaagattccatctcaagaagaaaaaaaaaagcaactcatagttattttcataataaaccctggaaggaaacatcacatgccaccttcaaaagatcctattcacattgcctcacctctctatttcaaaattctctttaatcgaatgcttaatcgcttcttctaaacattaagaaaatattgttaggagattgtaaggacattttccttggttatttatcatttacagtcctccttcagctttcaaaagagatttgaaataaaataaaaatcatacatgtgatatggcttttaagatggaataacataaagaagtaggggaagcttttattttagtccctattatttctttcagagaagtcacataaaaaatcatgaaatgctgaggcacagcaagcttccattttacatagagcttccttcttaacattctattttcttacattgtatggaaattgcctgtgtgccgacatcaacccagggttaccatgggccaggcactctcaccacttcataagcatcagcttgtctagtccccaaaacatacccacaagggagatgctctcattaattctactataaatgtgaggaaactaagatttaaagaggttaagtagcttacctgaggtcacacagctagtgagtggcagagagaattctaatccaggtctgagtgtctctgaggtgcattatcactaacgaatgtgtttaaatagtgggtcacatcccattaggggatcatgaaatcaacttagaggcatgtgatcccttctcaactgaataagatagaatagcaatgatcaaagctcatcccacataactttaaaagagtgatatttcgggaaattttgttttcattatgtggatgtgggtgtgggtgtgggcatgagtgtgcgtgggtgtgtgctagtgtgtgtgggtgtgagagtgagtgtgggggtgtaggtgtgtgttgggagcgtgggtacggctgggtgcatgctggattgtgatataaaatatatttctaactgcaaattactgccttaaaaaatttctaagccaccacacaaagatatattgactctctcgttcatgttccaaacacaggaggactactcatttttataaatctgactcctatagaaatctttacaagcaagaaattaagggattttaaaatctatgacacagtatgcctctccctgcgtgaacaggtttaacaagccaaccccagtgccatgcagtggagaagtcttcctaaaatagtcacagacttgactggtcttatgcctagctgccggtagtaaatctttcatccactactgcagcaatagcagagaaaatgatttttgcttttgtaagatcaaaattccaatgagcagaaaagcatccaaaagccacgctctgagtcttcctcctcagtcagaaaagacccagaggttgtggccacaccagcctccgaagtgtgcaccagcacacccggctgaccccagagagggccagaggctctgcttttccgtgcttgcgggatctccagggtcatcaggactaaatgactcaagctgaaatgatctactcatcctaaaagcttaatgtgcatttgtaattcagacatagctttgttgcctaaactccaacccctgccctttaacaaatgacatcatttgttaatgagagcagcaggttctacctcctttaggagagtctcctgaggggcttctctacaaggcagcatttgcttgaagggctcaggcctcacaagagcattttcccaagaaccaaagtagacgtgccttcgtgttctcagtcgtttcctcatctttatttggggatattaacgccaaacatacacagttgccattaacatcaaatcaagtaactaggaaatgcccagcacaaagtagatgatgttcctactgaagtttgttccttatccttctgctatgttaaaaatatcatctcccacacccgcccaagggaattctgggtcatgatgctagccttcagccaaagtgcgtggttaggagcactttgcccacatccctcattcccttcaatgagtcatgatgacctatagacattcctgtgtctacactctccttaaatcaatttctgtgaagttccaattttttttttttttttttgagactgagtcaagctctgtcgtccaggctggagtgcagtggtgccatcttggctcgctgcaacctctgccccccaagttcaagcaactcttctgcctcagcctcctgagtagctaggactgcagcacgtgccaccatgcctgactaatttttgtatttttagtagagatagggtttcaccatgttggccaggctggtctcaaactgctggcctcaagtaatttccccacctcggcctcaaagtgctgggattacaggcgtgagctactgcacctggacaggactctttttaaaaaaaacatgacttctgtaattttattagccaacttaaaacatgtctctttattttctgaaaagtatcctctcaaaattgaaagaatatctcttacatttaaattgctagaattgttttggtcatcctatccatagatataatacttttgtaaatgtcgattatatttattttctttaatttcttattcaactcagctgttattcaactatcattggtcttctcttatgtaccctgcaccagaagattgtttctaactagtcctgatttatgctccttgaaatgcagattcctgaattgattgatagtctcatagtgcaatggctaagggtgggcctatggggtcagagggaggattcaaagccaccctgtgtcacttcccagacaaaccactgcacacaagatatttaacttccctaatcccaaaacatgaaggataatatcgcccatacataggctggctgaaagattaacaatgataaccactgtgtgaagtgtctggcaaacagtagacccagtagacacgatagatgagtgttcaatgttcaattctagttcccctctttctaatgtgttccaggatttctctctaactcatacttaaactctccttttgcaggtatatttttatcatgtcacctcaagtccttcttgtaaaagattaataagtaaatacatctacccatttgaccttattagctcatggttttacctttctgtttccaagggtggatgactccttgatttcatacaaatctaggacaatacatctggttttgtttatgattaccttgtggaagtgaattcaaaatgaacctggattctgttcttgatatagctgatgttgggtgtgattatggctgtttaaaatgttatcattggccaggcgaggtggctcacacctgtaatcccggcactttgggaggccaaggtgggcagatcacatggtcaggagtttgagaccagcctggccaacatggtgaaaccccgtctctactaaaaatacaaaaattagccgggtgtggtggttcacgtctgtaatcttggctactcgggaggctgaggcaggagaatcgtttgaatttgggaggcagaggtcacagtgagctgagatcgtgcactccagcctggcaacagagcaagactccgtctaaaaataaaaaataaaaaataaagttgtcattgagaatattattcaaagaaactgtgcactaagaataataccagatgaactcaactcatatagctcttgtgaaaattaaatgggacaacacggagagagcttggccatggtaacactttgtttttgccccttctttcatgtagattttgcactgactcaaggtagcatgatcactccttcatgccaaaaaggatattttccctgtgggaatcttaccaagtgcttaccccgagcttttcactgtgatggcaaggatgactgtgggaacggggcggacgaagagaactgtggtgagtgctcccctcggctccccatgtgtgcctcactttatgaacaccccaaaactgtgggtcggttggataatgattgtgataaactaggaaagctgatttggtgttctgtagggatttcctttgaaacacaaataatgactccccaatgtatttgtgataacgacctgaatttttgtaggtacaggttacttaagtcagaaatacagtatcataaaatgttatattttataaaaataaaattatatttgaaaatctacttcaatactcatattttaattataagcagttttctatgaatacctccttatggctggtaatttggttcagcttcaagaatattcgtaaagtggctgggagtggcggctcatgcctataaccccagcactttggaaggccgaggcaggtggctcacctgaggtcaggagttcgagatcagcctggccaacatggtgaaaccccgtctctactgaaaatacaaaaaaattaaaaaattagctggccgtggtgacaggtgcctgtaatcccagctactcgggaggctgaggcaggagaattgcctgaacccgggaggcaaggttgcggtgagcccagatggcaccactgcactccagcctgggtaacaagagcaaaactccatctcaaaaaaaaaaaaatgcataaagtgtgaatgggcctagctaaagaattaattgatagaacagacctatactgagtgcctgctatgtgccaggagctctccaaatcactgggacacagtgagctcaagggagacaagtgtcttgaccttgtggagttcacatgggtaatgtgaactaagatgatgataaacctgtatgtaaaaaaatcaataatctgagtgataaataaggaaatgaaacaggataatgagatagaaagtaacttggagggagggatacttcaaggatgtaaccagagaaaatctttttaagatgatgacatttggattgagaaagaaagaaagaaagaaagaaagaaagaaagaaagaaagaaagaaagaaagaaagaaagaaagaaagatactgtgaaatattctggaggggcagaattccaggcaaaggcaacatcaagtgcaaaggcccaaggctgactgaaacaggatgatgtgtttgatggtgtgtggctcaagcagagtgaacaggggtatacacatggaatgaaggggtaaccagagaccagatcccagagcatcttacaggccaatttcacctctgtttattgaaacctaaaaaatatttttctctggaggaaactgatgccaagagaggctgacatgtctagttaatccaaaagaatcctgtgtgttttctcccacagagagctacctctcttcagcactgcccaaccatccatcaaagtggggcagcaaagcccacagcatgcatctctagaatctcctgtcctgcccctgggtactcaggcgtgcctccctctgaaggacatagcctctatccacacttcccgtggatcacttctactcattctttagggcctggtttaagtgtctcctcctccaggagggcttccctggcccccctgaagctgtatcaccggtctaggatggctgcaatttctctgttatcacagcaccctgggtgtatctgtatgctgcacaaagtagaatgccttatcttttcagtgttgttgttgtttgtttgtttgtttgtttgtttgttttagagatggagtcttgctcttgttgcccaggatggagttcaatggcgtgatctcagctcactgcaacctctgcctcctgggttcaagtgattctcctgcctcagcctcatgagtagctgggattacaggcgccctccaccatgcccagctaatttttttgtatttttaatagagacggggtttcaacatgttggccgggctggtctggaactcctgaccttaggtgatccgcccgcctcggcctcccaaagtgctgggattacaggcatgagccactgcgcttggcccttatcattgtatttatcttcctagacaggaactccttgagaagaggcctgagtcttatcaccagagcttagagcagtagagtacacagcaggtactcagtcagtgctcagttttgggggcaactgtctggatgccaatgggcaagttactcaaattctcatcctttcctctttgctgcatgggaatcagaagccatgaatgtttaccccatgaggatttctgaacccaaattaaataatgcaagtgagggagcatcatagtagcatcattgagagtattaataagaaatagaaataaagattccaaggatcaaagcagactgtgggcaattattttaattgatttaggtatttgtgtgaacttcagtatcttacattataatgcatattttattattttataacatatagtgaaataacaatacttcacaattaggcctccttttttaaaaatatgatttaccaaaaggaagaggaaaatttggcaaataaattacatttacatatgacaaattgacattaatatatgacaaattgaggaaatgttattttactcaaaaacctttatttatttatttatttgagacagggtctccctctgtcacctaggctggagtgtggtgccatgatcatggttcactgcagctgtgacctcctgggctcaagctatcctcccacctcagtctcccaagtagctaggactacaggtgcgcaccaccacacccagttaattttttctgttttgtaaagagagggtctccctatgtttcccaagctggtcttgaactcctacatgcaagtgatcctcccacctcagcctcccaaagtgctgaggttacagacgagtgccgctgcacccagaaaaaagcctttgagaaactttgcttttgctttattaaaaaaaagtcagatgacataaatgttatcagaactcaatatatctatcaagtatgtttctacatatacagcagtatgcacgtgacaaaaacaaaattcagatattttcttcagaggtcctcaaaattaaagtcaaacatggacaatgtctgtattagaaatagatgatattttccaagacatttatatttatgtaaaataattatatacttgcattgcaaattttatgatacatacatttggagtatttttcatgtaaaaaagggacaccttgcagatgtttgcctaactttttctctcttactatgtatttaaaatatcaataattctattacttaaacatattttagtttaaaatcattaccaaattgttaaattttgtcagatggtatttagtttctagaataagtgacacatctcaatcactatttcacaggtgacactagtggatgggcgaccatatttggcacagtgcatggaaatgctaacagcgtggccttaacacaggagtgctgtaagtggttttgattcaaagacagtatcagctttgtgaaaaacatgatttgtgatgcacagatttatatgggtaatgtgacaaattcccttcagaatttccgttttagttcaatgtatttcactggctaacaggtctgctgtctgcctgtgattggaaagatagaaaaagaaaacgaccatctccatttatgctattttcatgcattactctctgattgcaagaatatataagtattgaataattgtgacaaatagtaaagttcttattacttttaactattttcttcaagaaagatgttaggcactgagaggacaacgatgactaagactgagttctaacccacaaacatctcacatgtagcaggaaagacagctccttacaaaagcagtgatgatataatattattgctaaaagggaggaataatgtttgcaccagggaatggggaagcccattggaagaaatgatggctgtgctgaggatggggaaagattcccagagaggataacatttgagatggactttgaagtccatggatgaaggaaaggatatgaggtgacaggatgagcagaggagcaagatcaacaaaacactggggtcagaagatgcgcagcaggctgcaggatgcctcttcacaaccattctgagtgcatgaggtggaggggcaggagccgagcctagaaggctggtgctagcccatgaagggttttggtgtacaccttgaagtgtggcctctatcccatagatagaatttttggggtgtgtgtgtatatgtagagacatagatatataattaggaagatgaatgtacaattacatacattagtatgtatatgtaaatgtatatatataacatatatatcaaatactacactgatagtattttatgtactctataataccagtttataattaccacttatatattttattatacacaagaatattctgtatgaaaattagaaagtaaaaaaggataagattaaaaataaatataaccaaaagttctactattctacctgagccacaatgagttgtcttgcccacatcccattttaaaggttactgctgtatagaatgggaaatcatcatagttttgggccttatgtttgtttgatttgttctatatttctttcattcttaatgaggaggaagagcatgtgatcagaaatgtatgtgaggaagattatttcattagaattgcagagaatggattagagcagcgagtctcagccatggcaacagtgcctgcaaagaacgtttgacagtgtctggagacttttttttttttttttttttgagacagcatctcactctgttgcccaggatggagtgcagtgatacaatcacagctcactgcagcctcaaacctcccaggctcaactgatccttccaactcagcctcctgagtagctgggaccacagacatgcaccaccatgcctggctaattttcatattctttgtagagatggggtcttaccatgttgcccaggctggtctcaaactgctgggctcaagcagtccacccatctcagccccccaaagtgttgggattacgggtgtgagccacgcatgcccagcctggagacacttttggtcatcctgatggaggagggtgggttgctgctggcatctagtgggtagaggccagggctactgctgaacatcctacaatgcaaaggacagcctcccatgacaaagaacgattgatccaaaatgtcaatcatgttcagatagaggagaaagaatgatgataaaagagttactggttattatgtttattccaatccccagaaaatgccattgagaagattgaggtagagagagatgcaaaaggagtttcagaaaaagaatccacaaaatcatggggacatgattggtttgcaggtgatggagggtgaacagttaatgctcacatttctggtgttgacagcacacccagcttgaccatatgaaattattctattggtaaataagtttccaaccacaggttttcaatttaatcatataaccactatttcaatggtggttatgtcaataaacattgacgtaagcatatgaaagttatctttaggaagttgagctaattaacatatatgtatagacaacataaaatattttccaaaatgtatacactaaaagcatcttttacattaagtactcagtagaagtttgttggctttactaataaaattcagtaaaatttatttttaaaataacatttggataaaagtgatctaaaagaagaagggcacctgaaaagaacttataattacattaaaataaataacaaaataaattcaaaaataactctcacattcttagctctatcagtacaaatattcataggctcagaggagaaatcagactccaaaaatacttgctctttctctcaaagcctcgctctctctcctctgccctcgtctgtctctctctctttcacacacacacacacacacacacacacacacacacacacacacacagtgactgtcctatggaccagcttggcctggcttctccttagatttctcactcctttacatgtcattatcctagtaactacgtaagtcccttcagagtacatcctgagtccttcttctttcttctgaatgcttcagatagatagatctttggttatttcagctttgcagctttttaccttcaactttcaacctcatagtaataaaaaacaaagaaccaaaatgaaggaatatctggctggatggattttagtaaggtgccagggtggttatggtagaacctgcatctcaatcttctcatggctctaagggaagtttgaaggaagaaaaaaaatgaatctgattttaaacaataaggatttattgagcaactattttatgctattcaaatgaattgactcagtcatatccattaagaattactcaatcatacaaatgtttttcattgaagtgaacttaatcttgcttcactagatgagtttatgctagttaacattttgtgcgttttttccaatcacttggtaaatgcctctgaaatgactactagaagctagaactgagattaacacattagtctgcatttaagtaggagagaattcttatttaattttattaggggctgaatgagttcatttaacagatgtaaattttatacattcgatgaaaagaaaacaatatcagttattaaaggcaaagtcataattaatgtatttgtttactagtgaaatcttactctttttgtcccattagttctaaaacagtatccacaatgctgtgactgcaaagaaactgaattggaatgtgtaaatggtgacttaaagtctgtgccgatgatttctaacaatgtgacattactgtgagtaaaacttaattattggtgatatctgtccctatagtcacatgaaaaccaagaaaaaacccaatagtgttgcttgtgcattagcaaaataatagaaaccctgtttaaaactaccagtcatcagagaattctccatgcttcctattcagggggaaaaaatggtttacacactgtatgttagattagcctgtcatcagttagctcacaaatgtctgtgggcctggagttcttattttcaattgctttctgatttatgtatgattactactgtccttgtgttgaaatgctttttttttttgttttaaaaggaagcacactcacttattctacgttttttttaacgttggtaatctatccaagactgcaaagatataaaagatccatgaagctagtagctatgttatatcatgcaaaattttctgtactttgcataaagttcttgaaagcctcaggaatttgcagtcatgtcatcatttgggcatgcatgagtgggttgggatctttggctggtttttggtttggtttggtttgttaatgcacccacagagtaaaaacaaagaagttaaatcaacatggacttcccagtctactatactaactggctacatttgtcaaatactcacaagctactttattttgctttataaacttttcattctcccatgaaaaatttttagttattgtcatgttcaaatatggattagtataatgaacgtcatcaaatattcttttcccaagcatgtggcttctagggaagagtgggttggccataacaatccataatgaagtttgctttacatgttattttaggtctcttaagaaaaacaaaatccacagtcttccagataaagttttcatcaaatacacaaaacttaaaaagatgtaagtagccgttaatagcatatttatttaaaaaaaatcctcgtggtggtgtaagatgtttttgatctaaaaataaaatattgtttgttatctttatcattacatttatgtttctaaatgtaattaagattagaaaataaaacatttgaaagtatgttatctttccatttcataatttgaaggagctgaacccattttatttaaactttttcagagaattaacttggagtcgaggtaaaacatctcaataggaaaatacacagttccattattttcctcaagatattgggaaaatgacattgcagattcagaggcactttttcacttgaaaaaaaaagagtgacagcataaacaagaacaatcagatcatttcagatacataatgatagggtacagatatcccccagggtgttaggagtgaaaacacaggagttatgcaaccagtgatattaacatatctgaggaaagaaaatgccaataaataggatatgatcagcagagaaggtattctgtgacaaagaagggccaatatgcttccagaatcatccaagaaagaaaaccgggaactgggaaatataatccctagagatgatctctcttggagggtcaggatgcaccatcaatccccaccacaattttcatgaacaatccctttgctttgattctctactcaccaagaaaccttaggatgatgaatttaatttcccaacttcttcattttaaagtatttgaaaagttgcatggcatagagaataagagcattcctataagtgggatgggatgctttctattcacattaataaatggagaatattcaggttcgtgtatcagtcatttgtaagttggatcaatatctgtcaatccctctgggccagttgctctgtggcactggaggggctacacctgctgagatgatcattagactagataacaaaattagcaagagaatgctgtacacgctgcaagcccccttggtggtaccatcatcttattgttttatccttcaatatccagcatagaggagaaaagtttctagaaatgtgaaatttatgaaaatccaggaataaaaattatctgaatctttgctgatactgggcacacacatttggtttgaaataccatcaaggattttgtgttcctgaatttaggtataaatttcctcatacaagaaaagaagtagctaatggaagtccatgacgtagaaccttgtgtgaacatcaatactcaatcatacctgggcttgattgtggcctctgtaaaccccggctgctctcagacctgttgcttcatcctaaagtatgtgggtatgtggtcatgtcattgccacactggagtagctatgcattggctctgcatgtccagattcctctagagaggaaattctaaccacattcttcctagtcttccaagaaatccctaaaatcacaacatgttcattagatgaatcaatattgtctttgtactgcctgaataatacatgtgggaggaaaaataaaatagcactagcagaaaggaagggaagagattttcgtttcagaattcttgtttcacagcaattgaaattctattttctagagtcatagaagttttaagaatttctaattaaatcttctcattacacacgaagtgactaaagtctgcaatggttaaatgactcacctaagatctacaactagtaagtggaagacccagaattagagccaatgtcttctgatgtccaaggtagtgcttactttaccataacaggaaaccttaagagggaaagaaatagttctagcaatcaactgaatttctaccagcacagactgtcccaccccatgtagaattcccttgtatatgttttgccccctaatctggggcaagctgacttctggggagggggcggagtcactagaggctcaagcaggagggttaaaattagacttctcaggccacgtccttccttggtctattaactcataactgtgttctatgccaatatctccctctgtggtcccaggccctgctagcccactgaagagaagaatatagaagcaatttaataattcaggtccacaattttcctagtgaaaaaagatagagactaacctttattgccaagattagctagcaatttctctaagtaaatgtctaattctactttgtcagagaaaacaggcaccacatcataacctgaatatcacctgacagggcttctccccatgcaagctgctatttgatgatttgcaggcaatttaattttcccagagactaatagaaaagaggttatgagactctcatcaataaacattcaccaagtgtctattatatgtaagataaagcacagggggataaaacacaattgcttacagtcatctaccactttttaaagtttacaaagaattccaatatttggaattttcactttggctttgatctccaaagtctgtgaggtggggcagacaccgttacagcagtttcaggaatgaggaaagctacttggggagagaggttgtttgcccaaagtcagtcagctgacaagtaatagagattggcctcaaacccaaaccttctgaccatgctcctttggaagcccacccacatagtccaggctcagaatatgttattatcaatgaaaccacccagtaagtaaactttgatttgaaaataactcaagttctttatactcaaatatcctagagcagctcataagctcaacaatgcttccttaaatctcctttcctcaccatcccctttacccacattcctcaactcctcctgctcttttccaaactcccagaaaaatagccccctgcaccagtcctacttcttgtccctcctgtccatctactcttacctttttcttcccaatcctcattcaatgacccaaataacaaatgtggcaaataccaaaccatccccaggaagggatgtcagttggaggaagaaaccagatgggcctcagccagaactcttggtatggaatctggtagcaggagagcagtagctagcaagacccacatattcattcactcctgtgatgaatatttattgatacctacaaggtgccaggcaccaaggatacagcatgaacaacacagatgaaaagatgaaattaagcttgtggagcttaatttccaatcaagaaagatagtcaataaacaaagtttaaaatatataatttgttaggtggtggtgagggctaaaaataaaccagaaagaggattagaaggtgctggggaaatggaatttcaaacaattcactaataattttgtccacattaccactgctcaaggcgcctctaaagcttcccatcattcctaaatttacccccaagagactgctcagaacacatctaattggtcttctacatacgtctacaggtatttaagactagctatcatcaccctccaccacaccactaatctcttccctaagtatcctcatttccttaaattcctccccaaaggacatagtttcaaatctgttcttcattctagtcacaataatctgcatatgtttacctacatttgtcttgatgggtgacatctagaataaatatactattatcaccgtaacatgaccgaggcaaatagggaagaactcgcatccctttccttctgcactctatgtgccctatgattatattgctcttttgatgacttcttgatactcttgactcctagtgatctataatttctaattccatgccacatgtgttgctgctaagtgatgtgtgtgctacatcttgtactcatgcacttagcatttgagagttagtcatgggtccttaaatacatccctagtcagtttcatcctgttagagtcagcttttcttaccggagtgtgaaggtctttttgtattttccatcatagtcactactcctctcataattatgtcatctgcaaataagatcaactaccttcacccaggtcatggagtaaaatattgaagagaacagcactaaattgtctttctatattccttcatcatcatccttcagataagaatatgtgtcattctttcttttgtccataaaaaattataaaactgcttgatcaatgcccagtagacatgtaacaatgtttatcacatagttttgcacagtctttcaaagaagaatatgaagttggtctgccatgtggtttcttgtgagctctcctggtcactctctctttgaggcatagacaaagcagcatcatattcacctgttctatgatcttcccaagaccagcattgagctcatccaactacagcttgtgaaaccaacttcttccctttttgagaacttaagactacatttgccatcttttactttccagctgctcatcctttctctggattcctcagcaactgatcataatttgatgttctcattttttggcatttctcaatttctgggagaaaatttccaaaccagagggctttaattaattttgattaacaccttctaccatcttgggctttcactgacctgccatatagcctttccatttgcttcaatcctaagaccatcttctttgatccagaacacaagaacaaagtaggagttgagaaataagcagttgttccttttatattatctcacaacattataaaacaggttccaggaggcaaactgagactttccttgacactttcttgcttctccaactagatacacatttttattgccacagtattctctactgtttgagttttacacatgactcgggtcaactacaattctattttcatgaagccctcactttccttctcgaaggaacaactctctgaccaccataccctcctcatgggctggacagtcctcctggttctctcttagtctattgaggcctgtgtcgtagcatacctagtaagaaacccataaggactaatgagtatttgctgaatgaacgatgggtagcactaacatgtagaactaaagagaaggtggggagcatcttcaccagggagaagaaagaaacataagcagaaatactcaaaggatgttgagaagagagtgaacatgcagtttgcctaaaggaaaggcatccccacaggagatgatggagcgtatgccggagaggtcactgaatcttgattgtatgccagctaaggcatctgaattttattctgtttgagcagagaacagacatgcacaaatatgtgttttagactgtattgagctaataaagttaatctgcatatttaagttgtattgggatatatcctatgccaggggttcccagaccccaaatcacagagcggtaccagtctgtggcatgttaggaactgggctgcacagcaggaggtgagtggtgagcgagcaagcaaagctgagctctgcctcctcctgtcggatcagcagtggcattagattctcaccgtagtgtgaacactattgtgaactgcacatgcaagggatctgggttgtgcactctttaagagaatctaaggataaatgtaatgcacttgaatcatcctgaaaccatcccccctctccatccatagaaaaattggccaggcacagtggctcaagcctgtaatcccagcactttcagaggctgaggcaggtggatctgttgaggtcagaagtttgagaccagcctggccaacatcgtgaatgtctctactaaaaatacaacaaaaacattagctgggcatggtggcgtgcatctgtagtcccagctactcaagagggtgaggcaggagaatcgcttgaccccaaaaagtccagattgcagtgagccaagaactcaccacagcactccagcctgggcaatggagcgtaactctgtcttaaaaaaaaaaaagaaagaaagaaagaaaaaagaaaaattgtcttctacgaaaccgtggggactgttgtcctgcgagatcaccaaatttaatgtcaagagggtctccagtctggaatgctctaaatattcacagtggagttgagatcatttaggcatccaaaaaaaaacaaaaaacaaattcctaaatcaaaattaaatcttaattgccagatgaatgtgttgcttaactgatctgaatgtttttaccattgatcagtttattcattttaataatcttttaaaatgtcaggcctttctaaattgggggtggatgcagtttcaaatgacctttcagggaaataaaatacaatttatggaattgactataatactttatcactgctaccatggaaacaaacagcagttctcctccttattgtaacaaaaaccttttataaattaggaattccttcttaatctgggttcttgttaaatacaatcactggaaacaaaacgaaactcaaggtgtctgcctggctcttgaatacaaaatggcacattcaaaaattgcctataaacatgcatgtcattaaagcatttatttgctttagtttcgggtacataaattcctggcatttctgcttgaaaagtcctgacagctgaaactgcaggaattcatgaacctgtaagttatccttagaaaaggcattcggtgtaaagtatattaaatgggcttatatctcagctctgaataaaaagagggcgccacttgccaagttgtcatgtttccaaatatccccacacattctttaagctactattctgcaaagaagacagcagagactagaggatggagttcaagttcagcagcctaagtctgagacatggaacgtaggagggactacagttctctatggggtggcaaccagctaactaaatagaagactagaagctcttcattatttaagagtttgagttttaactgatgtcagtgaagggagataggttgtacacatcagatgagttgtgtggatcactggttttactctttctttcccttgacttataagacaaaagcgtaaggtcaaattcacaatttgcaactgcattcatctcttcaagatgtgacaacatgtaggtaaaatatacattccatttttgaatttctcatcttgaataaaatgtaaatagcattagttaagcagtgaattgtatatttaagagaaacttcaatatacctacaatacagtattttgctctttttctattttcatttgctactgtaacataattcatcatattaacttcattgcatcagtctcaaggctctgaaagtgctaaaacagatattgatctgtgtgagttcatcctattcacagcagaaccttcaaccaaaagcagaatgtatgctgctctgtgaagcatctccccatagatatggtaccgggaatgggggttaagatggcacaaggtcacactgggtttcaagtttactttgcaggattgaaattgatgctttgcatatcaccacagatgtgatgttctgtagtgccaacacttggcacatggaggaacatagggaaaatgaccgtatttgtaaagtacttggggtaaaagattgtgtttgctgataactggaagcctgtcctggctttttttttttcctttctaataatctttatttactttcactttctttttttaattgaagttaaataagtgtactttaccatctttaccatttttaagtgtacagtttagtggtagtaaatattcatttgtaccccttcatctccccgcttcctgacctctgataacccctccaatcttggctttacctggctctcttcaggtctgaaagagtcaccatcctggcactcttataagacaatcgtgactcagaggcaaaggctggggagctctgctaggaaataatcatggtataacaaaattcacagtatagccagacgtcaaatgagcatgtgatctacaaatagttttgcagtagaatatcataacaatgaaacagcgctgtgtaatagtttaggaagcaattcaaaccaaaataagagaaatggaagccattcaaaagactatgtaacaatttgttactattagtatagttatttcctgcccctgagagccttcagagaataggaattcagagctaacttcccattgtacaatgaagacagcaaatggaaattatttacttagatactcctgacagcgcaattacggaatcaatactgtactattaagttgcttcagaggttaagtcagtcctgatcctatgacttgaaattggcatacttgccctggttcaactgctgatgtcctttgatatcctgagtacctaacttgccttgtccttctcactttgcatcatgaaatagaaaagaattaaagcttgccctctcctttatttcatgggaatagaataaggataaatgaggagttaaaggtgcatctctgtgcacaaagaggaagaaagttcagcagtgcgaggctggctagtctcacatggccagaaactcctgccagtcagaacaggacggtcaccatagtgccagtttgcagaaacaagactagatccttccgcagacacatcacactggagttcagcgtatgaatcagagatgcctcaatctcattgcatgagtactatgaggaaagcactggctagttggtagccatttctcactgacaacatctccccaacatgagaataggacttcgtacttcaatttcacaattgtcttcaggtaaagaaagtggagaatatgttcaacaacctaatatagtccataaaccataatcacctgactctcttatcttattcctaccagatttcttcagcataattgcattagacacatatccaggaaagcattttttggattatgtaatctgcaaatattgtgagtaacctctttctcatattgtaggtataattttaagcaaagactaaaaggatagaatggtactttttcaaggctcgacttgattgtagggaagtgggaggaataggttatcacaaagtacttagattagttattacactgaaagaattattaaacgattcctacctttaccagaagacatacaaaggttctccttaaccttgtcttctctagcttgggtcacttccacaatattttagcattttatttcttttctaactcttgctaacttgctatgcattttcttaaaatgctagtctactaaggatgtcaccaaaaaggacaaaagcaaaaattgccccacatacttagttattatacccttacaatctaacatgatgtaatatcccaaaacattttaggaccactttctctgccctggccctggtgttgcacacactgggcttgtggttatctgtaccttctggataccccttgaatttgccccctctgctcattcagccgaatactttcagacgcagatgtccatatccataatcatcatcagtggctcatattctaattatatgtgactaaaatagggtattgagtttgcctaattaactcacccatgctatttgtagatatctcaaccacaactgcatcacaaccctcagacctggaatattcaaagacttacatcagctaacttggctgtaagtactctaattcttctttctcccatagaggatcatagtcttgatgatatataacagtgctaatgtagtttccactatttgacatatcttatttttatacttgcttttctgattatcatataatctgcagaactttatccaggcaattcaatgtcatgtcaagtagtggttatgtgcctgtgcattttaggatgctaagaaccatctgtggcctctacccactagatgcctgtagtataccccttctcccaagagttgtgacaactaaaaatgtttccagacattgctgaatgtcccttgggaggaaaaattgacctctgctgaaaaccactgtactgaaaagtaagcaagttaagaacttgttctgctttccagagcattcagagagaagtctgaaaacatgatagcttgtagtatttcaccactttccagactgagccaccagctccgttccaagaaacctcacgtcagatgtctgtgctttcaccaggaaaatacacaaggggcggttagcaggctttctgtattgtttgcccattttctgcaggttggcctggtctagtggaaaaagccagggcctcaacttcatccaagcccttctgtgtgcctggcccttagccccatgcttagccttccaggcaactttttctttctttcctttctttcttcttctttctttctttctttccttccttctttctttcttttcttttctttctttctttctttctttctttctttctttctttctctttctctctctctctctttcttccttcctttctctttctctctttctttcttttttctttctttcttgtttgcttgcttgccttccttttttccttccctctttccttcttttttttttttttttttttgagacagggtgtcactctgtcacacaggctggagtgcactggtacaatctcaactcactgcagcctcaatctctgggactcaagcaatcctcccacctcagcctcctgagtagttgggactacacgtgtgagccactacacccagcgaattttttgtatttttagtagaaatggggtgggtctcaccatgttgcccaggatggtctccaactcctgagctcaagcgatctgcctgcctaatactctcagtgttaagattacaggcaagagccaccacgcccagcccaggcaactttcttaattttcctagacctctttattttcatctgtaaattataattcctttccaagaaggatgttatgaggattatatcacataacagttaaacagttccacatgcaaagctcctggcatatagtaggtgctcaatgtggcttccttctcccactcctgccctcaccggccactgcaagtaagaggaaacacaacctggcttcacaggcaacaagaggaatagaggcctatttccccttactctaatttcttctataaaatatagtttaaaacagtggtttgaatatgcaaatagtttcactctttcacccagaaagctccttatgaatagcgtgacatccatccattgatttaaacacaccttatttaatacatcagtttaacaccatgtgaccaaagaaccctctgtgatttcctaaaaattatactttaattcatccttcagctcagccaattagtaggttaaggcatttatggagcccaaatgcattcaatacgtggagtttgtgccagacccaggtacccagaggtgacagatacaacctgggtctttaagtccagcaggaggtggaggcagcagggagaaagcaaaacaatcaggatccaacttgataagtgggatggaagctgtaggaatttggaggaaagagttgctccaaccacagacggaaggaaaagctctcagggaagggacaggtgagccaagtatggaagcacacaaaggagtaggccaggtgttgaggggaggcaggttttatttcacaaatgtctctaatattggaaatgtttcttgatacattttgtcagaattctagatgacaatccaataaccagaatttcacagcgcttgtttacgggattaaattccttgtttttcctgtaagtattcatcaacctttcaatacatctatcgatacattgcaatgacatctagcactagcttacaaaaagaacttttaaaaaaatcaagcccacaaaaatttttattagtcaaaacttctcctgtgtttccagccacagttactgttaatataatacttcctggccatggctcaaagggaagagctgaccagatcataatgaatattttaagcctactagttgatttttctatcccttttaatttcctttagtactaaggcatgtttttatttgcagtggttgaccaaagatagtattaatttttatatcctatgtttatattttcttagaatctcccaggagttcatctccaactccatttttaatggaagaaaatgtgcctttgcccagcaagactcactgaaactttcaaaatctttgtcctaccaagagagctgtctcacaataatattttcactgtttattaatacactagaatgatttatcagcaggggattattatattcctttacaactgatcatataacatcattatttttccatttgtcaaaaggaaccacaatatcataaattaatcctgcagcttaacatgctcaagagttgttttctttccccaaattccccctactgtcacttctccaatttaatgcagtttccaatgtggccctttaatattataaatgattaatgatgcccttaagaagaaactttggatgtatggcactggaaatgattacaacgtgaagtttacaaggaaaattaccatgaacttcaaaattattacccaatatatacttttgtttcatctcataaaattaaactgtgtaacatctattcctaggatatgtatcatacttatgcattcatagtttctttgacaacatctgctccctaatctttgccatacacatgttttaaagaccattttgaaatagctatatatgttatcatcataagatattaattttagcacgcaagttttgaaattttaaaataataaaaagactgtcctaaaagtgtcatatcattttatttctaattaacattttctttgtgtaaaggtctatggttaataactacttagaagctcttcccaagcagatgtgtgcccaaatgcctcaactcaactgggtgtgagtatttatttaggaattaatttgttatttgccctgattaaggaaactagccataaagttaattcaaggttacctagaaagtccatctataatttctttccaaaatcaaaatctgatcatattaccttcccagtttcaaaattatttgagggttcccaaagggtgagggtaaagtttgaccttccctttgagcatccaagaccctcattttccattccttaccccatctagatgctatccctgaccctcgtatgcatgtatcaaactactactcctacagtcaattccctaagcatattgttccttggacttaaaaaatcttgctcccttattcttttggataacttaaacatttcctttgaaagacaacttaaacctcacctccaggaggtcattcctgacacaccaaccagtttcagcagccacctatgtactcccacacattacatcatctacaaaactccaccacactgccctgtctcagggtactatctcatccctatctcagggtactatcaccatatagtcattgggcttgtctttttttttttttttttgagatggagtctcactctgttaccttggctggagtgcagtggtgcgatctcggctcactgcaagctctgtctcctgggttcaagtgattctcctgcctcagcctcccgagtatctgggattacaggcatgcaccaccaggcctggctaatttttatatttttagtacagatggggtttcaccatgttggccaggctggtcttcaacccctgacctcaggtgatccaccctcctcagtgcttatgtcttctatactgttccataaattctgggaaggcagaaacctatagtatgatttcctaccccagcattaggacaatgaccagtacataataggtgctcaataagcctttgttaggatggatgtactaaaccatttccactccttgttagcttttaaccaatacctgtttaaaacattcatttaatttacgtcgtaccttcaccaccattacccaccattccctgccacatacaccttcacggtcttctgcaacaaccaggattgtcatgtctattgctttcctgttccatgaaaatgctgatggtagcgctgctggaactcttctctgtcaaatcatggaactcaagacccataagatgataaagttttagtacttcagcttttgatcccctctaaactaacctcaaaatctcttgttacaacactattaggtggtgttgtgtttattttctgatgtttatttttatgtatttatttaaatatatgctgtcaaaaggcttctaaaacagtagaggtctcacgtaagtgtgccactattaaaaacggaaataatgacctgaacaccatgagaataagaataggtgaaaagaaaatacttagaaactaaacaagtgcatatacacaatgggaaacacacaggaaagagtaaaggtagcagaaaaatatcaggagctcagcctgctctccctccccaaaaggggcatcagtcagcaggaggtgaggaaccagcctcagagctcagggttccggagacacttattttcacaatgggctcacacaaacacgtgggaaaaaatagacacacaataaaaacgcacaggtagcaagacagcctgattgcaattgagagcctttcaacacagagggtaggaagctgaaaggccagacaggaagaaaggccagacaggagaaaacctgtcctggggaggcttctcctcttccgttacttgctgtcaagttggacaattgctcccacaacaccaaagtgtccttcttcggagaacatgaaaaacattttttccattccatttcacaatatttggatttttaggagagtatggtgtttgttatttttaatcacagtatattgtgtgaaaaatgtacatctcaagttcctacacaaatctccaagatagttttaaaataggattttcttaaaatgacaaagggattggtgattttagtgtgactatgagaaaagttcagaagaagaaaaatagctattgccatatttggggaacactgtaagaagctgactatgaaaaggaatcaggagacttggcagaaaaatgggctgtttcttagtcccccgcattgctcaaagagggaatgtcagagtgttccggaaggcgctgtccacgtatgtgggatgccactgacctgcagaattacctggcaaaatgaaatctccccagcagtgcttctcagacatcagcgtgcatcgtaaacaatgggcgaacttgctgagacacagatggctggacttcagtactagagtttctgattcagtcggtcttgggcaagaatctgcatttctagcaagttccaggcagcgctgaggttgcatccctgccattctgagcagcattgcccttggcattagcgtccttgaggcatcatagaaagagcctgcactttggcatcacacagatcgggattcacatcctgtctctggtgttcagtatgtgcaggataactttggcctgagattctccttcagcaaaacagagacaagaacatctacctgatgttggagggaatgtgaggatataatgatcaatgacgccacagacatggtagttaagtgtctaggctttagattctgacagatctgagctgggtcagttctaccacttactagctgtgtggtcagaaggaaagtgaatcaccaaaagccttggatttctcttatgttaaatgggggataatagcagcaatttggcaggagtgctgtgtgatgcgtgtagaacagcacctggcaccataaaagcccaatcaatggtagtttatgatgggttgggcaatattataattaatagcatagcattcagcacagaaagacgctcgctaaaagttaggctgccctttcctcaattttattaacattagttggaagggggaaagaagcataatattagttatactaaccttgcaataattaggaggaaagatagtaacaactggaatgaagtaaaaataaacttgataaccattttaaaaagtatctctaagcatatgatttgtacaaaaaatattaaaaatatctttcctccatgacttccagggatttggaaggcaatagaataaagtatctcacaaattctacgtttctgtcgtgcgattcgctcacagtgctgtaagtatacaatggacttcactaaatgaggggaaaccctatatatttggaagttaaaaagaaaacattgacaaaaaattttaaagtagtgttttgtttacagccttggtctgacactgcagtgctagaaaatgcacacactgatttattgatttggatgttgggactgagcctcaagttaaggtgcccaccctttagggacatcatgtgccatctttatttccgtgcaccttctcagctgaactgggacctgaaagttccagtttcctaaccccatggtcaccaaggaagggaaataatgtatgtgaaaggggttagctgtacaatgattagctttacaatgattagccaatgactcttaccatttgatgtctttctccctaaagaaaaaaaaaatcataatttcatctaaaaggaaaaacatctaatgcattctgattggccaaagattctgcctcatgattctgatcgctgtttatattttttatgggggcgggaaggcagatggtttggtcaatcagtgcattcatgctggaaagcttcaaaacatcagtgttttggttttgttttaatgatagttttccacatttagtaagcacttagtgatgtttgttgattggatggatgattggaaaaaagaatggaaaaggaaaattaaaagagacattttctaaaataattagatccaaacaaaatgcagctttctagaccgcactcaggacctcaaattgctcatgacagcacttcctgaagagaacatggggatgtccacggtgaaaaagtcctgccttagtttccactccaaaagatgcctcccttgaagacttcaaaggaggcttataaaattctgcctggatcagtggcctctcccaatgagaactgattactacagcagacgcaaacccacatgctgattctcgccatgtcttacaggtttctgcctagaaatcaaattggttttgttccagagaagacattttcttcattaaaaaatttaggagaactgtaagtagcatcgtctactaggaaaatatgattgcttcttccgagattataaatttaaatgactagtgagactgctttgccactagtagcaatcaaaatcctgtagactattggatattaaaaatcaattaagaaaaccaacattatcctgaagtccaaagcacattcaaatcagacagtgggctaaatatggatttaacctaccctagtttctctacttgttttctttgggtgatttcttatttatgtgtgtttgggagtaaatgagttttccatggcttcttaaacacagggatcatttctttctactgactggagtatagttaattcccaataaatgtttgataatgaataactgactaactgaaataatattaattccttataactgaacaaaggaacaaatatgcttactagtccttgagaaattatgacttatatagcaggtgaagcaaatcccaatgctgagaatgagggttaggctcacggaaaaaatattcagagagctcatgtgaattttttctgttcaaatatttgttttatggatctaagccttttaaaatcatttctctcgctattaattcattgctccccacataattgtgtatcagtggaagttaaaactaagtctgttacattacacatagcagtgattaggatagaaaactcatctttctgattgaggccttaaaatggaaattaatttctgaattaatctctccccattctttacaccttattttgaaatccagaaaggattggagaaaataataagagtaatctaaaaaataactcatgaatagttaaggtaattcaatctaattaatgagcatcataaatcaaatccacacatatttatgaagtgcctggtatgtgcaaggtactgcattagaactgaaagtatgatcattttataggcaaaaacttaaaggcagctcattcagaaaagacttcctcccagggcattcctgcccaggctgtggaggatgactgtggacttgggttgcatggtggggtggaggaataacccaggacaaacagaggggttttttgtttgtttgtttgttttgttttgttttgttttgagatggatttttttgctcttgtcacccaggctggagtgcaatggcatgatctccactcactgcaacctctgcctcctgggttcaagtgatcctcctgcctcagcctcctgagtagttgggattccaggtacctgccaccatgcctggctaatttttttttttttttgtatttttagtagagacagggtttcaccatgttggccaggctggtcttgaactcctggcctcaagtgatccacccgcctcagcctcccaaaatgctgggattacaagtgtgagccaccacgcccaacccagaggggtattttatatataaacttaaggaaacagtggtacagagtccatatttttaaaattttcctaaccctcttcgcatcctacatataggcagaggcacaccaaaaataagagcccacttaagagatgccagcttgctattaagatctatagtgatccattgcaattcacttagcctcagaaagctaaaagaaattcagaagctggtaggcttaactagaacaaggcattcatatgtcttgagtttacaaatgttaagtagttttactgtgccttcatggcaacaaacccatccagggaggaataagcacaagtacttgagacccccaaagtcctttcctccaaaagagtgtgctttatttttctgggtaaccctttgaaaggcattttctaggtgtatgaaatcatcatcatattgctttattgtcaggctctctctggcctgtgtgcacctgtggtctcccttctgggctgagatctaggtgtgctcctctcatctggaggaccagatgagacatctcacttggcaggacttcagactttggtgtcatgacagcacctcaaaagcaacccatttgaaacagaactaacaagagaccccaacctgatggccagcttcttcacctggacttgccatctcagtgcctccttcctggtagccaggcttgaagaccattccgtttccctccaactttctcttaatacatgttcagccagaccctgagccctgctgctgtcccccttaaccctcatttgctctcacctggtccatgtagaagctcctgcctggtcttcctcccccaactcccaggccttgttgcctgtctttcatgcttctgacagaataatcattccataacccggagtaaatgatgccattgccctatttaatgttcttacttcttgttgcctggtgtttagcaaagtccttgacacagttctcaaacattaatgggccgaagaatcacatgggatattggcttaaatgcatgttaccaggctccctcccagaaagtctgatgtgatagttccaaggtgggtcccggggatgtgctctttttataagcatccttggggacttggatgcttggactctactatgaaaactactgccttgaagtgcacgcatggctttcccattttgtctccacgcactctccatgacgtcctctacctctccctacatcttgcatcctccacccatgttggatcacttcctgactcctgaaagtgtcactgaattccaagcatctgtggttcagatcattttttacacccacctgagaagctgttcttcttttaccccacctaaaatcatcaagctttcttcaaacacttcctaatgtcccaggccaagactgatgactctttcctctatgttttctctgcacttctataatagcacctgtttgattgtttccttgtttgtatctagttgctactctaaatgtaagcttctttacaaaaagagctaagtcatagttatttgtaactcccacataaccatcagcagttccagagtatcaaaagagatcatttttgtttgactcttagttaggcaactgtatatctgttttaacatcttctctggctcagaaatatactctggactcttaaagattcatttcttctgattttaacaggtctcttttccacattttatagagtcactttcttaggattctgtctggattggacagtcctattatatttaattctaaacttgcaatttcttctgcaaaaatagtcttgtagaagaacatattaaaagcgtgtgaacttattcaagattatctgggcagatactgagtggacaatattgtcttggttggaatgcaaaacaaatcaaagatgcaagacttgacctcgaaaagtgtagttggataaacaagagaccacgtatatgaagcaagtggcaatcacagaagcatgaagagtagaagtgtacaaagagtatctagagcaagggaaattaaccaaattagatatgaaagccaggttgggaatgtgtttgagagagggtaagaggaaattccagataggaactggacgagcaaagtgttacatgtaagtgttggaaaccgtatccatttggctgactcatacggccctgttgtgtaacaagttatcaggttggttaaattggattcatattttctgttacatcaaatgggatgatgataattgtgaggagtaataagtctgtcatttacttccaaagtaattgctttgggttttcattgtcgtcaacagggatctgtctagcaatacgataacggaactatcacctcacctttttaaagacttgaagcttctacaaaagctgtaagttctacttctcaccataatcagatttaaagggcaatattttgagctttcaaaataataataccttcaaacttcttttcctctctcatctaatggtaaaaaaaaaaggaacctgtcatccaatcctcttatgtatcttcacaagaaccagtttgaaagtcttaaacaacttcagtctctgtaagtgaaatattacaattatattgattataattttagtggatgtacttagagacacatttatttttaaatgggtattttgcacacaggagcatgcatttcagacaactgtctgaatcacagatcccatcaagtacatactgaatgacaaataagcctcattatttaccattcgacatgtatgaagtccatttctgtacttgaagaaggtttcaggaatgtccttcttgaaaactgggttcatgtggcaaaatctcatcctacagttttcacaaagaattaaatttgcaatagttttgtttctaaaagtttggttaaaacaaattatgtaagacttgcctgcttttcccctttgccctttcctacaaggatctacttgatattagtgtacagtgcattgttttacttttaaataagtttttaaaaaactgtcccacaaatatgcacattcagaaaattaatgtacagtatttttacatttcaaccatattaagtttcagtggtatcaagaactctgccacttttcctttgaacttcatgatttctttccaatggatggcaattgctggctaaaggttgtttgttttcacacagacagcagactacgctgcctgactgcagcctaaagcatttcctcctttaattccaaagaccaattcttagtatcatcttttattcttgctagttttctatcagaaattaatgcaagatttaggtttctctcttaccagatattagtgagcatccactgatgaaaaagatctggtccctattcttaagaagccataatattaaacatatatgtttattttttaaaatataaggacagacctgaggatgtggacagcatgattcttctctttgcttaccgcatactgcatttctgaaagccaaaataccaagtcactacataatgccttcctgaaagtcaaagtagtaattatttattacatacttttctttattcatttctactttttttctttagtgtttttctttctttctttctttctttcttttgagacagagtctcgccctgtcgcccaggctagagtgcaatggcacaagcttggctcactgcaacctccgcctcccggcttcaagcaattctcctgcctcagcctcccaagtagctgggattacaggcgaacgccgccatgccaggctactttttttgtattttagtagagacagggtttcattgtgttgcccaggctggtctcaaactcctgagctcaggcaattcacctgccttggcctcccaaagtgctaggattataggcgtgagccaccgtgcctgcccagtctttctttttttcctgtgattcatttacccatttatttcacaaacatatcttagccaccaacttacacaaagcattgttttagcacttgggatacagtggcccctgctcttcaggatgctataggttagtaatcaaataatcacagaatccacataaagctaaaactgtgtaagtcaaggacagagccagagagaaaaaaaaaaaaaggaaaattaaacttttagaaagggcttagagtctcctgctagaggggccatgcaattactcagtagtataacagctttcccagatttcatttttgacttccaaaaagcaagaactccttgggcaaaggaaaactcagaaccatgttgagaaatctttattcggattagtcaaaaagaaaccaagtgagaatcagacatatttcaaaataaacattaaaagcaaaaggcctctgtctttttagattatctctctccatctgcttcctaagaacatggcagctcttaattcataccatcctaaagagatcttcaaagtgtccacatttgtagaagcaagcattgaggtcaactaagagaacaggagtgatccttggatccctttgaggacattttatggggcctgaaggatttaaaggaatttaattaaatttaacttaaatttaattaaaggaattctaagacataccactggtgtcttagaagactcctgaattggagttcctcttgctaccttcatggttttccatcctaaagacacataggccaggaagaaatgatcatatttaaatccagattctcacaaaactcacttcagtgatgctctccggttggaaagatcatctcctgaattaaaccctctaattcctatggcattacttatattaataaaatcaaactacagagccaatttcataatacacaaatcaccactgccattcttaaatcaaagaaatgaatgaatatgttctattagaatgtaattctgcatgtgaaatgacacaatcagcgccaaactgcaggaggcataaatagaaacagccattttctaagatagtgtactgtaaaactttcattctaatctgcattggtaacataagatcttgaagcattatatttcggatatgatgaagaatgcaattattaaaacgtttcatctcaacaccattaaacctatcgtgtgtattttccagagacctggaaaggatagagattccaaatataaacacacgaatgtttcaacccatgaagaatctttctcacatgtacgtatgtataaaaaatggaggaggaagcatggtaaaatgcttcaaattatctcctgtaaactgtctaatgtatcactgcaatgtgtttctatgcaacaaaagtcattttattgagaactttttaattttgtcacctttggtccctgttcaaatagagttcaatattatgatgtgccgacatgaatgacccttctctctggaaacacgctgtttatccaattgaggcccaataagagatcagggtaccagaatgccacatattacacaagatgaagtcactggctaaatggtactcaggcgacctggaaacattaattcacctctcatgaatgagcagtcggctgctctaagatttgagcccttaggaagaaaggtgctatataaattccaggtgttgttactgttactaagtgcactacaaaatggaggtaattaatctttatagtagtttttgataagtcactttagtatatttggctaaagtgcactgtgtaagttgtgttaatatatgtgttcataattatttctttatcaactgtgtaatctatgtgttcatgacttcaaaaattaaccattgttatctacaaaaatagggagaattcaatgtaagattacaagttgggtacagcaagtggatgaaatggtggctgtgaaggtgctcttttgggagaacattttgtttatgtctgtgcagtaggtgtgattactaaaagacaagtgtttgatgcatttccacatggttttgttcattttcttctgtggcactattagataaatgtttaatgagggtatcatttccttgttgtaggcaggatatggggtcttcttagtatagagaaattcaaactatttagaacttgatggagaaactgctgtgttaaatatagacctcaggccaaggtcaagaacaggtcaacaattaagagaaaacacattagcttagttacttccctactaagtaacctacttactcttctttcatattccttgtcctttatttattgaaacatccccaccttgtcaccccaatccctttcacctgacaacgagtagtgtggtcacagcgcaagggggccctgaaccactgagagatgctagacggttctatctgaagatagcagacataatggaatcctaaaaggaccaagaagtcaagccatgtgtgtgccagggactccagggaaggagaagaaaagagttcattatagttcaggttcctttaattggatgccagatattaggaagctgaactgtaagctacttgaaggcaagaattgcctcctgtttctcttcctgacacacccagtgctaaattattcatcatccacttgctgatccaagaagtatttgttgagtacctacacgtgccaggcactgcgttagacaccagggacataaagatgaacaaaagagaggatgtctgtgcctgagagcttccatttagctttgggaaccagagagtaaaggagcaagtgagtaaatagtgaataagtgctacaaatttaaataaagcaaggtaagggatagaaggaggattgaggattaccactgaggtggggtggatggaagttggagtgaagtgacatttgagcagacctgagcggagggagaaagcagccctggcagtatccaggggaagaatcttccaggcaggggcataagaaaaagcaaagctctgagtagggcatgagcatggcttgtctgagggtgtgtgtctgggtggagtaagcattgcagggcaagaggcgaggtggtgcaggcagccaggggtctgataccaggcagccttggtctagaaactgaattgagaaataacaaaaaatgaattaaactgacagcaaagagcagaaaagtgaactgaaagaagtagcaaacgaataaaaatagagcaagttttatgagagaaaattctaaacacacaggtttgagggatggcaatggccagatgacctcacccattccagcacttccagatgccttgtgcccactgaccacaaacaaacttattttcccatagaaactaactccttccagaccctggtaagaaatctgtgtttaaggcagctgcttctcttcccagatccagtgagaatgcattttcctagtgtcagaggtcctcccttcctgccagtgtcagggaagaggaggctagttaaagtcagtagacctcggtgtttaaaactcaggacaagacagaaatgttctaggtgagcgacaataggcttttcccatcccaagcccaagcccctgaaagtctgctggagatcactttgacaaggataatccacttttcataataccttacagaataatcaataaaccaatgtgaccagggaacatacagcccctgagatttcaaattttcatgtcctcccaaactctcctcatccaagttactgaattcctatgttctttaggttcctcatctttaaaaggatactgcctagtgtttcatgaagaactctttaattatataaacactactaaacaaaaataaacaaacctagtgaagttgtatacctagcatggagttgcagccccgataggactgcaactgtaggttctgtatcattgctgcaaagtgacactttttttccctttgactttagttatttcaaaaactttcgatactgctcctatgctccccatgtccgaatatgtatgcccttgacggacggcatttcttcatttgaggacctcttggctaacaatatcctcagaatatttgtctgggttatagctttcattacctgctttggaaatctttttgtcattggcatgagatctttcattaaagctgaaaatacaactcacgctatgtccatcaaaatcctttgttgtaagtatgtttccagtataagtagattaaggatatcttctgtgagttgtgcactagacatatatatgtatttattggctttcaacaaatggcatttaatgtgaattatacatcctgggcacatttttttttctaaatataaaagttctggctctttgtggctttgttttaggttgtatgaccttacagtggcctgctctcaggagtatgtcttgggaatgggctaataggcaaccaatgagtcaagtgacagattataaagttttgtgggtgataaaactaatctgaacttcaattacaatgatacctatgctcattaggcctggaaaatgattccctttattaactatgaagatactatatgttaactgtttaacaactagtccttcctccttccagaaaattcccattccgatttttttaaactacaaaataaaaacatagtgtagtactttagaaatattacagatttttaagtccactcgcttcttggtactcagatgtttacattagttcatttgatataagatgaaaggaactagatctaattagaaaattaaaatgctggaaatagacttaatcagaaaactaaaacagggacattggaaactgatgacatacactgtttcaattcttccacaggtgctgattgcctgatgggtgtttacttgttctttgttggcattttcgatataaaataccgagggcagtatcagaagtatgccttgctgtggatggagagcgtgcagtgccgcctcatggggttcctggccatgctgtccaccgaagtctctgttctgctactgacctacttgactttggagaagttcctggtcattgtcttccccttcagtaacattcgacctggaaaacggcagacctcagtcatcctcatttgcatctggatggcgggatttttaatagctgtaattccattttggaataaggattattttggaaacttttatgggaaaaatggagtatgtttcccactttattatgaccaaacagaagatattggaagcaaagggtattctcttggaattttcctaggtaaattatattttttcatttcctggaaaaacataattttgctagaaatacgttaaatttcagcaaaggtggatttgtttgtttcagaaagtgagataacatagtcaagactgtgtcctttttcacacaaaaaagtttttactattgtgtttattgaagttttattaaactttttattagacaatatttagtgtggaaaataaagacatactaccaggatctctggatgatatttttattatccataagatcctttgatttcatgtttatatgaaatgactatgagctgaaggaattccagtttagtgcctcatcctgtaaacctaccaagttatttaaactcttttttttttttttacaatctagttatgagttaagtaaataataataaaactcaggaaactgacaagtaagagatatctgaatggaaataccaggaaggtttattgcctttgttaaatgcagctgttaagtcagcaatgtaagggtgcttaataaagctctttcctttccagttttctcaattccttctaatattgtaaaagaagactctgtgttctttagaaatgaatgacaaatttagccctttaaagttaaaaacactttttttctattttctaatatgtatccctcctgcttagaattaaggcctttcctatatcctctctttggggcgatcttcttttgactctctcttctaatcttttcttcccatccaaggagccaacaagctcttctgtcctttctttttcttcaaaatttgcttctgcttctgctccttccagtctctacccactgctgttgccttagttggaaaccttactccctcaaccctgaattattaccttatcccttactggtctcgtaacctctgggaccttccccttcctctcatttatctattcactaccattgttatattctctgactatcaaaaggactgtgtacacctccactcagagaccttcagtggctccctagtactatcaaggtcaagtttaaattagtcacttaaaactcatcatgacatgaccctaaccatcatgcccagttcttctccattactccttctcttcctcctctgaaaaacagaacatttagtttgcaccactttagtaatacccctcacacactaccctatttggtagttatttggtcatagatatgtcattcccaggatccagagtattacaggctgttctttgtatttccttatcattcattccctcattactcctaacataggtgcacttaatagagactctccctgaaacacacaccacacacacacacacacacacacacacacacacacacacaccatgacatgcattgttcaaataggcatttattcagcactcactataggctgtgcactatatactatattaggtacgggagaaacaacagatccagcctcaaaggccttacagaccacagaggaggaggcagacaagtcaacatgtcctcacatcacacacaggctgataaatgccatcaaggaagagtacagaatgttctaggagccccagatctgagtaacagggaaggcttcccaaaagaaatgaattcaaactgaggcccaaaggatgaggaggtattagccaagcgaaggcagaggagggtggggtggggtctgtgttccaggaagacatagtggattcccaggctcaaagccagggaacagggtaagatgaaggactgaagaaactcatttggtggagcataccatgcaggcatggagctcggcccaaaggagttaagtatctgggatatattccagatagacaaagagatcgtcacacacacacacaaacacacactcacaaaatcatcatcatcatcaatttgcatatgagaggaagagtcccagagctctaaagtacaattttttttctgtttgaagaatataagaatacataatttttaattaattttttatttgaaaatagttttcattttaggaaaggtgcaaagataatacaattttccacatatgccccacctggtttcccctattgttaacatctttcttatattactatcgtgcatttagagcatacacttttttttttttttgagacagagtcttgccctgtctcccaggctggagtgcagtagcgccatctcggctccctgcaacctccgcctcccaggttcaagtgattatttcgcctcagactcccaagtagctgggattacaggtgcccaccaccatgccccgctaatttttatatttttagtagagtccaggtttcaccacgttggccaggctggtctcaaactcctgacctcaagcgatccgcccacctcggtttcccaaagtgctgggattacaggtgtgagtgaccacacccagcctagaacatacacttttgatcctttctgtaagtctgctatcagaatttggggcaggggagcattttctaacagagtgattatcttttacgcttaactaaattttttggaaagaggcctaagacaactagttttataaaattttaccgtatggctttatactatgatttcattgaatacgaaatgatttggataaaaataacagatcaccttgaatttaaagtatttttaccctagacttcaccaatcttacatacagtctaggttcagattcatattttttaacaactttgaaaatatatgcaagtcttattttcactgtgagaaatgagatgatcactcaggattttagcgacagcaagaataaagcaaagagtgactaagaagtcagcatgaaaggtaatagtgatgttaggtgggaatcttgtgaatatatttgggcccaaaagaataattcacatagttgaatttttaacttttttcttttttttaataaaattagtctaaaggttctgaaccacagtagtttaatttactgtaagaaacatgaagaaaaataaacaaaaatacatttttgttctatgtgttattctttttttttttttttttttttttttttttgagacggagtcttgctctgtcgcccaggctggagtgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaactatgtgttattcttaagaccaaaaacattaggaataatgtttctcagacaattatattcatgataaattccaaggttattttattcatttattaaaattatttttatttatttttattcttttattattcatgtttataggataagaaaatggggttgtttttattttttgagatgtgcatatgattacagtaatcccttaaggtttgaatctgcagagagctgaaaacaaaaatagcttcttttcatgctttaaaagagctagagtttacttcatgatatgcctagatctgaattttagaagtctataattcctcataagggtttatgtatttgaaatctctttttcatctggtgaacccaatttctttgtttttattcccttgaacctgggttttacctaacaccactgggcttatataaaagaatgcttcctggaagtgcccgtggaagaggcactgtatttaacatctaagtacaggttaagcatttgtaatttgaaaatccaaaatttgaaatgctctaaaatatggaactttttgagcatcaacatgatgccacaagtggaaaattccacacctgaagcttttgctgtctgatggttcaatgtatgcaaactttgtttcatgcccaaaattatttaaaatattgtacaaaattactttcagactatgtgtataaggtgtatatgaaacataaataaattttgtgtttagacttgggaaccatttccaagatatatcattatgaatgtgtaaatattccgaaatccgaaatccaaaacatttctggtttcaaacattttgggtaagggatactcaacctgtaccacagtaattttactgttgacttttacgcctgagatgttaaaagtgtgcttttcccaacaggtgtgaacttgctggcttttctcatcattgtgttttcctatattactatgttctgttccattcaaaaaaccgccttgcagaccacagaagtaaggaattgttttggaagagaggtggctgttgcaaatcgtttcttttttatagtgttctctgatgccatctgctggattcctgtatttgtagttaaaatcctttccctcttccgggtggaaataccaggtcagtctcttctatcattcccaagtataatacatcgtgccttcttacgtccttcttttgacaaggccagagtctaggacacataataaattattcataaaaaccaatacaaagttatttccctccatgttttataatcagtattataaaatagaaactgagtagtggtgcaatccaaccaggaataataaaaagcaggagctacagagaaactaagtctgagtatcttgcttctatctgagcaagacattggttcttcactaggagtatgcataaaacaatcaaaatatacatgcccaggttccacccgggactgttttgtctctagaggctaaaacctatagatggatgttatgtaaaaattcccctgtgattctgatgcacactcatctggctagaaccaccattctattccatggtcctagccataaaatgtcatgctgggctctgcggagcacgagatatttcctgaaagagtctcctccaaaaggccaaattccctgaacacacctctacttcaaccagagaaaatcacctttccttagcagaatttcatctgaagccccttctggaatctagagatcacagctatttaggggccaccacccagggctttaacctaactctcagtaaaatagtttggaatcatcgtcaacctactgttccagccgatagcagatctacttgggagttgatccaagacagtaattgtgtcttatacatcttgactcctcagtgtcaagcaggatgcctgatactttgatagcccttatgaaagagtgatgaatgcacagacgataaacagctgtaacaacctatgtccctcctgtgcactcagttgtgaggctatgtcaaatatcttgctgcaaaataccacacaacattcacaacatcctcttaagctatcagttctgtctccacatggcacagatgctcctcaggccgtgtaggatacgaaagtgaaaattaggaaggagatcaggtcagggctgaatacttggaagcctttgctgggtggtgaaagaagaagccataagagggttttgtgggaggtcatgtggggagacccagttgcacgtgaagaacagagataattaaatgttaatagtcacagttgttcacttgatgaacagcctccaatctattactgctacctggacatctcaattttacaccctaacctttcaaattcagcaggacaaaagtgtccgttggcctccattgctcatggaacaaagtccaagtgctgggatgagcattataatatttcttacctcccaccctcgtacactgtgatccaggcccactggaatgattgggctttgttttctatgcttttctgagaagacaccagcctttcctgaagctgtccccccaacctggattatactttcaccttctaagattttagcgtactaaacaccacttcccatcctccaaggctcaacccaaatactccctcttctatggtgcagtgccattttcgatctcttctcaccccactttcatgcaatccagttgcttaaacatccatgatggtttgtttacaccaggtttattggcctcatgtgaactgcctcatagcgacactatttcttagtgtgtccattgtgtccttcagatgataagcttggggaggcgtgtatgtcttattcttctgtgcattttccacagtgtttttcacatagtgcttttgagtaaatgattagtcaactaaagaaggtgagctggtccaagagtgatggaataggggatcagtctcatcaaccccctccccactactgtctccacactttcttcaaaaaaaaaaaaaatggagtctcgctctgttgcccaggctggagtgcagtggtgtgatcccaactgactgcaacctctgcctccctggttcaagcgattctcatgcctcagcctcccgagtagctgggattacagaagtgcaccaccacacctcgttaatttttgtatttttagtagagacagggtttcaccatgttggccaggctggtctcgaactcctgaccccaagtgatctgccccctgctttggcctcctaaagtgctgggattacaagcgtgaaccaccaagcctgaccccgtctccacaccttttgatgtgctttcccacttgtagggggacgcagcctagtgtggtggaagaaggacccagcaacaagtaaggcggaggtcctgggttcctctcctgcccctgccactgacttgttgagtgatctcagggagaccatctcacctcacctcaatgagactacctctagatggtccctcaaattcctgcctgttttaatcttctttgaggctttttctgtctgtatgaggccactaggactgctataacaaaggacgtccagttctggaggctggaagtccaagatcaaagtgtcagcaggtttgatttctcctgagcccttctcattgcctcacaggaggcgtccgctctgctgtgtcctcacatggcagcagaactcatcatcctcagcgagtctacgacacctcagatcatgataagcttagtaaatacccccatgaagggaactagaagagtagaacattgtcttgtggaaacattattgagccacacaccagtctttctttacatgtatagttcaatagtctgaggtttgtcttgaacacctcagtggaaccaggaaaaatgtcatgatcacagttgacaaagcttcttctcgcttgcccagcttcccatggcgttgtaagaaatgctgccttcactgacctaaaccaaccctgtccccaccctccaagaagtctggcatttactggttatggcatgccactgacagtacctggggtcacccaaaagataggccagagttagcctatctcagaactcagctgctgctaatcttataagaagtctcatcccagcactttgggaggccgaggtgggcagatcacgagatcaggagatcaagaccatcctggctaacacggtgaaaccccgtctctactgaaaatatataaaaaattagccgggcatggtggcaggtgcctgtagtcccagctactcaggaggctgaggcaggagaatggcatgaacataagaggtagagcttgcagtgagccgagatcgtgccactgcactccagcctgggcgacagagtgagactccatttcaaaaacaaaacaaaacaaaaacaaaaagaagtctcattcagagtagaacttaagtctatggccataccaccctgaacatgcctgatttcattcagagtggaacttacgtggcctatttgcctttgcctaattgaaagcaggcactatcaggcattgtttttctgtgagattggggtgggattcgtgatcacaattccctttgtgggcacaacagaaaaaggccacttattttgtttttcttcaatcactaactgttcagattgtctaatttttttaaattagggacaaataatataaaacttaatttaagacaggctaaaacataatttttttctttcatattcctttcagttaaaaaataaggacaaggaagagaagataggataggaagagaggaaggtaaatatagaaaaggagaggaaagagatcaaaggaaaagaagaaggaaggtcagataagcagtcagagaagaaatggaaaaggaagaagacatagagaggaagaacagaaagatacaagaaataaggcagggtcaagagaagaacaaaataacagtggctgaaggataaaaaaaattatgagattgcgaaggaggagagcagaggatgatgagagaaagcatcatgggtcttactagccacctcttcacctgaatggggagttccttgaaattgtgaagatgtgagaggaagtagcgtcctgtggtaaggtttgaggatctcaagtcttagtaccaaaaaagcacatcagcagagctgactctggcccagcccgctggattcagtgagcaagttatcaccagccccctttaacagagagagcagatgaagttgaggaagcataagtgattcgctcacactcaacctagctaagtgtccggccacaggatcaggccacgtgtaaagggaaagatgcattttgtgctaaccaagcaaatgaaatgatgctctcaggaaggacactatcattccaaatttcacctcacaaagaacttcttgtgacctctttccctgaatattctattagcatttgtagggctgcacacaagagaatttcatcaagtttagggaatgcattcctctttgctcttcaaagcttttaataggataacaggataaccagaacaccagggcagggcaataagctttgagaactggatggagttaagaccaaggtcagatctggcttggtccaggggaccagaagttttgtgaacctcactctattgactaaagattatttctttatttttttattttcctataaaggaaggtgataaaataggaaaaaatgcattatatagcaatttatagtttacaaaatgttttcacatatttcctgttaatatcacaatgaccttcacattatttactgaaactcagaaaagttaaatcgttaagaccttgaattcatagcttctgtgctcttccaacaaagattttccttcaggtgagagaaaacttaaaatgtactatgtctccctctcataaatagcattgactgcaaagtgttatttgtattttatgtctatttaaaacttcaacttttttttcacactttgcttccttttccagacacaatgacttcctggatagtgatttttttccttccagttaacagtgctttgaatccaatcctctatactctcacaaccaacttttttaaggacaagttgaaacagctgctgcacaaacatcagaggaaatcaattttcaaaattaaaaaaaaaagtttatctacatccattgtgtggatagaggactcctcttccctgaaacttggggttttgaacaaaataacacttggagacagtataatgaaaccagtttcctagcaatcattttggatcactggactttcagtggactacctaaaacaggggacagcttttggaagatgacatctgcaatgcttttcatctttaccaacggcaagcctttctgcacagagagcacagcagaatggctcctgtcactgcattccaatggcagctgtactatctaccaaccatgctgaggacagcaccaaaggttcctctcctcaccccacatgcctgaaaagcacatgtgaattcgtgtatagtgggctgaggtgcagctgatctctagctaatcaacacaacccaccaacaaatgaccacaggttggcactgtgtggtctttcacatcgggttgcactgtccatgaaatagaaacactcacaacatctgattccagtgtggccataataacagaaatctaacaactctttccttgccttttcaatatcaaataaaaccatcagcatcctgctggattgatagcaaaggatttccaaaatattcatctacccgaagtcctcctctgtgaaggccggtggagtagccactttgaaaacagaacttccaaccaggttaccatgtctaacctatgaccagagagtcacactgatgaagcctcataccatttgccttttggattttatttaatatcagaagagatgaattcttaagatatttttctgaaggttgcccagggcacaaacaaattggacactttcactgctaaaaagtacactttaatattcttaaagtataatttctttagagcagtatccctattgctggcaagttctgctttcataaaatatgcagataagaagtgttaaatgggattcaagaattatggttttatttgggactgtttgcatactcacaatggttttgttctcattgtttttaacaaaaaagcaatgaagtttggggtggttttttgaaaacgaaactgaaaaaaattatatgtgaaaatgagaactgggtaaataaaattatattttgcacttgtccatatattaatttaagcttaacaaagaccatggatggggtttgttgactgttaagcatgtttctcctgataaagaatacagccaggaaacacagcatttcagttcacaagacacatcctatatttttctctcttccccttttgccacagcatgaggcagttacttaatttcttcactgttcacttcattctgagttcctttaatgagataaaatgtaagcagctgactaagaccaccacaatacctcctattacatattaaatggacaccctttatccagtagcatccagaagagaaagaaattcagagtttatgggtctcagccattctggtaatttacttgttattactcactattgactaaaatcataacgtgagttcattcattttgatcaagtaagatatttctcatgtataataaaagattttcattaggattctagaaataatgttcccactcattgactatgctaccctttcctttatggctttaaatttttctccatcttgtttcttcagtatgatgaattgcttcctaacttgttttccaggtttgctgacattttatcagatgtctttgccagtccttgatcatcttacgatttatttcctaatacattttctaacaccaggagcataaataaggggtagaccctgagcctagggtattgtaattttagcaccaatgtgtgtctcccgttcttgaaaagcatcatccgtggtccatgaaccaagtctttgggaaccatgtaagagcccgcactttactgtagtgcagtgagtgggcatgagaagaggcacgcaaccagatgctttggggaaggtggcagctgtatggaaaaatgggagctctacataggtcagcaacatgccaacaaatagcatgaacttcatatctgatagcttggtaatttatagtcttattctgtactgctctgcaaatagaaaaccattagaaatttgtattattttagtaaataatagtctttaatgtggattgagtgagaacttttgtgctaggccaagcctgttttctaaacatggtatttctgtgtggttatgaaaatatcacctgtgtccatgaaccattttccatgacaatctaagcatcaattaaatgtcactgcagaatttcagaggccacagacggtgccatctctgagtgggagagggtgtgggcaaatcatctgctccacatcctaactatgcatctgtatatgactgatgtcttgaagaggataagaaaaaaatacccccaaaaatcaatatggagcttcagacgagtgtacagaaaaagggtatgtgttttatttgtgttagacattgataagatagtttacataactttgcttcatcctagaggcttttgttcatagctttcatagctttttttaattcagtaggctatttcagaaattgcaatcgacataaactattctatcaaaagagttcatgtccattgcaattgctgaaatgcctcttgatggtcaggagcttcaggataaattatatttatttgagctttatgtacaggtagcactatcacctttccccaaccctaccctacaccccagctccacagctccattcagcaggtctccatggcatcatgaagccacaaaagcaggcccatcaccccaaggtttatctcttaaggatgactctgctgccagattgaattcatatttggtgatttgctacagatttgctcatgctacattttcaagactttatctcacccaaggtaaagacttaccttaccatcctcaagttagtaagcaatacagagctcccgagagtgcacatgatagaaaggagaaaccatagagtgtcaccaatcatatctaacctattattttataaatggcccaaggggagctgacagaaatatatcttccaaaattaaccagaaatactttaaggcacattcctttttcattgttttcaatgtagcataaatgggcacttacaaagttgccttagacaacttcactcaagaaacaaaatattaattaaagataagaatttgtatttccttattcccttaccctgttgaataaagaaagggagagccattacaaagatctgcttatatatttgcctgtttatatgtcaggtttttgtttttgtttttgtttttgagacggagtctcaccctgtcgcccaggctggagtgcagtgccacaatctcggctcactacaagctccacctcctgggttcacgccattctcctgcttcagcctcctgagtagctgggactacaggtgcccaccaccacgcttggctaattttttgtatttttagtagagatggggtttcaccgtgttagctaggatggtctcaatctcctgacctcgtgatccgcccgcctcggcctcccaaagtgctgggattataagcgtgagccaccgcacccggcctatatatcagttttctgacattctgtttatgcaggatgtaagatgcatatttagtaatgatcattttcatttttgagccaggaaaattaaatgaaattagactattctctttttaaagggcttttcagtaggagacttcgaagtccttgagaaatacttcctaaagccctataaactaatagaacctattactcaacgtatttcattagaattgtcttcaggatatttccccacatcccgcatacggaagaagtaaattaaaaatgaagaaattgggaagaataaggccaagttacaaaactgcacatccagaaatgtgaaccttctgctgtctgaagcccatggtgacatttcttacctctaagttctaagcaaactcataactattttgagttataagctcataagtggcttcaatataagaaaaaattatttctagaccacctgagaatcaataatgcttttactggtttcacaaatttctgaattcgtgatgctagggtgtttgattcagcaattatttttaatggaaaccataccctttgctgctataggcaacacacatttaaggtaaggaaataaaggtcaaaaggcagggggctggagctgtagttttagttcaaccatcaactgcttacatgacctcagacaaatatctttacatctcttcccttatctgtaatagagtttccttaagatcaaatcacataaacagatgactggtcccctgtctgtcaaaatccgttttgtggataaaaccacatgctgaaggtccaagtggtaagcatttaaaaatttacatcaagtgcaaagatcattccattctcaattcccctgggatattacacattgttcatgaagagtcaatgcaaagggcaccaatgttcagaaaaccagtcctttgaggggaggcttacgggaccccattctgctgtgaaaagaaagctgaagcaaacctcagacaatgaagcttttctaaaccatggcagctaaccaaagaacaacagtaagcaccaggtaaaaattaggtaacctattgctagcaaaatttaggaatgcagagatcaggaagattaacatgcaatcgttttaccacagatcacagactagtctcttcacataagtgtaggtctactactgcctacattattctctaaaccagacgtaaatgcacgggaatgtctagcatgtatgagtgggtatattcctgggaaaagtgttgtaggataaagagataactatttaatttccccatagaaccaggatagaacatgtggttcttaaccaaggttgatgcctatctcaagtcttgcaccatcagcaacacaccctttcctgtgtatcatcaacttctcttcctctctactggctctttcccctcagctctcaatgctcacatttctcacacctaaaaagacattcctaccacccgacaccttcttatagcttctgtcttgttctcaaatgctctttacagctaaacattttgaaataatgataagctctttgtcatcaacatcttacctcactttgacttctcaaccaactgaatgtggcttccacactcaccacaccaccacaccacattaaagattaatgtctgccctgctgggtttcagacttgtgtgggagcctgttgtcctcattaaggttgccaggacgacaatccagtgagcatttgcctttcctcagctactttgcctccctggagaattagttactgatgtccattttctcaatctctaaactcctctcttggaatgaaggataccattcatttctgttctgaaccacttccctggctcttctttctcacatctttatgaacttccctttctcctcttggcccttaaacttatgtagaaatttctggagatttactcttggctccctgatctttgccctccatacagatctccctgacttcaacctgtctacagctgtcatagataagttcatttgtaaaaatctctattaaaaacataaatacaattagagtgaacttattttgacttttcttactaaatcttgacactcgctttttaatctgatccaaaaattatacaataagttttgttgaggcaggtgtgcggtggctcatgcctgtaatcccaacactttggaaggccaaggtgggtggattgcatgagcccaggagttcaagaccaccctaggcaacatggtgaaaccctatctctacaaaaaaatacaaaaaattagacagcatggtgcccaccccctatagtcccagctacccaggaggctgaggtggaaggatcacctgagcctaggaggtcgaggctgcagtgagccatgatggtaccactgtactgcagcctgggtgacaaagtgaaaccctgccccaaaaatatttatggctgggagcggtggttcatgtctgtaatcccagcactttgggaggccgaggcagttggatcatctgaggtcaggagcttgagaccagcctggtcaacatcgtgaaacccaatctctactaaaaatacaaaaattagccaggcctggtggcaggcgcctgttaatcccagctactcgggaggctgaggcaagagaatcacttgaacctgggaggcggaggttgcagtgagccgagattgtgccattgtgctccagcctaggcaacaagagtgaaacttcatctcaaaaaaaaaaaaaattatatatgtttatatactaatgtagttgttgaaattctatcctccctgatgaaaataggctattctcataaatgcatctaaaagcaatagatttttatatatttaacaaatgggttcaagacccacctaaatttgggaggggggatttttattaaacaggatagaaaattccaaaaggttaaaataaataagtggcccaggctggagaggggagatgagaaccctggtgggtccatatatacatttcctaacttcttattttttctttattttttcctggaccaaatcataaggcacaaacatgtcaactaagagcatgaaatctagaaggtgatcttaaggaaaagtttcacagaccctactgaagaagcactgagtagtggagtaaaaaatctcaattcacatgatggttgtttgaggcagtggtattaattgatgcatcttccttgtttttatgtcacaggcaataaccttagagtgctgtattattccattgctttgaaacagaaaatcttttggttgtcattgtccgatcttctgcatttcatgctctcccttagatattcttggttcctcacctcctttgaatttcttatttctacccagccctgctctttgtaagccaataagaaaagggttggacataatacataattcaaaagtaataagattttcaagaaagtgaatccctccaaaatgcaatcatctaaaattctgttgtcatccactcattcatttattcattcaacaaatgagccttgtgaaaccacctggagccagacatgctatctaacaagatcatctccaagggcaggtaaagtcacacctcaagaaaacaactgctatggtttgaatatggtttgtttggccccaccaagtctcatgttgatatgtgatccctaatgttgaagatgggatctggcaggaggtctttggattacggggcagatccctcatgcatggattattgccattctctcaagtgggtaagttcctgctctattagttcccacaagagctgcttattttaaaagtgtctggcacctccacttgcctttactcttgcaatgtgatttttgcataggttagctccccttcatcttccacaatgactggaagcagactgagttcctcaccagaagcagatgctgctgccatgcttcttgtacagcctgtagaatggtaagccaaataaaccacttttctttataaatttcccagcatcaggtattcctttatagcaacataagtgggctaaaacagaaaactggtactgaagagtggagtgttgctataaagatacatgaaaatgtggaagccattttggaactaggtaataggcagaggttggaagagtttacaaagctcagaagaagaaaaaagacaagggaaagtttggaacttcttagagactggttaaatggtagtgaccaaaatgctgatagaaatatagacagaaaaggcaatattgaggaagtctcagatggaaatgagaaacttattgggctctagagcaaaagtcacccttgttacacctagcaaggaacttgctgcattgtgtttgtccccttgggcttggtggaaggccaaacttaagagtgatgtcttagagtatctggcagaagaaatttctaagcagcaaagcattcaaggtgtggcatggatgcttttaacagcttacaatcagacacaagagtaaaggaatgaactaaagttggaacttatcattaaaaagaaagcagagcataaaaatttgtaaagttcacagtctggctgcatgttcaaaaaggaaagaatattttcaggtgaggaatccaaagatgcttcagagcaaccacttgctagaacaatcggtgtggataaaatagagccaggggcttatagtaaagacaatgggaaaaaggcccaaaaattatttcagaaacatttgaggccacccctcccatcacagttccagaggcctaggaggacagaatggttttggggaaatggcctgaggtgctgctgacctctgaagtatattccctgaatctctgccacaactcaaaaggccccagatgctacttggtctgccactctagctggaagccttggcatcttccacgtgctgttaagtctgaaggtgtgcagaatgtaagagttggggaggcttggcaccttccacctagatttcagaggatgtatctaaaagtatggatgctcaggcagaagcctactgcaggtgtggagcccccacagagcgactcaaccaaggcaatgcagagcataaatgtggagttggagccctgcagagagcactttaccaaggcactgcctaatggtgccatgaaagcagggccacagcactccagaccccagaattatggagtcaccagcatgatgcaatctcagcctaaaaaagcaacaagcattaaactccaacctgtgaaagcagccacatgggctctgcccagcaaagccttggggatgcggctgcccaaggccttgggaacccacccctcacaccactgtgcctaagatgtgggacatgaagacaaaggatatgattttggagatttcgagattattgtctgccctgctgggtttcagacttgtgtggaagcctgttacccttttcttttggccagtttctccctcttggaatgggattgttttcctataccaccattgttttcctgcctgtatcaccatcgtaccttgggagtaaaatccttgtttagatattactggcttatggctgaaaggaagttgccttgagtctcaggtgagactttggacttttgagttgatgctggaataaattaagactttccaggattattaggatgggatgattgcatttcgcaatatgagaaagacatgagatttggcggccaagggtggaatgctatggtttgtatatgttttgtttggctctgttaagtctaatattaaaatttgatcctcagtgttggaggtggggcctgatgggaggagtttgagtaacgggggtggatttctcatgaatggcttagtgccattcttgaggaagtgaattcttactctatttgttctcacagaagccttttgttaaaagattctggcacctccctccccttcttgcctccattattgccatgtgatttctgtacaggccagctcccctttgccttccactaggagtgaaaacagactgaagccctcaccagaatcagatgctggtgccatgcttcttgtgcagcctgcagaaatgtgagccaaataaatctcttttcttcatacattacccagcatcaggtattcctttacagcaacacaaacagactaagtcaacgaccatagcaagataactgtagaacttctgtagatttgacttcaaagattaagtcctgcatgtttatcagtcttatcaattttattcatagcacattctttcttattgcaatatcttttttctctactcttcttcctactctctctttcaaatactttgctgacatttctgaccctttttcttttgctctctcaccacatactatgcacacacatgaacacacatatgtacctctttatccctctaagtctgctttcttgcctcctggtctctgtcctacctctatatttctattgttctctctctttccctgtgtaggcagtgtttgtgcctctctctgtgtaggcagtgtcaagacaagatggaggccaaaagtaagatggacacttatattgagtgcataagaaaacaaactgattgataacattcatttttatgctttcagcttgctataagtgccctaacttggtaacatgggtctaactggctgacaaccctcatatagcaacataataatagtatcaatacatcacacctgaacagtactttatatattgccatatgctttcaaatagcatttaatttgctggaagtcaagcattatttattcacaagtgcctgctttcacagacacaaacatacacagaaccatgtcacacattggaattaatttatttggcaacctcaccttctcagaacatagctgacttaaaaaaaaaaccactatttttaaaggactttaaggaactaaagacaaacagttgtcgcagattcataaattaaagtttagaagcaagatgtgtatagaaaaaaagcacagagcatctcatttgaattattcatccattcacaaatatttatcgagtgcccactatgcgaggaaatattctaggtgataaaaaaatataacagtaaaaacataaacctgtctaaatggagctttcattcttggggagtaggtgagacaaacaataataaaggaaaatgagcaaaatttataatacagtagaggatgagaagttctaaatgaaaaaataaatcagggaagtgagagaattattactagaggaggagaaacagcaatgaatgtattcagtaagaggtgacttttgagtaacatagcctgatgctaccatttcttctcagtttattcatctttaaaatataaaaaataataaccacttcacaaaattaccctaagtaaacaaatatactctagcacatagcctgaaactaattaattattcaacaagtgatagatatgtctttatctcataaatttcaatcatcacaaagatcctcatctactcagaacccatttttctataattcacatgtaattttagcaagattattttcctattttatttatttatttttcattgttttgagatggagtctcactcactctgtcacccaggctggtgtgcagtggcatgatcttagctcgttgcaaactccacctcccaggttcaagtgattctcatgccttagcctcctaagtatctaggattacagcgcctgccactacacccggctaatttttgaattttttgtagagatgacgttttgccacgctggccaggcttgtctcaaactcctagcctcaagtgatccacccatctcggcctcccaaagtgctgggactacaggcgtgagccactgtacctggcctattttcttatttctaagctcagatattttaagaaagtatgtatgcatatacatgaatatgtgtgtatatatgtgtgtgtgtgtgacattcatttggatttgtactacaaatttagactttctgtggtctataaactcccaagccaagaaatttacctaaaaatttatcttaggatatgatacctctgttgtaattggaagaactaaacataatcttctccaaaacacatatccccaactcagtcctcccagaatgttatatccttatattagtccagaatgttatatccttatattagcctttatagactttcacaggtaacgtctcacagaggatgaattcttaatcccaaattagtaaatcatgaggaaataatctaccatgagtgagattcaacaaacacataaaaatgataatgagaatcaaaaccaaaaccaaaccaaaacaaaaaacttcaggtaatagaaatatctgataaaatctacaaaatacattctttaagaatatttaagaattacaaaagaaattgaaaccataaaatgaacacaactctgtgaataatgccttaaaaaaagattatctgggagtgacattaacaacatagcacagaataggagttttcagcacttacctttcaaagaaacatcagtttgaactaccatccatgcatgaagataccttcacaagagctaaggaacccaggtgaaagattatggcacctgggtggaacacagaaataagaaaagacacattgaagagggaaggaaagactgtttcatattacccatatcattcacccatgacccaagcctgtgcagcatgcacagagggagataccctctgtgtgggggaaggagagtgaagtgagtacccaactttgccacagaccagaggactagaccagccccaaagaaccttacagccagcccagctcctgcagctccaagcccactccaacaccaggccagctgcacagcacccccagtcccccaagcacccagactccatacaagcctacctcagctccagaacgccttccacatatggaggctccaggactgccccagaaccaggcccatgtcttatggaccaaggtatcaggcccaagtccccactgatcagtcaccaaggcagcctacccaaggactccagcagtaaacctgctcataggcctcgccagctgttccagcctgaatccctggacaggctgatttgtaaacggctttccatgctgaagtcagttgcaaagactgcaagagacgcccacttcctcaaatgcacagacaccaacataaatccacaatgatcacaaataatcaggggaacttgacaccaagaaaggaacaaaataaagcactaagtaactgaccctaaagaattcgcgatctagaaactatgtgacaaatatttcaaaataatcatcttaaagaagttcagtcagtgatacaagaacacagacaactaaatgaaatcaggaaaacaatatatgaacaaaatgagaagttcaccaaagagatagagatagaagcgataaaaagtcaaacataaattctggggctgaagaatacaatgactgaactaaaaaaattccatagagagcttcagtggcagaacttgatcaaatagaagaaagagtcagtgaactcgaaaacagattgtgggaaattattcagttagaggaaaaaatgtttaaaaaaagaatgaaaaacgcttatgcgacttatgagacagcatcaactgaaccaatgtatgcattataggagtatgagaaagaacagagaaagcaaaataaacagaaagcatttttacagaaataatgtcagaacacttcccaaatctggacacgtaaatgaacattcagatccttgaagcctgaagaaccccaaataattaaacataaagagattttcaccaaaacatattataatcacattcttaaaagtaaaacatgaagtgagaattttgaaagcagctagagaaaagctattcatcacatacatgcatacttccataagactatcagttgatttctcacaaaacctttgcagaccaggagagggtgggttgatataataaaagtactaaaagacagaaactgccaaccaagaatactatactcagcaaagctgcctagaaatgaaggacagataaagattcccagacaaacaaaagctgaggaagttcatcatcacaagacctgccttacaagaaatgctaaaaggagtccttctggttgaaacaaaagaatactaactaaaacatgaaaacatatgaaagtataaaatgcactgtaaaagtaagaatatagtcaaattcagaataatattgtaatagtggtgtttaaaggacttttatcttccgtataagaattaaaagatgaaagtattaaaaataaccatagctacaataaaggattaatgaatatatgcagtataaagtatataaattatgacatcattaaaataacatgtgaggagatgagaagtgaaagtgtaatgcttttgcatgcagttgaaatgaagttgttcccagcttaaaatagactactataactataaaatgttttatgggagccccatggtaatcccacaccaaacaaaaccaaacaaaaactatagcagatatacaaaagataaagagaaaagaatcaaagcataacactccaaaaataaagtcatatcacaaatgtagatagcaagaatggaagaaaggaattacaaaacaatcagaaaacaatgaataaaatgtcaatagaaagtctttacctaccaataattactttaaatgtaaatagattgaattcttcaatcaaaagacatagaaccgctgaatggattcttttaatccaactatatgctacctacaagagacccattttatctttaagaacaaacataggctgaaagggaaggaatgaaaaagtatattccatgaaaatagtaaacaacagagagcaggagtggctacacttacgtgagccaaaacagattttaactcaaatactgtcacagcagataaaggggacattatataatagtaaagaggtcaattcatcgagaggctataacaattataaatatatatgcacccaaagtcagagcacctaaacatacaaagcaaatattaacagagctgagggaaaaacaaacagtaatataataatagcagagacttcaatacttcattttcaacaatggatagatcagacagaaaataaaaaagaaacagcagacttgaaggaaactatgcgaggtactgtatatattaattagcttgactgtggtaatcatttcacaataaatatgcacaaagcattatgttataaacctgaaagatatttatttttttatttgtcaatcatagctcaataaagctgggaaaaaaagaacttcttgaataaaaaacatatttattaaaagtaatgattcaatggatactttacaaagcagattatatacagctgaagagaacattattaaagtagacatgaggaaaccatacagaatagagacagaaagataaagtaacaaactttctttctaaagaaagcaaagtttcctgacatgataaaagtgttattttttaggacaatgtaattaatgggaagtgttacaaccatttcttcacaagtcacgaataagtcaagaaggcctgctattcaaagttgtgctgcatgtctcaggccatacaaaaagcaacagaaaaaaatacataaagatttaaaaataagtaaaagaaagaaataagactctcagtattcattgactatgcaattgattcaatagaaaaatttaagaaagtctataagctattagtattaaaaagaaagttcagtatgtttgctaggcataaaatcaataagtaaaatcaaatcaaacttttagaaaatgtgattaataaaagaactatttataatagcaacaaatcataagatatccaggaagaaattacaaattgcaatgatattcaagaccttatgatagaaattgaaactttagccaagggtgctggctcatacctataatcccaacactttgggagggtgagatgagagtatttcttgagtttaggaatttgagaccagcctgggaaaaatggtgagaccccaaatctacaaaaaaaaaaaaaaatggaaatgtgttgaaaataataaaagatgtaattccaatcaaaatcccaactggaaactgtatagaattttcaaaagctgactctcacttatatggaagaacaagaagtcaagaatggcagatataattgtgaaaaaatatcaaggggaaatcatttcattaggcattgagacctactatgcagaatggttgcagtggctcacgcctgtaatcccagcattttgggaggctgaggcaggggatcacctgaggtcaggagttcaagaccagtctggccaacgtggtaaaaatacaaaaattagccggtctctacaaaaacacaaaaattagccaggtgtggtggtgggtgcctgtaatcccagctactcaggaggctgagtcaggagaatcacttgaacccaggaggcgtaggttgctgtgagcagagatcgtgacactgcactccagcctgggagacagagcaagactccgtctcaaaaaaacaaaacaaaacaaaaaaacctactatgcaaatgctaaaactatgtggtaatgatgaaagaactgatgaataatccattgggtcagaatagcatacctaaaaacagatctacatagaggatcttggtatataacagaaagcctaaaaatcagtagaaaaggtaatggctgagtaggtactacaaaatctaccatttgcagattgagtctaattttttaaactcaatatcttcagaaaaatagaacagaatacagactctccataaaatcacagtcacaatgtttagaatacaatctcaaattattctacatgcaaagaacaagaaaagtgtgactcattctcaagagaaaatacaaatcaaaagaactcagccttaaggtgactcagatgttggaattagcagacaataattttaaagaagctattataactatgcttgacataaaagaaaatatgttggtaatgaatgaaaagatagggaaccctatcagagaaatagaaactataggaaaagaaccaagtggacattgtagagctaaaaaatacaatgtattcctttcctgtggttgctgtaacaattatcacaaactggttagcttaaaacaatagaatgtattatctcatagttttggaggccagaagtctgaaatcaaagtgtcagcaaggccacacttcctctggagatctagaagagagtcctttcattgtgttttctagcttttgatgactgttggcatttcttgtctacggctccatcactacaatctttgccactgtgctcacaatgccttctcctcttctgtctggcaaatcgccattgtgtgtctcttacaaaattgcttatcattgaattaaaagcccacccagattatccagggtgatctcttcatctcaagatctttaacttagttacatctgaaatgactgggttttttttccaaaataaggtaacattcaaatgttctagagatttatgtagataccttctggaagactacttttcacccttataacatacaatctccgaaataagaaagaaaaaagaatgtgctggatgaaactgtagtagcatggagagtcagcaaactcgaagaaagagcaatagaaattattcaatatgaagaaaaggtagaaaaaaagaatgaaaagagcctcaggagcctataggtcaatatcaaaagagctaacacatgtgtaactggagtgttagaagcagagggagagaagatgaagggaaaaagccctctgtagaaacaatggtcaaaattttcccaaagtctgtgaaagacatacattgacagattcaagaagctttgcaaaccccagcagaattaataaacctaggcaagatttctgcatttcatatgaaattctgcaatattaattctaagtagattatgtgagaattgactgagaacgtatatgaggaaactttccaggttgatggtaacattctaatcttgataaaggtttgaactacagaagggcatgcctttaccgaaactcagcaaacatacgcttaagatttttacattttattgcttgtacattttacctgaaaatttaaaaatgtaaataatattgaactatagttaacatatgcatgctataatatttaagagaaagtatatcatgcatgcattttaattttaaatgcatgaaaaacagggaaaattggtaaatggatagaaggatgaactgatgaatagatatttgataaagcaagtatagcaaatgttaatgacagaatccaggtggtgtagatacaagagttcaccagaaaattactttaactttgctgtatgtttgatatttttcacattaggatattggaggaaaaatcaatgggaaaatgaagggctgctttatatgtagttctgagtcaatggattatccatatagaaaaaaaagattaaataaaattctgattttgtgggatacattaaaataattccagatggttttaaaaaactaaatgtggccaggcacagtggctcacacctgtaatcccaacactttgggaggctgaggcaggtggatcacgaggtcaggagttcaagaccagcctggccaacatggtgaaaccccttctctactaaagatacaaaaaattagccaggcatggtggcacacacctgtaatcccagctactcaggaggctgaggcaggagaatcgcttgaacccagaaggtggaggttgcagtgaggcgagatagtgccattccactccagcctgggcaacagggcaggactctgtctcaaaaaaaaaaaaaaaaaaaaaaaaaaaatatatatatatatatatatatatatagaatgccacactgtaatagcacaaaagtggtgaggtggtgcacgcatgcagtcccagctactcaggagacggaggcaggagaatgcttgaactgggaggcagagattgcaataagccaagatcatgccactgcactccagcctggcaacagagcaagactctgtctcaaaaaaaaaagtggaaataactgtcctgtagtaggaatatggattaataaactatggtttgttcaatcaattatcatagaacagttaaaatgattttatgtatcaaattagataaatgtcaagacataatattgattaaaaataaagttacaaaggattgtgtacaaatatatcatctatttaaaaatttaaaatacacaaaatgatatatcctgtatatatccaatacatggtaatgatatacagtcatgcatcacttaaagcctggaatacattcagagaaatgtgttgttaggcaatttcatcagtgtgcaaatatcacagagtctatttccacaaacttcaatgggataggcgactacatatctaggatatatggcacaatctattgctcctaggctacaaacctgtacagaatattactgtactgcatattgtaggcaattgtaatgcaatggtatttgtgtagctaaacatatctaaacatagaaaagatacagctaaaacatggcattataatcctatggaaccactgtgaaatactggtctgtcattgacaaaatctttgttatgtggtgcatgactatactcctatttcaagaaaggacttacctctggtagaggagaaaaaaaatatttttaaaatcttgtgtctttaacaattgttcttttaaaaaagagaccttgtgtaaataggacataatgtaaatatgtccttttttcaaaaagaccttgtgtaaatatgacatatgtaaatatgatttatcggtttaattttgtcagtacatacattgttattgattatattaattcataatattttatgtgatcatgtcatcttttaaaattaaaatgtagatgactcaagccctcaccttacatatagcatataacgtacgaagtcttttcagtatttctttggaatttcaggggatttacaattggctaaatgagttcctgttctgcgagcatctttctttctctcttgatccctggctctgggcttctgccagccttaactgcctcagtcttctttcaatatgttccttccaccaacacatcagcatagcagagggagtcttagaggaggggtgcattgttcctcaaaccccattatcattaagaacacagagctaccatttatggtagatttgtactgatagttgaggctaatgaaggattacagtttaatacttaaataaaatattctaaaagttcgttcagccatttccacctctattttaggcctacattgtttccatcttcctgggcttttctcttaggcacaggtgcacacccacacacaaacatacacacattctacttactctgactgccagtctcctacctccaaatcctgttagtccttctgcagaatagttttgttcttcacccttgcctcaaactaagttttaggtctaccttgcatatccaaaatatgaattctttgctaaacaaagggccttctattcaaggtcattattgtttaactgcacgaaacaaaaggaaaagctttaaaattacaggctttcctttagcatgatcacatttttttaaaagacagcttatccctacaagtctttctgaaaatagagggaaaacagtatgaaaattcactctacctctctccagaatacatctgcaagagtggtgagtctcttccagtctcctcatccgcaatttacccaaccttgcttcataaacacatatatacacatgttaaaagctctgaaatcttggtccatttagcaaagggcaaacaattccatatattttagttgatactgaagaaatatgtgtattattatccgtattaaaatgaatgtccataatgatgatgctttaaatgtttatggcattctacagtttacaaggaacttttacataaaacaacctgaaaagaaatatgtagggtcccacaaataatttttagtaaaactgaagctagagtccaattctcttgacttccaacacagtgccttttcaacccatcatgttgtctccagccccacagtgccaagaaaaggttagattcacgtcagagtactatcgaacggataaagcaaaaggaaaagtagaaggtgttagaaaaatagatcatttaaaagtttaaggctggtagatgagtgtctaggacagtccctaacacatagtagacactcaataattatttgttgtattaatacataaaatgtcacttctgagctgtttaaaatcacaatctagttacccagaatgattcaagggttttaaatggctgtgatcgtgctacacgggatagagaaagatgcctttatgtgcatagatgtatccataaatttcccatagccatcattctcttccttgccatctaattgtacacaaaaccacattagaaagtgtaaattataaacagttaataaaacatatccaacaatataaaaaccctgcctagagaaagacactgagattcagataagattgttttacaaatttgtgatgtaccatatagaggacttttgggtaatctgcagtgaaactagactttcataaaagaaagagtatgtctgatatccttcttcctggtgctataaacagggttaataggaagtgaagtcaaacccttgactgtgactgacatgagggagtaaaatctgctccgagaatgggacacatcagagggcagaattctggtctaggcttagaaaggacttccaggtggctgagcaaacggcagtcttttatttggcagaatttgcttcagggactaagagaagagaggagattcgaagaaaaagagtgaagattatgttctaaatcactgataaaaagtattataattaaagcacattggaaatttataacactaaccaaagtatcagcaatctctatctagcaaaaataccagagtgtcattaaattaccagcaaagaacacacagcagaagagagaggtctgcattttcaccaaaccacagcaatcctggagagggctctatagccagttaagacattctaggtcacaggatgagatgggaggtcagtacaagatacaggtcataaaaaccttgctgtttaaacagttgcagtaaagaagccgggcaaaacccatcaaaaacaagacggtgacaagagggacctctggtcatcctcactgctacactcccatcagcaccatgacagtttacagatgccatgccaatgtcaggaagttacccctatatggtctaaaaagggaaggcatgaataatccatctcttgtttagcatatcatcaagaaataaacataaaaatgggcaaccagcagtcctcagcgctgctctgtctatggactagccattcttttattcatttactttctgaataaactttactctatggactagccctgaattctttcttgcaggagatccaagaatgttcccttgaggtctggattgggacccctttcctgtaacacctgctctggagaagtttggggtgaaagagacaggctcactaaagggagcaaaacacagtgcaaagagcataataaaaggatcaagagtcagaaggtataggccatttttagaaatcttgattagcacttcccaaatatttaggaagatggaggcagggactggagtgatactgccaccagttaggaaatgcctggaactacccgaaaggggaataaacaaaaaaggatcctcccctaaaggctttcagaaagagcatagctctgccaacaacataattttggatttctagcctccacaactttgagagaataaatttctcaccctggtttgtggagtagaggcaaaataaagatactgggtcaaagaagaccaagttagaatgaggaaactgggtggccttgctattcaaaatgtggccagaggactaagagcatcaaattgatacaaatgcaggatcttgggcccaacccccagacccatcaaagcagagcctgcattttcacaagatccccagctgatgtacaggcccattaggactgagaagtactgctctagggacacagatgatggaatcaggccttatgctcttggtatgccttatgcttatgttgagcataatgccttctattctgactcttctttaacacctgttcagaaagaggcttagcctcttttcttttggaatgtagataagcaatgctgagactacaatggtgagatctgcagaatgtaaactagttttctgtttttacatagccattatcagcaagcattctcagaagcttctaactgaccttaaaatgactacagactctttctttttttttttttggaagctaagcagaatgagtcacaaccttacctcctctttgttctttgtggtggctacagagatgtgccacccaccgcatggcccttcaatgaagtactagtcccagctgccctcctaaaggggcagctggctttcagtgatgaagtgggcccagccattttggcccagtgcagtccagtgcatggcagctctgatgggtcatctccactccagatctctccatggcgttggcctaggctgctgctcctgtattccagctcacttctccctctgcctgctcagctcctgccctctcccttccacaagtgttgatcccaagggcactccacaatactccctgaacactaaattctgtctctgagtctgctttctgaagattcctatgacgtaccataaagaaaatgtaagtttgccagggctttgggcagaagtggaatataaatcttacactgggcattgaaagatctagttcaagtctcagatcagccacagagaggcagtgtggtcttgaacaagcatcttattgtttatgaacctcaaatatctgtaagacaagaacaattcctccccatctatctcacagagctgttgtcatgaggacttcagatgagataatatgtgtctggggaaagcactctatagagtgcaagacattagatattttattattagtcagtagattctagagtttgttttgtattttgttgttgttgttgtttctttgcctgtttcttaaatccattcttctcagcattaaaccattcagatcactctagcaaaatacttctctgggttagtctcatatttggctgagaatgtgagtcctaaaggttcataaggagttgtcaaaaatcaaaaagacctatttatctttgtcttcctctttttctggaagagaaatagtctcagactagtgtaataattcacttactagtaaatttctatgagagaaaaattaagagatataataagagcctctacacctacagcaaccttcagagacctttgagctcctcatttaaatttactttaaaaaacacattcttggccaggtgcggtggctcacgcctgtaatcccagcactttgggaggccgaggcaggcagatcatgaggtcaggagattgaaaccatcctggctaacacggtgaaaccccatctctactaaaaatacaaaaaattagccaggcgtggtggcaggcacctgtagtcccagctactcgggaggctgaggcaggagaatggcgtgaacctgggaggcggagcttgcagtgaaccgacattgtgccactgcactccagcctgggcgacagagcgaggctccatctgaaaaaaataaaaataaaataaaaacacattcttttctgcctgattttctgagggcaaaaaaaaaaaagaattaaaaaatacattattaatcaaaaatcacaattaaatttcagttgcccttcaacaattctttgggtccagaaacaagcagctcttctctttccctctctgttcatctctgttctctttttcccttaggatcttgcaatttttttaaggttttctccccttgaagttcttggcctccaaaattccttatcctgaagccatcctcacaggattaacaaaaattctggaaagacctataattaaccactgatcaagctgcactttggcccacttccttgtaattgaaagtcaggtagcactagatactgatcatttgcattcctatttttctgatggataggatttctgacgttagaatctgtttaaaaattaatttgtatgcccattgttcttatagataggatctctgacgttagaatcataaggctttcgtttaggagttgcttaagaggtttttttccaaatccccaattccagtgaccctccacataggaactgaatctacatgataatgcagtttcttcatctccctgtgccatgacatcaccgtgcactcctcaatgaatcaatgatctccaaatttcagcccaccccaaaacccttaaaaacccttgccctaaactcctcatggagatatggatttgaggttttaagtgaccctaactaagattaaacctctttctccgctgcaacttggtgtcttggagtactgacttgccatgaacatcaggcaatggacctattatggttgaaattctaccttggtcctgcttgatccagtatcattattttgccttcaccccccaacccaggatgtatacttctttcccacccatactgcacccctatagttgatggattttcccgctattagtatttaaaggctaatttagctaattcagaggtcaactggtattacagaaagaagctgggtggagacaggctgctttcagataatatataacatgtgcatgttaataataaccttctaaaggcaaatagtctgtgggaaccatttctccatcagtgtaatggtggagattttggacttgacaattgagggggcccagactccagctggttgtgggagcagagataactgctagaaaggccactttcaccctgaggaggtccctccccagccctaatcatttgaaatggacgtcttcacctgctagtttccttcctgccaagttctgggaatgttgatgctatcttaccaaaagcttttcaggtctccttaattctcattggtctagtcgtatacttggctttagaacaaagaggatttcagtgtctgtcaatgatgatctcctgtgatctagcagttctgaaagatgaacttgccaaaatgagaaaattaaaagagaagtgccctatgtgggagaaaaattatgcattaaagtgctaagtatcacccaagagataagtagtaagtataagtactcaaagacacttacagtatcttaactttcacattgaaaaaaaaaattgtgcagcttttaaactccctcagttttgtattttccgaggtagaagctgtgtgaaaagagtgatattgcctgtggtgtttggaagctgactggcagtgacattaggcagcagtctcctgtgagaagcacagctcgcattcagacagggtgaagaatggcagagaaaggctccaggaagtgaggcgggacatacggagacgctataaaggttaagtgggaaagcaccactgagaagttcaaatactactacaagcaacacaggcttaccagctcatttactgggtgtgttggcatgtgcacactgagagctcccagggctcctgcagcataaaaatcaatataggcaagaatccccttcctccttctctttttgttcttataaattggaaaatataaggcccatatcattctgatgttccccaaaagtcctaactatccaaaatgattaaaagcaaaaagtcattcactccattcagcgaaatgaatagagaagaaaatgaaaggatggggattggggagacatatttaaccaattttcatatattccagaatgatctttatgcctgcccctcatgtagatgtaatatgtgaacacggctgaaagagatatttttatctcctattagcatatgcatggacctctgcttcacatgattaatgtacatgtatatgtctgaaatcagtcaaatgagttataatgaaacttcattcctaaagggcttgttcattgagttattaatgtataaagaaaagaacgttaaaatgcaagccttaggaaaataaaaacaatagcttcagtttttgcaagataggcatgctattcgcttttgctcagtatcggtttctcaaaattaataatcatcaattgcaagaaagaaataattcaagttttttaaaagtcttgactaatgacgcaatttttacaaagcagagaataagttgtatggtttttaataatcttttagacttagcatctgagtattttttcaattaagaaacaacatttttaaggaaaattcaactgtgtaagtagctcctaatgactactataaaattaaaccagattaatgatttggtctctcttttctaataaatgacttagaaaagtttaatttcctagaatgtcacgtaagactatttccatgtatttttctattaatcaaacattgaaaatccaaatgtatgagtgcgtagatagctgatgttaaattggttttaaaatgaagtacattatttctctggtccaaaagctattactgaattctacagagatgtctgtgattgtgtttgtaagcataactatcatggtttctgaaatatgatttaaaaatcaatatctaaaagaattttaaatgcatacttggacattattcatcctagagatatgcatatctcattttctagaaaaatcaaaggcatactctttcaaaatcaaaattatattttcaattctgtctgcattatttgattgcataggaataatacttagatttaaccaatttagaggaagaactatatgatgaaagaatattaaacttgagtagcttagccttcatcttctatagctagaactcgatgtcttagcaatataagtctaccagaaatactgactaacaaagaaattattatagtaaaaatgaactccaagtttcttttatcttaatgtttctgaagaaatacaggaaaaagaactattatgaatgagttcaatattgttgttccctaattatataatacttagctcattttgctaaggtatgtttgcagaaacagaatgatgacttaatattgtacagattaaatctatgaagaacaattgctaaataataaagcaaaaaataaatataaaaattttttgttgactgggcgcggtggctcacgcctgtaatcccagcattttggggggctgaggcggacggatcacaaggtcaggaattcgagaccagcctggccaagacggcgaaactccacctctactaaaaatacaaaaattagctgggtgcggtggcgggcgcctgtaatcccagctactcgggaggctgaggcaggagaattgcttgaaccagggaggtggaggttgcagtgagccgagatcacgccactgcactccagcctgggtgacagcaagactccgtctagaaaaaaaaatttttgttgttgttttaaagtccctaggaattttagaatacatcctaaatgaacagctataaatatattttgctttagataaggtttttcacgtttatttttaggaaaattattttttgaaaaaataatttattctgtaattatacattactttaagattttgaattcatgctctgatatataagtagattatgattaaatgaattgacacattaatctggtccatgacatatcaggctatggttgattcaccactcattacagtttcatctttagtctacagtcaaatctaaacccagctttcttctgagggaagaagtattgagaattttatttttatttatttataatacttaaatgtttatcatttccaaatttcattgaaatgataaattttgttgattctctggcacttcagaacttataatttaatattttaggcatattcttgaaaattatttataatttgttgtgctttagtttagtatttattttattttatttttatttatttttttgagatgcagtcttgctctgtcacccaggtggcacaggctggagtacagaggctccatctcaactcactgcaaactccgccctccaggttcaagcaattctcatgtctcagcctcccgagtagctggaattacaggcacgcaccaccacatccccctgacttttgtatttctagtagagacagggtttcgccatgttggccacactggtttcaaactcctgacctcaagtgatctgcctgccttggcctcacaaagtgctaggattataggcgtgagccaacatgcctggcctgttttgtttttagaaacaaggctccactttgtggctcaggttgaagtgtagtggtgcaatcatagttcactgcagcctcaaacacctgggctcaagcaatctttcctcctgcacctcccaagtagctgggactacaggtgtgtgccaccatgcctggctaatttttttttttttttttggtagagacggggtctcactatgttgccaaggcttgtctcaaactcctggcccaaggctctgggattacaggtgctagccactgtgcctgacctattgtggttttagtaggcattttttcatgatctcaaatcagaagctttaactataaaatacttagagcctcttactatagaacttggtaggtgttgattagaaaaggcaattacagaaatacatcatttagaaatacatagtccacagaaaaaaaaatgaaatacataaatatatcacaaggaatgtacaaggtctcatatctgtgtgcaaacctgaagcatagggagctacttccttagagtaactttccaagcactgtcaagccactgccagaccaccattggtccactgggtagcaaaggaggggctgtgtgcaagagagaagccaaggacaattcagcccaatgatgctaagaagacctggacacacttaactacaaactttcaaccactaaatcccaaccaagacgggaatgctccctcttcttggctgtctatacccctcaagctgcattttatccatctgccttcaaaatgactattgaggccaggcgcggtggttcacgcctgtaatcccagcactttgggaggccgaggtgggcaaatcacctgatgtcaggagtttgagaccagcctggccaacgtggcaaaaccccgtatctaactaaaaatacaaaaattagccgggcgtggtggtgggcacctgtaatcccagctactcaggagactgaggctggagaatggcttgaactgaggaggcagaggttgcagtgagctgagactgtgccactgcactccagcctgggcgacaagagcaaaattccaactcaaaaaaataaaaataaaaataatgctgttggccagccacggtggctcacacctgtaatcccagcattttgggaggccgaggcgggtggatcacaaggtcaggagatcaagaccatcctggctaacacggtgaaaccacatctctactaaaaaatacaaaaaattagccaggcgtggtggtgagcgcctgtagtcccagctactcaggaggctgaggcaggagaatggcatgaacctgggaggcagagcttgcagtgaaccgagattgtgccactgcactccagtctgggcgacagagtgagactccatctctaaataaataaataaataaataaataaataaataaataaataaggctgttgagttaacctgatttcagatcaataaattgttaagatagaaacatgctgttagcggtttttacactgtgcgctcatatagggacaatgctgcactgattttcgcctccacaggcctttcccttctggccaattccctcatgagccctctaggctgcctagccaacaagtatacatgtaatttttctcagcagagctccagagtttggtctatctatttttaatgttcctgaggattaatttattacagctcttgaaattcaatgagtcccagctctgaatcatgttgaaggccgtgggtgcagaacacaaagcttcaggaacctacctagagctggaaatgctgcagttgcgttttaggatatagcatatacatggttctttcggcagtcacatgtcttttaatctaatgaaagcagaaaagtgctagctggaaataactgaatctgcaaagctagctaagatgattcaaatctgaaacacttcaccctgaccccaagcctgtcctgagacagctttgcattttattgaattaatcattaatgttgcagcacctctagttttattccatcattagaatgacatcatttggaagaagtaaagaagttgctatagatttagtggaccaagacaatcaattgaagtttcttaaaggtgaaaagatggcagaaattcttgtccttggcttgcctgcaagatttccatttgcccacatacatactatatattattttcagtaccccccacgcccatcacttctcatattctctacagctggttctgtattttcatggcaaataaactcacagttgttccacaaactcgaatttccaggaaaatcatataaaacagtaatagaaaaagaaggaaaaatttatatcttttcaaatcattcttcttactttgtatcttctaaaaaagagaaacatttattcattcatttatcctcatattgaaagggggagtaagatgtgctcccttttgcgaggagctcataatttatgaaagtggtttttaaaatgtgggttagtaatctcttttggatttcaatgagaaccaaaactcttactaggaaaatgaacaaacccatataaaacttcgaatataaatgtttagggagttgataaccacctgtggcccatctatacagcccatgttatgaactgaatgtttatgtccccctaaaattcatatgttgaagttctcatccccagtgcgatagtatttggagatgaggcttttgggaggcaatttgggttagagcagataatgagggtaggcccctcatggtgaaattagtggcctcataagaagagaagaaagtgatagtcctgttagaagcatgtagcactgtccacagcttcactgggagaggacaaatgaaagatctacccatggagcttacttagactctgatttatgtgctgcttttttgactgactttaatctggaccccttccagaatatcactatgctataatacaccataactgtgagtataacagacttcactgagttctgtgagtccttccagtgaatttctcaaacccggagattgccttggggacccctagacttgaaattggtatcagcaaggagggtggtcttgcaaacccctgaacagtgtggttggtgtcagaaatgaaggtggtcttggggactgcctaactctgcacttattaaacatgcttaaacttaagactttataatgccatcaaagaaactagtcacctttggaggatattaggaaaacaattttcttaaaagactggcaaataaaaatgcaagcatttgttttaccttaattacattaactgtacatttatttgccttaattatattaactgtatacttatgataatcaaattatagattagaggaggtgtaccttcttaaaagtaatacaagtaaaacaataaaccaacaatgaccaaaatgtaatattactattttgaaacccttaataaattaatagatttaggccctacatatcaacagtgcttgaaaccacaaaaagagaaatgaccagataatatatttttcctgctgaaagaacactagcacctccttgccaaaggaaccaaacctgagtctgatcaagtacctgaatccagttatgaatttgcaggcaataatgaggacagagataactgttaaactgaacaatgagtattatgcagtcaacaactgtgggaaactctattggtcaaaaagtgccagtttagcaatagaaaaattgtaaagaaagtaaaggaatagaaaaagaatctgtaggccaggtgtggtggctcacacctgtaatcccagcactttgggaggccgaagcgggcagatcgtgaggtcaggaaatcgagaccatcctggctaacatggtgaaaccccgtctctactaaaaatagaagaaattagctgggcatggtggcacgtgcctatagtcccagctactcaagagactgaggcagaagaattgcctgaacccgggaggcagaggttgcagtgagtcgagattgtgccactgcactccagcctggacaacagagcgagactctgtctcaaaaaagaaaaaaaaaaaaaagaaaaggaatctgtagactaaaaaagatgtatcaaattataaaatggggaagattcaatgataatatctaaggatgaacatttatttaggtgatagaactataaataagtgtgaggaagtaattattagaagtcaggctagtggttacttaaggcagatatgagggagctgtgattgcaacagtgggggctggaaatgttccatttcttgattagttggctgagtggtagctacaagaatactctcttatgtgatttattaagctacacatttgttttgcatgtttttctttaccttgtgaatttgacttttggtttctttacttttgttttttgagacagggtctcactctggttattggctggtcacaatcatagctcattgcagcctcaaacttctgggttcaagcaatcctcccacctcagcctcctgagtagctgggactacaagcacacaccaccacgcccagctaattttaaaaaatatttgtggagacgtagcatcactatgtagaccaggctgatgatcttgaactcctggcctcaagcaatgctctcaccttgatcttgaagcactaaaattacaggcctgagccaacactgccaagcctgaggttgattttttttttttttattatacttcaagttttagggtacatgtgcacattgtgcaggttagttacatatgtatacatgtgccgtgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcagtgtttggttttttgttcttgcgatagtttactgagaatgatggtttccaatttcatccatgtccctacaaaggacatgaactcatcattttttatggctgcatagtactccatggtgtatatgtgccacattttcttaatccagtctatcattgttggacatttgggttggttccaagtctttgctattgtgaataatgccgcaataaacatacgtgtgcatgtgtctttatagcaggattttttaactcaagggcaaggcttgcacttacccccactaaattatattcatctcatgtccctggattcttaagatgcctttggattctcatgctacccaacgtgattgttattcttcttggcttaatgctatccacaaattcaggggcaaagtatcttcagcaaaacaacgaatttaaaaaagaagttgacaacctaaattctagatcttgatttgggtggtgcttgcacaggtgtatatattcatcaaaactcaccaaactctacacttaaaataggtccatgcctccctcatgtttgcttgtttaatttgctttcctttcctgacagcaggagtcattcattgtgactcatccacaatcatgcaaacaaccagctgaagatgagggaacaacttgttggaaggaacccaaggctctgcatgaccatttggggtacagctacttactgactgggaatgtttacctacagcttttaggtgagagaaaaacaaacttctttcatttttaagccacaatattgtcaggggtatttggaacagcagcatagtctattactctaataactcaattgccttcagaagccaagcaaggaacagaaatatacaaagaggccaggtgcggtggctcatgcctgtaatcccagcactttaagaggctgaggcaggcagatcacttgaggtcaggagttcgagaccagcctggccaatgtaatgaaacccccatctctactaatacaaaattagctaggcgtggtggcactagcctgtaatcccagctacttgggaggctgaggcaggagaatcacttgaacccaggaggcagaggttgcagtgagccgagatcatgccaccacactccagcctgggcaacagagcaagactgtctcaaaaaaaaaaagaaagaaagaaagaaagaaatatataaagagggccgggcgtggtggctcacgcctgtaatcccaaatcccagcactttgggaggccaagccaggtggatcacttgaggtcaggagttcaagagcagactggccaacatggtgaaacctggtctctatggagaatcacttgaacctgggtggcagaggttgcagtgagtcgagatcatgccactgcactccaacatgggcagcagagtgagactttgtctcaaaataaataaataaataaactaacaaagaggcaggagtaagacactgagaactgtggttagtacatactgtcctaaaagcactcaaaaaactgtaatttttttaagcattctgtactgaaaacaaaatgcagggtcaaattctatctgatggctatagtttgcaaacctaggttaatcaggacaactggagtaagattattcttccagctacaaattcatgtaattttcttgcacacatttcttctctttgtatagaagtacatcataagagacctaagcaaatgacttactaaagtacacgttttcttgattaggatataacctaagctgctatcacatggagacttaaaaatgcagtggctcagataaaatgcaggcctatttctctttaacatacagcatctggggggagataggtgttttttcttcatgtggccatccagggactcagggaccctctaagctgttgctccaccatcccctgggtattgttctgactgcttggttgacgttccctcaccacttttggactgcagaacaaggaaggagaaagtggaggggagcaatccagggaccagactgatggctccttattacaccccattagccagaacctagtcatgtggccacacccagccacagtggagtgcagaaagtggagtctctatataagccatcatgctcccaattaaaactcagtgggtgcttttaataaaaagatggggagaatgtttattggggaacaattagccgtctctgccacatattcactagtctaataagtttctggacgatctgacgttatattcttcaacaatctctgctggattcttggtcttcactttttattaggagcaaactttgaataacccattctagaccctcactcagaatcattgtcaggttcatcagtcttactttgcagaaatgaacgctttttgctttagaaaactggggttcacttttattttttcccatctccctagagcactcacccctcaggattcttcagagatcaataccttggtgacttcagtctcaaccactcctggtgccatggaatatcattcttacaggtcacgcgacagaaaaataaaaaagtaaaggaaagaaatgaaactatttcaactagtctagtgaataggcaaaaacaaaaagtgttaggaaattaaaaagggtaattaaaaaaaattttttttttgagatggagttttgctcttgttgcccaagctggagtgcaatggcatgatctgagctcactgcaacctccacctccctggttcaaatgattcttctgcctcagcctcccaagtagttgggattacaggcacctgccaccacacccagctaatttttgtatttttagtagagacggggtttcaccatattggccaggctggtctcgaactcctgagctcaggtgatccacctacttgggcctcccaaagtgctgagattacgggcgtgagctaccgcacctggccaaaattcatttttgagagtttagctacatcaagaaaaggcttcaagtcatttattaaacaatggatcatgatttttatgtcaatcttctttacacacatgcatccatagggttttgttttattttattttaccatcactcaagctaactagaattgtgaacatcaacttctctgaataatcactatgaaatcttccaaaagaaaggaaagggctataatcctagcctaaatttttggctgtcctcccaattaagtgtcaaaacaatcaatcactgccttcgggataactattctttattttactgaagagcctttttagtggttgattctgaataattatatatcatgcttgactttccttgcatataatatgaattttttttcttattctctatggtaactgctaaaatatttcaagcttatttcttttctctcttaagtacatatctagttttctggggcaggaggaatctggaaatatacaaaggcagagttagtacaggaagtttaggttaaaagaaacatacacagtcatccttcagtacatgcaggggattgattccaggactcccatgtatacctgtgcatactctgtggaaggtagatagggaaagtcagccctcagtatatgtgggcttagcatcccatgaattctgtatttttcaacatgtttggttgaaaaaaatctgtgcatatgtggacacctgcagttcaaacccaccttgttcaagggtcaactatatttcaagcttcatctctcaaaatcctctccacatttcaaccacattgagtccatttgctttttcctgaaacatatatacattgttacaccctgtgactttcatggtgccctttattcaacagggaatgtctgtcttcccctttcattctcagactattgatcctcattcatcctttattgtcagctccaaatccacctccagcacgacgttttccctactcatccacaacataatcaagtgtttctgtttcagctagcaaatagctgcccactaacttttcaaagagagtgtatgcaagtgaattttttttatttttaaaaaacttcatggtttttacatttatacaacacccaaaattattctttttcatcaggctaccacttctgtggtcgctatctgctggaatggttcctttcctgaaatttagccataaggtaaatcgattgtcctaaaacagcaagaaaccccatgctagctgattgaaaataccaggatctagcagacagctcagcaggaaagcattttggttcctctccagtcctatccttgattggctttgcacccatagaaacaggtcccataagcatcctaagggacattagatcactgtctctgtgactctgcctagccacctgggaaaggagaaagccttctagagaagtctgcaaagccatggctagggggtagagttgatggatgacaaccagctaagctgacctagcaacacactttctacttctccaggacggttttcccatgctatcatatatgacccaattaggtctgtgcttttgctcaaattatttgcttctgaatgtatttagaaaagtataatgttcatttgcttttgcttctatcagtaaagaatacttactcatttagagctctatttggttggtgctgatcatatttgataacattcacagaataacttgtttatattcattttctcatttcttccaacccataataactccttggggagggacaacatctgctcctttgagatgaatagcttcagccttctggatggtttctccaggcttcagactccagggagatcagcactccccagttcttttgaattccccagatttctgcacagaagtttatggaaaacagaattgtaatgctgaggtgttagctatcagaaacctgtgaaagagaaaaaaaatgagcctaagagaagatattgaaaaagaaaaagaaacaaggaagatttacaaaagatttcaaagacctttaaaatcaatagtaaattacctcctcagggattaaaaattctataatgaatattaaatttcttctgcttccaagtatttagtgtctttactgttaaaatattaatattttgctttcctagaatgagattaacttttaaattccaggcatttagatttagaattcaatacacagcttattaaagtgtgggaagtgttaatataattctctaatgttcttataactatgtcccaaagccctagagcacatatgctatatgggccaattaatatccaaatttcataatgtatgtcatcaccataggcaattagaatttaaaaaaaaatgattccctttctgatgctaacatgacattggacatttaacaaacattcattgagggcctactgagagtggaaagagggtagggagaggggtaaggatagggatgagaatgcaagtaaggggaggggaagcaaggaaatgaccaaaacacggtacaggttgagtaccccttatctgaaatgcttgggacaaaacgtgtttaggattttggatttcttcagatttcagaatatttgcgtatacatgagatatcttggggatgggacccaaatataaacacaaaatttgtttatgtttcatattagacctatacacacagcctgaaagtaattttgtacaatttttttttttttttgagattgactcttgctctgtcgcccaggctggagtgcagtggcacagtctcgactcactgcaatctccacctcctgggttcaagcgactctcgtgcctcagcctcctgagtagctgagactacaggtgcgtgccaccatatccggctaatttttgtaattttagtagaggcgaggtttcaccatgttggccaggctggtctcgaactcctggcctcaagtgatccacccgcctcagcctcccaaagtgccgggattactggcatgaaccactgcatccagccaattttgtacaatatttttaggaattgtgtgcataaaacaaagtttgtgtacattgaaccatcagaaagtaaagctgtcactatctcagccaccatggacagtctgtggttgtttgggatcaccatcattcctgacttttaatttatatgctactgataagcaatcattttcttacacttattcacacataagtacttaacagaaaaaaaaagatttaccattattacagttagaaaaaatgtgttcagtgtaactaagcagcacaggagcatcatcagaatacctgtatcagctgttaaaccagcagcaacagacctggtgtggtggcttgtgcctgtaatcccagcactttgggaggccgaggcaggtggaccacttgagatcaggagtttgagactcgcctggccaacttggtgaaaccccatctctactaaaaatacaaacattagctgggcatggtggcatgctcctgtaatcccagctattcagaaggctgaggcaggagaatagcttgaacctggaaggcagaggttggctgcagtgagtcaagattgtgccactgcactccagcctggtgacagagcaagacgctgtctcaaacaaaaaagaaaagaaaaaaaaaaagcaacaacagatgaacagtaggctttcagtctccacgtatggtgctgtattttgatttaaaggttaccaaacattatattttacttttttaaatgagaagaaacatcagaagtagttgaggcacaaggaagtaggtcttctagggataaggagatatttggctgggtggctttttttttttttttttttgagacggagtctttctctgtcgcctaggctagagtacagcggcgcgatctcggctcactgcaacttccacctcctgggttcaagcaattctcctgcctcagcctccagagtagctgggattacaggtgcccgccaccatgcccagctaatttttgcattttcagtagagatgtggtttcaccttgttggccaggatggtattgatctcttgacctcgtgatctgcccaccttgccctcccaaagtactaggattacaggcttgagccactgcgcctggcctctgctaggtggctttttaaaatgtttcctctggagtcatctgcctcattagcattggtttttgtccagaagtctctctttgattttataactggcatgatttcttgctttgttatgagtgcaccctgctctagtccttcaacaaataagcccatcacacattttcaccatgtcatctagaggcgtgagccaccgtgcctggccctgtgtctttagtcactgtgttccaagccttggaaacagcatatacagcatccttcatgccaaactccttttaaaaaccttctactctcatgcctctgttcagtgctgctagtatgctttccaagaaagtgttcttataattactcttcatttgatatttggttacatagctgaattaatgaagtcacatttttggggaaagtatatgtcataaatgatattttttatgagaatttcagcaggagaatgagcaggacagtggtcaaggaataacaatatcttgcagtagtcattgagtccagcttttctgcagtgagcactagccaaccactggtacaaaatgtttgtgatactagtcagaaaagacgtccctggcgatccatgcctttttgttagcataataatggactagtaagaaattcatttcttgaaaacagccaaggatgcaggcttttgcctatcacagcaagtttacccttatgcgtgctggctgcattagcacatccctgcagttattccgtccttggcatccttaattcctgtaggggctgtctcattagctgcagtcactgtctttctggggcaataatactaaagcagtgatgtttcatcagcattacagacttgttctgacgtcagattttaatcagccatgaccttggcaaactcatcaatgaatttctctgctggggagaattgcttgaacctgggaggcagaggtttcactgagccgagatctcgccattgcactccagcctgggtgacaagagctagactccgtctcaaaaaaaaaaaaaaaaaaattttatctgctgcctcatgatcagcagatgctttattacaactaaaatctttaacaatttaatgctgtgttttttcttaaatttcttcagaccgttgaatatcacagttcccttcagttttcagttcatcatgaatagttcttttcttgtttcatgatcagtataccattaagtggcatgtgttcactgcgaagctgacacatccactctttcaatacatgatcaaaatctgcatttttagctttatgcaatgttttcccatgtttcattaacttctattcatcacttgcagcatagaacctcaacagtgtatccttctgattcttcaggtcatatatgatggtcattcctaccccattctcttctgtaagatgtttcacacaccctgtccagtttctccaacaactaatatttctgtgctatagattaacataaatgcttcctctatttcttatcattgttacccatggggtatctccaggcccttttgacattttaaataatatttttataccatggagcagaaaataagcaaacaaacaaacaaaaaaacacagtgagcaatgcacttgacccaatgtggggcatcgtggggaacctgccattggagagtccagcctgcacatgtgccattttattatcctatgtgggtgtgcctgcatagggaaatctgcatgtgcatgaaaaaaaatatcacagctgatgcaggggtcttctttcccttggggacactaagtaaactgtgtgttgtatacctgtgtcttgactgtgacccatcacatagggtcaggaatggaatcttcacttatgccatcaggtcagtgctcaaaaacattcagattttggagcatctcagattttggattttttgattaggaatgctcacctgtacctgtgttcaaaaggtgtttataatcccatgagggatggaaggatgaatggatgtaaaggaaggtgccctcagtatgctgacatttgtatactgacaatagaagtaggtagcctcctgtttttacattgtagagtcactttttatgaaacctggaatccagggctttgttgaacagactcaattgaagagctaagacttgtagctaagtttttttccctagggcttgtaatgtttctagctcccaatcaaaacacagaaagactccaagtgaaaaaacaggtttcacttgctactgcttagagagcttttttagctcaagagttctttgcacttataaggaagctttacaactcaaaaggttgacaatattgagaatataggatccaaggtcagtagatggagtttcatccaacctccgtctcttagaagacatacagccttgagcacaaccccttcacctctctgagcttcaaaggaggcaatgcacaaaaaccgtttatacataccacaaaggtagaaacaaaagtcagttggtgttaccattgtttgcttatatgatgatgactgagaccattaaccaaaatcacacactacaccagggatagaaatgacccagaaggaatagaaaatttacttcctaattagcctgtgcctctttaactgagctctagtccacagttctactctgtcctgtaactgtccagcttcacttcctgtcacacctctcacactcagccactttggccactgctgaaacattacacatccttcagcccctttatgattgtcttagcaccttaaacctgcacttcgtttacctccctagagtgacaccttattatattataaactgtcccctcaatagactgggaactccttgatgacagagatcatgcattatttatctttgtacccatgtcagagtaatttgataaacatggatgtggattgttgaatgaatggatggatgctagtacataagtcagaatttctgcccacaaagaaagaattgtgacatactccaaatatgtgtttatgtggatttccccacagcaccatcactctggatacttttttttttgaaacagtgtctctctctgtcacccaggctgcagtgcagtggcaccatcatagctcactgcagcctcagccacccgggctcaagtgttaatacagttatattttattttattgtcacgatggagtcttgctctgtcacccaggctggagtgcagtggcacaatctcggctcactgcaaccatcgccttctgggttcaagcaattctcctgcctcagccacacgactagctggaattacaggcacgcaccaccatgcccggctaatttttgtatttttagtagagacggggtttcagcatgttggccaggctggtctcgaactcctgacctcgtgatccacttgcctctgcctcccaaagtgctgggattacaggcgtgagccccgtgcccggccaatacatttttaaacatcagaattattgagatactgttcacattccataaagttcagccctttaaaatgtacaattcagtggtttttagaatattcagagctgtgcatccattcccactatcaaattgcagaacattctcatcaccctaagagagtcccatccattagcaatcactccccagccctcccaccccaacaaccactaatctactttctatctctatatttttaattgattgtttgctatacagtatacatagcattacatatgagaatgcaactcttctctggacagaaaagaaataaacgctgaggcagctttgatttagcattgaaatacagaatcaatctgtaaccagctctatgaccttggacaagttgtttaactggatttagtttcttcataagataaagaagtctagaggtgtgtaaggacaccttcaggttaaaaaacaagcaaaaacaaaaaagccttggtgacaattccagtgcttcaccctagacagcctttcctgggcttccgtgagaaacgaatttatacaaataagatttcacaccacagctgccgcggccactgccctccccgcgcagagctctagagatgttttctctttttcttttctttctggccgtctatttatctctgggctggcaaggagagggagaactgcagcgcccaggagcggaggccgagcgcgccggtgcccgcaggaagcctcgcccagcgcggaccgcaccctcccgcgacgcccctggagaagccgccagtctctgggccgccagcagcgcgcgcccccggcgtgggaggagcgcggcgagcaggggcggggccagtgactcccgcagccaatcggggtggcggcgcgtccttggagggtccgcagctcgcccggcgcgcacggggcggggctccgcttgaccgtggcggtcgccgggcagcagagcccgggcgcagcgagcgcagcgcagcgcagggagcgcaggcggtggcggcaccaggttcccggggctccagcgctcggcgcagcgaagtagcctccggcggtggcaactacggcggcggcgccggggcgatgctgtgggtctcgttgggcgccggtgtcctggcctcttcctcaggtacccagccccgcttgcccctcgccccggggaaccgcagcgcccgggaggtagctttgtgaggctgtgggctcgctgccggggagtgggtgggtggggccgggcggggctgtgcggtctgggccgccttccctcggaggaagagggtggggaccgagggaagcgggcgggggtgggagcgctgtctccgggccgccgctgatggcatcccagggctccgtcctcctcctgcctccatgtgggttgaaagaggttttgttccaggagaaagtttgatgcctagacttgaggagccaaattcgggggtccctgaggtccgcgcctttaaagaggcagcccgccctgccgtgtgagcccgtgccctgcgtgtgggcacgtgggaacccgtacctgagcagcattcctgacacgggaccttccttgagaaaattcccctgtggaagaatcccccttggggagggggctttgtggagatggcacccagagcccgcccagtgtgggttttgcttgaaaacagtgcagcaggtagtcaatgcccccttgttatcttcccgtagaatggactcgaccaagatctatgatctaagagcttcaaaaattaaatctaccttgccatctaattaaacatccccaaacactagtgtgttcaaggtgccaataattactctgtcgattctttaatattttcttattgcccatactttcagttggcttttgcagttttggaaagggtgctgtggagcataccaaagtgggtagaagttatggctcacctctcagggtgatagcccagtgcaaaaaaatacagaacacatgcctgtccactcgaagataggagaaggtttcagccttcaaagcaagatagattaggtgggggttatttgctttacaaaacttcctccagtgcagagaagtgatgcttagagttaaaactgagttttacacaagtttgtaggaacacatctatcataaagcggctcagggtagaggtagtgacaggtagaggtagatatcgcatagtcttgccattaagcaaatctaaaaaaatgcatgttaaattctgcatcattctcactgatcacacgtggatgctcacatttacatttttcctttcttatcaagatgtattcctaccataagacaacttcataattccctcaaaacgccttagccaaggccattttgtggtccatataatttaccccatgctaaaaaacgtatctgtaaaaacatttacatttaagggaatttccctagtggtgacacagtagtgtccatacattgagcacattttattcaccagacacattactagg

SEQ ID NO: 205 - DNA, 99636 bp, Homo sapiens
ctgtgtgtgtgtctgtgtccaaatttccctcttcttataaggccaccagtcatctcggattaaagcccatcctaatgacctcatcttaacttgatgctgtcggcaaagataccatttccaaataatgaatgtcacactcacaagtaccaggggttagaacatatcttttgggaggacacaattcaaccagtaatatagtacctcctagtactcccatgccctgtgattacattagtagaattaattataatagaattttaattataatggaataagttaatagaaaaccacactcaggactgcaggcttgggtcaccccatcaggcagggaactacaatgacccaaagtgattgccaaaagcaaaagaaataaatatggaatgaaaagtgcaagaaggtacttaataatggagagaactgtaatagataggagtatcttttcattttgataagaacacatttgtgtatatattaagttattttctctcttgccttcttcttatttccaaccatctaatataagctgtgtcaatagtagttaaccttatatctcagtgtttgagccagataatgtcaatgggagaatgtatcgcagctcaagatggaatgactgtcatccacagatgggtaaaggaactttgcatcttttagggagaaggttagggtgttttcagttgtatggacagttgcattattttaggtgaaagtacaattttgatattgtctttttcagacaattaagtatgttaaaatagttgtatgtggataagaaggttacaaggggtagatagtggtaaatatgtatcaagtcaacttagcttaacttagcttgactgtggaatcatggtaagaccagttctagctaaactagaactgtggttcccagaagccctgggtagtactatcagccacaagacacatttagtgtgagatctggacagcaaaagtgaagccaaagccacgtcctttttatattcagaaagttggtgcagggtaccaggccctgctgctgcttgcctcgcggcccccagctctgtgagctcaccttgtcagcgtggtgacttcacctccaacctcacccatttccccctaaactcatctcctaggagtttgagctccgtgccagcggctgccaacttctcccgcccttcaccacctgtcttcaaagttgaggcgtggagaggatgagaggttggtgcaggttctcatccatgctcacagcatctgtgttgcctgtgtagatgccagtcctctcttcccccatttaggtacatccttgcctcccaactgcctgcctgctgacttcatactcccacaccagaggaagaagcagtaaccccacacataaaccatttttttttttttagagacagggcctcactctgtcccccaggctggggtgcagtggcatgatcatgcctcactgtggccttaaactcctgggctcaagcaatcctcccatcctggcctcccgaggagctgggactacaggcatgagccaccacacctggccatctgtcataaatcttttaactaactcccaaaattgtgtgaagtcaagttcctgtaacaaattctttattatgtatcctactggtcctgcttctctgattgaaccatggcaaagtcaatgccactgcagacccttgatctaccagccttaccagacactgacaggctgccttagccagcggtcctgctagaagctttccatggggtcagacctgcaagacatcctgccagctgagtgcctgaagatcctggatcattgtgactcacagtgtgtggtttacgggcccattgattaatgtttaccctgtggatatcttcttttaaatgccatctatccaaaaatgtgtttattaaccaccaattaaattgtgttctcatattttatgactcacagatagtgaaagctgcacatcagcccaggaaagccaacattcctctcctgcactgatataattccagccaaaggaaagaaacttgacatgtggtcagctcttcaaaggccacagcaaagggaaagtgtcacatctttcaatttgcctcagaaaagcctgtgggaagtggggagggggttgcagtctgcagatgggagagccatgacaaaccgttccagcaatgctaccaatgggattgcaacccagtcttcagcagagccagggatgcaaggaagaggggaaagaataggtggagaggtggggagcacatggactcgccttcatgggtactaggggacgtcgtgtggcattctgagtctgatccttcctgaaacaacgcgaatgaagaactgcacacaactcaacagagaagagagctgccctagaaagctttgggttaagtgacatcagggataggtcctgccatcctctgtccagttggtgtcatcagcaaagtttgggcaacgttacagaaaacctacagaagacagtcaccccagcctcagctggtcaggactctatagtgggaagtgaacaaaaaagagtttatcccatggctcacctcctgggaataatgacaaagatgatgataacaatgggggcatcggcatgaagcaagagacttccatgcctgattttactctgttgttaattaagtttgtaattctgagtctacagtgtcaccattcttggcttagtttgcatcttgtaaaagaagaacgctgaggcatagggtgtccttggcaaagatgcggatgtccactgaggtctgcgtgccccttcccctctgtggactagctgctgcccagccagagactacacttcccagacccccctgtgatttgttctcagcaatggaatgatgagcaggagtaattggagcacttccagaccaaaagggacaaaaaacagatgcatcttttccaaactctcttctatatcctggcaggatgttggaatccacagcaaccttggaaaccacatgcccagagcccccatccttcagcctgtgtccccaaacacccatacagagtgagcgcagaccaggacttgatatgaatgagaaatagcccctcattatgttcaactagtgacattctaaggtctctccatcaaagcagcctttaagcttcaagtttatgactaacaatttacaaatactttcttgttaatatttttaacttaacttgacctagagaatgacaaccatgggaaataagtcagatatttttctcattttacaaataaaaacctgaagctaaaatgctgaaattgttccccaaagtcattgacaagcagcagagccaggaggcaggagcagggtcttggattaggtttgagtgcaagaaatagggtggtgccggcattcataccacagggctctgggtgtcatcgtgggcctacctgggactgcctccgtgattttaaggaattgtttaatttccctcaggaccgtttcttggataataaacagggaacaataggccatgtcaatcatgtaaagttgttgtaaagataagggaaggccgggcatgatggtgcatgcctataatcccaacactttgggagaccaaggcgagaggatcactagagcccaggagtagaaggttgcagtgagctatgactgtaccactgcactccagcctgggtgacagagcgaggctcacacttactgaacatctaccacagaccaagcactgttccaccatcttgaatctattgactcattgactcatccaaccaccctacaagttatatcaagttatatcctccctattttcaagatgatgaaattaggaaaagttaagtaatttctccaacaatgcatatccttagcctggattctccagagagccaagagggaggaagggagggtgggatccgccccaagctggttatcactaaatgcatcttcttgacctggtcagactgtccgcctagaagcttcttaaggtgtgactaatgactgtgagtctggggcaggaggatgcctgggtatgagcgctgagtagggtccccaggaagccccagggcagaagataagaggagcccaagtgagcctgaggcggggcacggccaggctgactgctggagtcagtgggagtctgtgcagagctggtcgccacctctgaggctggcacaagagacaggcgaactcgaaaaagcatgcagtcgggcaaagtcgggtatgttacaagcctacgatgtcatggggctagtctttctctccttgtgtgaaagacgtggttcccattcctgaccaaccacagggaggcatgcattgtgagctagttagctcctggtgggaacaggcttacacaaatccacacatatgttctgttccagtctacggccaatgcctgtcttggaggaagaaacgacccaagtacagggaagctgcagctttctgctcaggactgccagcatgtggagcttccaggtctagggtggatgagacacatccccagggaactccctctggctagatgattgaagatgttaacgatgcatatagttgcacccagccatgctcaccaggggagaaaaatgctgctgcccccaccaagcaagggtctttcaaggagctcctagtcaggcttgtgttttcaaatctgacacacacaaacacacacacacacacacacacacacacacacaaaggccaggcacaatggcttctgcctgtaatcccagcactttggggaggctgaggtaggtggatcacttgaggtcaggagttcaagaccaacctggccaacatggtgaaaccgcatctctactgaaaatacaaaaattagccaggcatggtggcaggcgcccataatcccagctacttaggaggctgaggcaggagaattacttgaacctgggaggcagaggttgaactgagccaagattgccctactgcactccagcctgggggacagggcaagactccttctcaaaaaaaaaaaaagaaaagaaaaagtttagttctttgattatacaagtaaatacttctccattaaaagtaatttatactgttgtagaaaaattggaggtataaatacacttagaagtttgaagagctcatcttccctggtctatgtcctctgctcctggagacccagcctctgtggccctgtgacctgcaggtattgggagatccccagctagacgtcatgtcccctgagatgcctagaaatggtctcttcccagggtgagagaggaatgaaaacttaaaggaaagaaactctgggcttccaagatggccaaataggaacagctccagtctgcagctcccagcgtgatcgatgcagaagatgggtgatttctgcatttccaactgacgtacctggttcatctcactgggactgtttggacagtgggtgcagcccacggagggcaagctgaagcagggcggggaatcacctcacctgggaagcacaaggggtcaggggatttccctttcatagccgatggaagccatgacagactacctggaaaaacggggcactcctgcccaaatactgtgcttttcccaaggtcttagcaatgggcagacaaggcaattctctcccgtgcctggctcggcaggtcccatgctcatggagccttgctcactgctagcgtagcagtctgagatccatctcctatgcctggctgggggaggggcatctgtcattgctgaggcttgagtaggtaaacaaagtggctctgaagctcaaactaggcagagcccactgcagctcaacaaggcccactgcctctagacttcacctctgtgggcagggcatagctgaacaaaaggcagcagacaacttcttcagacttaaacgtccctgtctgacagctctgaagagagcagtggttcccccagcacagcgcttgagctctgagaacagacagactgcctcctcaagtgggtccctgacctccgtgtagcctaactgggagacacctcccagtaggggccaacagacacctcatatagggggctgccccttagggacgaagcttccagaggaaggatcaggcagcaatatttactgttctgcaatatttgctgttctgcagcctccacttgtgatacccaggaaaacagtgtctggagtggacctccagcaaattccaacagatctgcagctgagggacctgatagttagaaggaaaactaacaaacagaaaggaatagcatcaacatcaacaaaaaggtcatctacacaaaaaccccatctgtaggtcaccaatctcaaagaccaaaggtagataaaaccacaaagatggggagaaaccagagcagaaaagctgaaaattctaaaaatcagagtgcctcttctccaaaggattgcagctccttgccagcaacggaacaaagctggacagagaatgactttgacgagttgacagaagtaggcttcagaaggtcggtaataacaaacttctccgagctaaaggaggatgttcgaacccattgcaaggaagctaaaaaccttgaaaaaagattagatgaatggctaactagaataaacagtgtagagaagtccttaaatgacctgatggagctgaaaaccatcacaagcttcaatagccaattcaatcaagtggaagaaacggtaccagtgattgaagatcaaattaatgaaataaagtgagaagacaaggttagagataaaagagtaaaaagaaatgaacaaagcctccaagaaatacgggactatgtgaaaagaccaaatctgtttgattggtgtacctgaaagtgatggggagaatggaaccaagttggaaaacactcttcaggatattatccaggagaacttctccaacctagaaaggcaggctaatattcaaattcaagaaatacagagaacatcacaaagatactcctcgagaagagcaaccctaagacacataattgtcagattcaccaaggttgaaatgaaggaaaaagtcttaaaggcagccggagagaaaggtcgagttacccacaaagggaagcccatcagactaacagcagatctctcggcagaaacctgacaagtcagaagagagtgggggccaatattcaatattcttaaagaaaagaattttcaacccagaatttcatatccagccaaactaagcttcataagtgaaggagaaataaaatcatttacagacaaaaaaatgctgagagattttgtaaccaccaggcctgccttacaagagctcctgaaggaagcactaaacatgaaaggaaacaaccagtaccagccactgcaaaaacataacaaattgtaaagaccatcgatgctaggaagaaactgcatcaattaacgggcaaaataaccagtgaacatcataatgacaggatcaaattcacacataacaatattaaccttaaatgtaaatgggctaaatgccccaattaaaagacacagattggcaaattggataaagagtcaagacccatcagtgcactgtattcaggagacccatctcaggagcaaagatgcacataggctcaaaataaagggatggaggaagatctaccaagcaaatggaaaacaaaaaaaaaagcaggggttgcaatcctagtctctgataaaacagactttaaaccaacaaagatcaacagagacaaagaaggccattacataatgttaaagggatcaattcaacaagaagagctaactatcataaatatatatgcacccaatacaggagtatccagattcataaagcaagtccttaaagacctacaaagagacttaggctcccacacaataataatgggagactttaacaccccactgtcagtattagacagatcaatgagacagaaggctaaaaaggatatccaggacttgaactcagctctgcaacaagcagacctaatagacatctacagaactctccaccccaaatcaacagaatatacattcttctcagcaccacattgcacttattctaaaattgacaacataattggaagtaaagcactcctcagcaaatgtaaaagaacagaaatcacaacaaactgtctctcagatcacagtgcaatcaaactagaactcaggattaagaaactcgctcaaaaccacacaactacatggaaactgaacaacttgctcctgagtgactactggttaaataatgaaatgaaggcagaaacaaagatgttctttgagaccaatgagaacaaagacacaatgtaccagaatctctggggcacatttaaagcagtgtgtagagggaaatttatagcactaagtcccacaagagaaagcaggatagatctaaaattgacaccctaacatcacagttaaaagaactagagaagcaagagcaaacacattcaaaagctagcagaaggcaagaaataactaagatcagagcagaactgaaagagatagagacacacaaaaaaaaacccttcaaaaaaccaatgaatccaggagatggttttttgaaaagatcaacaaaattgatagaccactagcaaaactaataaagaagaaaagagagaagaatcaaatacactcaataaaaaatgatcccacagaaatacaaactaccatcagagaatactataaacacctctatgtaaataaactagaaaatctagaagaaatggataaattcctggacacatacaccctcccaagactaaaccaggaagaagctgaatctctgaatagaccaatagcaggttctgaaattgaggcaataattaatagtctaccaaccaaaaacagtccaggaccaggtggattcacagcagaattctaccagaggtacagaggggagctggcaccattccttctgaaactattccaatcagtagaaaaagagggaatcctccctaactcattttatgaggccaacatcatcctgataccaaagcctggcagagacacaacaaaaaaagagaattttagaccaatattcctgatgaacattgctgagaaaatcctcagtaaaatactggcaaactgaattcagcagcacataaaagagcttatccaccacgatcaagtcagcttcatccctgggatgcaaggctggttcaacatatgcaaatcaataaacataatccatcacataaacagaaccaatgacaaaaaccacatgattatctcaatagatacagaaaaggcctttgacaaaattcaacagccctacatgctaaaaactctcaataaactaggtattgatggaacgtatctcaaaataataagagctatttatgacaaacccacagcgaatattataatgaaagggcaaaaactggaagccttccatttgaaaacaggcacaagacaaggatgccctctctcaccactcctattcaacatagtgttggaagttctggccagggcaatcaggcaagagaaagaaataaagggtattcaattaggaaatgaggaagtcaaattgtctctgtttgcagatgacaggattgtatatttacaaaactccatcatctcagcccaaaatctccttaagctgataagcaacttcagcaaagtctcaggatacaaaatcaatgtgcaaaaatcacaagcattcctatacaccaataacagacaaacagagagccaaatcatgagtgaactcacattcacaatagctgcaaagagaataaaatacctaggaatccaacttacaagggatgtgaaggacctcttcaaggagagctacaaaccactgctcaatgaaataaaacaggacacaaacaaagggaagaacattccatgctcatggataggaagaatcaatatgaaaatggccatactgcccaaaataatttatagattcaatgccatccccatcaagctaccaatgactttcttcacagaactggaaaaaactactttaaagttcatatggaaccaaaaaagagcccgtattgccaagacaattctaagaaaaaagaaaaaagctggaggcatcatgctacctgacttcaaactatactacaaggctacagtaaccaaaacagcatggtactggtaccaaaacagatatatagaccaatggaacagaacagagccctcagaaataacaccacacatttacaaccatccgatctttgacaaacctgacaaaaacaagaaatggggaaaggattccctatttaatcaatggtgctgggaaaactggctagccatatgtagaaagctgaaactggatcccttccttacaccttattcaaaaattaattcaagatagattaaagacttaaatgttagacctaaaaccataaaaaccctagaagaaaacctaggcaataccattctggacataggcatgggcaaggacttcatgtctaaaacaccaaaagcaatggctacaaagccaaaattgacaaatgggatctaattaaactaaagagcttctgcacagcaaaagaaactaccatcagagtgaacaggcaacccacagaatgggaaaaaaattttgcaatctacccatctgacaaagggctaatatccagaatctacaaagaactcaaacaaatttacaagaaaaaaacaaacaaccccatcaaaaagtgggcaaagcatatgaacagacacttctcaaaagaagacatctatgcagccaacagacaaatgacaaaatgctcatcattaatggtcatcagagaaatgcaaatcaaaaccacaatgagataccatctcacaccagttggaatggcaatcactaaaaagtcaggaaacaacagatgctggagaggatgtggagaaatgggaacacttttacactgttggtgggagtgtaaactagttcaatcattgtggaagacagtgtagcaattcctcaaggatctagaactagaattactatttgcccctccaatcccattaccgcatatatacccaaaggattataaatcatgctactataaagacagatgcacacatatgtctattgcggcactattcataatagcaaagacttggaaccaacccaaatgtccatcagtgatagaatggattaagaaaatgtggcacatatacaccacagaatactatgcagccataaaaaaggatgagttcctgtcctttgcagggacatggatgaagctggaaaccatcattctcagcaaactatcacaaggacagaaaaccaaacaccgcatgttctcactcataggtgggaattgaacaatgagatcacttggacacagggcagagaacatcacacaccagggcctgtcggggggtggggggctgggggagggataacattaggagaaatacctaatggaaatgatgagttgatgggtgcagcaaaccaacatggcacatgtatatctatgtatcaaacctgcacgttgtgcacatgtaccctagaacttgaagtataaaaaaagaaattagaaaaaaaagataatatgacaggctaggaagaaaggcaggtggaaaattattgtctaatgagcacaaagcttttgtttagaatcatgaaaagtttctggaaacagataatggcatggttatacaacactgtgaatgtatttactgccaccgaattgtacaattaaaatggttaaaatagtttttaaaaaaaagtttgaagaagagaactattatcacctaaaatctctcttctccccaagataaccacactaacattttggtgtattcctttccaggcctttctttgtagacatataaatataaactgcatttttaaataaaatggagttgatgatacaagtgttttattactctgctttgttctcttaacattttatgataaatattttattgccattaagaatgcttccaaaacacattatttatagctgaacaatattttttggatattcgggctgtttataatttttcactctgatatatggtgctgggatgaagagccttaaacagaagtctttgatcacatttctgattacttcctttagaagacacttaaaagtagaattactgggacaaatgatataaatattttaatgaaaatttttattgccaaatagtttccagaaattgaccaatttacagttctatctgcatctgtcagtgcagacacattgcaaaaacaagtcagtattttaaatgcttttcagagtagcaggaggaaatggtatttcattttttttgactcctatttctttgattaatggttctattgaccaattcttaatttgttgaccgtttggatttcttcttttaagaactgcttgttcattttctttgataatttttaagttggtatgttagtattttttattgactggatataattaggagctgcttatttgtcatgctcattgcaaatatttttgcctgttttcattttactttttacaattttttacaattttttatttttaaaggccagtcaaatttagcagtgggtgtcattttgcttttaacttgtattatacagggattttgtaaatatagctggtttggggacttttctttgttttacatggttaaatctaacaagagttacctttgtgattcctcccatgatctcatgcttataaagttctctccatcccaagatcagttacacatgctcttattttcttctagataattaagaaaagatatgaaatcacaacacattagtattggaagagttggcgaagtccttcatttcacagatgaagaaacttaggcttaaggggtaaagtaactcaaaaaccagatcacgcagccattaagtggaaaagccaagattttcctttcgattgaggtataattagcacacaataagatgcacaccgtctcaagtcatcagttcgatgggttttgataattgctgacgctcttgtaatcaccacccaaatcaagatacagaatatttccaccaccatcagcaaccactatctgagatctttcactatagggtattttgtctagatttggattttataaaaacggaatcataaagtactttttagtgaatgtcttcattcacttagcataatatgtttgagattcaaccatgctgttgtgtctatcagcagctaattcgttttttattcctgcgtaggatttgtatgaatctactatactatgaatgtactatatatacaaatataatataatatgtttatccatccccctgtttaggaacacttggttgtttccaatttggggctattatgaaaaaggcttatatgaataagtattttttggacatgttatttcatttcactcgggagtgaaattgctggggcactgaatggatgcatgtttaactttataacaaagtagggctaaggtttactatctgaccctagagaccatgccctaagccactggacacactgtccctcacagacccaagcactgagagatcaagtttaaatcccagctattctctgtccttgctgtgaacactttggcaagttccttaacctctcagtgcctggtttcctcatcggcaccaccgtcccactccacctcccaggggttgttgtgaaaactaaaagagttaatacaaataaagccctcagaatgagatcttgcaagtggttggtttattattatgaagaatgtctctacatttagtttgtcagatactggactgagagaatggttctcttgaaagtaaccaggaaaggcctccctgtgatggaggggccaccctttaagactgcttgcagcagaatgctatcccttcccacaaagtcagctgggcctgccataactgtcccagtgctccagtgtgctgcctcaagtgcccctgctgcctctgcagtgctcattctccaggtcttgttcttgtccttgtggggttcagcatacacagctctcttgatcagaaggtggccccagccagtccctgaggactcactgcttttaaatactccttaacacctgagcaggatcccacacgctgctctacctctcctccttaggggctaaccaaattgcacaagactccattggctgtggttaatccctgatgtcccagcttgcagtccgtctgcaggcaggtcttcggagggaacgcatttgcaccctggtgtagtactgctaggactggatggcagagcacctttccaaacctgagtgcagttgtccctcagaatccatgggggattggttcaagaaccccaagattacccaaatccatggatgctcaagcctcaagttttggatatcaaatggcctgcaacctaggcacatcctcctgtaaactgtaaaaatacctaatacaaagcctacacatcatttagtgtgcatgaaatccacatacttctcagcatgcaacaaaaattcaagttttgccttttgcaactgtgaaatgttctttcccaaatatttcagtcctcggttggtggaatccatggatgcaaaagccatgaatatggagggttgacagtacttcctaattccttctagaatatcacctacttctgcccttcctccatgccaatctttcccactggatgagaagctccataagggcagagtctaagaaaacttcatgcatggggcccaggcacatcattagtcaggccttcagtaagcattgtcgatggataaggcaaaaatacatttatgtataagcattcaatgcctatcttctcctctcaccctcagaggagatttctgccttctctcatagttcagtttctgggcttttattgaaaagatcagaaaagggttgaaaagaagaacagagctcagagatgctttttagatttctttggaaaatagaagcaaactattaatccaccaacaggagtacttatcatttataattatggctatgcatataatagagtatatagtgaaaatgcaaaatctaacacacacttatccatggactctatccgtgcacttatcaacatgcataaatcatgcaaagttcagttcttaaaatctggagagtgattcatgcatacatatatgtgataccatttaaataaaatttgaaaaatgcaaaatgttgctattattactatgatacctagttatgaatacatactatgtagaaatagtacaaaaacgtatataaaatagcgtgagagtgataaacaccaaattcaggaggaaggttatctaagttgggaccaaattatgtagataaattatttgtgaagaataactgaaagttttggagccacaactgacttgatcagagttgcagtttaggaaggtaaatcttacaagagaaatggaggaaaagttgattcattcaatatttatcaagagtccattatcagccagttgcagtgactcacacctgtaatcccaatgctttgggaggctaaggcaggaggatcaattgagccaggagattgagaccagcctggacaaatggtgagactccatctctataaaaacattaaaaaattagccaggcatgctagcatgtacctgtggtcctagccactcaggaagctgaaagaggattgcttgagccgaagagttcaaggctgcagtgaacgatgatcacgccactgcatactgcactccagcctgggcgacagagtgagacaccatctcaaaaaaaaaagaaagaaacagaaaaatccatgatgtgtcaaacacttgttacaggcacttgtgaatggatagaaacccctgccctcggttgcattctttctgctttctagccctaaggcaataaagcctgtttcacagctgcatctagtgagggcctagaacctcaggattggaaatgaggaggatagactacccaggtagaaggcacagcctgctcaaatatgcaaggcactgcatcaggtatgaaaatgaggtttggcatctcggtggcctgaaaaaatgggtgtccctgggtgaaaccaggaacatggaagtgagacagaatgagcacttgttatgtgcccagccctgcagcagggcccaagcactgcggaggtggatgtcatgttccctgccccgaagcagctcaaattatttctgacaaccattcattcagcagttcattcagcaaatactttctgaataagtgtgcggaaatctgtactgggtaactgtcatcctagcaacctagcaagaatgtgatctatggccccacagcagaatgtggctgtggtttgggggggtctggtgcaaaggtgagaggtaccctgactccaggcaggaaggagagtgagagagttacgatgtgcacttgtctctcacccagttcaagaacctgctcctctcctccttaaacactgttcattcccaggtcctggtccctcactggctcagcctccagacccgcagaccacagccataactctccaaactcaaaacatccactcaggggagataaatctccgcttatggaaggactttctctgggaaggagggtcagaaaggccgcctgaggcagctgaccgctcctgtgggctgaatgtcagtctggcgaagcagaaaacatctgtcagtgagtcagagacctgggtttcagtctcagctctgcactaaaagctgggggaccttgtgcaaccgcttcccctctctgggcctccgcttcttcattggtatgaaggcacacttagatctcttggggccactcctgctataacgattgtgtttcgtttttgagggctgctgtaacaaagtaccatgagccgggttgcttagagcaagaaatacgttttgtgtaatcgctctggaagtgaatagcctaagagaaagatgacagcaaagctaattccttctcaggattgtgcgggagaatctgtttcttgtttctgtcctggcttctcctggtttgctggcatactttggtgtttcctggcttagggacacatcacccggatttctgtcttgatgtccacatcatgttctccctgtatgtatgtgtgttgtatgtgcgtggaaggcgggggtggtgtctctaacttttttgggtttttttgagacagtcttgctctgtcacccaggctggagtgcatgcagtagcttgatctcggctcactgcaacctccacctcccaggtccaagcgattctcccatctcagcctcctgagtagctgggaccacaggtgtgcaccaccatgcccagctaatttttgtggtttttttactagagatggggtttcaacatgttgcccaggccagtccccaactactggccttaagtgattcacttgccttaacctccgaaattgctgggattacaggagtgagccaccacacccagcccggcgttcttcttataggatatcagccatattggatcggggcccaccctacctactccagtatgacctaatcctaactcattatacctacacctatttccaaataaggtcatattctgaggtactgtgggttaggagatcaacacacatattttgtaggggggcacaatttaacccataatgaccatcctgaccttttaattcctcctcccaggaatctgtagggtgactgtaacatttatcattcaaacaggggattttgagaatgaaaaggggaactactaacaattgtggcaaatgacaggtgtcactggggactggcccaggtgagcaggtatgctggtcccctcaggggcctgggggatctaccggggccaaacacgagggtggttgcagggcccagggctgcttccaccacccacggggtcatggtgtgacccagaggaaaactacatcatctctcaaaatgagaacggacggagtgaggggagagacagtgcctggggaagcgccaagggacacgaagaggctggtgctggcatgtggcacctggagtttagttggagaaaagtcaccattttcaagcagtagtgcttcctgatgtgtgagtatggccgcaagcccgggtgggacatgcacagtgtatgtgggactataggatgcatggagaagccctgcatctatctacacagagcgtttaatccatcctgggggacactgattcacgtgaatgattagagggcatccttatgctcagtggagaggaactgggctccttagtgcaatcaaagttcggaaaagaaggtattcagctgggcgcggtggctcatgcctgtaatctcagcacttggggaggccaaggtgggtggatcacgcggtcaggagttcaagaccagcctggccaacatggtgaaaccccatctctactaaaaatataaaaattagctgggtgtggttgcatgcccctgtaatctcatctactcaggaggctaaggcaggagaattacttgaacctgggaggcagaggtggcagtgagccgagatcacaccactgcactctagcctgggcagcagagcgagactctgtcctcacaaaaacaaagaaaaaaaaaagaaaaagaagcatttgagtgctgtaaagtaattgggagatttgtgctcacaaaggtcacttgagagcagaggaacgaaagtccagtcgtgtaagggacagtgaccagagtagcctgagtaaatacggccttgaaagatgaactgagaaactctcctcccatctctatttcctatattctcatgggatcagcataatttcttccttaaacatctggtaatactctttagtgaagccacctgggcctgcagtactctttgtgggaaggttttagattattaattcaatctctttcattgatgcgagtcaattccatattttcacttcttcctgagtcagttttgataaatgggtcattttagtggacttgttcttttcatctagggtatcaaatttattggcatataattttttcaaaatagtattttattaatgcctttaggatccttatgatgtcctagatacagtaaagatatggcacagccatgtaccacataaagtttcagtcaacaatggactgcatatgcaatgataatcccataagagtaaaatggagctgaagaattctgatcacctagtgaagttgtagccatcataacattgtaatgcaattactttattttttaataaatttagtgtagcctaggtttacagtatttataaaatctatggaagtgtacagtaatgtcctcagccttctgaatagtccattctcacactgctgtaaagaaatacctgagacttcataatttataaataaaagaggttgaattggctcacagttccacagcctgcagaggaagcatagcagcttttgcttctggggagacctcaggaaacttacaatcatggcagaaggggaaacacccacctcacatggcagaggcaggaggaaaacagaggtgggggcaggtgccacacacttttaaacaaccagacctcttaagaatactatgatgagaacagcaccggcggatggtgctaaaccattagaaacctcccccatgttccaatcacctcccaccaggccccacttccagtactgggaattggacataagatttgtgtggagacacaaatccaaaccatgtcaccttcacattcactcaccacttactcgctgattcaccagagcaactttccgtctcacaaactccgttcacagtaagtgtcctgtacaggtctaccacttttgatcttttgcactgtagttttactttatcctttctatgtatagacatacaaaaactactgtgttataataggatctaccatatagcctaagtgtgtagtaggctgtaccatctaggtttgcgtacgtgcactccatgatgtttgcacactgataaaatcacctaatgacacatttctcagaatgtaacctgttgttcagtgaagcatgaccactgtcatacatgtgatctgtcactgactgaaatgttatttggtctgtgatgatattgtaaatctcacaaagtattattataaaagagtcaacaatcttttaaagaaattcaaaaatgaaggaaagtatctcttatatttaatcaaatattttctgtttctggcacttttcattcctttgtgtatctaatgtctctctatctggtatcaccttaattctgtgttaagaacatcttttagcatttctagtaaggtaggcctcttggataaaaattctctcagcttttgtttgtctaaaaagtcttcacatcacttttcttagttttggaagacacttttgcttggaatagaatttttggtcaacaagcttcttttcttccctccctgctcttcaaagacatcacttcattgtgtctgacttgcatagtttccaacaagaaaacagcctcaaattttatatttgctccccaatacataatgtgtctctttttttttgctggctgggttgcttttttaaattttcattagttcacgtttgcagcaatttggttatgatgtgccctcgggtgcttttctttgtattttcctacttgaaattctcagagctttttgaattggtgtctttccagtttttataaatttgagcagtctttagccatcatttcttcaaatatttattctgcccccttttctgggactcgaattacttgtatattgaccaactgatattgtccaatgtgtcacaaaactctgttcattttttcctagcaattcaccattttttttttttttgagacgaagtcttgctctgttgcccaggctggagtgcagtagtgcagtctcagctcactgcaacctccacctcccaggttcaagcgattctcctgcttcagcctccctagtagctagtattacaggcacctgccaccatgcctagctaatttttgtatatttagtagagaaggggtttcaccatgctggccaggctggtctcgaactcctgacctcaggtgatctgcccacctcagcctccaaaagtgctgggattacaaacatgagccaccacacctggtaaattttttatcttaattgagcatttctatgattctatcttctttcctttcttggcgtatcagttatacttctcctaccttttttcagtcattgacctagaatttgcaatatacatttagaactaacccaagcccactttcaaataacaatatacagcctcatgggtagtgtgagtacattataataacaaaataaccgaaaatcctctttttattccttgtgtcattgctgtcattcatttcatttatatgtaagcatatgtaagtgtgaatatataagtatatttgtcacaagcatatatttatatatgtattcagttataaatcttatgtatatatcttatgtacataattgaaggtgcagttgctattattattttgaacaaactgttatgtgttagatcaactaagaataagaaaaataggccaggtatggtggctcacatctgtaatcctaatactttgggaggctgaggcaggagaattgcttgagcccaggagtttgagaccagcctggtcaacataatgagaacccacctctatatttagaataataataatctaaaaaagaaaaaaattaatgataagaagaataaacatttttatattgatgttcttcctttctttatgcagatctaaatttctgacctgtactattttccctctctctaaagaacttcttttaacatttcttacaaggcagatctactggcaaagaaattccctcagtttttgtttgattgagaatgtctttttttttttcttcacttttgaaggataatttcacagggtacagcattctaggctggcggggggttttctcccaaacctttaactatttcactacattcccatcttgcttgcatggtttctgaggagaagttggatgcaattcttagctttgcatctctctagcttagctggtttttccttctgtcttctttcaggatatttttctttatctttggttttccgtaatttgaaaatgacatgtctaggtgtagttgttttggcatttatcctgcttgatattctctgagcttcctggatctgtggtttggtgtttgacattaattttggaaaattattggtcattattatttcaaacatttcttctgtttcctttctctttttattctccttctggtattccgttacatgtatgttacaccttttgtaagtgtctcacagttctgtttcttttttcagtctctgttctctttgcttttcagttttagaggtttctattgatctacccacaagctcagagattctttcctcagccatgtccagtccactaagaattctatcaaaggacttgtccattcttcctttctctcacagtattattgatctctagcatttccttttggttttccccttaggatttccatctctctgcttatattacctatctgttctggcatgctgtctactctatccattatggcccttagcatattaataggagttgttttaaatctcctgtcctaattctaatatccctgccatgtctggttctaatgcttgctctgtctcttcaaactgtgtcttttgttctttagtatgccttgtaattttttcttcacagctagacatgatgtagtgggttaaaggaaatgcagtaaatagacccttagtaatgtggtggtaaagtgtatggggggaataagcattccatatttctatgatgaggtttctgtctcttagtgactctgtgcctctggactgtgaacttctcaatttttctccaccttaggttgggcaggatggctagagtagctgaacttgggttatttcccctctcctacatagaaggatagagctggctggatttgggcatttcctccttccctcccaggtcattaggctctgataaaattccagcaggttagactctagttaactaatttctcccgacagcagaccttgttaagacagagtgttctggcatatttcaaaatggctcctttctctctcccatcctgctgaaagcatgaggagatttttctccagtatttactgtgagaacctggttgatatcctgaagacaaaactcacataagtgttgggggcctcctaagactgggtctccctagagcttttaagtctcagatttgtccacgcctagactccatcagcttgtcagttacagttccggttctcccaggcagcagtggttcctgcagaggttgctgctctaatgtactatgattctctgtatttgcttgtctgtctgtttaatttagggggcagtagtttgccctatgacatcatttctcttatgcatctaagaagagtggttgatttttcagtttgttcagctcttattgttaggacacagtggcaacttctaagttccttatatggaggacagaaagccaggagttgcatttttcatttcagatattatatttttccactctagaatttctgtttggtttttttatatcttccatttctctctccattatcttcatattttccactagatttttgagcatatttataatggatgttttttaaataaatttttattttagaataattttagatttgtaggaaagttgcaaaggcagtataaagttactgtacacccttccttagattcccttaatgttaatatcttgcataactctggtacatctgttaaaagtatgtgttgtggctgagcacagtggctcacgcctgtaatcccagcactttgggaggccgaggcgggcagatcacttgaggtcaggagttcgagatcagcctggccaacattgtgaaaccccatctctattaaaaatacaaaaattagctggacgtggtggcacacatctgtagtcccagctacttgggaggctgaggcgggagaatcgcttgaacccaggaggtagaggttgcagtgactcaccactgcactctagcctgggcgatagagtgagaccctgtctagaaaaaaaaagaaaaagaaaaaaaagtatgtgttgtgagttaaactgaactccccaaaaaaggtattgaagtcctaacccctggtacctgtgaatgtgaccttacttgcaaatagggtttttgcagatgtagttaggttaagatgaggtcatactagagtacagtggaccctaactccagtatgacaggaatccttataagaagagacacacaaggagaaggccgtgttatgaaggaggtggagactggagtgatgcatctacaagccaaggaatcccagggtttgccagtgaccaccagaaggcagagagaggcgggaatggtttctccctaaagcccttcagaaaaagcacctccctgccaacatcttcctatcagactcaaggctccagaactgtgagaaatgaaattctattattttaaggcaccctgtttgtgatactttgttacacggtcctagaaaactaatacaaggaaaatactaacattggtacattactatacaccaaactccaaactttgttcagctttcaccacttttccccctaatgtcctttttctgttctggaatccaatccaggagacagtgttgcatttagacactgcatttctcctgtctcctctggactgggacactttccaaactttgttttccatgatcttaaaagtactggtcagcattttgtacgtgtttcccagttagagtttctttgatatttttcctcatattaggctagagatatatggggttgttctttttttttttttttttaaataccagacaggtgaagtgccctctcataacatcatataggggataaatgatattagccagatatatcagcagggatataaaccttgatcaattggtgaagatcgtatctgtcagatctctggctgtgaagttaccatttttccccttccatcctctattctttgcaagtgagtcactaagtccagtcacactcaagcagatggaaatagggaaaattaaattacttttctgctaattccacatgtctgtcatttctgggcttatttcttttgagtaattttttctctcctggctatgggttacattttcctgcttctttgcaaatctagtaattttgtgaatgttacattcttgagtgttagattttgttgcatttctttcaagagtgttgcactttattctggctttcaggtgagttattcagacatcagttgaatagtttgggctttaaaaaaaaagaaaacctttttatcaggcaggagatctagagaagtgttattctagattagttaagtaccactgccaagatgtgtactttctgcggctgttcaagtattaaactaggtttctccaagctacctagtggaattgaatgtgtcccagtcctgtgtaagctctggagatctcttggccagcagcctctcggcaattgttctttccccagtggttgttctttgcccaatcccaaggatgccatcctgctcagccccagactcaagagaacccctctgcacatttctggagtcattttctgagtagtttattcatctctattctctgccttaaaagtcccagctccctcagcctccggaactccaatctctgcctcaacaggaccactgggttctgttggggttcactcttcctgcaccctggttcagaaatcccccgcaagcagggagccagggaaattgtagggctttcttgcttcattttccttctcccagcaatcacagtctcagtctacccactacccagtgtctgacaattgtcattgcacatgtctttcttatccagtttttcagctgtgcgtgacagggagacaactgccgatgctcttaccactcaaggcaggagtgcttctaagttttctttctctctttctttctttctttctccttccttccttccttctccttccttccttctccttccttcctttctcttttttcttttctctttctttctttctttctttctttctttctttctttctttctttctttctttcttctttcgacagagtttcgctcttgttgcccaggctggagtgtgcaatggtgcaatcttggctcactgcaacctctgcctcctgggttcaagcaattcccctacctcagcctcccgagtagctgaagtttccatagttcttctcggccctctattccctgaaaggagtaactgcttgctatagtccctgccttgtaataccttagcagtcggttgagccttttcagttctccaatacaaccagagagctgtgttgctaacagggatttacactgcgctctctccatgggagtaatatgtgtttccatctcccatcaggaccgcccaccttccttcagagtaaaagcgagagatggagcggagggctggtggcatggtgacaggtgatacggatggtcacctttttctgcctaaagaaaagggggcctataactagaggggaggcccaggaagagttcccaggggagcccacacggtgttccctggagtcaagaggccccaggtcaggtgtccgacctttacaggagagccagatggccagagcatgggttgctatgtggaagggccagcaatgagagggttgtcctggagtgcctctcggggactggcagggccacggagccaggtgcttcctctggctaggccatgctagccaggcacggtggctcatgcctgcaatcccagcactttgggaggccaagtcaggaggatcagttgaggccaggagtttgagaccagcctggaccatatagcaagactccgtctctacaaaatataaaaataaattagctgggcctaacggtgcccacctctggtcccagctactcaggaggctgaggcagaaggatcacttgaaccaaggagatcaaggctgcagtgaacaattatctcaccactgcactctagcctgggtgacagagtgagaccatgtctcaaaaataaaataaaataaaataaaatgaaaaataaaggccatgttcacaagcgcaccctccaggaccagatagccccagcagacaggtgcaagctgggcctccaggagcaggaactgagggaactgtgtcacatggaagatgggaggtccccaaggggaagggagagggtgtccaataattcctaaaagtccccagagagaaagcctcaccttgggcaccaaccggcccagttagaaggtacctactcagttcctatcgccagccagggatgactgcttcacccctttatggctccccacctccctctcacccacctcccaacaagcaggagagccagcaggggccgttgaactaagtctgatctgaagctgcctctttgactattttaagtttggcctaaagttctttccatgcatagtgagctgtaagctacctggagactgaacagactgcagcctactcttgtgccaatcaccgagtttctggcaatcgaaagcggccaactgttcaaactctgttcacataaggcaagtgcccagctgcaatcaccctgctgcttctgcacctcacttctgtgttctgttcctcactttcccttttttgtccataaaccttcttccaccatgtggctatgttggagcttctcggagcctattctgctcccggctctgcccaatgtacaaatcattctttgttcaattaagcctgttaaatttaatgtttttttaaaaaaatttaatgttgtttaaggtttttcttttatcacagaggaggaagacacacagagagggaaaagatacaccccttcctctactgcaggtttaggaggctgtggggcagggagagtggaaagtttaacttcaataagaacgttaaggccgggcgcggtggctcacacctggaatcccagcactttgggaggctgaggcacgtagatcactttaggccaggagttcaagaccagccatgaccaacatggtgaaactctgtctctactaaaaatacaaaaataaaccaggcatggtggtgcatgcctgtggtcccagctgctcaggaggctgaggcaggagaatcacttgaacccaggaggagaaggttgcagtgagccgagatggtgcctctgtactccagcctgggcaacagagtgagactctgtctcaaacaaaaactagaataaaataagataaaaacctttaaaaactcctttagattagtctggactatttggtacaggaagatgagacagtgtcttagtacctgcaaaggaccagaaagcaatggaatctaaatgacgcccccaggacagggatccaatggagcaggcgggaaaggcagtcaggtggaaaatagaaaatgatttcattatttcagccccagcctagctccttcagtaaaccagttacaaatattagatgcatgaaaatcttcataggaaaagagatgggagcccagagtcccagacaaagagcaggcagctgctctatcttccctcggtgccctgccaccccacggcttcccctgcaggccacgctgagtcccccaaccctgcggcttcccctgcaggccaccctgggtacccccctaccccaccccatggcttctcctgcaggctgttctgtctttcctgagtcccccaccccacggcctcgcctgtaggctggtggcagtcctcagctccagaccttccccacgacccaaggttactctcagggtggagccagaaacaccggccctagctcccacacacacctgaagacctgtgtccctgcctaaccatgtgggaccccagcacaggtatgtagatgtgacaggccacctgcactccagctggagagaggaaatagatcaggcatcagtcagcagccctcagcaaaccatatgaggctagagcacgcgtcaccctaggaaaacggagcctcttccgggaagaatatcttctcaaaccagccatggtttgagaaaggctgtcaggaaagaccagttgttgttttttctgtccaatctgtcacagatctatattttgtaaaatgcagtacaaatgagttattaggaaaaattgaataaaaacaaagcactcaaaatacaagctgaaaatttgtattattagattggacggacataaaattactccatcaaattacaatttctgtacttatttcttcatgggccagccacagccagtccacggaccatgctgtgagcagccccagcccggccaggaactgttcatggcagccagccctggccactgcactgcccaggaagctggtcattaaaacttgcaggccatttggcagacctaggccatacctttcgtgtctccctgctggcctctccagcctccttaaagccacttctgattaggtcagttcccctggcatcagccttcagcagatcccccagcgtggatccacgtcctccttctctgactgctgtgccctcttcctgacctcgcgtatccagtcctgaccgctctcaggctccacttcactgccccaccttgtgagtcctcccaataccatcactctgaggattttcaggggagttcgtccacacttctcttatttctcatttcacttcctactcagcactggggttcttataccgacctcttaccttccctgcgagatcgtaaaatccttgggggcaggattcatttctgacttatctttgcatccttcataagagctggtacagtggctacccccaaaccactgacttttattaatgattgaaaacattaaggccagtcgcagtggctcacgcctgtaatctcaatactttgggaggccaaggcgggaggatcacttgaggtcaggcatttgagaccagcctggccaacacagtgaaaccccatctctaccaaaaaatacaacaattagccggatgtggtggtgtgtgcctgtacttccagctactcgggaggctgaggcaggagaatcacttgaacccaggaggcagaggctgcagtgagctgagatcacaccactgcactccagcctgggtgacagagtgagaccctgtctcaaattaaaaaaaaaaaaaatagaactctctccctgagtctggatggagtcatttgggcagagataagcagctgtttgtctgttcttcctaccttgagtgccagtaagtcccaggccctgaaggcccccagtctgggaagttccctcagcactggggaaaaaggtcggtcgctaagtggacagtttgatgcgctctgtgcctctctgagcccttcagaaaacgaggacaccagctgtcccctgtctcaattgagcaggacgtctcctttcatttctcctgggcctcttactccctagcagggtgtcagagcccgctgccagttgtcccaagatggggaagcggccccgacagatggaagatagctcagtgctgtgtgaagggaaacggcttttgtttcagcccccggtgtgtgtggcaggcacgaggcttgatgacagggtgatgagctgtggaaggaatgcaccacagggctggaacacaatcgtgctttgtttttgttcttgcatctgagaatgcccctggactgatggcagcgacgaggcccaatgtgccacatttcatcctacaggcgccaatccacatccccccaccgcagagaggtggctcttcctgcaatccggccgcgatgcgcctgctgtaaatcagcgtggctccccccaagtcaaaggccgtctgaacaaggtgacagagaaatgcaaggaggatggacagcctcgtctggctctgccttggagggggaggctgcctggcctcccacagccgggacaggttccctatgtgcagcgctgcctgcgagagggtccccaggatgaactcctgctgtgtcactcctcagaacccgagtcctgtgccaaggacggtaactttagctatgaaggggagtcaagaaagagagaaaaatgaggagaaagcaagaaaaacagaaagattgaggacagggggatagaaggaggcagaaggggagaaatgaaggaagaggattttaaaaaataaaaaaaaaaagaatggacgcagcaaaccaccatcgcacacgtatacctatgtaacaaacctgcacgttctgcacatgtatcccagaacttaaagtaaaattaaaaaaacaaaaacaaaaaagagagtgtgtgcagggtacctcccctttacaaaaccgtcagaaaaaagaaagggaatggacaagaaagaaaagacgggaaaaaaagggaaaaagtaaggacatttttaaaggggggagaagagatggcaaataagaaatgatgttggcagtaatggcttttgagagccttactgattgatagaaaatatttcttagataggtttcccctccaggagaggactcttggttcaagctccctcctctcatgctggccaggagcagggctgcagaggaagctctgagtttctcagagaagcctagcactcccttctcttccttctaggcagccaaagtcctgggaggcacaagaaagtgagttacaagttccactctgtcccacagggaggctgcaaagtggtgtcatctctcagaggaagtcggctgagctggctggaaagtgtgtaagtgtgtgtgtatgtgtgtgtgtgtgtatgcgcgcgcgcttgcagcttctctgccagagttgggaaatcagaggtctgatcacttttgactctggtgtagctgttttcctcttgtaatcctcagtgtggtgagcagaaggcagtggaaaacacactccgtgaagtttttttccattagaaggtcactaaactgtgtaactcagaaataaggttctgctgcacacatagctttcaacttacatattcctggactttggacaacatcttttgtcccagaaatgagagaaggaacaacacttttaaattatttttaatttttaattgtggtaaaatacacataacataaaatttaccatcttaaccacttcaagtgtacggttctgtggcattaagtacattcatgttattgtgcaaccattaccaccgtccctccacagaattcttgcaaaactgacactctctacccattaaacaataactcctcatttctccttaccccagcccctggcaaccttcaacctattttctatctctttgactttgactactgaagatacctcacataagtggaattatgtagtatttgtctttttgagactggcttatttcacttaacatcatgtcctcaaggtgcatccacattgtagcatgtcagaatttccttcattcttagaaaaagcaaatgctattgtgtagtacgtatacagcacatttcgtttttccactcgcctaccttttggctattatgattaatcctgctatgaacatagatgtacaaatatctctttgagtccctgatttcagttattttaggtatacactcagaagtggaattgctagatcttatggtaaatctattttgaagcttttgagaaactgctataccgttttccacagtagctgcagcattttacattcccaccaacattgcacaagggttccaatcactttctccacatccttgccaacacctgttattttctgttgtttatttaagagattgggtctcgctatgttgcccagactggcctcgaatttctgggctcaagtgatcctcctccctcaccctccttaatagctgggattataggcacatgacaccacatccagataatttctgtttttgatagtagccattcgaatgggcaggaagtaatatcccattgtggttttgatttgcatttctctactgattagtaatgttgaacatcttttacttgtttatctgccatttgtataccttctttagaaaactgtctattcaggtcctttgtgaattttttaattaggccatttggtttttgttgttgttgtagaattgtaggagttctttaaatagtctggttattaatcccttatgaaatgtatgattttcaaatattttctcccatgctgtgggttgccttttcactctgttgattgtgtcctttgatgcaaagaagcagaattttaagtcaactgcaatactatggcacttctcgagatgtcactaaatgtgagagagaggccaggtgtggtagctaatgcctgtaatcccagcattttgggaggccaaggcaggtggatcacaaggtcaagagatcaagatcatcctggccaacatggtgaaaccccgtctctactaaaaatacaaaaattagctggatgtggtggtgtgtgcctgtagtcccagctactggggaggctgaggcaggagaatcacttgaacccaggagactgaggttgcagtgagctgagatcgtgccactgcactccagcctgacgacagagcgagactcagtctcaaacaaacaaacaaaaaaagtgagaaagaacaagataaaaccctaccctgatgactgcaaagtgtgtgcacccccatccaccagtatttcagcctagcctcaccagaacttgttgaccaagttaggacataacccacctcttccattaccttccctatcagagtctgtatgtgaggttcccagaaatcctttctttgcagacctatgctaaatagaaggttttgtgtttgggcttttttgttgtttcattgtctggttgggttttgttttgatgttggtggtgttttggtttgtatctctgccttctgactatggtttttcaagtcctgcagcaaggaatcttgcagaattaacttcacataaaggattcaaatgaaccacttattcggaagaaaacatcccaggtttgctggccagttcagctctccacactttgcaccaggagggatcattctaaaaagtgatcccaaggggagtgagccagatgcagacatttaactgttctgcaagataaggacttgaaagcatcttataagtgagcactcagcattcaaggtcctggctctaagttttatgagccctaattctgatccagtgtcagctgctggattctctgccaaagaaatactggaaaaccagcttttcttcaatttcattggtatgtcagccactgatggacatcgtctgtgaagccagaccaacctttaaaacatccaaatatattggaatgagtgcatcattttcttttcgcaatggaaaagcaaagctagtttaatggacgacgacgtcaacccaatagtgccaatagtgggtgggggagagtttcgcaggcagggacaggaaaggtcctggagtgctgcccaactctccccactttagagtcacttgcctttccccagggagccccaccaggccatgctctgccacactctgaagtccaattggttcaattcattcctcttctttcttaaccaccccttacaagtttcttgaatttaaggcatgtgcaaggcactgtactgagggcaatggcagtggggagggagacacagagctcatattatacacggcagctgtcctcatggtgctgacagacaagtggaagtgatgaaggaacaatcaagaaaaagagtgatcaatacaggccgggcggggtggttcacacctgtaatcccagcactttgggaggccgaggtaggcagatcacctgaggtcaggagttcgagaccagcctggccaacatggtgaaaccccatctctactaaaaatacaaaaaaattagacaggtgtggtggctggcacctgcagtaccagctactactctcaggaggctgaggcaggagaatcacttgaacctgggaggcagaggttgcatgagccgagatcacgcgactgcactccagcctgggcaacagagtgagactccatcccccaaaaaaaaaaaaaaaaaggtaatcaatacaaagcagacttggtaccacaatttaacattccactcgaccccaagtatgtaggggcttccagcagaggggccagtgaggaggggaagtcccagtgacctggcattggaggtacattgtacacacagacaccaacacaaacacaagcacacatctcaatgccagcacccacacacgctgacactgatatgcacccacacacattcacagatacccatacatatacacacacaccctaaaaaagggatgtgctcttcccacatcagtgccgggatacatttttttttaaacattcctctcctaaaagaaatgataaataggttgggcatggtggctcataactgaaattccagtgctttgggaggccaaggcaggaagattgcttgagttggagaccagcctgggcaacctagcaagatgccatctctacaaaaaatacaaaaattagccaggcatgctgatgcactcctgtagccccagctgctcaggaggctgagctgggaggactgcttgagcccaggagtttgagcctgcagtgagctatgatcacgacactgcactccagcctggggcaacagagcaagaccctgtctctaaaataagtaaataaataaataagaaatgataaatggacaaaaacccagggcttcctaaagcagtttggaggcccaagaagacagcccggctgaatttataacatatcaccatcctttgccccattctagataggtttcatatgcaccttataaaaagtacaccccaacttcctggaaggggtggggtttttaaaggagtagattaatgttcatgggtggtagttgctagagttccaggtgaagaagagaagcaccaagctctgagtgttttttgcagaattccaagtcctctctgcagatgtacatttattcctgtaagtggatgctgggctttcgttttatgtaccctggctcaatttcagcgcaggtcaagttcaaatgcttcatgcggcatggacagtgatgagccttgaggaagtccaggtggttctgattaggtctggaagcacataactcatccaatagagaacccaatcaattgcaaaggtctgggtccctgttcctgcctgctgggtccaagtttcattcctgttggaatgtaacttcccgatcaaagacaaaatctttgattccttcttcccacctaccctcccaacaaaaagtcaccgaaaaaaaaaaaggctggcttggaattgaggctccagaggtttatttggacaccacccaccctttgtaaatcaacattttaacgagttaagtgcacatgaatcagaaacacagggtcacatttcctctgaaatacttgggggtggggatgcaaaatgcactccgaatttggcccagtccagaatcaggaggcaggccaggcccttgtcaagattctctcatcccagtgttcggcccagcagccgggaccatttcccccagccgtcctcagctgcgtcaggactgagcggaatggtgctcacatgccctgccggccgccactaggataatccatgccaaccccacagaatgggaggcgagcgatactgagaacaatgaaggggtctgacatggaaatttcagtaggaaacaagcaattacatgagaacaaacattcccagtgccacttacaacaattggaacacaacagtgattataaaaatgaaagcaacaaattgagagccagggcagcatgcaccttaaaacaaattgtcctcctggtgcagagctgcgaccctctccctgggcaactgtgtgactgtgtgtgtgtgtgtgtgtgtgtgtctgtgtgtctgtgtgtgtgtaacacatgaattttatttgacttgtcttagaggctggatctcttatccctgcggtagaaaccacttctcctgagcaaactggtttccatccaccaggcagggaggaaacagtgagaaaactggagaggattttctctggccctgctataggttcagtctcaggactgtgggaaaatgtgcacggcaggggaaaaggcctgtcttctccaactcagggcagaggcaggtttctaatgaagagggcctaggaaagaaatattttgcagggagccaaacgtaccaggacataccagctttccttgttttcttcatcaagatccacagaacagtgaagctcattctagggttcgaaaggtaaattatttccttccatcggttgagtgaaaatcagtcctctgggtctcatgcacatctactcagtctccattatgggatgccttccttatccagctccagcctgtgtttctcattcatagctgtcaattctggcactgcagggaggaggcatctgaaaataaggcggcagcctggggaagtctggagaggatgcagggagtttctgcgtggcagtggttggcaagtggggagcagagctagcaaggcttcacgctgatatacattgcaatttacaggctggtacttatttttttctctaggcaattactggctgcctcctgctcctcctcttctgtaggggccttggggcctccctcaagcctggcccagctcggggcctgatttgtgcggctaagagtcattgagcaacctgccaagactagcagccaagtttggattcctatggccacagctgctggccttgggagggagcactgaccccagaggaatccagctaaatctgtggaacccaccctggttgtccttgggccacattgtgaaatatgcacttagattgtgggttgggttgtggcatgtgatctctttattccttcagatgatgggcctactcatctagttgatggggcaagattacccagatctgcataagccccccagagaactatgcagcaaaaatggaaactgaggcccctaaaccacccttccaccctcaatccattcccaagtacaaacaataacagcagatgctagtgtaaatcattaaaaagtgcaatagatggctgagcacggtggctcatgcctgtaatcccagcagtttgggaggtggaggcaggaggattgcttgaacccaggagttcaagaccggcctgagcaacatagtgagacttgtctctacaaaaaaatttaaaaattagcatggcttggtggcttatgcctgtagtaccagttaatcagaaggctgaggtggaaggattgtctgagcctggaaggttaaggctgcagtaagccaagatcacaccactgaactccagcatgggcagcagagcaaaaccctgtctcaaaataaataaataaaactaaaataaaataaaaagtgcagtagagatggggatcttgtgcaaagcattttagcagaatctcctgttttctttctaattcccttccttggaaggaaatttattgtgcagttctgggttttttttttttccatttcaatagatttagggggtacagattgtttttggttacatggatgaattatatagtgaagtctgggcttttagtgtaaccatcacccaaacagtgtacactgtacccaataggtaatttctcattcctcaccccactcccaccctctgatcttctgagtctccagtgtccattataccactctggtggacctgtgtacccacagcatagcttccacttataagtgagaatatgccagtatttggttttccagtcctgagttacttcacttaggatagtggcctctagctccacgcaagttgctgcaaaatacattatttcattttttatggctgagtagtattccatggtgtatgtataccacatttcctatattcactcattggatgatgggtacttaggttgattccacatctttgcaactgtgaattgtgctgtaataaacatacaggtgtaggtgttttttgatataatgacttttttcctttaggtagatacccagcagtacgactgatagatcgaatggtagctctattcttagttatttgagaaatctccatattgttttccgtagaggttatactaactttcattcccatcaacagtgtataagcattcccttttcactgcatccatgccaacaaactgtgggttctgattgctttatttatatttaagccctgacacccggggatctcagagaagctggatccctggatcctacctggccagccaatgggcaggcttcctgagggtacacagctttaggactgtggactcaggcactccagggaagcgggaaataagaacttctccttagtgcttgcaactgccacatcagaacttagctgaaatccgagggatcggatcccaaatccttcctcaccagcccccatccaccagtccttttgctcaggtgataggaaggtcatcctaatgataaccacgtggtgggtttcagctgtggaaaattcctggcccctttctccttcttcccaccccctccttctccccttaagcacacacacatgcagctttcccttcctttatttaagcaaacaactctccatgattgggtacagccccttcttatctaaatagtctgcagatgcatgaagatgcaggcgctttctgctcctattcggagcttgttctggtgcccatcttctccaaacctacaacaagtggcctcccttagaccttgctgacagcaatccctactgcctgctcccctagtaagtcagctcaggggacaggctgtcctcaatgtatcaggggtgggattttccctccaaagacttcaatttcccctctctttcttggctcctcccataacctgaggttgaaactgcccagacatgagcaaatggaacagggaaagtcccaattttgttgtcagattcctatgtaactttagttgtccaggtacataccaccagttggttaacaccatcaacccctggtgggtctggggatgggggctgaggactgggaagtttggtaaagggcacagtccataatgttaatagatgggaaaaataggaaggaacctgtgagtttccataatgagcagggtctgagggaaaagaattaaccctaaggtctaggacaagaatgaaatctaatgagtgggttgagaagatcagccccagctttgggtttataagcatgactctctggtttgattttcttcccattccaaagcgtggtcaatattttgagtccttaggagatgggctgtgctgatcatagagatggtgatactgtaacagggggtgaggacgcacctgaaaccatcagcctgttagagcttccctacccaaagtacattctgcacactgacagcttcacagcttcagcctcacccgggtacccaaggaaacgtggtacacatacactatggaatactacgcagccataaaaaataacaaaatcctgtgctttgcagtcacatccaaatgccacatgttcttactaataagtgggagctaaacaatgggtccacatggacatcaagatagacagaatcaattctggggactccaaaaggaggaaggggtgggggcaagaattgggaaatttcctattgggtactatgttcactatctgagtaatagagtcaatagaagcccaaacctcagcatcatacaatatacccttgtaacaaagctgcacatgtgcccccaaatccaaaatttatatttaaatttttaaaagattattcaaatgttaatatggcccactagtagtttgcaaaaaaaattatataatctttggattaagaaaaataacctcttttgatattaaaagcattacgagtcatgtgtgctttaggtacttatggattatttgacaaagctccattggataggccatgtatgtctttatacaaataaaactggaaaaatatgaggaaaaaaaagaaaagaaatgcagaattcaagcccacctcagacctacccttcagaatcggcattttaacactggtcctcaagtgagtcatatacatattaaaatgtgagaaacactccttggacagccaaatgtactcagtcttaaggaaagagggctcgttcccccttgcatttaacttgcctctattagctgatgccgggtaagatgaactcacagagcttcagaagggactgcggcaatatgaagtgtggatgtggggagagggagatgacaaaataacttcctgcctctcatccccgggccacgcaggtcctatgagaatgttttgcaaagtaagatcccgtgaactgctggcatcagagaaacctagcaccttggttctagagcccctttgccaaccttcccaaactttcccaatcagaatgtctgggggtgggagccaagacccacatattagtaagctccccttggtgatactcacataggctgaaatttaagaacgattctccctctgcccttcaattgctattggatgattagtaccatgtcccaccctcaggagcaaaagtgaattgctagcacttctggacccaaggaggggagacagcctttgaagttaagaccagcctacctctgtgtcccttggtcttttatacctcctgcctagggaagtgccgaaatttttcattaaggaggtgcaggtgccatgcagcttgaggacaagcctgtggttccaagtgctgccagcatctctgaggcacaagcgtcaagcagtcctgacccttgggcaccccaaactccaccacggtgactccagcagctggaactgagatacctttgcacacacttcatcatccttttgcagacttaaaaaaaatggaaatggtgggtcatggtggtgagcttcagtagggggtggcaatgacatctccacccagcctaaataaattttctttcttattaaccacagggagctaaaaggaaatatggacattttccttggctggactagtatctcactattttaccagtcaggtacattagcatgtgagaatctttctggactacagcatgactttgatagaatgtttacaagtcctcataccacaccttaaaaaaaaagttgtgtctctgtgcttgggcgtggatttgggtaacctgggaatattttatcacttctgggtaaaactgacagttgtctgcggtttggaggtgacttactgatcagggaactacatccactgaagttgtcactgtaattgcttgcagaattagaagtcacatggaagaattcctgaggcaagaagcacataacctaatatgaaacagcttgggctgggtatggtgcagcactctgagtccaaagggaagctcggcagggagcgcagacatcacgcctacgcaagtgggatgcaggagccctgggttctaattccaaccaggcgagtgacctgggagtcccagactagttgggaaatcccagctatatccccatcttacgttaaaagagtggatatgttcctctccaaggcctcctatgtgtctaagactccagataaggacaagttttccaattctagttggtaattctaacattgagttgagccggaggggaaagagaatgtttccatgagaaacatggaaaagaaattcaggcagggccgaaagctacattcttgtagagcaagcatttaaccttctctctgatctgaaacacacacaaccaggagaaacacttctggaagttatttataggagcagatggtaaatgggagggtgggggccacgggtagcctgtggtgcctcccaagttctccttcagcccacccacacccagttaccatttgcaagctgttgaactgggaccagaaagcatcactgaagaaactcaagaggagaaagatacatgtggttcaccggaaagggtgagaagtgtatgactgagtgggaaaaaaaagtcacagctcacagtatcattgattaattgagtgattttagtcaagtgaatattgatacatggctgaaaaagcatgaaaataaaatgaacacgtacgggaattactattaacataagcgataacatcaaaacatctggtaaaatgcagttaaaaaaacaacacaaatgaaatggaatgtaaaacattttcacagtattcaaagcttttgtaagagacttaggatctaaaagaggagtactacaggaagaaactagaggaaacgggaatttcatccatgtcctgtgtatctgctggcaacaggtcagaacggccagtatgttattccctgcaggctgcctagggtgctctcctcaaacagatcacctgagcctcctgcatctatgaagttatgacacagcaaccagttactcagagtctgatgagaaaaacagattttaggtttgggaaatgggattactgtaatttacacatccaaatgcaaactggagctctgattgaattctaccctggggagaacttgatgctaacccacaggtaccaagagccaagtgttacacaggatattttaaaaataaaatgtttttggaatcctcacctcccatgctatcttctaagataactacaaatattcttcaaagatttaactgagttctgccaaggacctcccaggactctatccagaatgattattgtaaagctttacaaatcccaccttggccctagcgataattaggaaatcacaggcaaacctcctctctcggagaccaatgaccaggccaatcagtctgcacattggttttgttagatactttgtggagaaaaacaaaggctcgtgatagtgcagctctgtgcctacagagagcctcccttttggttctgaaattgctgatgtgacagagacaaagctgctatgggtctaaaaccttcaataaagtaactaatgacactcaaggtcctgggactctgagacagacggtggtaaaacccacagctgcgattcacatttccaatttattttgagctctttctgaagctgttgcttcctacctgagaattcccatttagagagctgcacagcacagtcacctgctcttccgtattctgtggtaactactaatgttccaggtaaacccctccactaaggactctgccgcagagagagggcccggttgcatgaggcactttgtcaaaatgagcagatacgtatgagcactgaactcttgagtgaatcaaccagaactaagacccagatccacgcactcaggaacttgctctgaatttcagtttgacaacagagaagtagaatatttctaattagctaatatatatacacattttttaatcatccaaaattacaggcaaatcacttaaggtccccagcactttacgatgaaaggtcagagagaaccccacaaaaaaggtgttaaaaggacaggatcactaactgtgagaggttaatttatcaggataactctccggtaggtaactaggcgggcatgctgattttcatactggagtcttcaagagttaacagaatctaccatcctttcctccgggtcaggctagggccgcagggggccactttacagcctcactgcagcatcctcactgggtataagcattggcccagagggacaatcataaatgtcctcaaagtgttgcagagaattaagaatccggctttgggggaagaaattaatatgcattttttttagaactacttcctgtacattggacaagaagggtaaagttgtctaagtgaactggcttatatacatcgctgattaaacataagggctttgggaagtatctcagggtacttgggaaaaactgcagagatgttttgcttttgaaactctctcgctggatggggacaccccacccatgtcaactttccatctgcagaaatgaaacaaatatatgtaaaaagtgcggggggacaggcaggctgttctgaatttctttgatccataggcaatcaagttcaaaggaaatgtttctttacaggaaagaaaaaaacggaaagctctgtgagttttgctagggggtgttaggttctagggcaaccacggactcttcaggaaggaaagccacacagctacactaccagggaaatccgcctcccttggcaaatgcctggggagagctgctcctctgggaagcagcctcggacggatcaggagaccttgttctagcacacctttcaaatgctcaatgtagactgttttaaaaccttgaaaaataagtgggtgtttgtcattgttcttttaaaaatgtgaaaaggaaaaaacatgagattagaatcctaagctcttcacccaatttcacaattcaccctgactagcaatttgctggactgttctaaaatttttttcatttgtttcttttttaactatgtgttttgaaaactactgccttctcagcccgaaaatcgccgtctctctcaggctcactgtggtttcctttttctgacacaaaggcaggcacaggctgcccctccacatgtcttggggatcagatcatgccccgggctcataggaaccgaaactttggggcatctgagactggctgattcagattcaaagacaatcacacggaaagactgtgggcagagaaggcaatgcctctcccctggtccctttgctgtcactattacataatggacttgcacttttcctccctgcacttatcactttctgggcttgaccttaattgtaagtgtggtatgagtctgtttccatttaaagcagacagaaagaaactactctggacctgaaaacaacgtgacttgccaatcattagaattttctagttgaaaggcatagatcagccaatagatccacaccaacaagttgcaaaatgtagtttttgctgctggctctcactttccgcccaatccccctttttgtgttttagtggctgtgttgctgttggaaatggtttgtcacctcctcctgtgcagtggctgctgctccacattgcggatcttaaaaaccttcctaatctaaatggcccttgctttacccggccatggctaccctggggtttggagcgtggctatggagggaagggagcgggaatgctgcaagaacaagccgactggattacaatgtccactactgacaggcgcagtgcgtgtgtgtgacccaccgggttcccggggcactgtcccccccgctcccaccccacccgaggctccctccccaccctgcccccgggagaatcacttaaacacggactgaaaggtggggcactcatggtttttcattttcttcatgaagtttttgaactccttgtttttcttgtcccacttgtggatggccgtcagcaagtactggctcttcaccttgcggcccatgatgaggaagtggtggctgaggttgtccagctggtggcagggacagtcagccccattcttcaggtacagcacaagcttcttcaggtccttcttcttgatgggccccaacttcaggggcttcttcttcttggggacaatcttcttgtcgccattttcttttttcacttcttttattttcatcctcagtgctagagatggagaggacagaagaagagaaaagagggtaagagaaagcatttagaacacagcttttctttttttgatcctcaaagtgattgcattttattattttattttttggcttatactttcttcttgtaaatatatatgtttttaattttagattcaggggcacaggtgcagagttggtttcatgggtatactgcatgatgctgaggtttgggcttctaataaccccatcgcccaagcagcaattacagtgtcggccatcctccctcatgtcttttggaatctccagtgtttactgtggaacaaagcttttcatctagaacaataacccaagtgtacagctgaggtggagaagaaaatgaaaggcaagtaacaagtcaagaaacaggcagttttatccataaaaaccaaggtctgttaatcccagcactttgggaggccaaagtgggtagatcctctgaggtcaggagttcgagaccagcctggccagcatggtgaaaccccatctctactaaaaatacaaaaattagccacacatggtggcaggcgcccataatcccagctactaaggaggctgaggcaggagaattgcttgaacctgggaggcggaggttgcagtgagccaagatcacaccactgcactccagcctgagcgacagagcaagactccatctcaaaaaaaaaaaatcaaggtctcagttacccattctgccaccgcctccgccccctattctgtggtgtccagtggtatctctctgtaatggccatcggtgccaggagatcctcaaataaatttcaaagctaaatcacattgctctttttaaaaatccagttatcatgcactgctttaagagaaaaaagggtcctataacccaatttactccacatgatctgatgctattgatctcatcattcaaagacaaaaaatcctgagtgtttttgttttttattgttgtctttgtggaggcagggtctcactctattgcccaggctggagtgcagtgtctcgatctcggctcactgcagcctcaaactcccgggctcaagcaattctcccacctcagcctcccaagtacctgggattgcaggcatgcaccatcatgcctggctgatttttttttttttttaagagacggatcttactatgttgcccagaactcctggactcaagaaatcctccctcctcagcctcccaaagtgttgggattacaggcatgagtcaccacgcctgaccatgagggtttctttttgtttggttttgttttgaagagcaagttattggtttagtattttaacattgaaagacctacaattccttgaaaattgagtcctataaaatgacaggcagaactatgtgtgtgcactcagcaagggaaagttaaaggttgtttcaaatggtcatgcttcctgcattaaacatcaacgtccaaccacagcatgggagaaatcagtttctactactgggtctctatggcggtaagacagcaggtactgctagtatcagtcaatcgctaatcaaccactaatccccactgacaggcagcactaatgttctgccaactgagaagacctacacaaaatccaaatctactttgactttctggcagattagagcaagttctggtgaagtcctaattgataaatccaggtgatgagctctcttcaaatccaatatggtaccagggctgcttctgttctcaactcccaggagtgtgggaaaatcagcccattcaccaactctgctttctcttttctctgtcccaatggacactgaattaacagtgttaacctgtgagccacatcctgtagcaatgactccacaggggctgctgatgaagataaatgagcgtggacatgctctataaacgaagcagactgaacacacagtgtcgcgggtacaatcaactcccctttaagactggtcagcccgagatattcccaaaggagttggaaatcactttctaggtgccagtcaccagataatttgcgtatcttctgaactctttttaatagaaaattaccaagccccctctttttaatgatgcaaggcttccacccacacaccctgaggaaagtctttaacctgaactaaatcacagtggctaacaattatgaaagcatgtgacctgccagaacatgtgctaagtattttccgtgcatttcctcagttaattctaacaactccaggaggaaggcataattattttcccatctaatagatgagaaaactgaggcatagggggttaagttggcttgcctaaagtcactaatcctaagttgaaacccatgtctaaatgtgcacttttaatctgcatgttgtccatgctgactctatggttccaaaattctttagaatggaccccaaacttggagtactgattaaatggaccaagaagatcacagggaggagctcagaccctcttcccagtttcacctacatttcaaaatgacttcacttatgaaatggcaaaagagtgcctcctggttgaaagagacttctctggcaaaggagaaactgcatttgtgaaagctttattatttaatattttaatttattttatttattagagatgggagaaactaatgcatactccagctgacaaggcgagcgccctcttgtctgcagagaagtgagccattgtaaggtagtacccaccacatgctgggctctgcagatgagaatgggatatgtctatctacgactccttgtttaatactcgcagcaaccatgttaagaaggcatcaatagtactttattataatcaaggagaaggactcaggttaagtaacaacagcatgaggccacagtttgtaagagacagaatcaggatcagaacccacacctaaccccaaaaccactctttcctgccatacacaccacgacccggttagaagtgatattgcttcattggaaactatttcactcttctgattgtgttgctttcaatcacaattcaaatcaaaaattaatgttcctttgccatgaccgtgtaaaggaatgtagtttacgtaggtgggggagcagccagggaggagaaatcagagtatgggaatgtgttacacattagactttacttcttgtcttgccacttggcccctttctttttttgaggtggggagagcaggaaagaaggcacgtatggccagaaattactaacatctttccatctttcaagggtttgttttaggagtgcagactaccaacaatgttgaaaagatcatgagctgtcccgggtggatttttccttgtgggtgtgtgtgcagaccccaccatgatgcatcccggggctgctggggcgagggcaggtgctggcccaagagcagcccggaactgatcaccaccaccccatcccatcatgctcacagggcctgggccccagcgatgttgcccatggcctgaatttgcaatgcaaatggtggtggtgaacaaacagaagcccagaaggtagcagctggggcaacagctggatacagtcccaggtcctgggttcttctctgagtctcagtactctgtctgtaaagtgcagggcaccatccgactgcaggcctggtggatcgaccatctgaggagcccctgctgggtacttctgggagacagcaaagtttatctccagcactatccccaccctgtgctcactccatgcttccctgattgggcaccctgctgtgcctggagcatagggctaaaactaaactaccaccttggaccctggatctcagctccctgtaacagctagaccctaatctaaaaccaaacaaaaaaattttaaaaattatgtgttttttttcttaagcaacaattttaacatcctccaagggtaggacatgactcccacctaggcatagctgccagcaagaattcagagacccagaaactttgaaaactcaaaatttgaggctgcaacaagggcctgcctgggtctttctcgggaaatcttaaaataatccattatatttgagtaggccattaagctttcattctacttgcagtcacccaaaccatttttgctcacaaattatacttccttggtagcctccctcaagaagcctggccttatttgggaagctgaaatgagaatgaggaagtcatcacacaccatcccaaaccctcacattcttcaaagccgtctcttcctcctgactccctgcttctatgagtggtgcctccaaccctcccaagcccgagacatcctacccatgactttgaacgtaaggcaaccattggcccagagccagtcatttcataaccagtcctgtggaatggctgtaggaatccaggaagggtctgtggggaaaggtggcatggggttgcattaggaatcaatcttataactcctctgatggcagatgatagtagcaatgaagggtaaagtacagagggaaagagggacatactagagagcgccttcgtcaggtgaaaggaagaagagttactgtaaatgccacgggaggccccgctgggaaaccaggcagcccagtgtcaatgaagaccacagggtccatttaaatggaggaaacacccctcaaccctaagtgccgaagagcttaagaatgagtctgaaactagagcacttcactgggtgattagggggccacgccaacccataggaggccaggatctggagtggtgagggcaaattccagagagcaaaaatccaatgggaagggaaaagaagagagaagccatatcaccaagcttctggactgagtgcgaaggagcacttgcaggcacgctagccacatggattagactgagcccgtgcaatcattcccactcttcttgaagtcagtttaaaattagagtcaaaaaaacaagttataaacacatgcaagaaagtggtaaaggaaaaaagaacatatcaacattttgtatgacagaaagcaaatggatggtagaatctggcttaaaagggagaagaaaagctaaaatgcagatagggatgccagtaaagtgcagagaaaagaagaaaaagagggacagacagggatgccagtaaaaaacaagcccatttgcactccaggtcccacaaatgctcctgattggggcccccggacactcctgaactccatcacagaggctgtcaatgttgggattggcagcaagtttacatatggacactcaaacctactcccctgggccatgagtccaggtggctgccctcaccaactccagcagtagccatgggcttcattccatacagaaggcctgtagttccagctacttgggaggctggaggtaggagaatcgcttgaacccgggaggtggagattgcagtgagccgagagcgcacactgcactccagcctgggtgacagagcaagactccatctcaaaaaaaaaaaaagaaaaagaaaagaaaagggggaaaaaaagaaggcctgaacctgcacacagcctgccgctggggtatactagacacagaggaggaccggacaggtgctgctgcgtgaacaccaaagggttacatgaaagtctgcaaagtgaagaatgagacactcgggtcttagaacactacatttatatgcctgtgtcagaggattgagtggtttttctctaaagaaactattaggctgttgcaaaagtagtcacggtctttgccattactttcaactgcaaaaaccgtagttacttctgcatcaacctaagaatagttcaaaagaaaagacatatgggccctctgcaaaattctcaagtgaggcctaacaaatcacaggccctgcatgtacacaaagagcttccaacgtcatgtctcgctgttaaattcaaatggacagtcaagggctggcaagtatttaaggaaagcctccaaatgtgaatggcagagactgtaacatacaaaacagaaaaggaagaaaaggaattcagagataacagagacaatgcagggagtattaaaaaaaaaaacttttcactttttgccttgttgcactcctaaaagcaagatgggtcaccagcagctctcctggagccatccaaaaaaattcggccagggttctcattcttgtcattatggcctcaatatgtgctgccagtgtttccatcagtatgcagaggaggtaggcttcattaggttagactaagtgagcttccctgaatggattatccaaggcatccaccaagtgaaagaaaccatgctagctctctgtacataaaataaaattttaaaaaaaaaactttaaaaaatgataatatggccaggagtggtggcccgcacctgtaatctcagcactttgggaggctgaggcaagcagatcacttgaacccaagagttagagaccagcctgggcaatatagtgagaccccatctctaccaaaaaaaaaaaattagccaggcatggtggtgcatgcctgtagtcccagctactcaggaagctgagatgagaagatcagctgagtctggggagattgaggctgcagtgagctatgactgcacccctgcgctccagcctgggtgacagagtgagaccctgcctcaaaaaaaattgttttaaatgataataaattagataagacttttgtattcctaaaacaagaacagaaagctattaaaaggaatgttcagagactgggaaagattacttggaaatttaaaatataagagaagaaatataaaatgcaagacaagtaaaaagatgtgaaagaaaggaaataaatatgcagtacactacatggctcagctgcaaataatatttacataattctaataaattaaacattcaatattaaccaaaagtgtgatgtaattatattggaaagatagtgtaaaagagataaatctttaacttcaataacagaaaatcaataaataatggttttaagataaggttaaagaggccaggcacggtggctcacgcctgtaatcccagcactttgggaggccaaggcaggtggatcacttggggccaagagtccaagacccgaccagcctggccaacgtggcgaaaccccgtctctactgaaaatacaaaaattagcctgtgtggtggcatgtgcctataattcctgctaattgggagggtgaggtaggagaattgcttgaactcaggaggcagaggttgcagtgagctgagattacaccactgcactccagcctaggtgacagagccagactgtctcaaaaaattttttcaagaatattttttaaattttttttaaaagataaggttgaagaaatttcatgaaaagatgaacaaaatgacaaacagatgggaaacagaggaaagaaaaagagaatcaatccaagagtttcaacatctgagaaaagggtattatagcaagagagaacaagaaaacaaacggcagaaaataccaaagaaataatacaagaaaactttccagaaatgaagaacatgagtcctcaggttaaacaacacccagctcaaagaatcatgacatttacaaatatgaaagacaaaaagaacttttaaaatcttcaagagaaaagggtagacatctaatacaaaggatcagtatcccagttgcactggatttatcaatacagacactggaaactggaggataatgaatcaatgcctttaaaattgccaaatttgatactgaggcaagctatcaatcagcatgcaagagtagaatgaaaacatcttcaggcattaacaggttttaaaacatcatctcccatgtatcttttcttaggaaactactcaatgatgtgctctacaaaaatgcagaatttttttaatttataaaatgtattatcagccaggcacagtggctcacacctgtaatcctagcactttgggaggcagaggtaggcagattgcctgggctcaggagttcgagaccagcctaggcaacatggcaaaactctgtctctactaaaaatacaaacacttagccaggcatagtgatgcgcacctgtgggccgatctactcaggagggctgaggcaggagaattgcttgaactcgggaggcagaggctgcagtgagccgagatcatgccactgcactccagcctgggcctctgtctcaaaaaaaaaaggcattattaatgttatttttgattgaaaagtaataattgtataaacttatgggttacaatgtgatgttttgtataagagaaggaatgattaaatcaagctaattagcatgtacatcatctcacttacctatttaaaaaaatgcagaattaaacaagacacgggattcaggaaaccaaaggtctaacctaagaaaggaaaaggaaggcttaggatggtttttcccgaacaactgtgtggcaggctgtgatggttaattttaggtgtcagcttggattgagggatgctgagaaggctggaaacgtgtgtgtgtccaagagggtgtttcagaggagactgacatgtgagtcagtgggctgggagaggaagagtcagacctcaatgtgggctggcaccacccaatcagctgcgagggcagtcagaataaagcaaggagaagaaggcaggtattcagcttgtggagtttctgctctccctcccttcccaataatggctgtttctcttctcctgcccttgcacatcagactccatgtttttcggctctgggactttggggcttgcaccagtggcctcctgggggctttcaggctttcagcctcagactgggggctgcattgttccaaggcttctctggttctccagcttgcagacagcctatcgtgagacttctccaatcctgtgaaccaatgcccctaattaactccctctcccatctcctgttgtttctgtttctctgaagaaccctgtctaacaaaaaagcctaaagctccatcagcccagaccaatggtaggaaagagaactcaggcagatttcctgatgcatatctgccagaaagcttggggctgaattcataatatgaacataagtaactgggttaataaaatggggcagttactatctccaggaaaaacaaaatgatgtaaaagaaaggaaataaatatgcagtacactacatggctcagctgcaaataatatttacataattataataaattaaacactgaatattaaccaaaaatgtgatatacctgtactggaaagacagtgcaagagagataaatctttaacttcaataacagaaaatcaataaagaacatctaaatattaaaaataagaaatccaattataaccatgttatttatttgctccagtttgctgaatatgaagaaatcactaaaatacttgaaaattattacttctaggtcataggaactagaggtgggaagggaactgcatgcagtttttgttaaaaaccattcattccaatttaactttttaaactatatttacgttgaatcaaaaatttaaaatttaaaaaacttagtctaataaagaatgtcagtgtatataaaatataaatgaaccacaaaatgtcagatcatgaaggaaatacagagatttcacatctccagacccttcaccctccattcagctggagcaacttggccatatagttaggacttcttaagggttttgattaagaattctgctttctcaaccagctttttgttgtttcctttttttttcttttttgaggaggaggagggaggcagtccactgatttagtcaatccccatcatttttcagataacaaaatcaattgggttagaatgcaaattatttacttagaactggaagagacgttaaatctggttcaaccgatgctcaaaagtgaagtcacttgtcagctctgcctggaacctgctccctgcttccctacccagagctttatgattcatacagcagttcctccagtaggagagcgagaggggatgaatgggggcctagccatctgggatgacggggcaagcagttggatccattttttccaaaaggtgctgttaaaaaaaaaaaaaaaaaaatcacccagagacagataccagaccacacactctgattcctaagagacttgctttttccctaaattgctttctttttcagaggggcctaaagttcccaaagagataacaagagaagtagagggcaagctagtcacagtgagactggcaaactctttttgttttttttttttagacagagttttgctcttttgcccaggctggagtgcagtggcggaatctcggctcactgcaacctctgcctcctgggttcaagcaattctcctgcctcagcctcccgagtagctgggactacaggcacacaccgccacgcccggctaattttttgtatttttagtagagacggggtttcaccacgttagctaggatggtctagatttcctgacctcgtgatccgagactggcaaactctttaagagacagggtctcactttgtcgcccaggctggagtgcagtggcgccatcacagctcactgcagccttgatcttctgggcgcaagtgatccttcagtgtcagcctcctgaggagctgtgactacaagcattcagcatcacatttggctgattttttaatttttgtgtagaaacagggtcttggcatctttcccaggttggtctcgaactcctgagctcaagtgatcctcccacctcagcctctcaaagtgctctcaaagatgtgagccaccacaccagtctgtaaactctacaaagtggcttagcccagcttggttgatcaggaaaggcccacagacgggcaccccaatgcaccagtcgcatgggcctgctccacccctcctaccccacagagcctccaggtggaaaagtctgctcagataccaaagcctcactaagccatgaagacagagcactggtttcctgcctcccagccccagatcacacatgtcttgggtaaccctgaggtctgaggcagaaagcaccctccccaagtccaattgtgcaaatgagattcagtaacagcactgggtacggcatttggctgcaagcaaccacaacctccttccaacactcagcagagttctgggcaccatggcgagctggctttgcggcactagggcccagataagtcctactgacaatggccttgcaatggcagcttaacagaccccactgttcccagcaggagccaatgtctggcatcattaattcgtttagcagagaaaggggcttgtgctttgtcacaataactcagcgtctctcccctgaccacaagccacatgctgcatacttggatgcatttgctgactacaagacatacgttacacacaagaacaaaaaaaactaaactaaaagaacaagatccaaagcagatttctttttctctcatctccaaaaacaaaacaaagcaaaacaaacaaaacaaaacaaaaaacagcagatgtggaaaatgctcctgagtggctcatttgggacaaattatttaattgaagttgtcctgttttctggaccccagacacctcaggaaggtggccaggcaggagagtagagattgcaactttgcagagccctctccccagtactcacatatgaacgcacacacgcaagctcatgtacacatgcacacacactcgccagcatcatcaatgcatacacaccagcagcatcggtgtcagccatccagaatcctgctgctaactgcttgatttcctggattgtgttaaatccccactgagttaagctaatggtgcaaaatgaaaaccccactctgagagcaaagtgctgcctggtgtgatttcatctgggaagccacgcatcttggggagcaagggcttgggcctcagagtggatcagagaagaactgtggcccctccccttcccagtgtgcagcttagcctcttccacccccagccccccaccctcaccaccatcctgcactggagggagagaaagaagaataggagaatcacttaaataaagtccatcactaggattgattgaatcttggctctgagtccaggcaaacctgccaaggcaaacagcttttcctaccatggggtcactggtttttcattcctctccaatctacttcctggtgtttgcccaaatggcaagttgaaatgtgggatggtctcctgggagggaaaagatggggagtgggctacagaaaaggcaaaaactatccctcgctctgagagatgctagagtgagcatcatcagaatcacctggaggattgttaaaaatgcagactgctgggctccacccctggagcttctgagtcagcagccatgagatggggcccaggaatctgcattggtttttatttttagagaccaggtctcactctgtcacccaggtcagagtacagtggtgcaatcacagctcactgcagccttgaactccagggctcaaaggatcttcctgagtaactgggactataagcatgagccaccacaccacctaattaaaaaaatgttctttagttttgtacagatggtgtctcactatgtttccaaggctggtctcaaacttctggcctcaagagatcctcccaccctggcctctcaaagtgccagaattacaagcatgagccactgtgcctggccagaaatgtgcatttctaacaagtccccaagtgatgttaatgctgctggcctggggatcacacttgagaaccactggtttaaagagcctgagggttgggacagggtgggttgtttgatttgtcaccttggttattcacagtggtatcttttaaggactctttcttggatgacgtctaaacatcctagaggcccagagcagccccccaaacccactggagctcaggtggaagccagcaaaattggcacaggcctgtccaagacacagcggagtagggcaaggtggtcagcactacttacagaattgctgaggtctcttccagagctgtgggtgcttgcaaaatcaagaaaacaaaagcttggatagcaagaggcagcacatttcagaggaacggaccccaagtggagagtcagcagaccccagctgaccaatcccaccactcacattttagtggattagactccaccattaacctttagcataaacttgggtaaaatcattttacttctctggatcccagcgtagccatttgcaaaacgaatgtgttcattcattgagatggatccgttcatttcagtctccctgcctgcaatggtgagctacatctgcatcttcctatttcctttccctgtctttgaaatccagtagagaagcccagaccgcacaatgggaacatcccacctctcagatggcaatgctgcccaagccgctccacccccaggggccttgcttgcatgtgcccgaggccagccctgcagggcagacagtagcacaagagcaccatcttggtcacaaagttgtctaagctcaaagacagccccggaaaaacacctgacacactccacaaataataatcagcagatcttcatgccatcccatgtgacagatggggagcagaggcctagggggctgctggcccctttgctgagagacccctgacaaagttagtccaatgcctctgcaaaatcgcagcagttgcacctcactcttctccctttatcatgttctcggtttgtcctctctgaaggaagggggtgcaggtcacctgtgcttcaggccgagctacagaccatcttctccttgatgcctccccagcccagtctagccttggccttcctggctctccttgcctcaacattgatgcagcagagctctgcatgagaatgacccacgagtgttcctacctctcctcctcccctctgtgagctcatgtaggacatggcccaaaacgcatccaatctctgttcaatgactagtgcaatgcctgacatcagggggctcagctaaacacacgtggggcacacaaatgaacagagagatggaaagagctcagccactgcccggatgttcaaagactcactcgccagactggaactctctgcacagaactccgcttcagcactaacaacaacagcaagagccagtggtcaccgagtgcttgcccaggccggggtctggtctacccacctatcagtagatgcactccgggacacctctaacagcctagaaggcagatactccaataatgacacccagtttctagatgtctgggagcagaacctttctgtcccagaaaggttcaagtcccacaactagtccatggcagagcgggactttgatccaagaagcctggctcacaacatataaacactaccagaagcaaaacgaaccacataagcagaacaggaggcctctgtcttgggggttccctttctactggggatagctgcttttcaggcctgggggcagagaagggtctcactggccccctttccctccaagagctttctaggtataaagggatttagagagggaagcatctctctgatccatcatagacagttccaaagtacaaagctaagaaagcaaaaaaaaaaaaaaacctatgtccaaaatccttcatcctcgccatcacatgattctctccaaagcaaaaatagaggcctcatctctctggacctgatagtgtcaacaagcacagttcaaggttcttgcttattcccatttctgaccctacctatttatccaactttctacacctgaatagtctctttctttttttcagctttctaggctttatgtcaatagcaggaaggcttgaagacagaggggccctggtggcctgctctgactccggcccttggcgggcacgaggtccagtctgagcctgggcccaagccacacaccttccccggcataagatgggcagcgctgggcttccctcccaagtccaggggagtgcagggggagggctgacggagctcatacagttttcctttgtggggtgcagggtcgggggatggtgcggcaaagccctgcccgaggcacacaatcatccagtgagatgacaatgtacaccaaacaggatgcagaggaacgctggcctctcaaagctgaaaagtgtcttgacctgagacaggtctggccaaagccaagaatctaaaaagctaagaggaatcagcacccggtcctatgtcaaagctggccttacctctattttctggaattcgcactccctgccctactccgctggcacgcattcaaggcagccaggtggcaccggcctcaagctgaatgccctgactccggcttccaggtcctcagaccctccctgggtctttcctttctctcaagccatctggagcctacacacaagtcacggggcagaggttctgagagctgaagggagcaagcggcaataaaaacccatacgaccccaactctgcacgccctttctacttcttcaggaagccatttcttgagaagaaacaaacaaaaagcttccctgtggctgcaggagctgctgacccatggggccaaattagcacctgcagagggacaaacagccccagccctagaggagaccacagaaggctgctggatgggcaaagactcagggcacacatagacagagctttgcaggaacgggtgctcggcccacattctggagcgcctgccccaactcccagaagcgttcctagcatgcagaaggcaagtgctttctaagtatctctaccaagtggctccacaacagacagattcttttaatgttccaagtactctccagggaccgtgcttctcttcctactgaagatagtcaacatccaggtttgggggccaaggctgagccctgtgggacaggcccgtgagctcctagcaggcatgaccacctctaatgtatgcagctccctctcctctatttccttttcctgcctctcctgccacctgccaagtgctcctacctcgttcatggccttccactccgtgcagggagggagtgggagtcctctctcctgcacctcctccccaaggcctccagtttgcatcaggggtgctgatcacagccccacctcaccagccttcaccagcaagctttgccctgttacacagctgggcacattcgggggccatgcaggcccttcaaggatttgccagtggagtgggagtgcagtgcccctcactccctcagcatggggggattgatgttgcagccacagacaggggaaaatgaaagacaaatgtcagcttgcactcacccatagctagaggcaaagtcccttcagagcacagaagggttaagcccatggctgccatccaaagagttgagacacattgaggatgcggaggcagctagtctgtcctcaggtgctatccaagcacccttgtggctcctatctcttgtgaatggatgtgtacacaggggcataatataaacaagtcacagggtcaatctgtcattgactgagggttcactgtgaagccatccctcatatactgcacacaccctggctaagcaagatcagtaacctgaggagctgcaatgctgtgtgcaggggaaacccccacaccctacagggtgatgaatttcatatacatggccaactgggaaaggcacagtctcaagatctaggatcccctcccaaccttgctgaccactctctggtgttctcgcctaccctgatcgtgatttgtccagagcacctctggcgaatgcatatgtcgtgcctcatggtcaacaaataaacaagtttcaaagggtcctcatttgtctgaagagcctgaaatgagctgctaggacaattcacgagacagctggagaccttcagagcactcagggccaagggcgcaaaaggtggcccctccattcctctcgtcaccctataggactgggttgctaagggccttttgggtagctgtttggttgcctcccacatctgcctctcactgtccctggtttgcctgcatggcaaagggcctctcacccaaggtgttcagatgtgtgcaccttgtagctctgtgttttgtaatgttagaaattaggttttggccatgcagggtgactcaggcctataatcccaacactctgggaggccaaggttgggggatggcttgagcccaggagtttgagaccagcctgggcaacatagcaagactccagctctacattttttttaactagtcgggcttggtcgtgtgggcctgtagtcccagctactcagaaggctgaggtgggagaattacttgagcccaggaggtcaaagctacagtgagctaagattgtgtcactgcactccagcctgggtgacagagaaagaccctgcctccaaaaacacacaaaaaatgcttgtttggaaatctgaaatagaaaaaaataaataaataaaataaaattttaaataaaataaaattttaaataaaataaaaataagctcaagcatgggaaagcattttgaacatggcaacctgttcctcttacttttaattctgtattatttggacattttttattttatacaatgtgaacacattgcctttttgaaactacatattcaaaaatattatatacacaaatatatgtacagagttatatacatgtttaggttttattcatccattcatttattttattttcctggctttctgtacaattttaaagtactgccctgccttcaagaaaagccagagacaagcaaataaagtttttttgcactgatcgggccaaaataactccagctttagaaattttgattcatttccctatgttctttcaagaagctctctgtggctatctacgatctcattcttcttcattccactccaaaagaatgaagattccaacgtatctcacagataagaacactgctgaatttagattcttgcttttattacatgaccttggacaacatgagtctccatcctgtttcttcctctctttctagatgtagatttcaatatctttattaagtttcaggtcagtcatgtccttgtttctccttccctttgctacaataaaaagtacttttccctgacaagtgtcagaattagaccaccaggtaggcgtcacatctatctcctcctccgagtccctttcagagtgtgtgtgtctcccatacaatgggagtaggatgatctttaggccttgtcctgcgaataggtcacattctctgcattagacagagctggtggccagataggaaacccccgtgagaccatctagacagaaaacgtgcaggcccccgattgctgtttcagccatgctcaagatttacttaaagacaatccaatgaagtgatcagaagatcaggccaaagtcagcggctgaacttgtaaaaatcattcagatcaacgctatttttatagaaactaaaaaaaaaaattaaactcctccaactttctttttttttttttttgagacagtttctctctgtcacccaggctggagtgcagtggcacaatctgcctcccaggttcaagtgattctcctgcctcagcctcccgagagtagctgggattacaggcacccaccaccatgcccatcttatttttgtatttttagtagagacggggtttcgccatgttggtcaggctggtctcgaactcctgacctcaggtgatgcacccaccttggcctcccaaagtgctgggattacaggtgtgagccaccacgcccggccaaactcctccaattttcttgtatctattgatgagttgggctaacacaaagagttgattagagcttgttactttgctcagcctgactgttccatccaacctactgctgtacacaaggtgtcctagctgggccaggggactctctgggggattgcctacagctcccaccagcattacctgtttgccatggcaaactttaagattgtcagcaagtaggatccaaacctaggcctgcacatctagagtggctgacaggagcctcatcactgagtgaagatgggaagctggagaatccaagaataataagaaagagtctggttcattagcccagactcagatggaagaggagaaggagaacggcagctccaggtgcagcacagtggctattatggaaaccggccacactgtgggaagaaagtgccaggtaaacaccctgaagagctctttcactagaggctgggacacaccagggcccggccaacattgctggagggcccctcccacattgctggagggccccctcccacattgtctgagcccctcccacattgctggagggcccctcccacagcaaaccccactcatgcactgggcacagtgctctggtggctctgtgatggctgagagcgtcagcagggaccctcagtctggcaatggagctgccactcaggagatgctgggctgcaaatacccacggacctccagcatggctgacaacagccaggacagcagctcagggcagcagcaaatgaagtgacctgcagggaccacacctgctcactccacagagcccagcctgcagggcccacacctgctcgctctacagagcccagggaaggtggcgtagggggaggggtctcccctgcctcctctgaagagcattcttaggtgaggcagaggcaaagcctctgggagctgctggtaagcgcaggcaagtgcaggctggcaggctaacatggcctgccatcatgggtacccccaggctgcaaggccaaggccgatgctccagtccagggagaaagtacagagtcagtgactcattgagttcactctgcccttcttccctcaggtcagacactcactcttccctacgccccacagatgcaccgcaagagtaagtggaggccaagccagcccgacactcagtcccctccgcttccgacctggtggcctgtgctgcctggttttccacaatggagttccgggtgagatttcctctaaagaaaaattgtgcttcgtggcacatgagtgtttaacaaacacgaacttcacatatagatgcacagaatgttaaagcacaatgggatttaagaggccatctaaccaaagtctcattttaccgatcagaaaactggggcccagagagaaaatgaagcccccagcccctcagccgtcagcatctgagctggcaccagaaccaggactcccgacttcctggagccactgctgtcctccgcccctcgttccccacgcactattcccttcacacactcatttccggaagggtgatgccccagcccctcgggttccagccccatgggctcaatcagcctccctcatttcttccacaaatgcaagcaagccactccctacttccctgccagaataaaatgccaaaaaccagagaactaagccccactccaggcggaagaagtgcagccccagcttactatcagataagtcgtttcctaaaaagaaatgcggctgcagtaaggcaggaaagccgggagccagggaccctgaggccagcccacctggcctcacttttcccaggaccacagtcagatacaacagcagggctgtggcccagccccccaacccttccaactcaggaaatgctgagcccccgtgagtgccagggagtgcccctgccatgcctcctctgaagagcattctggggtgaggcagggacctaggacagacaggcgtgctcagttagctcgagcgggatggaggctccaccggatgggatggccaggctcaggctagggtcgggggtgccaatgatccctcccagccgcctcagaagtggccaccctttggtgttctctgcggagttttggggtatgggtccccaggaactctcaggctgagggctccatgggaggaacaggcaacgtttccactccaacccagggtcctcattctatggaactgggcggggggagggggtgggtgggtaaagcagaagctcatagttgccagccggcccagacccgattcctggcatcaccccacttccaaagagcgtcgggaatggggggacagggatggggacgatgaacccaagagagagaaacactctgtgttcctccctgggcttgcctattcccgacttcgagtaatcatccaaaacaaggaaacctgccaggagatacattaagtctgtaagcgaagaagcctccaggcaaagagctgtcagtcacagggaaaacccaacacaatacatggattctactcctgttccgaggcaggggcggttcccgctcaaccttcccaccgcctcccccgccgcacaaacacagggacacaactgtgaaggcaaaaaaggatttgtttttcaaagtcaccaggaaaatcaacaccaagggaggcagagggagtgtggggccagtggctcctccttggataaaggaagcggggcggggggagggggttcagccctgggcctggacttcattccatgtccatgctccttgctgccaactgcaggtccgttcccaaagagtcacagccactagaatgctccaggccatctggccttcctctccaagacacgcaacatggaacgactccaggattctgtctttacacaccctggcgtcatccctttcttcactgaagagggggtccacacacgaggtcgggggcagctaggaactcatttcaagggtaggattcatacgctgctggtgacctaaagagatgggggccctagctggctcctccaccttcttcagaaagatcatcttacatctccaccagaaggaaggttcacccaccaacacagccaacttctggagagaagccagtggccagaaagcacacagtgagtgccccaagcgtggcatctgaagggctgaaaaagagtcctgtgggtcatgcctctggcttcctgcccagtgcaggcctccaggtatcgcagctaagaggctgccaggtctctgaataacgtctacagtgggaccctaccacggaacaaggcagcctgcccctctgctgaacaaggtttcatttcctcaagcccagtttctccggtgccacacaggagtcttccctttgctggactgcacagccttggccctcacatctgttttcttcctgacacctgcagtcctaaaaggtggacatcctgaaacacacaggcttgtccacttgaaggggttatatagggaagagaatggccaggccccaggaaagtgggaaatgcctgggaatgacaggcgtgccagcttgttttctctcacctcacagctcctcttacacaaaatctctgccatcggccaccatggccgaagcgatgctgagcgctcattctaaatgctggcatcggctcggaggaacgtcatggagagtgggtaagagcaccaggtcatgtgccactgcaggctggtggccccgatgcatccatcccacctgcaccagggcctgctgtgggctctgttccctctttaggggtgagcctggctctacatctcaagcctggatttttcaagcatcctttctgatttgatgctttcgatctcagggtcttcagctaatatttgctctccctgtgagtccacagagaaggtgagggaatagattcgtgtgtattataataacctctgaagttctttttaagcttctctgagaaatacattaccattactatcctggcttcaatttggtatatctataaaatgcattcacctgttacagtttaaggaaagtgcagcatgtgtcacaaatgctttgagggaagggaccacaagggatgctgacagcctccacataaacaggaagcccttccagggatgccacatggagctgtaagagagcaactgggactggccgccacagggtgaatgacaagttagaggagaactgcactttgtatgctggacatggcagctcatgcctataggcaggaggataacttgaggccaggagttcaagaccagcctgggccacatagcgagaccccgtttctataaaaaaaaaaaatttaaatttggccaggcacagtggctcacacctgtaatctcagcactttgggaggccaaggcaggcagatcacctgaggtcaggagttcaagatcagcctggacaacatggtgaaaccctgtctctactaaaaataaaaaaattagccagttgttgtgggacgtgcctgtaatcccagctactcaggaggctgaggcagagaatcacttgaacccaggaggcagaggttgcagtgagccaaaatcgtgccattgcactccagcctggatgacagagactccatctccaaaaaaataaaatgaaataaaaataaaaataaaaattagctaggtgtgatgctatgcacctgcagtccctgtacttgggagactgaggcagaaggatcgcttgagcccaggagttcgaggctgcactgagccatgatagtgccaccgcagtccagcctgggcaaagagaccctgtccaaaaaaaaaaaaaaaaaaaaaaaaaaaaaaaaaaaaaactgcaatgcactttgtagtttccaggactcttccatacactctcatgtctacacaccagctctgtgggggatgcatgatggccatcatttggcaaatgagaaaactgtggttccaagcattgcccttggccaaagccatgcgactagtaaattgtggggcaggaatgaaaactcagttctgagttttagaaagtaactgcttccaaactgcttccccatagcaggctctctcctaccctatgcagcggaaggggctcctatgccatccatctctgggtttctgagaacagaagggaagaagcagcagctcagagacacattcaggagaggggctgcaaatgcggggatcagcccaagaagatggcgctggggccaggatgtccagcagtgcccagccctggtcagagaccactgatccacagtttatgcaatgcactgccctttgcagtggtcctacgccctccaatgcacccccaactcaacccttcaatgaatgcgtccaactcagttttcatctgctccaccctctcaggcacatagcgacttctcttccccatgcacccaaggtgaaggccagtgttcccaggggccttgcctggggagcaggaggtgccaaccaagatatcacacctagagagcaagtcacagagtttttgccacagaccaaaaccacctaactgcagagctggaggacactcacagatcacctatggtgaccccttcaactcgcttaaggaaacaagctcagagatttgaactgactggccaaagtcacaaacagttcagtagcagcgcagaaattagatgccaggactccagaatctgtgttatttttttcttactccatattttatcttctaacgcagaagtctttgtttttgtttcttaacaggtgggtaaactgagccaccgagtgcttcagtgacttgcaggcgctgacacagtaggtggtagaaccaggcgctgggctcacgcctgtacagctcctaaggctacacgtgttctttccaatgcactctttaaatcctagagattacagcaccgcctttatgtcaatccctgctaaccgctggaatcctctaaggaagtgactcctgcccagagaaccagcagttctaaatggacttgctgcaaacactgaaacctaaacaaaagaggtctatttggcactcaaagtaataaacaaaataccaagaccataggagtgttccccaaacttacaaagatggcactcagtttgtataatggcatcaatgcagagaaatccctcctgggcttctcagaagctcttctggaggatagtggattagcagcatgctctagacagtgtctctctcaagtgctgggggaggaagtgaccctcgggcctcaccagtggagaccaagtccctgggaagcccaggccagctggaaaaggcagctgcccagcacagccaggctcaccaggcagatgtgctatgcacacacagacagacgcacaggagggcacacgtacacagctcatcacaccacacactacccacatctgtctacacccacacctcacagactgacccatacacaggcaaacacagacacaaacacacatgtgtgcacagcaggtggtcccttgtgtcccccaactacacataggcatcgacagacacccatatctcgcagatataaccccacgtgcacagaggcataaacacacaaaccacacatgcacctccccttgtcccttattgtcactgcagcctctcctgcctccctctttcagggaagctccagacacctgggctaacccagccctgaaggccctcataaatgccattcccagtgcaatgctttggggctggctccggaggcactgctcctgctgcccctggtcaataacaaagtctggagagaaaagtcaggaccatttatgatgggtcctaatgacaactgctcttggtaatggccagctctgcggtgacctaagtatgagctgattacaggctctggctcccgctctgcacacgcagaacacaggtgtcccgggggcactgaccgcagcagatggccccttccctgacggccaggacagctgtgctgacctcatcagccacctcccgagggctccttcaagtgggtggccctgagcaggcccagacccaacaggcaccaccctgagccctctcatacgggacgcggctccagggctcctctctccctcccaccctcactcagagactccctgtccaaaatgtctcaccactgatgtctgcagttctgccattaggacttcattatttgattaatgaggtctttgtcttcttctcctcctcttcctcgtcttttttttttttttttttttttttttttttttttttttgagatggagtcttgttctgtcacccaggctagaatgcagtggcgcgatctcggctcactgcaagctccacctcccaggttcacacctttctcctgcctcagcctcctgagtagctgggactacaggcgcccgccaccaggccccgctatttttttttgtatttttagtggagacggggtttccccatgttagccaggacggtctcgatctccggacctcatgatctgcccacctcagcctcccaaagtgctgggattacaggcatgagtcaccacgcccggccttttttgaggacttttttaaagatataagacagtcatgttttaaaataagttcccagtgtctctgtgttaccaacaaggccaaatctccattctgtaagaaagcagtcaggttgccgcacaagctggcttttgcctgttttgtcatcatttctagatactcaccaccacaccctgataagctagctaaccacaaagagattcgccactccccagtgcagcgtcgcagctcctggtctgatctccactgggattatcttcctaggcccacctttgctgcctgacaaatgcctaccagctccatggaggacagcacagggtctctcatctctgcagctccccttgaccatttccttggagaccagctcccttctgtatgctcccgtggctcccagctcttctctatcacgggcatctctgcatcccctgacctcctctagatggtaaggcctggtagagcagaaccacttcccaatcacaccccatgaccattttctggacactcaccagcgcggagcccagcacacacaccacgcagtcagccttgactgggtctctgacactaacatgaaattaggttaatccaggtgtttccttcccgaggcaggaaacaccatgaggagcagcacaaaggcactgtgatccagggctggagcacggacagaggcaccttggagaagcctgtgacaaacccaaagcttctgcctcaaacaggccccaggagtggggacagcgaggtaccctagtgtggccaggggcaccccaatacagacaccctcaccctctcctccaaaactcaccagctcctacgtggccagcccgaggctcactgcagggcttcccactcataacgcaacttcaaaagcaacacaccccaggcagaattacaccactaaaaacttccactcctggactcaggtgtgcaggtaagagctatctatagccaacagagttttcaccttccttacccagggcttaactcgggttcagagcacttggagggaggagacagctgcagaattctttgcagcgaagatcccatagcagccctttttggctttgtgtccccacccaaatctctctttgaactgtaatccccaggtgttgagggagagacctggtgggaggtgactggaccatagaggcagtttcccccatgctgttctcacgagagtgagttctcacaagagctgatggttttataaggggatcttcccccttcacttccttcacacactctcacctgccaccatataagatgtgcctgcttccctttatgccatgactgtaagtttcctgagatctccccagccatgtggacctgtgagtcaattaaacctcttttctttataaagtattcagtcttgtgtagtgtctttatagcagtgtgagaacaaactaatacaattatggagacttccctcttcccaggccctgggaagaaatgatatcaacacttctgtctacacagctaaaatctctttggatgttgattctagtcaacagatgtggtacagactaagcagggctcagtagaagcccaacgattgttgaatcatctctgcaagagtgcacgtcttctgcaggtggttagattttcaaaagaaaacacatgcacaaacacacatcatgagcctgtttttaaatgaatgtgtgttaagagtaaagaccctgtaaccagagaggctgggtgccggctggcatttggcactgtgcagacatctcagctcttagtgcctctacatctcagaacaaaggtcgagactccttctagccagccctgcatcctgtgagtggaagcagcggctgcgggttacgtggaggtgagaggctgctctcaagactcaagtcttgcctgtgcacttctcagcaccttccttgcccagggctgacaacaagtacttacctgactgaactccttcccctcacagctatgcactccctgggtgtcatatctgactcaggcccatggccacaaccacatgagggacccctgaaacacatgggccattcattccaactgctgcaccacaagaacaggtacagccttgctgggacctcgtcaccctttgagctgggtacacagacagctgcgaattggaaggagcagctccccctcccatgccttgatgcagcctttgagtccccacgctgtgggccagggctaagcagaacatagaatgcgaagcgagttgttataactgacaaatgacaaaccaacattctcctctgtatttatttaccagcttaggtttcgtcaattgaagaattactacttgttttgagtctttactccctttccctgtcctcatctcctgacaccaggaatgccctcctctactttctccattaatcttcagcctgacagttagatcctcatcttctctaggaaagttccctgaatttctccaggccccaccgaagacccctccctccttcagtcctgagtgctagaactacgcacaaaggcatctgaagttaccaaagagcagagacaaaaaagcatggcaaaggcctgtctcgcccaccagattcttgggggttttgtggggggttttgtttttgtttttgtttctgttttgagacaaggtcttgccctgtctcagacccaggctggagtgcagtggcctgaacacagctcactgcagcctcgacctcgcgggctcagacgcacatcccaccaagtagctgggaccacaatgtgccaccatatctggctactttttttttttttttttagagacagggtctggaactcctgggctcaagcaatcttcctgcctcagcctcccgaagcactgggattacaggcatgagccaccatacttggccaccagattcttaaatgtgtcgagggcaggaacagggtcctccatatggggctgagaccaaaggaaaagtggaaggcgcccagactgtctatgagcctgagaggtgagcacagcgggctggcacagccgccctatggagtaccacaggagggaatgcgctctctaggcaccagctgctctcagggtttaaagtgcttatccaggctcgtttctagctctggtgccaccgacatatagttggggatttccttcagccataagccattccccaaagctgaatgcatccattgcggaagacaccgacgtggaaaattttcaaagagctcacaaagagaagagaacacatctgaggtagtcccaaaaggaaatgtcctttggagaaagctgatggaagggctagagaaaacaagagagagaaaatccccctcgtaatcctgcctgaatgagaaagaacatcatttagggaagctggtttctcgttttctccccactgccaaagtactattttggcatctctttacaactcacagacatcctttcagaatttgtaaatgatgtcccttaattcctgccctacagaaaatacctctgttatgcctccaaatatctgccaagccagtaagcatctattacctgcacatcaatccctaagtgctgtcaaatagcctcagccctcatgcttacagccccccaaacctaacagaccaacaccttttacattcaagactcaaatatgtatatggaagctctgcacatgcaccgagatcccaaccccaaaagcccacacagacacaaatgtcaccttctctcaggagtccccagttcctgctcctgccgctttgaggagttgggatgagaaggacccagcgtgcagcatgagttatgggagctacccacaatcatctttaaactcagccctgcaggaagaaccccaaggctagtgtgatatggaaactccagcatctggagctggctgggactgtaagaacaagcagtttataatccagcagtctccctgaaaaaaccactatcaacaatcactacaggccagtgcagtggctcacgcctggaatctcagcactttgggaggccaaggagggcagatcacgaggtcaggagttcaagaccagcctggccaacatggtgaaaccccatctctactaaaaatacaaaaattagccaggcatggtggtgcgtgcctgtaatcccagctactcaggaggctgaggcaggagaattgcttgaacccaggaggcagaggttgcagtgagccaagatcacgcaactgcattccagtctgcgcaacagagggagactccgtctcaaaaaaaaagaaaaaaaaattagccgagcatggtggtgggcgcctgtaatcccaggtactcgggaggccgaggcagaaaaattccttgaacccagtaggcagaggttgcaatgagctaagatcacaccactgcacaccagcctcagcgacaagagcaagaggctgtctcaaaaaaaaaaaaaaattcactacagtaccttccctggaaagacctggaaggctgtatttcatctcgtccccatcatcaccattcatgtgtccatccaccctctcacttaaatatgcgctgcagcactcacagaactcaacttacctaattcccaaatgggtctctcacagccacccactagcaaagccagagacactgggggagtatctgcagcatttttttttttttgccactgtcattaacactcagcagaatccagaagatgacttcaccccctgccaccatgccctggccccagctcccagatcagtcaatacgtccagccccctgccaatgtggatcaacaaatgtctattttcaaagaaacctaagctggctgcttctggttcactttcctcataactcatcaccaactatttgtgggatgcggagggcaaccatcctgagcctgccccctttgaattaggaagtccccaggtgccagcagtaagaggcactcaaacccagggaggctcacgctacaggggtggctcttgcacacactgactatggggcaagtccctcttcttggtcacccagccagacagactgcagtccaggtcctctgggcacagtgggagtgacagcactagtggcaggccagaccccatacacagcaaagctgtagttcaaatatgtattatatgtgtctggctttcacacggagtttgcaacctgccagttagtagtgtttaccttggtaaaaattcacgggaaatcttagtctgaacaggcccagagtttattttactgccagataaacaactttctttgataaatcatccgtgtgacagtgttcctgaaagactaaacaaagatttcaagcacaatctataggcctttgagaagccttccaaagcgaaggcatgtttaattggctgccctaaggtcggggcagggcaatgatctgacatttctttggccatttgttcttctggaaaaaaaaaaaaaaacagattggggcttccagcacatttctgcaaaactggatgaaacttaccaatatttaaaagctcattcgcattataatgcatagcctattttttggttaaaggaagtgaatatcacaaggcaggtgttggggttggggtaggggaagggaaaagtgccccagagatatcgctggagaaaaatggagaacaaagtgaagtaaaacagcacaaaggggctctgaagtccctcaaacataggccctgctaaattaaaaggagaacgcgttaggtagagtgtttctaaaaaacacacaaatgaaaacttcagtggtcctatcctggaacaccaggcagtcacagctcccgcattcagccctcatcactgtctggaggcttccaggtttacgttgacataaggatgtcatctcactaaaacccagatctcctaacttctagttagggtttggctttccgagggggagttgtttgttattgttattgtgaattacagcaccttgaagctgcataaagcagttctctttgtgggttttgttttgtttttgagacagagtttcgctctatcacccaggctggagtgcagcagcgcaatctcagctcactgcaaccttggcctctaggttcaagtgattctcctgcctcggcctctgaagtagctgggattacaagcgcctgccaccatgcccagctaatttttgtatttttagtagagatggggtttcgccattttggccaggctggtcttgaacttctgacctcaggtgatccacccacctcagcctcccaaagtgctgggattacaggtgtgagtcaccgtgcccagcagcctaaagcttttaaaggtcttccaaatgggttttttaaaagacttcttcagtttaatcctccattaaccagagaattaactagcatattccattcttcttcctaaaaaactttccgcccaacaagctgatttcattagtgctggaattttccttcctaggctaaatttcatcctaaaacatttttttccaataagaagacataataattattacagattgaacagccaccatattccaggaactgtccacacttgattaaatccaattctcccaacacagtcacgtaggaattctcatccatagtttgctgatgaggagccaggctcagggaagttaagagactttctggtggtcgcttagcttatagggtagggatttaatccaagtctgtctcgcccagagcctgtgttctttccattctgctacactgccggctttcccaccaagaagggagccaatgattgctgagctccttccgtgtgctgggcacagacatcagtccatttaaattctacaaaccctaagagtaaaggagcacccgatgccccttcccaggaagctcctcaactaccttcctgcttgatgggtgtgagaggatgggaaggagcaagggtgtgcaatctggcctggatgccagggaagtgctggtgggcagtaacagggatccaggtagagtgctcttgggtcactgaatgcctaactcctttatttttttgtcttatttccttcagtcagtaacgtgagggcacggactggctgatctttgaggtcctatccaactcaacacagctttacaatggcaaagtggtacaggggcttgcttcagtagcacacatggtaaaactggaacaatacagagaagattcacatggccaccatgcaaggataacacgtgagttcgtgaagtgttccgtatttttaaagaataagatacagtcttcagtagcacagctaggcaattatagttaacaataatttattgtatatttcaaattaactagaagactagatttggaacatttccaacacaaagatcagtgtttcaggtggtagatatcccaattacacaatttttttttttgagacagtcttgctctgttgcccaggctggagtacagtggtgtgatcatggctcactatagcctcaaattcctgggttcaagcaatcctcccaccacagcctcccaagtagctgggactacaggtgcatgacaccatgcccagttaatatttaatttttaatggggatggggtttcactatgttgcctggggtcttgaggctggtctcaaactcctgacctcaagcaatcctcctgcctcaccctcccaaagcattgagattacagatgtgagacagcatgcccagccccaattacccagtttgatcattacacattggatgcttttatcaaaatatcaaacataccccataaatatgtgcaactattttgtatccattaaaaaaattttaagtggtacaggtgagcaacgcagcacccaaagaaatgggcagttcacatgagctgtgaacagccccctcatcccactcatcccttttccctctttctctacccacctccagaaaaacctcagaaaataaaggtgaacttgagggcaaatccttctctccactccccttcttatgagagtctatagtcatatccaaagatgaggacatgatgcataacacataagccagatgcaaaaggacaaacactggctcggcctccatctcttcaccgcctacccccccaaccccccacctcccatgcacaagaaggctgctcagaaagagacacaggctctcagctgggactcacacctctagtgcactaagcaatgggccaatctcaggtttttacgcacataaaatatcctaacaattagctccattttgtacagatctgtggatagaatatgtatcttcagcaacaataaaacccagttgttttccacctatcaattccatccccagagtaacaattccttccatgtctaattttactttgactgaatgagattctggatgttggggcttcttttaaacatgtatacatgtatatgctcagtcacccaaaacagggcatgtagttttccttgaacttaatacacaagttgccgacatccaccttgaaaagagccttctcctttataaaaaaaaaaaaaaaaaaaaaaaaaaagaagtccatcatgcctgcaatcccagcattttgggaggccaaggtagggggatcgcttgagcccggggggcggagattgcagtgaactgagatcatgcccctgtgctccagcccaggtagagcgagacttagtctcaaaaaaaaaaaaaaaaaaaaaattccaacatccacgtcccacatcccctgtcattcatacagtcagctgacaaactttcattttatgcctaccatgtataagacactgtgccagggactatttgagtgcaaataggccttactttgttcattccaagacacagattttctgcacatttctgcaagaagtatggtttttttattgttttttgttttgtcagtagtacaaactgaacagtgtgtctcacaattaacaggcatctcccaccaggtaaaacacggcattagatacagagcctgctctcaggcagcctgcaggtgccgcagtgactgtgctagcagccatcttgcttcatctttgggaggaaacccaaggtttagtttggaaaggctgagcctactttctgcaagaactcaaactgcccgtcagagtaaaacactgtcccccaaacagcagcacagccaagacatcctgaaagaagttggaggcagagtgagaacagattagtggaggtacggaggtgcgggaaactgaaaatatttctactaggaaatactccctaatgctaactgtgaaagctgatgttcttttccttcctatttgactaaccttagtgttgcatagtacagcttttctctttatgaggaaatatataaatggaaaaaagaatccttccagaaggcaaggaaagtttctaggggcaaagaaatccttttccatagggagaaaatactgggctgaagaaattgccacctgaactctcaagctcaaaacactgaagaaggtagtacaagtggaagctctgaactctcctagcagaagtgtatcaccatgcaaatttcccccaggaaagcttacgggtgtttacagatactgcagaagaagctagagaaagtggccagaggcaggaattaacctcaccacaattataaataaatcagatcctcatatccctgggataaaccaacccaaagggaagacggctgtgggtactgagctgttaacagcaggatgattagtgtggcggctcgcaaatactatattgggctatttaagaggcgagagtggcaccctgttgtcacagagcaggaaaagcagagagagaacaaaaagcagagccctgcaagctgatggaagccagcaggcaggctggtcgccatgttcgatgcggtgactttgccccatctaagtcttggctcccacatctggtgcttgatccaggctgatcagctgcattcctgagcatcagcacacaagcttttctgctcatgtttttttcctgttggggaaaaaatgtgccctgaactgagcaggtacagtgcagggctggagacatgagtgactaagcagatctgccaaggggttaaagcacactgcatgccgagaaggtcaggggtcagacatgcccagctccacagaggctcccggagaccacagatgcagtggcagggggacgagggtgctgcttacccagggaaatgcaccccttgttcccggagctcacagagagccttccagcaacctgatgtcttcccactggggatgtcagggccacttaatgcaaagtttgatccctggaggagggagtcaagcattctctttcttctctgctgtgtgtcagcttgcattgttcaatttctttgtttcctaactgaatcccatcagtgtggctgactgcctcacttacttgaagtgagctgagctaggaaacacgtttctcgacaaggctgcattctctaaggtgctaagaagggcagagctaagctcagcccctacagagagagagaaaaaaaaatccctatatattgttttatgagaacattacagacaaaaaaacaaaaaggtttctcctgcaaccagctcaaagaagcctgccatacaccatacgcacactaaggaggtcagcgcctccgtggcagagcccagcggctgtgcatcaactcttaagtgaggagggcaggtggcagagtgtaaaaggactccagttgagaaagtcaaattccttctttatcaaataagaggactggataagatgacctctgaggtccaggaggaacccaaaagttctgtgaacccaagaggaaaatattgtcagggctaaaggaacccaatcccaaacagctaatcactcagattccacaaaccgtgactggttatcgacatgagatcctctgtcctcttctgtgtacagaacgctggctgatttggcaggtgcctgctgccgtgggaagaagatgtccatcccagatgagttacctgagtgccctctagacccctgccctacaccttaaggtcaaccttgccagattcaaattctttcccaggcttgcctcttcagcctatgtggcaaagggtctgaatcctccaacttctgtcttttttaaaaaacaatactcatgtattacatttatttagaggaagagttccaccctcaatctgtatctatagaactcagaaagcactaggtatacagggaatcctcactgatgaatttgagttaatgcagaaacagacaagtaactcacactgctgcatcacagagaacacatcaatcttccccatgcatggaaacaggatacgcgctctccagtttagctctggtggccatctacatccagcttccatcttcatccacaattgcaataccctgagaatgaccctgtcgtgaggcatgattccctccgacttgcatgtgtcctcccacatgtgtgcagcttactttgacagggcaggaacaagacccttccgtgtactttaccatgttcgattaatgaaaacatggactgggatgcctccgaatggactcacatcacctatctttacgcttttccagataagaattctgtaagaaatccgatctcagggacacaaggcaggaattatgagaaacacgttgttcagcatcacactgagtcttctgaaagtgtggcttggccggagccacttctctgcatccatgtcagatagaggcgagagagagggagctggccctccaaaggggtgccgtttacatttacttttctcagaggagagactctcagggtgtggtgaattcaggtattctgcaggtcagactataacagaccatccctggaaggccccaaggcccctggcatctcccccacctccccctggcccccaccagctcctccttctcctggagctgcgagtgctggttcagaattctctttcgatggagagtgacttgggaagaagagagaaaaaccaccctgctgtggggatgtccatttttctttgcctcgcggaacctgatgaggacccccactctgaatcccctaagcattgaactctcccctccctgggaaggcacccagagggcagccatttaaatcctggacagagtcatgctgacacctaggggtagatgttaaaaaaaaaaaaaaaaaaaaagagccagtccggaaaaaaccgggcccaaccagacacagtagcaggtggcaacttgtactccctgcagcttctgagaaggagctgctgtccttccctgctcctctcgacctgtccccaaatcagcctccctgcatgcctagagaagatgcccaaaaatctgtccagcgatcccccacaaaggagggcaaagtatggccttcatcaaaactggccggttctggaccctgtctagtctcccatctgcctgagaaaagcagccatttggagaggaatgaggtagagaatatggaaagctgcaacgagatacatcagcagggcctccgtctggcagaggcacagaccaggaggttccaaaccttccagaggcagctagaaacgctttcttaccaaactcgctggcacagagatgttcaatgatggcctcagatttcaactcgttgtcacagggaggacacaccgttgtgcctgggaaaggaagtagggagaaacggaactgtaagttacagagcaggaagggagcagcccctggggaaaagatcggccctgggtccaggctgaaagtggctaaaggtcttctggaacttctgaaggggacctgagaattgaaaacaagaagccttgagcccagggtctacaaccagagcaggcgcaggtttcttgaaacattttggcccagagctgctaaatgtgacacagttatttaagccagcataacctgaggctgggtgggtgcaggtcacatgaatgatgacttgtggggcgctgtgagtgccgggaaaagctggcttacaaacccacagagatctcttcctggtgtttgtttcccatcctctcccttctcctttcaataccatcctccgattcctgcccccttcccatttccacactcccagctagcctgctgatccctctgaccaggtctccaggagccaagagagaaagaaactcagccagactcacaaactccagctctcggcccctgaacacctcctctccaaaagggccaccgcagcaggaggccagggcaggcgggcggggtggggcactaacaggcgctgccaaatgggaggacagggctggataggaaggggtccttcagaggctctttcctgggcaactgtgaagtgctttgaagaggaggtttgtgggggcagacgtgcataacgttggaaggcagctccactgcctgggaggagatgtctgaggccagggcagaagcctcctccaagccaatatactgctgaagtcagaaaatccagtggaggtaaaggactccagcttcccaggacagagggagagcaggacggcgctttcctccaagagctgaagtggcttatcatcattgtcatcaccttcacctatcaagcagcctggagcttatcgactgtctaggaaaacatcacgagcacattctaggggcaccccacccccgggcacagcacaggaggccaagccaggctggagctgaagagcacaggaaagtcaccgctgaccctgcactcggggagtgcaggtggggcttggtgtgcttggagcccactgctcttcatcctcctccaccatggcttccgtggcagcatctccctccccatcagccccccttatggctcagacattgaaataggcaaaggctccctaagtggaagagaagaggggacctgcagagcacccccagatcaaggctgccctcaggacacaagtggcccatagaccactccctacttccaaacagggtccctgcagggcccagcagagaccccatccttagtttttattgacacattcctctcccacctttactctgcacccaggagcaaacaccttccagattctcagtgcagttaagaaccacgctcccagcagacgatggcatgactgtccttagcccagatgctggaaatttgctttgcacccagaacttgagactgggttctagaggtggtaattctcacaaaggagacaacttaccacaaattttgcattatggtttttgcttccacatggggaaaaggaagtgtgacaatatggaaaggaccaggttacttgcacaaggagagtgaactgtgcttttgggttttccttgtttaggttattttgaaaaaggaaaagtgggagttacacaaacacacatagcaacgttctgtgaatacaatcttgaccaaatagtgaagtcagggtgatccaaacataaagggcacatctctgcccgctccacacactcactgcatctcctctggacacttgaagttcgcctgaaccaatcggccaaggagggctctgcacttctcagggacattttcctcagtcccgtcaattacatttggacttcagtgcctctcagaatggcaggagctcgttggggtgggctctgtgtgtttttaccacggctttcccctatctcagcttttctaacggctgactctggagcagcctgatccagagagagaaagagaaatgtgtgatgcggtattaacctgcgcctcattggtgcgtcttggggctctacaggctgcctctgcaggagaaatccacccagtcatccttctgagaggtggaactaaatcgctgttttcagttgtatttaaaataatgtttaaagcaaatgaacaaaaaaagcaaaggttttgtgtttattaatatttaagggtgtgtggaggagacagcccaacagctgaatcaggattaagtgatttttgtgatacatcaatccacacacacacaagtgctttctcagtctctctctctttcttctctctttccctttctcacacacaacccccacaatcttccctggccagttcctggggggaccaaaagggagccctaaggaaggctttctggggaacagagggctctgtggcctctgccacactgactaaatgcacaacatgcccaagcaacaacaaaatcaaacccaatgtgctggctcatacaacttcacccagtaaaaccaggcagagagggaaacaacaatgcatcagcctgggagttcacagttctaatggaagtgccaaattcaaaaatgacttccctagaaaaagagcaattgcctcttccctaacaggagcttctatggcttgggtatcagcctttgcaggggaaaaatgtcaagtcatttctcattatcaggtttctccttaataacacatgaccacagacagctggccaataatccaaaactgaatttgcccaagtgtgtgaacagaaaccagtatgcaaagatatgacactgctttgaaaatgcattttaattttaaagaataaaagcataaagaataaacgaataaaagagtagtgcatgcatacttattctcattggaaagtgccagttacgaccccacagccacaagccataaggttatgaggatcagtagtctggtttgtcttgacctgccctctacacacctacacacacacacacacacacacacacgccccaccctcccctccacagggacctcgcaggaaatcacgtggggctcccttacaccagggattgcagtcctggggagggtggtgtgccatctcagggcagagccccccaccaaaaccactgaggggaaaaccagtcccaagccccactcccgaccggccctctccccacttttctctttgctcctcaaagacctgtcttgggagggtgactacctgagcgctgctgggaggagtggaggtgagtgaggacggttccaagccaggctgagaagggcgccgaccagtggaactgcagccaaggggcaaaaggtgtccggaagacagcgattatggggtttccccatcccatcacagccttttgggggctggggtgagggattctttcctctcttcttcaggcaacccgtccaatccccccatgttccctgtggactgcagcaccttttccgcagccgagccccctaaggtgtccactcatgtctgcagacggtcccagaaagagaccatcggaagccattgggaatggactccaggtcagggctgggcacagcctcacagggcagggctgggctaatccccgctggctgaggaaggggagaaggaaattcccgcaggctgcaggggatgggtgcaagccaacagaacacaaggcgctttgtttgctccaggtaactgctcagttctcgctcacaaagtgcagatgcatccgctaccctcactccactcccaacaccagagttgactctgagagcagcggtgcccagacctggccactgcgggcaatcagtgccgttcccatccagccatccaacgacagtcactgtggacccatctccaccctccctagaataagcaaaagcatctaaaatttggggtatccctttcccccacctgcccaaatcctcactctgaggagccaggtgactgcactcccctcttttagcatcaataacagaggttaaagacactttaaggtgagctaagtgtaggcagtctttctcccccaccctaaaggccctcctcaaaaagccctcaggaagcctgcgtctgtgctaagcgcagctggggtacagctccccaatccctgaccctctccacacctcagagcctaaacttcgcttctaaagaattctgggttgaatttacttctatagaagtcaggtctgtgatgtgtatattttatctttatatctatttcattttatttgacttcccaggatttttttttcttccccctcaagaattgctctttaaacataagggggttttgagaggaacctcgggccggtccctcaggctgttaggaaagtctgcattttgcagagctgctctccccgggaggagatgaacaatgagctaattacatttttatctttctaatgagctgaggatttgtgtaaatgagaaaagcagggggtacgctagagggagggagaaaagactttccacccccagccctccgagggcagagctggtacctggaaggggtggagaaacagaagtccccacggttcctaaactttctcagccagttttgcagcaatcccaaggctacttgactgaatgaccagtgaaggaaagggcttggttttattttttaaatctttgtcgaacctatgaaaataaacaaaagctgctccaagcattctctcggcctttctgaactttctacgctttgggtttttgttttttcctcccgtctcagaggttaaaaacttcgatagggactcggagtcctcctagaggagagggaagctcccctgttatttaaagcgcaaggctttgtttcaggtatgggaaaggcgaagttggatcccaggaagagcggctccggggaccacagcgagtccctgcgaggccaaggcgcagagctgccgctcccgggccagccccgccgtgcacctgggtcgcgaggggcgctgagcgatacctgggacagaccagacgcgcttaggaatcacgtgcacagcatgcgagcaacctcgggccctcagtccccagcaccgggacccagcggcgggcgggcgtagggtggcgcgggttctcctgcagctccggccgggggatggagggggcggctcgcgcacgtgggaggaggcagccttaccttggggcttggaggcttcggtggcattgggcggcgtcatggcgatgcagacgtccccctcggggaacttgtcacacttaagcatctcgggccagtagaagccgaagaactgcatgaccggctcgcacgagtcgcgcacggcctcgcagagccagcgacacgggtagatgggccggtccaggcagacgggcgcgaagagcgagcagaggaagacctgggtgccggcgtggcagttcttgttgagcaggggcacccagctgctggcctgctgcttcacctccgccatggtctcgtgctccagcaggttgggcagcaccatcttcttgtagcccacgttgtggcacagccgcaggtccgcggggatgtccacgcactgaggtggcttggtgtagaagcgcccgctctggtacgggccgatgtccgactggaagctcacgtagtcgtactcgctggccgagcccacggccagaagcgccgcgcccagcgccagcagcacgcccagggctgccccgcggcggcccccctcgctgcgcccgatgcccatgccggctctgcgccctgttctccgcgacgtcggggctgcctccgccgcctccccgcgcgcgtcctgccgcaaacttccagggacctccggggacaaaaggcgcagtccccagcgttgcccggctccgcggccgcaagctgctgcccggtccccccggccagtggcggccctcggcctgcggtcggaggcggcgcgggcggggaggcggcgctgcgggctgggtgcgccccggctcccggaggtgcggcgagcaggaaggcgcggggcggcgggcgcgcggcactgactccggaggctgcagggctggagtgcgcggggctcctacggccgagccctcggagccgccccgcgcagccaatcagctcccggcggggcgagccgcactcgttaccacgtccgtcaccggcgcgggagccaatcgcctccctcgcgagcgggttcggtttactagaaccagacgcggctcaacaccccttaaaaaacaaaaccaaaaatacataaataaaagggggaggaggaaagagacaaggggagaaaaagaaggggaatggatcacggcgtggggtggagagagaccagggcggacgctgtaattaactcgcattggcttgcagagaagcggggagcctggatcatacttgcaaacccatgaaattatgaagactttttttttttgagacagtttcgctcttgttgcctaagctggagtgcaatggcgctatctccgctgactgcaacctccgcctcccgggttcaagcgattctcctgcctcagcctcccgagtagctgggattacagccgcgtgccaccatgcccccgctaattttttgtatttttagtagagacggggtttcaccatgttagccaggctggtctcgaactcctgacctcaggtgatgctcctgccttggcctcccaaactttttttttctttttctttacactgcttcctaatttcaaccaacagccctttagactagcggctcctctcctcggttctctagctgcggtgcagacaggtggtttcccaactaacaggggttcaggaaggctgaagcgagggaggtctgcttgtaaatacccagtgggcctggctgggctccctggaaggcgaggcgaaggcgcagttggagctgtttgctgtgagcagcacctctccaggtggggccgcccatggtggccctcaacactggggcagtgggtggactttgcccggtgtggcggcaggaagagctgctagcaacggtattagctctgggaggacacttttttaaatatataatatatatttaaatagaaaaaccctactcaagtcctagcccgggcgacagcacatctgtgtgtttgtggtgtggaaagccaaaacattaaaaacacatgtgcacttatcagcgtggctggtgtaaataccaagtccatcactcaggcacacatgctaaggttagacccagtccaggaacttcaagttaaaatcaagggtccccactagggcagacgccaagaggacggtatcagcacaacagctcggcccccaggaacagaagtctctctgccaccttctacctcgaattcctgagaattcttcgtaggtttcaaacattcccctgagagggagggttaagctctggagagctgggagtgagacccggactatcccgggacagaagaccacagcaaatagttcatgaagttcctggagtctccatatcttctgtccctaagtgcgggtggagagaggctgatatattcatagcccagtctgagcgcacaccccatgtggcaaaggggtcacagatcttagcgctccacagagacactatagggcgcgctgccttgcccgccagcttgtttgtaaagctctagggagcttgctttggactctgcaaacctaatttcttgatggacagattccaagtgaaatgactagagtttgtgaagaagcagggctgttttcttaaagcattcgtgcccgtacagacacggtgattccacggtgcacacaggaggcttctgcagatggatgacttctctgtcatttcgtggccaatggaagatgccttgacactcaaaaggtgacatggaggctggaaggaaaacacagagaagagagagcaagatcgggatggccaagggttaatcccaagacaattggtgaggccggcctgtggagctgaggaagacattcctcacagagaataagaccgcaggagacccggcaactgtgtctcaattcaaggggcatttagagaaaaatgctgtttggtagggggtctttttgtctcctagggccaggccctccacctcaagccaaatgcgtctgtttgctcactgcaaagatggatgtttgcagataacatcctctcacctctgaacccaggcttagctgaccgctcactcacgttttcagttttcccgaatggcaggaggacttgtgtctgtccacggttaaatgctggaaattcgtccaggtgactgccctggaagtcccaagtcaggagtaaatctcacaaatccattcaggggaagacctcgcctatgtctggtcactccgagtagactttgatcacctccagtcaccacctcccccactcacccctagtggtcctactgctttactgacccctgctgggaacacagttgtctctccgtggaacagggagtgatgggagaagaccccaaatcctaaatccagtgcactcctgactcctcccagacccagctggaaaggaaggaccctaagacctcagtcccaccgagagactttaatccattcctgggatgtgggagagggaccacccgccccccgtcctctcgggaaattcacatgctgcataacagcaccaggcagaacagcctgaagactttgtattgcagaggtacatacagtacttttgtccttttacttattgtcaactctttgcacttcaaaatccagtcccccttttcctaatggcaagtgtgtgtgtgtttgtgtgtgcacgcactcctgtgtgtacagcagaaggttctagaacaaaggccctttaaacatgcaactgacatgacagagctcccagatatgagggttcctgagtatgagaactgtgggccaggagacatatcctccctcctttttgaatggcttaaataaacagaggcaaaatgcagctttaacttatgtttctcatttcccagaagttctgcttttcccacactgctagatgcccatgcatgaagcctgaaagttcgtcctctgttgcttcaaaacaccagcttcaggaggcattctcagttcttcagcctccacagagggtcacagagggcccccccaggtgcctcccaggtggcctcttcccacacgcagagctttttcctggcttctcctggaaaaactgggaggggagccttcccagccacagctcccattgtgttccactatcatatcatcagtgatgtctgccatcctctccaaagatacattcagctcgctctccctcagccagcagcactagggagggagctcccgcctgaagctgggtatctgtgggtcaggggcaatgccaaggaaagcatgctggcccacagtcagtggacacaggctacagcctcagctctgctcctaactggctgggcgactcatgggaatcgcacttcctctctctggtcttagtgttctcatctgtgaaacagagctattaatgcctgcccggctgccctgctagctcagaagtgtgaattctcagcatgtagggtcactcgaggcacatccttagacttccaggcaagtctgaaggggccaaagtggtattcgttgtcagatgccttgaaacctggtcatgctcttacttggacaagcttcttctgcattctgcctctgtagatgtgtaatcctgatcctttctaactctttaaagaactggcctgacctgctaactgaagtctgggaatgtctgggaagcatcttaaaaatttggagttgaaggcaaattccagccccatctcttcatctcttcttagagtaagcacccctacctcttcatcttttttttttttttttttttgatacagagtctcactctgttccccaggctggagcgcagtggcaggaccttggctcactgcagccttgacctcctgggctcaggcaatcctgccacctcagcctcccaagtagctgggactccagatgcaggccaccacacctagcttttttttttttttttttttttttttttttttgagcaatgggattttgctatgttatccaggctggttttgaactcctagccccaagcaatcctcctgtctcagcctcccagagtgttgggattacaggggtgagccaccgcacccagtcctctgcaccattcttgacagaagctaacggagcatcccttttatttgtttgggatatagtcaccaagttcagacaatccactagaatgttcttccttccttgaagggaaactctgctccctgtaatttcttactaggccatcctaggatcagttcctatcgtaagcagccaggaagacaccctcagcggagccccaaactgggaggccaaggtcaccgtccccgcccctccactcagacagtcacacctgcccactctccaggcgaggttctgtcaaactgggcttgacaatttttgttcatttattactacattaattaatttataatttatattataaatatattcatgcctataaatataatttttatataaataaatgaagacttgtataccacctcttagaaagaagagaactaaaaataaaaggcatattttaagatgactttttaaatagaaataaaaatatcaaatggactatttctctgattaaaattctcacacactctttgtccacaggaaaaagcccaacctccaggatagtatcaagactcagccctgacccccatgacctctccagcttcacctccccagcaccccccaccagcctagtttccagtctccagaagtacttgcactttcccacccaatggcttctcgcttgcctctcatcctgggctcatgctgtgtgcacatgctgttttctctatctgtaatgcctttcactacttttgtacaaactactactcatagggtttccagatttacaaataaaaatacaggacacccatggccaggcacagtggctcatacctgtaatcccagcacttagggaaagtaaggcaggaggattgcttgaggccaggagtttgagaccagcccgggcaacatagcaagaccctgtttctacacataataataatttttaagaattatctgattaggcacaattttaagaattttaagaattagctgattaagaattagctacaggcacagtggtacgtgccggtagtcccagctacttaggaggctgaggcaggaggatcgcttgagcccaggagttggaggctgcagtgagctatgatcataccactgcactccagcttgggtgacagaatggcaccctgtctttaaaaataaaaattaaatttaaatattaaaaaatagaacatccagtaaaatttgaattccagatcaacaagaaaaaacttattaagtgtgtctcaaatattacctgagacatacatatactataaattattcattgttgaactgaaattcagtttactgggcatcatatattttatctggcaaatccacccacttatcctaacaatgttgtctcctccaggaagccaggcctgacctcctccatccctagtcagattcacccactctgtgcctgcagacactccgtgtacatttataactggtcccttccatgtacatcgtacagtgcagtgagctcttagaggccaggaccttgtcttattttgtcttacccattccacatctccagcatctagtacaatgccatgcatatactgagtgctcaataattacgcccaccccaacaaacaaataaaggggagacagacatgtgaaatacccaggttcttaggggtgctacccttgcacattgattttgtgcgatgttttctgagaacaaaggtaatacgccagcatgaatagctcccatcgttctctttgtctttgaaaaaggaaaatcttttctagatctgaatcctaagggaactgatcatcagtgccttatacaaggacagcaaacatagtgtgggacttctttattggatctcttcccatcccagagctgaccctgtggacagatgccacatccgattcactcctctctccccagggcttgcaccgagcaggtggctccatggagggtgggttggtcaatgcagtggcccattcccacaaatcctcacacaatgctgtataaaaacaggagctggcatctgggaggctagagtttctgggagccttgtatgccaagtgggggtggggactggggagcaagagaaggtagaagggggctccacagtgtgacacctggagtcggatcctggcgacggggctcaaggcttggctgggacatcacagagcaccagacacaggtctttaggaagcccctgcccctctgggaatcccaggcaagtgaaagtgaagtggcacatgcttcagtgacctgaagcccataaatctgccgggatggctgcggggagggcagcggcccagcgccgggacacattccccgaggagccatgtgcttatttacctaacccttcaaggcagtggagccagacggtgcatagccttcattgggggattgagcctggagcaagccggatataaatgaggtgctagcgagaggaacgggggagtgcccatcatcacactcctgcctggcaggaaagccttccctgctcccaagaactggtaacctcagctggggaagcctcgcctccaagtctccatccaggcaagcctcctccccacagtctctctcagcctgaataacacatctgccatctgccatttaaggggcattactcacctgggcgaaggcagaatcccctgtcgcataggaagatgccttgctgcagtcttttccgatttgctctctgcatgcattatggcatttgggcctcaccaaaagcttctgagctggctgagaagttcattactttcatttgacagaagaagatacagaagctcagggtagtgggaccctgactagcagtccagccaccaaagcactgtggtggaggccagtcgcaggtcaggaagcacagatctttggactccaaatcctgctggctttgcagtagacctggctttgctgaaggccagtccctggggagagaaacctggagagcccttgcagccagcaacatctgattgtccattcatttaccaggctctcttcctggacctccaccagagactgtacaaggtgcacaaaaacgtgagccacgcatgtcagacccgtgaccgctacaagaagatggcctgagacgtggcccaggaattgaagaaagacactttcagttttcagagagagagagatccttttctatgagaaaatgtcccaggaaggctggatggccactgagcccactgagagagcgctgcaggtgctccagaaagaaaatggccacaacaggcagaagctggctgactccaaggccgtttcaggctttcctgagtggcactttggcccctagggctccacccacagcccacaggggcctggaagtgccagggggactgtgagccttcagggctcccaggagggaggcgggtcacaatgccagggtttgggtccagagcacctgccagtttgattctgttttcccataaccaagtcctgaatgcccagagactcggcacaacgtcagccggtgctcctccctttaaagcacttttgatggatcccctgttagtttagctactgttcattagttcctgctgaaattgctgtcattgatgtttgatagatagcattaggactgtaaggtactattttccaaataaagattgtttaatataaaatatatatgtattttatattatatatattttataacataatatatatgtgtatatagaaagcccaatatggcatggcaccaaccaatcagattgcatgcagacaaaaaaaacctcctttgcagcctgacaggtgcatgccagtggggtcccagtgtgggggaattcatagcctccagcctctgtgcagagctcacgctgcccccacaagctgggccgtcttcccagcacacatctcaggtttggctaatgggcttcatctgcctggtctctccccagtctccctgtacatcatggctgtcagagcaccactcttcttgttttgcatgtttgcatgtccggagttctagaagcttcttgaagacagaatctgtatcttttttgtatttgtatctctagtgcctgccacatggtaggtgtgcagtagtcatgtgattgctgagcaaatcaccgtctcaagactcatctttttcatttgattgtctcaatactctgtacttagggcacctgaggaaccactctgtgacttgtctcctcttctgaaaagtaggggttctgccaggcgcagtggctcacacctgtaatcccagcactttgggaggctgaggcaggtggatcacccaaggtcaggagttcaagaccagcctgggcaacatggcaaaaccccgtctctactaaaaatacaaaaattatccaggtgtggtggcaggtgcctgtaattccggctactcgggaggctgaggcaggagaatcacttgaacctgggagacagaggttgcaatgagccgagatcgcaccactgcactccagcctgggcaacagagcaagactccttctaaaacaaaaattaaataaataaaaataaatggaaaaagtgggggttcataggacccttccagtaggaggctaaacagagggatgcagagcaatgtgggtgcatggatgagacaaactggggcctcctggagaaagggtgtcctgcaacctaggaactggaacaggaggaaggtgtcaaacttcccggtatgtggaagagttgctcaagatgggtttcctcagtcttaaataggcattggattcacctaggaatcttgttaaaatgcaaattatgattgagtaggtccgaggggggctactaaaaattagaacctccatgacagatgattctaatttttactgtctcctacaactttgctcctccaagtgtggtccgcagaccagcagcaccagcatcttctgggaacttgttagaaatgcaaatctcaagccagctctggccagtgagaaggaggtagaagttggtaagtgtggcaccctggagcacatcataagaaagatagccttagagattttgcctcttccctctgcttcccacctggaatttagctgtgatgcctgaggtacagcagctctctggcaaccatgaggatgaatgccagcagaccagtatggtggagcagaaggaaagaacctgggtctcaaggagtccctgcaccagccctgcactgcccacctggggattctcactggggagacctataatctgtctccctcacttgcttaaatccaaagtcattttgattttctctttcatgcagctaaaaccaaacctcactggcacaggtatgtaattctcacaataggcaggaagctcaaagactgcaggttctaatttttactgtctcctaagactttgctactcaaaatgtggtccccagaccagcagcatcagcatcttctaggaccttaacagaaatgcagacactcagcccacccgccgcccaccccaggcataacaattagtgtttgcattttaacaagactcctaggtgaatccgatgcctgtttaagactgagaaaccccatcttcagaaactcctccatgaacctggaagtttgcacatcttcctcctgttccgattcctatggctgtggagcacccttttttctgttgtccctatttgtgttctgtctcacccatgaacctgcatcgctctgtagccctctgtttagcctcccactggaagggtcctatgagcccccacttttcagaagaggagaccaagtcacaaagaggttcctcagatgccccaaggacagagcattgagacaatcaaatgaaataaagttctcaggcagaaagagtggacaaagcaactctcttaaggacacaggcgccaggagggtgggggcaggtcacaaagtaaaagtgcaggcagtgaggaaacgctgcctcttggcccctcagaggctgacggcagcagcagaacagactttgctttcttccccacacgtggtggcaccagcagctgtgtatctggaggcttctgtaatcttccagcagtttcccattcaatcatatttaatatctgtccctataaaaaca

SEQ ID NO: 206 - DNA, 181034 bp, Homo sapiens
accttgggatgtatacaaaatatgtgtgtagaaaatgttgacaaaaatggaatcatgttctgtaatttatgctttttttcattaagcagccttatatttcagtacacacagatccataccattctttctgctggttgtatggtattgcacaatatgggtataccataatttatttaatcattttcctacagatagacatttatattgtttccaatttttcataatttcaagaaatattcatttatgtaccaatactacctctagctttatttttaattttctcatccttcattcctctttattgcaatttcctaatctattttatcatattttatgtatttttaagccatttccaattcttttttttttttttttttttttttgagatggagtctcactctgttgcccaggctggactgcagtggcgcgatcttggctcactgcacgctctgcctctggggttcacgccattctcctgcctcagtctcccaagtagctgggactacaggcgcccgccacgacgcccggctaatttttttgtatttttagtagagacggggtttcaccgtgttagccaggatggtctcgatttcctgacctcgtgatcggcccatctcagcctcccaaagtggtgggattacaagtgtgagccaccgcgcccagcctttttttttctttctgaggcagagtcttgctctgtggcaaagctgaagtgcagtggcgcgatcttggctcagtgcaacctctgcctccagggttcaagcaattctcctgcctcagcttcccaagtaggtgggattacaggcgcctgccaccacgcccagctttttttttttttttttttttttaagtagagacagggtttcaccatgttggccaggctggtttcgagcccctgacctcaagtgattcgccagcctcggcctcccaaaatgctaggatcataggcgtgagccaccgtgcccggccgccatttccagttctttttggaagctgtcaggtagtaaaaaacgtttttgttttttatattaagacaatttatatcatttcagtacaagtctgaagccaaccttgatttttttgaagggatatacactaaattatagaaaattattttaatatcaagaacaaatggctaaggggacaggatttactgcatgagttttagcactgagtttttctgagtcatctaggggaagggagatgggtaaaattgtaacaaatggcaaaatacacacacaaaaggttttcttaaataacaatagcactgaaaaagaggtagtccggaagccccagtcattgccttatgtctctttaaatcattcttcaagtggagatttatttcgacatttcatatgtgacacatatcattaaagcttagcaatacttgtattatttctgtcataggccctacttaaaaaaaaaaaaaaaaaaagagtggctgagtttagctttatctgttttggttctagttcagcattccatcatacctgcagaaagcaagcctggctgccagaatcagtctgggctccatcgccacctttgtggcatttacctgaacttcaggtaaaagaaatctcaaagacctagctctctccaacttattttggggatggaaaatgacacctgagtcaacaaaaacaactttcttttcttaaggaaaccaccatccattagttttctttttccttgatcctattaagtgatttttttgtatatgagaatagcaataactattttggtttgttcatgcgtttttcacacaggcagctaagtattttataactatcttcaggtgactgactaggtcactgtttcactagtcaagaaagtgatgcttaagaccatctactgtcatattaacaaaaaaaggtcaataaaatagttgattaggtttcttttgtgacattctgatacaaaaatatatgtgacaaaaatgtttccttatttagaaatatcatgaaaactcatacttactttccagaaatgttttgtaataacgtacaatgttgggatgataaagctataagaaaataaataacaaacatgtattgcactgcttcaaaatacaagttttttcactgactacttagttggacttcatatttgaaaactacaaagaaattatatttatttacaaaactaagcatttcaagatatcatcgaactgagattgttgtgatttttaaaaacttgttgcttataaactgatctgaaaatagcaatcctctatagctttattaaataaaattaaaaacgttctatcacctaactttactatcgaacttaaccaagagaactatagaggtagaaggaaccttaagaattcctttagcacaccttgtcacaacccgacacacagactgtataaaggagaaaagtgaaatgcggtaacttctgttgactacaaatattcattgttctttacctctctctaccatctaaatatttatggaaagtttgtgcctatttacactatttctgtctttctatgctctccaaaatgattagtagaaaataacataatctaagagtcgactcagtttaagtcataataacagttgacaaggacttcctacttaaccaagctttagtcaggctcctctgagtcctcttcgtgactaggcctcatccttggtctgtcagttttagcaacttatatcctgctaagtcagtttatggaaaaatttcccacccttgacatccaattaagtttctcatccactcacccttgatatctaaccaagttcctcttagtaaacttccatccactgaccctccctcaccctgaccattggctctgagtccccagctgtccagtcctcgaattcagagttgggttcaatctctctcctctattacaatagtttgacttctattgcaatagtattgaataaagtcttcctcaccgtttttaaaaaatggtgcaatttctctttgatataagttaagaatgttagtggaatttctaattttttaattaaaaaagatcattttctagaagaatgctaataattttgtagtttttgcttataatttgagtttctagataaaatttgtcttagaacagtcaccatcacatcaacaaatggcttgcttgcatctctttttggtctttctgcacgtctttttgaagggagattgctagctgtccaccaaaaacctgctgtcccattgcaatacagttgaagctggacatggcttcccagttagagaagatttctcagcctcccttgaagctgggggtgaggctaccactcagttctgacctgtggaatatgagaggaagcatgtgtgcttcctgtgtgaactctaaaccttgggaatagccctccatgatcctcctcatctcaccttggatgtgagcatggctatggcagtttcaaccacacagatgaagacagtgcactagaaggtaacagcacaagaagagagaaaaaagcctgcatccccaaatgatcgcatggagcagagaacaccttcaacctggtttactcactttgggattgttccgtgaaagagaaataacccactgtactgtgagtcctctttctaagcacctgcatttgggatcctctttgttaatgcaggttaatcttaatgtactctccattctagccccatttgttttgcttctgcctgccactacctcctcctttaaggactcaatgttatcatcctttccatcagtttgatcctctagtgagagggcaattttgagttacctcaaagcccaagcatatgcttcctatctgaccctagtttgacagtttcttttcttaggaaatgtgctaaaacaaataatctactgcatcaactagcaagtggccagcagatcgtaagcaatatgtgaccaggtaaccaaccagaaccatattctggacctggctcacccacaaggactaaaaccaaatttgggtccagatgaaaacactggactggcttaggtcaaaagccctgttctagccttgtgctacaatgaaagagcacactgtggaaggctagatgaccatacaaacacatgaacaaactacacatgaacaaactttttaaagtctagtctattagtatataaaatcaactataaaataaacaattaatgataatatttactataatgtacacactggagtagaactatcgatttttatgaacaaaggtctccttgtttatggaatttgttacatcccaacacagatgctatgcaaatgtgaccagtggaggacaaaagcagcaaagctgatagtgcaccacaggaattataaatgaacagtattcgtgatgaatgtgcaaataaggaaggctgaaaaagaaaccaatgtgttcttggatcacacaaagaaattccatttctctttgaaatgtttattcttcctcctcaaacaaactttcataatgagagttaattgagctgttacattatatcagagtattctgctcatgccaatacataataacccaacttgaaaatctacattttagatctaataaagtcatatttgaggaatgttaacagcttggttccatttggcaaaagtcaagaaactcttagtcatatttctatgtatgtaactaagtaaccaaatatcctaaaatataaggagaaaagaatagatatgctcacaatgaaaagaaaaggatttctcatatatgatgcattctgtactgtaaatccgattgttttgcatccatgaccctgatataaactccagacagtgttttatgcttcaatgtcaagccttaggaaaaaagctggcaaaaatatcactgcttcagtgtcaattatttcacatggaactagttcataagcagcatggacaagagcaccacaactctactttcttgcaatgacatgtatttaagaaaaacatcttcagaaacaaggaaaacatttacctgctctttaattattgttaattcagaaacaatattccttacgctgctgtctcgatctttcttatcctttccaaatgctgggttatgtaaattgacctctttcattgctaaaagattttgaccactatgctttctaacctaaaataaagaaaaacacaacaacaacaaaaggaacagggtaaagaaggagaagagagaaagaggaagaaagagatagactaacaaagtcacatgagtaactaagtcatataaataagtcacagagcatttaaagttccagctgtatttacattaagctcagctcaaaacatcaaaacactggtatcccctgggtcagtctgcaatacttagtagcattttttaatttagagattgcatcatgcattgggagaaactattttgaatacctttgtgagagattaataatgccttttgtcttaaaaagtcagtggccaatttctagagcttacagctaaaacaatattagtgtggctatctctgttggacaaaaacaatcattctaattttcatatctgtttgctatttttcaatgacaagagttctaattcaattgaatatcggtgtgcaagtgtgacatccggtttggttgggagtatcagaaatgttccccaaggggaaagtcaccttgtaaacacagccaaaagctccacttccaagatgatccaaaattgcatagttgcctatatatttcaaaggagctttgttctgattaatgctttcaatattttcagcaatttgcttcagttcatcctcctaatcaaaatataaaaaggaaatgggtttctgtgataaattacatcctgactacatagcagcctgccaaaatattgaaaactcaggacttaccactaataaattcagcttggataccaattcttcataagcactgatatcacgtacataatgccctatgtcaatgaagatctcaaacaagtctgtggggaaaagtctacagagaatattacacacacttaaagtagaacttggacacagttgatcattacttcccttttttatttttttgagacagagtctcactgtgtcacccaggctggagtgcagtggcacgatctcagctcactgcaagctctgcctcccacgttcacgccattctcctgcctcagcctcccaagtagctgggactacaggtgcctgccaccatgcccggctaattttttgtatttttagtagagacggggtttcaccatgttagccaggatggtctcgatctcctgacctcgtgatccgcccgtcttggcctcccaaagtgctgggattacaggtgtgagccaccgcacccggcccattacttcccttttgaatgcagctcactcactgattaattacatgaaacaaatttaacttcttttggttatcaacaaagttggggaaataatattccccaacttatctcgaaaaaatacactatttacagtttttgagaggtaagaaaaaaacaaatggagaagaaagttctagagatctgctgtacaaccttgtgcttacagttaataacactgtacacttaaaattttaagaaggtagatggcatgttaatatttttaccataatttaaaattagatatgatacagattatacaaaaatcttacttgtaagatatttgggggtataggcattgaatacattagaaggaaacatttattgggtgtttttttgggtgtggagcactttcacaaatgtcatttaactcagattttagtaagaagtaaatactaacccaacttttaaataaaagtttcatgaaaataaaaatactggtacatgaaaaataaaacaaataaagagattcattcatcattcccaagacactggtttcaaggggttttaaaatctttgagttcactaaaagggatgatttagagctctgaaatgaaagattataaagaataagtagctgggtgtggtggctcacgcctgtaatcccaacactttgggaggccaaggcgggtggataacctgaggtcaggagttcaagaccagcctggccaacgtggtgaaaacccatctctactgaaaatacaaaaattagccaggtgtggtggtgcatgcctgtagtcccagctactcaggaggctgaggcaggagaagcaacaggatgagcctttgtcaaaaaaaaaaaaaaaaaagagaactaattttacttcattttcctctaaatccaaacagtatagaaataaagtaacaacataaaatgctccatgctttctgcacttgatctcagccaaaaggccgaaaagtgacgctccatgctttctgaacaaaaaatactatattaactcaatactttatgtctattctgccttattaacaaaattttaataaaaacttgggcctatgattttggctaacccacctaactaaatggtgtgcagaacaccactgagggaaccagtgtttgcttcccgaaatggtgaccttttggtcaggctcaccaacacagtatcttgaccccagaacatccagcctccccttcaaatgagctcctacaccatcaaagacacacaaaaaaacagtttgttttccctttgattaaattccctttgattaaagtgaaattacccgattgactttcaaatttctagctggaaaaaaagaagctcatattttaatgccatcttttaaaaatgttaatatctttaattatcaaaaagaaagctaaaatcacagcagtcacatgtaattaaggggagttgtattgatatagcaatttatgctctttcatcatcattctgttaatattcagtgtggctggatactgaatcactacagtagctcacttctatctgtgaaataagaaatctgaagacacatggtttgcatactgacgcattattttccttctgttgcatctaagccaagtatgtgaaaacagttcaatctaatgatctcctaaacctaatgatcacttatatttctctaacctcataccttttaaagagtggtctgtttctttccatactgaagagaaatctcaaggctctgaaagcataacactagaaaacaaaaggatatgtgattctcaaatggtagctcaacaaattaaaacattttcaggaaagaattaacaggaagtaaacattaacgtgactttattgtaagtggctggtccaagttggagccaaagcttctaactgaaaacaaaaaacaccaacacctggggtcattcctgtatttaaaaagtgtttatgttgtagaatgcagggaatattggccttgcttcacttggtactcgtcattaatttctttctagaaagtacaaaatgagtacagagacaagaaataaaattccgatgctgagaaaaccaaatgtctaaagatttccaggagctcaaggtttattttgtttctagcctgctatgtatacctcaatatttatatggtttctgtgagaaaataaacactagaaatgatgacatataaaaatagccgcaggcacactggattcaaacttgacaaattggtctcttgagtaaagagtcttaagcattccccaaatagaacaatctacactaactccctagaacgctcagaaagaggcctgtgagcctttacctaggaaaaataaacatctgacattttgcagtactgagaaaaaagagtgtgcccagcctgcagctgtgcctgcacaataggccaccattggagtgatcagggtttggtgaatcaaatctgggatcatttcctaaaatcagtgatctgaacacagaagggtcccatacaaaattgcccagagaggtgaggccggtaacaaaatgacatgaaggagccaggtgagagcagtggagactgtgagaaagggagagcatgcatattcctcaaaagccctccatctggaattctaaaaaaccctctactggcttaacgaaatgtctctgcaggatgggtttgtctttatctgtttaacagcacagtgtcatatatctgtgatgcactgaagaaatcaagtcccatgcctgcaccttcccgttggtagcgctccaaaaacccctgcctgccagcacagagacaccccgaaagagtctgctgggtttggccatcattttggatgataactcttaaatcagattggagacaaaggttgtttctttcttccttttcaaaatgacttgggggaaaaaaaaagatgagctacaactattgcaaagactaactttaaatcagattttgacattagggccactgccccccgcccccactctgccaatacccactcctcaaaaacgaacatagaaccctgcgtaactgttcccctttcttacatgtgagccctcaactcctggagcactgcctccccaaaccacacaccccagttccactgagcagctcaccctttactcagctctcccaacacccactcctcaaaaatgaatgtagaacctggctaactgttcccctttcttacatgtgaggcctcatctgctggagcactggcccccacaaccacacaccccaaccccactgagcagctcacacttccctcagcacactctaagctcacagctttcacacttggtgcatgctgttccctctgcatggaatgcccttccaccctgcagcagatgccattggtgccccacccaatatccccttatccacttggcaagtcccttctcatccatcaagatccatgatggcaaataattttccccctgttgttatattctgatacataaggaatgcatatttttttaaaaaaatagaacttattgataagcaaagaaacacctaaataaatcacctaattctcccacacagagaaaccactgttaagccttctgtattgttttaatattatttgattccatgccagtcttccttgccagatatttttccctcatagtcagtacagggaccagtactaacctaaacattctaaaaatcatagatcattttaccatagttacccaagatttcaataacttgatactgaaggacaagagacatgtttattacctgtaatagattactttttgctgcattcttttgcttatttggtaaaattaattttgctattgtatatacaccattttcctgaaagaataaaggggtcatactatgagtgacaacactgtagtgatacacaagcaaaaagaggcaaataaacaatctcaaacattaatatcaaagaagaaatattagtataactatggaccttgaagtaaacattacaggacaatatttaaaatgtcaacataacacttttaaacaccaaagagtacaactacaattttaaaatttcaactgtctgtggagaatcaagattataataaagtacataaacgtaaagtgattcaaataccttaaaaacaatgagagattaaaaagggacagagtaaaggtgtcccaatatcttagatttatatctttgatatttatttatatccttaattaccacaaccataaagggagaaattatattccagttattaatttatgtctttattataatcttgacatctttctagattttttaattgaaatatacacatgaaggaatgaacaaataataataccttacagccacttttctattatctagtaaatatataatgtactgatctttactgtgtgcaggcattcatattataactgcaaagagctttatttgccttattgcatctaatctctgtaacaactctgtgaaattagtctataatttccttgttttatacatgagaaaaccaatacttagagtggatacattatttttttagaagccaagccaagaagtaataattccaggaattgaacctcaatctggccaacttcagatgccctgttctatcaactaccccctgatctgctgagtttctcttatgtcctaatttaatcattgatgagctgatcccttactaacatgtacggatcttgaagttggatattgtaatgacacaaccaaaaatgttttctctgtaaaattcactaagtaggaggtaacttttgtgatagaaacccatacaagggttgtacatatacatgtgtatgtttattaatatagatctattaatttatatttatgtgtatatatacatacacacacaaacatgtatatatagctgtacatatagtagattaattagtggattatactttgcaaaatcagtttcttggcaataaatattttgtttgctgtgtctcaatcatcatttttaacttaataatctgatgcatagtcttaatcaaaatgattgctgtccttaccttatggtattctatacacccagaattaatgcaattcagagtatcccttttagaaagaaaaaataaaagggaccgcacataacataatgaagaaacatcaattaaccacatgtcagtcctttttaagtcaaatgagttaaaggaggaaggagaagaatataaagtggaactttattagttaaacgagaaatgttaaaatagttttaaaatcacatgatgggaatcccaaaacctatgttctgggatacagactgcaccacaaggtgagttgattatgaatggttatggagacctgaccttgagaaggagtgctctcacctgaaccacctggtgggcattggtgtcattgagcaccagctcagtgagggcagcacagcaggctggaatgacaacaatcaaatgcatagtgtgcatcattacaataaatatactatcacataaatactcttactccacagggtatttttattattttgctatttttattagcaaagtaacttctcaagaaacactaattttccttttggcacagctctggaagaaaagaagttgacttgtaatggcttctaattctcctccccatgtaattcatgtgcgtgtctattccactgcaaccatttattgagcactttcttcgtaccaggaggcaagtattgcatctgtccatttcattgtaatccccagtgcccaaaacatgcctggcacttagcaggtgctcaacaaatatatctataatggttgataaataaaagaatgctttaaatatattattcaactcaatccttataataagagtatgcactgtgattaccactgttactggtgagaaaacagtttcaaagagttactagactaggccacacaaccagtaagtggaaatgaccaggagtgcagccccagtctgccagacgttaaatccccagccctaagcagcaccactcttgcctcctgacagccactgtggcagcctttggtggtattttgcactgagatacttgtgctctcagaagtatgccagactctatagcacagagctcctataaaggataattccattttactgtgctgaagattttacatatattcccacataattctcacaatgatcttctatcattgataccatgattatcatcaccattttacataagcaaaactggagcttggagaaattaaggaactttcccaaggccatatagccatcaatgagggtggagccaaaactcagaccctactcttaaccgtttatgtttttaatttttatttttccatttttatttaggtattaacatggtttggctgtgtccccacccaaatctcatcatgaattgtaatccccacaattcccacatgtcataggaggaacccggtgtgaagtgattgaattatgggggtgggtctttcctgcactgttcttgtgatagtgaatgagtctcacaagatctgatggttttaaaaatgggagtttccttgcacaagccctctctttgcctgctgccatccacttaagatatgacttgctcctccttgccttccgccatgattgtgaggcctccccagccatgtggaactgtaagtccattaaacccctttcttttggaaattgcccagtctcaggtatgtctttatcagcagcatgaaaatggactaatagagtaaattggtaccagtagagtcgggctttgctgaaaagataacagaaattgtgaaagtgactttggaactgggtaacaagcagagcttggaacaatttggagggctcacaagaagacaggaaaatgtgggaaagtttggaactccctagaggcttgttgaatggctttgaccaaatgctgataatgatatggacaatgaaatccaggccgaggtggtctcagatggagatgaggaaattgttggtaactggagccaaggtgactcttgctatgttttagcaaagagattggtggcattttgcccctgccctagagatctgtggaactttgaacttgagagaaatgatttagggtacctggcagaagaaatttctaagcagcaaagcattcaaggggtgacttgaatgctattaaaggcattgagttttaaaagaggaacacagcataaaagtttggaaaatttgccatctgacaatgcaatagaaaagaaaatctaattttctgaaaagaaattcaagcctgctgcagaaatttgcataagtaatgaggagccaaatgttaacccccaaaacaatggagaaaatttctccagggtgtgtcagagacctttgtggcagtccctcccatcacaggcctggaggtttcagagggaaaaacggtttcatggactggacccagggtccctctgctgtgcgcagtctagggacttggtgccctgcatcccagccacttcagtcatgactaaaaggggccaaggtacagcttaggctgttgcttcagagggtggaagccccaagccttggcagcttccatgtggtgttgagtctgcttgtacacaaaagtcaagaattagggtttgggaacctctgcctagatttcagaggatgtatggaaatgcctggatgcccaggcagaagtttgctgcaggggcggggctctcatggagaacatctgctagggcagttcagaagggaaatgtggggtcagagcccccacacagagtccctgctggggtactgcctagtggagctgtaagaagcaggccactgtcctccagtagaatggcagatccactgacaagtgtgcacagtgtacctggaaaagccaaagaaactcaacatcaacccatgaaagcagccgagagggaagctgtacctcacatagccacaggggcggagctgcccaagatcatgggaacccacttatagcatcagcgtgacccagatgcaagacatggagtcaaaggagatcattttggagctttaagatttgactgccctgctggattctggacttgcttggggcctgtagcccccctttgttttggccaatttctcccatttggaacagctgtatttatccaatgtctgtaccccattgtatctaggaagtaactgacttgcttttgattttacaggctcacaggcaaaagggacttgccttgtctcagatgagatgttggactgtggacttctgagttaatgctgaaatgagttaagactttgggggactgttgggaaggcatgactggttttgaaatgtgaggacatacgatttgggaggggccgggagcaaaatgatatggtttgactgtgtccccacccaaatctcaatcttgaattgtaactcccacaattttcatgtgtcatgggaggaacccagtgagaggtgattgaattatgggggtgggtctttcctgtgctgttctcatgatagtgaatgagtctcacttgagatctgattgtttttaaaatgttttttttgtaaaaccattgaaagtgcatggagtttccctgcacaagccctctcttgcctgccatcatccacgtaagatgtgacttgcttctccttgccttccaccatgattgtgaggcttccccaaccatgtggaactgtaagtccattaaacctctttcttttgtaaattgccctgtcttgggtatgtctttagcagcagcgtgaaaatggactaatacgggtatagaataagctatgtaacgtaaacacatcttaagtgtaaggctcaatgagatactacatatctatgtgccctgtaaccatcctccacccagaggaatgtgtaggctatatttccagttctcaaaggctccttgtgccccttctcaggcactcactctcctataattccacatctaagtaactgttcttctgaattctatcaccgtcaatctcatccactctttgaatgattgctagaaacactcagagctctgagattccactggattagacttctggggagtcttcaaacagtaaacccccagcacaagaccttgtactgagacaggggcctttcagagtaagcagaaatggcactttgaggaggagctcctatgtccttgttttcacaccatctatgaagaaatatcttctgtattcttcaggagaaaatagtagacagcaaggaaagcctgccctctcccacttccccactccctcattccctctcctgcagtctgctctttcccctcagagtctccctgtctcctgctggcccataccacacctctctgctccctttctgtgggccgctctagggcacccaaattggccaatagcactcagaccgcactgtagctccagttgtcccaaaggccaggtgcccccaggcagggcacaaactgcatgactgctcaaggtggccctgccaaaaagcattgatgcattgctgctcctgcttgcatgtgaaaatcctagacagggcagcatctttcagtcttctctttggagctcaagaagcatggggaaggtactctcttgcacctggtgagacaagtgtgtgcactgtagattcccccttatgtagggtgccctgggatctagaaaattctagaaagcatgattctggccacagatcaagctgcatcccctaatccagctttcctcataataaagctaatgttttgtatccttatctctgacttctgtgtttatctcttgctaggttcagaacacagaagacaaagaaacatttgttgtatcattcatctgcaagtccaacactgggaccaagaagtttctggcatccatgtggatttcactttacatttttgtaaacttctaaattttgcctacttaacactactacactaatctatgatagtgaataataatacaacacaataaattatagcatatcaaataataaaacataaatacctgcttgaagtgagaaagtattttcttgtatttccctagggctcaagtcttctgataaatgaagctgctggattcggcctgcagcatttgcactggacaggcttccaatggaggagtgatcagaaacaaaatttctgtctctgaaaaagaaaagttaatgcatagaccatttatcaatttcccttcaccgtcagtcctttctgtgtcacatttaagaaatctttgcctccctcaggtcatgaaggcatcattattgtttcactttccaatccacctggaattgatttttgtgtatggtgtgtggtaagaaccatttttttatggttactgatttctcactatttattgaaaagtgtcctctccccactgctctacatggccacctttgtttttgaattttctattttcctggagttgattcacctgaatacatctcagtcttgattattctcagtttcctttttccatgaactttcaatcttcctttattttaagaaagttctctcctatcatatcttggaaatgtttggcccttttcattttactctgtacttcagggatctcaattgtccacatgttgaaaacctgtcttcttctattgggcgtatctttcattttctaatttcttttattcattggtctttttcttctgcattatatgtaatttttttcaagcttaccctacattttactatttccatttttttctggtgatctagcaatttatcggttctgtaggtgttattcagtccttgttttctttcctagctctgcagtcttctcccttttttgtgtccaaaaatttgtttcatctttaatctcatttcataaattcatgctctgcttaatgtctttgatgaaataaagcattggcttttctgtttactcagtacactttcttccataatagttcttcatctgtctttcacctgctttgttcccttttgttttacatagttaccatttttttccatgtatttattttttatagcagcaactctacctgaatttctctgtgcctaaatgtaacatggatggagtttccttgacttccctctcatgtcatctgggtccactagtgtcctccctgcaatgagcatggggaaggtaatggagctaggcctagggacagtcacaggtggtgatcttatctgtcaacatgattctcttaaaactcaaattgtagggatctcttcacctgatcaagagagccctttgggagctgcctttgagtttgagatggcaggtgaacaggcatgagaaagtgtcccagaaactgccctgaaaacagtgttcttcatactccagccacaagacagcctggaaacgtctacccctaatgccagctgcagtcagcccagggtcaggcacaagctctgaaaagaaactgtttatccagctggggtaataaattctcccaaagcaccagtacatatttaacatagaataagagttaaaatatgtcattgtcctggggaaaagtttgctaacattgcaccatcaaaatggactggaaaatgatactttagatgtgaaagacctcttttttaccaaggatagttatgacttcagcaaaagaagaaagctagattcaattctatatgagaaaaaggcaggttttgtctttgaaattctgcttaactattacagaatttcattttatccttatgaaaatagctgttctccaagagggcaacccatacctattataataggtatgattgtccaataataaagaataaccaccaccatgatcatcattaccatcgtcatcctacaaacctaaataaaaaacctttggcaattgtaattattttgaccaaggggctggcttattatgtcacagcactaatgaatgacttataatttatactataaagtaattgatatttttatgtcacattcatgaagcaagtgggttgtcaacagtctataaatttttcctttgtttaggtaatgacaaatattgttaacaaagctactgttcatgtctgtacagtctattcttatgcttctgaatgttccttaagagaaaatgaagttggtaacacacagttctgcaatatcgctggaagcataacaaatacaaagtcataacaacattgatttgataatatctagttatatgaaaattgataagtccctctgcttttattagaatgagctttatttatgtactgcagatcataaagacgatccagttcaaggaggcatactcatttttaactttggttcagcacccatagaactgaattatactttataacaatattaggtaatagaatcttcccatggatggtaccacaagatattattattaaatacttcaatctatttaattcagaaaatacagaagttagtttgcaacgtacttctagagaatttcaattgggaacaaaactatccattctccgtgctcctgacttagaatgtcactggaattctacttttaaaagagagataatgcccaccttagaggaccgtaatgaagattagagagaaaagtagagaactggactagagttagtaacatggcaaccacttgattaatgatatcatctttcaaaaacaaggattgtacacctgctcctttcatataggctttgttttctctttatagataataacatatgtgcacacacaaacattttaggaaaatattagtaatcattatacttggaatgacaaaatgcatatactaattcaaggaaaaggtggcaagacaaaggttttttttaggttactggatttccattcagccttcattatatttgcagattgatggccttctacattcccagcactgtactggaggttggtgatgcaaagataaatatatctgggtccccaaggaatttaaaagatgaatgcccctgacattgatttagaacatgcttgtgacaagtctagatgactttggaaagcatgaattaccaaagaaatcccaaagcaggagggaatgaggtgacacacaccaatctgccatcttgtcacagagtccccagacttcaacaaacagggcaaagtaggccaaagcccacttttactcacccttgtaaaatatgaagaagctgtttgatgcctccccaaatgcgaatttccacgctggtctcagggtcctcacaaacctgtaccagaatccagacaatgctccagaggagcttcaagtggtcagagtggagcagactgaggaggaccggtatcccctcatagagcttcacctgctctttcacctggggctctgcacaaagtaggcgcagcaactccgctgttagtctgaaaggggtacagagggtggggtgagaatcacagcatcatgagttgattactttacattaagactaaagctatcatcagtgcatgaaatataaccctaacattttgtaagtcatgggtcaatgtgccattttctgtaaggagcccgatcaaagccaaacacttttagctttactaactgtacaatctgtgtcacaactactcagctatgctgagatagcatgaaagcagccatagacaacatataaaaataaattcgcatccctatgttaaaataaatctttatttacaaaaataagcagtggaataaacttagactgtaggtcatagtttgcagaccactgttctaaattataggctcgttgcatcatcgttggtctgattaaaaacctactgaccagcattggcagggcgtggtggtgtgtgcctgtaatcccagccacttgggaggctgaggcagaagaattgcttgaacccaggaggcagaggttgcagtgagccgaggtcacttgccactgcactccagcctgggtgacagagcgagactctgtttaaaaaacaaaaacaaaaacaaaaaacaaacctactgaccagcaaataggtatcaaggacaaacaatgacatctgcattgtgctaaagactaaaaaaaaaaaaaaaataataataataaaagccttattctagtcttcagaaacttactatgtaattgcaaaataagacattcttagaaaatgtcaaaaacactacaatgcaggtaagttaagggcaaagcactcagttactatatactcagtgcaaagtgcattaaattgatggtaaagacacaaggttcagctgtgccatgaaatattatgatgataaacgttttatagaatcatccttagtcctccagtttcatactctaaacactcccctcctggatggtgtcatccattcccatgatttcaaacactctttcaaccctgtcatcatgatctcagcccaggcattgctcctaacttccagaagttttagccacatggatattccacaagtactctccatactacccctaaactcaaagtcattagcctcctccccaggtctattcttcaccttatatccccgatcttgactcatggcaccacaatattttcagtcttccaagccacaagactgggagtcatcaagacacatactcctcttttcacactcctccactgtcaatcaagagctcttagtgttttctatttcctgggcaacgttgggattcttttgaacaccaggcagctaggtaaccccactgctcctcccatccttgtaatcctttgtcatgctcaagatataaatccctctttcatctacctctccaatattctcattctcatacggctttctcattcctttcccctgagctgattacctatggctcctctccctcccaaattttgtgctctgacattaataataaatgttccttgataaatagtattctttaccttcacgaactttcccagcctctctttgttgtaagtggatctcaatgtgtggatataaacaaacacccccacctcactcccacatacactgctatcaaagtgatctttcaaaaaacaaatttgatcatgcttaaaatgttcccatgagtccccataatgttcatgataaaattcacatcgttatttatcagagaccatcatgacctggataaaggtgtcttgttgccttatctataaaatacgggaaaaatagggttaatgtgcagatcacatgagttaataagcaaagtgcttagagcaggtcttggcatatagaaaacactgatcaaagttagctacattttaaatttatcattaactatctgttctagttctctggcacttttgttcttatggtcctgctgtgcccaaccatcacattcctctaacacacccaatttcatgcctccatgtccaagcacatactgtttttatgttgtctctctctctctgcctagatatcttctctttcctccaggaaactttgcatgactccacattctaattgggaagtctctgctccatgttcccagagtaccctgtgcatctgtctaccgtatcagttatagcactgtttgaccctcttctacactacatatttataacttattcatctttggttttcaacacctggtaccaagcttggaaccttgtttgttcagataaccaagtctataagtattatctatatttaatgctcttttatgagagttttgaagaagaatccaaaaggatttactatgagttaagtgtcagggctccattgctggagatttctttttatctattttgcctctttagaaaattactcaactaaatatcaaatgatatagattgcaactctatttaagtacaatctaataactatctggatagttattagaacaatatgcagttcaagtaaaaatgaatccattttactctagattttgagttatcatagcaggtgatcacaaaacaagtcagttgctatcttattttacttgccttcatgcaaatggattttagcaacctaatcacttattgtaatatacaatttgaaattactaaaactagagccacctcagagtttctttccctaaaaaggcaggatataaataaatgcaataaacaaaacattaaaaatgatatcacaaaaatttatttcatcagcttctatgcccagatctagaagtaatgcaggactaaacataaatggatatacttctttgctctattttctttatataaacttaaacagaaaataaatgccaagctgactcatcatattcagttacaatgtaaataacatgacgtaataaaaataataacaagtgtatctgtcaaataaaggcactgcattgtctttttctactgttagcaatcctaccttttagaaagcaagtcatattcatgtaaaatcatcaacagattttctacaatgttgagttcacttatcttctccctacattcttgactataaattgaaaaatattagcaattactaaaagcatattttgctagatccatgtattagtcctttttcaaactggtataaagaactgcctgagactgggtgatttataaaggaaagaggtttacttgactcacagttcagcatggctagggaggcctcaggaaacttacagtcatggtggaagataaaggagaagcaaggcaccttcttcacaaggcagcaggaaggataagtgccgagccaagggggaagagccccttataaaaccatcagatctcatgagaactcactcactatcatgagaacagcatggaggaaatggccccatgattcaatgacctccacctggtctctcccttgacatgagggaattatggggattacagggattacaattcaagatgagatttggttggggacacaaagcctaaccatataaatttatttatttaatatcctagctccaatattatcttgggagaagagatcaaaaaacaaaaggaatcatatgttattcacagaaaagcaatggtccacttattgtcataaaaacatttaaaataatcatgacatttataagaggaaagatcttcttgaaaatttttcaaagcccacagatgtttgaaaacgttctgtatgttaaaattcacaggtaagaatgaattaagatggtcagaaagattcaactgccaaagaaatattatggtaattttgaaattagaagtaactgagggttagatgaaaagactaaatatttccagtcaggaaataaaaagaaaattttaaactgcaatttgcctttccagtttaaatttttaaataatgccttctatccaggattctcttcaacatgttatttcacacttatttatcaagaaattgtattaagtagttgacaaagtaactgattattttgcatccttaccacctaaattgctatagtagcagaactggaaagtatattagaatacactacttacctttctgctaaactagccagagccagaagggaacccaatagaacattagtatctcgggcaccaagtaaatttactaatgtctgaaaaatgaagtaaaataaagtttaattatataagtactacaagcttcttttttcaacattaacattaatttattttccattaccagctgcttgaatgacaaaatgcttccctcttaagatcatataggcttaactgttttttttttttgcttagtagtttataatgtatgtgcatatacaattaagcacaaactatatataatgttaaagctgctctctcttatgtttttttcttaatgttatctactgaaattttttcatggcattaaatatatctttataaacactttttgtcaatataatcaagttgtttattttattatggctttacccatagaatagtgaaaaaaattatgccctatcaagccttatgcagcttcctttttattttttgcagtcaatataaaagtttatcttaaaaagagttttattaaacattcaaaatatccagttctttacagatggcaggagtccatctctccttactttggaactcttgatagtaacctcttgtagccattccttgcccaggacaggaagaaaaggcatcaagctacatgaccagcctggttctcatacatccttctatttccatgtgcccaagtattctctcccccttctgatcccacgctgggaagaaccaggaagattaatgacataaattacaatagtggtagtgatcagccattgagaactcactttgagccaggcattgtgctaggcactttccaaattatgaaacgatttttcaacaaaatattgaaactttcattcttttgccaaactaaacaagatatgaatactatcgagcattccatttgcctcccagatttctaattgatgttgaaagtgcatcactgatgctcccaagcatcatcctaactaacatgacttagctggaagtctgtagcttgtcagtggctttccctgaattctcgttaaggcaaattttcttatttggaaaattctctacattttcagaatgcggagtgcccctgaaaagtgcctcccaaaatgtctcaggtcagagctgcaacctgcgcaacaacggctaaggtaatttttatgtttccagtatatggattttttgcctttatgatttcattttatcttaatgaagttatcattatctttatttgtctgatcctttcctctttttcttctctctttcttctctgtcttctaatgtttcccaaacttcaatccattacatatcattttcacattttttgccatattcaactaacatctttaatgttaactcaaaaaaattttttccaattgtaagcaataatacctgtgaaatagctggctactgaaacaaaaaatgttgacctgtgtatcacctagaatcatcctctagaccatgagcagcatgtgttaacacattttaggcaatcttgctcccatatacactagaaagtggcttcccgggatatgaaactcaacaggtttctgaaacttggctccacatggctacagtctaaacagttttgctataaatatagtctgttttgacctacaatggcaatcatatatggttcaaactaatatagccccacatgccatatggaatttatatgtatacatatgtacattttgtttatttctgttgacttatttataaatgcacacctagggtgtatttatacatagctggggcttttcaaataatatttaagtaataaacctagttggtattaaatggcataggaaaaaaaagaaaagagttccagaaaacttgtatttattatatctctattaacttgtaatgctggtaaagaatataaaagggttgacaaagatccacaatctcaggccaggctggtaggtttgtggattctaattacacatgacttaaccgcaaaggctctgaacttccctaatgtgaactattgccatagggagctgaagcattaactctttcaggggccactcaccttgtgggctccacttgtggtgacccattctctttgatctttgactgcagcaagtttttgaaaaatatctataaaggaaagaaagagcgcaaagaggcatccagagattaaagggggagtacttccaggagcacagatctgcagtgcatatgggcaggcagagaaaggtcaaagggaacacagcacaaaaggaacaacagatgcaggagcagcatggctacttttttaccccaagaattactcctcaagctccactggtatttattttctaatattattgtaataatgaaatataaaaataccaaaaaaggcaaacctctctttccacttgaagttccttaacatcattaccagttcaaagtgaggcctattcttcaaagatcctctctgtgaagatttcaacttataaagaagagagggaaggccagcaaatgagaggaacctgcacgtttcctcagctgaggaaaatagtcatcctcaaagagacttcctagtgcccagggcttgccataaactcttctctccctggatctgagaatcactgtgctgctccacaagcagatatgaagagccagtccagtcacacaaagaaaacggacaggcatcccacacggcaggacgtctgtgactcatcaaagctggagtgcaggacagcagggctgggaagagcctccaacgggagaagattgagtgactaaggaatacctcacactcacagtccaatgttttcacattcgcagcatcagataaggtttgttgttatttttctttttcatgctctggatgtttcagattctatgaggtaggcaatcatgattaacccaactttatagaaaaaaaactggatagtctctgacattttaacagaaataaaaagacgcaaaaatagattttaccaaaatttgcttttatggaagcctctcttgcattaaataaattgtgcttttcaaggtaaaggttgtaatctaaacatctttcttctggctgtatgttgccactgaatataacaattggcctggatgctcaacacctgagctgtgtgtgcgaacattaataaatatttaaagtatccttgtttcctgctgcaaacaccatactgctttttctagcaagtccacaaaaatggctgtgtccctgcaataacacttacatgtcatgttgaccagcttgtccacagtgtgctgctcttctccatagccgaggtactcattggctacaatctccatatactgcatgaaggaccaaaccaacaagccagtcaggacaccaaaagcacccaaggaagcaaggaacaagatgctgcagttcttaaaataaactgtaggtggcaaaacagattcatcaaataatactctcatgctcctggaacagttatcgctcaagtgcaaaaggtgactgggtttctagattctttggcttctcttgcgtgctatgaagttgagggaaagaccatctcaagactctataaactctcaaaagtctcaaaatgactcttaactaagtaagtttgttgtgtaatttagtatccaaatacaagatacatataagatacataatacatagtatatagaatgtttattcttcaatgtatctttttaggagaattttttataatacattgtatatattttactgacgtatataagctctgaatatatgtctaaccagcatacatgcagttagcaataatcagaataaaatgcgtactgagtagtctgataattctcactgtggataatgattataataagaaacaggctcagggaaacaggtaatttctaatattataatggaagttaaaatggataagaagatgctttgtaacataatcttatgaaatattaagttattaaatgaggtacacctctagtcaatttaaaaggttcttgaaaacaaaaaataaacatgaatcaattttctaagaatataataaaataaagtagatttaatgttaaattgccaccaacttaatcttccattaattattcagaatgagtttgcagggccacatgtttattatgaaaatcattctttctgtaaacattatacaggttttaggagactagcctgttccaactcaaaaacgtgatcagaaattttgttttattccagcctggccaacatggtgtaaccctgtctctactaaaaatacaaaaaaaaaaaaaaatgatccgggcatggtggcgcatgcctgtaatcccagctacttgggagactgaggcacaagaatcacttgaacttgggaggcagaggttgcagtgagctgacatcacacaactgcactttagcctaggtgacaaagtgagaccctatctcaaaaaaaaaaaagaaaaagaaagaaaaagaaattttgttttattgtattaataaatgcaagcctctgagttgctcagtatatatattcacttgcttaccctcgctcagtagttagcaaagcagaaaaataaataaggtcaagatcattcctttctttgtcatctatttattagtattttagtgagcacagtaatcattttcttgtttgaaaatgttttgaacatcttcataatcagtttattatcttgccaggcccagtggcacacacctgtaatcccagctactcaggaggctgaagcaggaggattgcttgggcccagcattttgagaccagcctaggcaacatagtaagacaccgtttcaaatatatatgcatatatatatacatatttcttttcctcccaccatatggtatatacaatgctaagggcttcagccttccagccatcgccccttttgttgttgtgaggcggagtttcgctctgttgcccaggctggagtgcagtggtgcaacttcagctcactgcaacctccgccccccaggtttaagcaattctctgcctcagcctcccgagtagctgggattataggcacctggcaccatgcctggctaatttttgtatttttagtagagacggggtttcaccatgttggccaggctggtctcaaactcctgacctcaggtgatccacccacctcagcttcccaaagtgcgaggattacaggtgtgagccaccgcacctggctgcctatttcttattattactagctaaagacatgtgaccttttatagcactttctcatttcatcaggctgagtaaagtgagcccaattagccagaacaaaatgtggtgggttcctccctgctctgtgagtatcatgcctcacactcacacttaacgctgtctgtccctctctggggcagacagcataacataggaaagccaccttctgtcacatacccttttaattcttgctcatagcaggcacaaaatgaaaaggcaagaccagccaccacaaaaggaatcttacctgagctaggttttcaatcccacccaagctatggagtatttcctaataaaataaaagcaacaaaacacatgtaaatgatgagggtggagggggaagtatattttacatgcaatttctttactaagttgtcatatttataattatattgtgaaggtctacattctaatataaatacggaaaacttacagtatgtcattcatactacctttaaaataaactattaataaatatgaaagttgggttgagatcaagagaataaatctgtgctcagaaccgcagcctgccccttcattcttcttaactcctcctgtgtcatcataaaatgttcgagttgagaagagccattagacaccatttcattcaatattctcatgttacagatgaggaaaaccaagacacagaaagaaaaccattttgcataactgacgaacctggatgagttcatcaccaaactccaagaaccctccgctaggtctctgcctagtgtccatgaaccagcagcaccctcattacctgggagctgaacagaaatgcagaatcctgcacccaccccagacctactcaatcacactccgtttcaacaagatctccaggtcatacgtacgtacagtacagtttgggaagcattgctctaggacagaaagagtttctcaaaattattagatgaatgatcttattagacccatgctctaaataaatgtaaagataatttttgacaatgtctcctgatacaggactttaaattgtgaaatggaccagcctagagatctactaatagtaagtgctcttaggttagccacattgtcatttatctatagacaaatattctcaggtggctttaacctgcttaattacatctgtattgacatctctctccttacttaacatgcccacaaggaagttatttgaaacataaacaagagccataatttcaattctgggaagtgcacagggacgagtacatgagcgtgggagagaacagtctagttctcccatgaagccagtgagtgggcagactgggaaaaggcacaggggcctttttctctcaaggcctcctgggtcaaggtttccatactctgtataaagtgaacttggaaatactgaacacacttacatctaaattaaattttaaaagaacatttagaactcaattaaaaatagttctatgactacctactaatttgaagcctcatcaatgctattcactctagaagagctataattaaagagcacgagaatattgtacatatgatctctatttatggtaggaggttttgtacacataaaaattaaaataacatttaaaaccagttatatttattcaacaaacattttttccattccacctatgtaaaatccttgagttaggctctggagacacacatatgtagatggcaggagtgctctttgctgagctgtaagcaagcataaggtgggtatacaaacaactagaacttaagacagaacgagataagtgttaaaagtaaattatacatgcagtgttacgaggcgccagaatagagacacctcattcctgctgagaggactaagagacacctcatgtgggtggtggtctctaaatggggactggaaggatggatggatttgccaagtaaagatcgggaagaggtgaaaataaaggagattccagcaaagagaataggaggctcaaaggtgaatagaaattgtgcagacaaaacatcaagacatgctgtaattccgagagaagcagttccgtaactccatggagggcattactgggaaaaaatgttagaaaattagggtggattcacactgtgggaggacttagatgtgagcctgaatttgaacgttttcatgcagaccgtgatacccaatgaaaacgtgtgagcaagggactggccagaattagctgtggggacttccttctagtcataaaatgaactggagatggggagcgtatcaactgggagctcaggtgggggtcagtgacagcaggagtaagaatggagagaaaggggtagtatttgaagcgatatgatcaacggaacatgaagaaagattggaagaaaagaagcaaagtcaaagacatcagtctatttaagtgggagtggctgggcacaatgtcataattaactaacacagggggagagaaaggaataggctgagatagagcagaggactctattttggacatactgcagtgccgcaggcccaggtgaaaaaaatacaacaggccacagaaaatgaggtgagggcaaaagactaaaatctgggagttattcacatgaaggagattcatctgaagcttgggagtgggaagacaccaaggaagagaataatgtttaaatggtcatggtaatgttatttttaaatgtttgccatgacaataaatttattcaataattttgatgatatgggactaactcaatgtttcctaaaccatgtcctggaaacagtcattttattttgtgcagtggatggaattaggcattctaccaaaaaaagaaaaaagaaaaaaaaagaaaagagagagagacagagagaaagagagagttttattgtccaatcagcttgggaaatgtaaggtaaaacagatttaacaaattctctatctcaggactctttggcgctgctgagcactataagtctctaaaagaagaactagtgtgcagctttttctaaacatccctaaccaaagcacacttcgtttcccaggacacgtattactcctgtggaataaagtttgagaagtgctgctatagagtagaagaatgagaaagacgcttactccctcttagagaattttgtcattatgttatgtactcaagaatttaaccttcatttatgaaatgaatattttccctccatgctcccatggaaagtggagcaaggccaggagattgctcacagaccctggtcttccttgcatttcctttccttataccaacaggactgtactaacctgagagtgtaaactaaagaaaaccatgactacaaggtatgtatacacatgggcttaacacttctagttactgacctgaaaagcaaatatgactgcaagcttagattacagcaatgcgccctgtgtgcccttttagccctcagcatctttcacttgtcacaggccagagggccataaaactggtttctatatttctgagtctaatgacttggagaaagttccctgggtaatctgaactttagttcaatctgtaaactgtgaacaatgtccttcctaagcttaccccctgaattgttccttttttaaaaaaaatagactcaataatataatactggtaaaaagtatgtttttaagaatggagcacattttgccaatatatttttattacagccaaaactgtcatttccatttagggctctcatcctaagcctacgtggcaactaaatcaatgaatgctgaacacactgcataacttttaacactgaatcactgacatgaccatttactcctctgttcaaaaatcatcagtggctccataaagtttatttatttatttatttattatttatttatttattttgagacagagtctccctctgttgcccaggctggagtgcagtggcgcgatcttggctcactgcaagctccgcctcccgggttcacgccattcttctgcctcagcctccccagtggctgggactacaggcgcccgccaccacgcccggctaattttttctattttttagtagagacggggtttcaccgtgttagccaggaaggtctcgatctcctgacttcgtgatccacccacctcggcctcctaaagtgctgggagtacaggcgtgagccaccgcgcccagccaaagtttattctttggttatgattttaatgcccctctgtggactggcctttacctatctttctaggtttggaacagtaaccactcttctaaaaggtttggtatactcgatttgtaggaggatgagaaaaaaggaaatacaagagatacttctaaagttttctaccgtaagtctgacaaaatatggtgccattaaaagaatcaggaattgattccaaaagttcaaggatgaggggaagaattgaagagctccattataaagttattgagtataatatgctacaattgctgttctcaaagttttggtctcaaacccctttacactcttaaaaattactgagaacctcaaagagctttgtttacatgggttagaatgtatctgtttatatttattgtattagaaattaaaagtgagaaatttttaaaacataagaatacacaagtacacatgttccatcagctgccagggccatgatgtcatgagatgttgtgtagcttagggaaaatcccacagcacacatgtaagagagtgacaagacaaataacatcactgagaataatttagcatcgtgttgaagatagctttgatcttgtggaatccctgaaagggtttcagagacctgtaaactgtacacgggcccacactttgaaaaccattatgctactgtgtcatcaaggtggttgtctaacatgtctctggaaacttgggacttaaaggggaaagtttgaggctgtagatatgaacttgtgaacaaacagcaacaacaaaaagatagttgaagccaagagcttggaagatatgggagaagacaataaagaaaaaaaaaactttggggaaggttatttaggaagacaaggttaagaataggaacgtgtaaataatacccaaaaaatgctgaataaatgctagaggttctcaggatcagtacaggcaaagagaaaacgtggtacagtgtgtctcctgctaaaaacaggttggggaatgtaagggctgagagaagtctactcaatcgcactattttttattattgtttctaacataattacaattcaggatcttttaaggttttctctttatctttgataagcaatgtgctatggcttcactataatgaatccaggtgaacatttatctttatcctgcttgggactcgagctgtaactgaaatctcaatacgtgtcttcgtttaattctgaaaaactctaaacaattatatcttcaaaatggcttctctgtcattccttccagtctttcctggctggaacattcactaaacatataatggaaactgtactagcaggaaagatccagtctacaagccaccagtttgcaacctctgagtcgaagaatgaggactgcagcatggcccagtgtggtctatttaaatggcttccagagagaaccttgtacatagaattcaatgtgcaagttatgcaatacatcagtcctggtggaaaggaactggattcaggagacagcctgacctttcaagaaatatagtatgaaagtaggaggaggacttgaaggaatagctgggtcaagagaaggacatttttatgataaggaaaaatagagagcgggtagaagggaaagccttggccaggaagaggaatattacttctgaaatatgagggaagtagagttgcgggataacccaaatatttcaaacaaaaagagaaaataagatagctcccactgggatggccttgggctttcctgtaaaacagaggatgatataatttgatgagaataatgggggcaggagagggtttggctgagaaaagtgaagatggcttggaagagccgctatggaccctgcagtactgactgaacaagagaggaaaggaacagatacccatgaaaaaggcatgctgagagccactggcgtaagtcgcaagttgtagtaaaccccagcatagctttgtgacttcagccaacaattcttggcacctcaagatgttaaacaactgcctgagcacgtggtcttctgtgtggaaagagtgccagggaggacagactcggagataattcccttctatggaaaggctggccagcaggacaatattcgtttaatatgtgtcttggtcacaaaatctcataaagtcgtctctgagttttttccttcagagggcaatacaatcaaccctgttcaatccacccagaatgagattaaaaaagacagaacttcagatgggagatcagcagagtaagacactcttatcaacagattttctgaacaaacagaacatctctaggacaaatatttgctagttcaagtcagattaactggaccttcctcctggaaaacgttattaatattacacatataatgttttcatctaaactgagacacattggagaataaaagacggcactatgaataattaagtgggaacagtaagcacataataagactgatccaggcaaaaggaaacttatggcccatgctcatttatacatgacccaaactgaattgcgataagcagctcagaaatgcatggaacacacagttctgtatggttggtcacaggaaaataaggatgcttacctacccagaaaactgtgagcaacaaggacagaaagccatttcaaggatgccctggctcacatatccaaagggctgtggttagctaaattacaatagcacgaggccagtttagaatacagtatgaggaagaggacgattcttctaatggaaagatgtgtagtgcccatgaatcccagaagagtccaatcagagtaggctctgtggctggttggtaccaaaatactttctcaaatgccaaatatggaaaagatggttacttctgaaatacgagggaagtagagttgcaggataacccaaatatttcaaacaacaaagaaaaaataagatagctcccactgggatggccttgggcttccctgtaaaacagaggatggttacttttccaaacttggcacttaaaggaaacatattctgactcaaataacaattcatcaataaaatcgagttcaaaattaaaggtgtgagcttcctagtagcttacgagggcagggcataaaaggagacactttttcagttaaaaaaaaaaaagtgttaagtaagcttttctttagagcctcacagctaaagcactatgtctttgctactcaaagtatgggccatgaactagtagcaatagcatccctgggaaacttgttagaaatgaagaatcttgtttatacatactgagtcagattctgcatgtacaagatgtccaggtgattcccatgcacattaaagtttgagaggcactaaaaacagaggccaggcatggtggttcatgcctgtaatcccagcactttgggaggtagaggcaggcagatcacctgaggtcaggggtttgagaccagcctggccaacatggtgaaaccccatctctactataaatgcaaaaatattagccggacatggtggcacgtgcctgtagtcccagctactcaggaggctaaggagggagaattgcttaaacctgggaggtggagagtgctaggattataggcgtgagccaccatgcccaaccaggaaaagattcttgacctcagtgccctcctttgggacaagcaggaggctccttgctcacctctagctcaaatttgactctagaggttgggaagggattgaccctggagcagctagtaaagctccattggctgcctctcagccacatgagcaggccatcactcatcactgctgactttgacctagggagctgcttggccttgaacatgtttgaagatgtggccaagtgtatacctccttgaatggtaaatggtttaaaatgccaaatagcaaagaaaacatagaccaaaaagttcaatccacttaatcccataagtaatacaacagaaatacacaaatttttggtccccattaaagcgctcctctcaaatctttttaaatagtagatgagacattccccatatatggaagctattgagttgtgagagagaaaacaaaaagtaaacatggactacttcaaagaaaagcccaccagtcttttattacaactttataacaagtaaaaaaaaaaattgtatttttccaaccaacctgataacatggatccctcattagtagcctcagacagattaacactctcagaaaatgaatagatggggctcgattaacccactctctgaaagaagaaaacaagagaacatgttcacgtttaaaatcccagtgtggcaattcataaaaatgcaaggctatgaaggagtataaagaacgcactaagcacttagttaatttgcactggggactgttatttggtacttgaacacttgactcattttaattcaaaacacatttaaactatctttttcagtgtggaggagaggccccccccaaacttatttggttcatgccaccacccttactgactcagtaatatttcatagtaccctaagatcaaacgaaagagctaaatgttccaaaatttaggtaggtctaacttggtaagaatttacgccataaccaattggtatccacttgaaaaaataatacattacatcaaaagattattttcataaccacacttacttattaatgggggtgtgtgcattagtggaaacaaaacaacttctcaagcctgggaatcagtttggacttcaccatctttgttttctcttccccctttcatagagtacttgtttttttatcatagcaaccactgaaaactcagcttctgaaagatataccatcagctaaaggaaggcaggatgacctaacattgaaatcacaaactgccttcagttgttcatgctgtatctgatggatgttgagtagcactgagggtgtttttggttttgttttttagaaaattgaaaatacctcacagtgtcccctgggagttctctgcagccctgaggcagtttggtgctcagtttgggaaacacagggataaagtatttttttagattagtttccccagaagcagaccctgagatgaagattagtgtgtgcaaattaatgactgaaaacatgctctcaggagaggccagtaagagagtgggagaaacaggaaagggaagaggagaaatccaagcaagggtatcacatcagccaaaatctcccctcaatccgaacagtggggctctggaatgtaagttactgctcagagttgtcccatactgaggcaagggcactgggcttttctacactactgaagctgttgccattcgctaagagctgcaggagggactgatggagcattcccagacactcccactggctctctgtgcctgcaggcaaggtagactcaaggaacctgagggtggttggtgcaagtgttgttggacaggaaggtgccaaaaccaaaagggtgagaacgggaggattctgggcaaagcaccaatactaccctacagttctatagtgagattcagcagaaccctttgaaatcaaagtcacagtcactggagaagtcatattatgacagaaactgaaggtgtatttgccacaggtctgttcagaggggggaaaaaaaaacctggatttttacttcaaatattgaatatagccaatatccaaaataccatcatcagatttctaaagaactatttaacttaaaagtatcacttcaatgtcatcaaatgctacaagtattcactcaactaccttttgagaggctttcaaaaagtatgtttctttagcaaagaatgatttagttgcatccttcaaaggtctttaaaataaggacaattgcaattttgcaatgtttttgaaagaagccagacactaatcaaattcagaggtggtcacaaggccttgcacccagcagctagcagctactcaaatatatatggatgaccaattctctgatttaaaccagtgtggtaaaggtaggcacattttaggcacctctcacttagatttaaacctaagggagcatatcagtcaaggcagaatccctccactgtcatgcctctatgagctcagaaggtgaggttagcttagaagtaggaagtcagggtagggatagtctatgctctttggtgacacccacatcccttcctgaccctgctgggccactgtgaacaatttctattttgtcgctcagctgtcccacatccagttatagctagtagtaaatgcagtcaaaatgttaaagcttttcagtcagctcctaatgttgcttcataggccatagaacgtgcacaatgcaaggtgcatttcacatcagttgttgaggatacttgtacccaaagagttggagcaacagagcccagactgaaactagaacccatggcttcctgaatctcagtttgatagtcagcatgtctgaaattgacttcatgaactccccctcaagcctgatccttccagtcatctaggtaaccagacagaaacccttggtgtttttcttgcctcctctatttccctcacattctttgccaattcctcagcaaatcctgtctgctctacctttaaaatatctgcctccacaacctatccacttctcactatttcctccaccaccacccaggatcaagccaccaccatcttttgcttgagccattgcaaaagcctcctatctggcatctttgcttccagctttgccccttcctttactctctcacatctgccaagatgattctttacaaacacaagtccattcacgtcactcctcagcccaaatcctccaacagaccccatctcgttcagaataaaaaccaaagtccataccatgactcataggccctccagggcctggcctccccattacacctctggcctcatgtctttccactgccccttgttcactccctcccagtcatgctgaccttctcattacatggctgggccaaggtccagtgcctaaggtgcttcccatgaaagccttttgtggcttttcaacactggaacctcataaagaatttgaaagatgttctccatgatatgaggccagtcacctgcagttgttctaaccacagtgtatgttgtgcagaagtggccaacacagcacagactgaactcctgaggtgagaaagagaggctgagtgctgccatgcactggaacttggaaacagaaggtggtcctggccaggtgacacttgctcacactgcccttcaagctagttccatagtggtgcttggtgcacacgttaacaaaagcctaaaacacaaagcatcttctatttcatactcagccaagaaaaagcgagggagataatggaagctattctagactagaatctatataatttctcccacatctcccacctccacagctgagctgattgtgtatccagcaagaataaagatctgcccccttgtcaaacacagcaattacttgagttgtggacccaagccactcattgcctggcctgtcccacactgatcctctgcctctgggtacagttcatctctgtctcctctatgatcctgagaaattcaactctgcccccaaaccagcacgtctcaaacctgagtgaatgagaaccatcttcctcaaagttaggatgaacatttgtagtgactgccactagaggtgctactccccaccccaccccactcacactccaccccaagccactcaccattccttccatctacaaagactgacttcatgggaaggaggttgataggtaagctcttcccaaagtcttatactcctgagtgctcattatagattacagtcccccaacaaggcctggctctgtggagagatgttgagtaagatgtccaaagaatatcactggctgaggattactcttcctcccatcaccaagactcttggcagctatgctgcccaccacagttgccatcaacaccttggcccctcctctggcccaagcaccctgtcagtgacccctttttgccaaggggacaaagcccagtttcctctgaaaatagagtcaggattcaaccaatcccaaaactgccagccaggcagaattatccaaggccacatccaggatgtactatgggttcatcctgacttcagatcagacataccctgcattgggaaaaataaaccaaatttgaaatacattttgaactcaaaatgatcatctatgggggcacttactaaaaatatggttattctaaagctcctaatacagagaggatatctttaatctttataattaggaagagggcacatgacaagtttctctttcaggtgctgggttagctaaaggcagcatgtagcctgaattatagggcaaagatactacatcccaaagatctaacagaagtaatgatcaggttgcaacagctgctagcaacctagtgatgttgaatgctaattacttttcattatttaaaggaaaagccatggggcattttaagagatgattcacgctacaaatatgtgtacagttggtattttttactgttagccatatacaatcatcatgaggaaatttcatgacttttccagtgatttttcatattaatataaatataaaaagtttgtttccttcccacctcccaggaaaaagaaaagaacaaaaattccagaatagttttttttaactaataaagaagtgtatataaatgaagagttccagaaaaatctcagagttgaaatttctgttccaaccaaatggaatttttgttttgttttgttttgcaatttgggaactgaagcccaaagctattaatatttctacgcggcctctgctgctgtaaatgtaaatagaattcctggtgtctgagtcctctggcttctcatctctttgcgctgacctctgaaagagcagttgttccttccttggctctcagcccttaacccactgcaaggacggagcacatgggatgaagtgctggtgttcaaggagaattgcatgctcttcaagactatacacacatatacacatatatacatacatctgtttgccaccagctgagggactaggaaacacacagcttagtgcaactggagaattacagtgaataatagtgacagattgtaaagacaggcacctttattttactgactcagcaattgtggcctggaggagctgagtgtctggcccacagctacacaataagtaatagagccaggtgccagactcccattccagtgctcttgccatccctcccctccacctaagtctatacagggatggctgaagagaaagtgactctgcagatatgtttaatatgggaacagtagcattcagcagagtggcatgggggcagccctgagaaacctgtctgcaaagatagtatttctctagaggccatgtctcaatatagcagccacacagaagcaaattcatgagcgggcaaatatttgtcccctcttatgactgaacttatgccactgttttcacaggactattaatacatggcagcgtgatcagctcctgccacccctgtccgtgaccacctgccattctgctgtcagcatcaggtgccatcttctgccatcaatataaaatgaaggaaaagcaccggagacacattatttgaaaagggaaagagtagccagggtttcaacttcttacacagtaagagaaacaaatatgtgatgtgagggttccaagtaaaaagtcagtccacgaagctgtgctattataatgaagcagggttaactgaacccaggaactgatgcaaatggcagaagtgacaatgttgactgtatttgtagcacactctgtctttttcatgtcacagcccttttcatgttgtagtagttttcattaaccacaagacaaaccaaaacaacctgccatctttgactcattaaaaacagaggaattcaagcctatttcaaaacacatatcacctcaaattcataagacagagtccaatttttttggatagctgaaaaagtaaaattcacatctatgcaaaacttaaaaaaaaaaaaacaagaatatatgtgaagaaattcatcctaaatgattatttagggaattctcactgacttattttgctattcttaacaggtctttgttctttctctgtgtcccctactaaatctagcatgaaatgtacacccaatcagaaacccatcaaatggatcatgttggcccctaaaatcaggatataaatgcattcttagaggtatttcttctacataattaatgaaaatttcagaatattttcaaatatttagtatatactcatcacctgtgatcagccaagtactgttataagcccaggagtacagcagaggaaaaacccatgcacttgtactcatggagcttacattctgatcacaaaaacaaataaaaatgcatatcaggtggtggccagtggagaataatcaaggttaaggatttaatgagtactgggcatgctattttaggacagtcacagaacagttctttgataagattagcatctgagttatttgagggattgatccatatggatgtctaggtcagaacagcagagtagttaaatacatagtccctgaggcaggaatactgtaaactgcaaagaatagcaaggaagccagtggggctggagcagagtgagcaaagatagagcaatagggattggggtgagagagacaggagaagccagagctttaacggccttgtaaaataagaacagggcctttggattttttatccagggaagtcactggaaggctctggggagaggattgacataatctgaaggagatcttgaaaaaatccttctaaattcaacgttgagaacagagtataaagagccaagcatcaaaagcagggagccctgttagcctactgcaatagtccaagcaagagatgatgggggtttggactagctgatggggaagactaaaactgaggcattctcacacattgagtgagaaaactcaaaagtactgttttaaacatgttaactttgagatgcttaaagaaggaagagcccacaaatcaatatgtataacaaaagatgaatttacagcaaaggagagtgatatggattggctgtgtccccacccaaatctcatcttgaattcccacatgttgtgggagggacctggtgggaggtatttaatcatgggggcaggtctttcctgtgctgttcttgtgatagtgaatgagtctcatgagatctcatggttttaaaaatgggagtttccctgcacaagctctttttgcctgctgccatccatgtaagacatgaattgctcctccttgccttctgccatgattgtgaggcctccccagccacatggaaatgtaagtccattaaacttttttcctgtataaattacccagtcttgagtatgtctttattagcgacgtgaaaacagactaatacagagagtgtacttagaaggccccatttcttggagctaagtggataggaaaatttaggaaaggccaggtttcacaaggctgtttggggattggttgatttttagctgtggaaatgcggctcccaggatgtgactgtcagttacttcctggctctcagaaacttatgtactcatgagaaactgtcatttattgatttggccaggtttaaaactggttctggtggttacctgtagccaaggaacaaccagttctttcctgggaaggtaggaacattttcacttcatgcctattgacagccaagtgaatgagctacacaagaagcagtaagtctggttaccaaagtgatacttttccctggtgcacacctaaaacaaattttaaatgtgcattgattagtaaagaacaagggaatccgtgaggcattagagaaaagagtaccagccatggctttgtctcaggaccttggaccttacctgctcatctcccacatctatcaaatgaggcttaagaaggttttcttcagagtccattctacctctataatttcatgacttttttggtatatatagtcatcccttggtatcctcaggagttccaggacacccacggttaccaaaatccacagaacctacacatattctcacatgtactataaatcatcttagattactcataatacctaatatgacataaatgctatgtaagtactttttattgttgtgttttttattgtttttcctgaatattttttaatctgcagttggttgaatctgatgatgcagaacccttggatatcaagggctgactgtgcctgtgtgtgtgtgtacatgtgtgtacacatttacctaaaataccctagataatattgcatgagaaataataatataagagctagatatttgctccaagttaggtgatgggaagaagggaaatcatcatttgcttgaggactacatgagatcttaggttgttaaagcttatttgcttcatgtctatgtttaaggttgtgaagctttgagtaaaagagagaaaaaaagacaaatttcattctcaaacaatgatccagctgtttaaaaagttctactctgggtaaaagcagaatgtagttttgtatgtgcataataatctatcagataagtgaaggaaaaaagcataaaattgttaaaagattagaaggaaatgtagcaaaagttaatatagctgtttctaagggtggtataaatagtaagttttcatgtttttataattttctgtgttttccaaaatttttaaagcaatcaaaataatttaatgcaaagaaattccaaatgaacaatcttagcctcaatgttcacctaacaaaaccagtgtcaatggctcgagcaggggataaaagactataaagaggtggagacggagtgcttcaggcagaggactaccacggtcaaaggatcagaggtgacaaaaagaataactttcataggaacagaaatttcactctgacctcaatgagtccaggaaagacactggacagaataaagagatgaggccaagaaggaacaagatctcaaagaactatgtgaaccaactaaggaataggccgttataacattttttagtacctaaagacacaaacctggctggatgcagtggctcacacctgtaatcccagcactttgggaggccgaagtgggcggatcacctgaggtcaggagttcaagaccagcctggccaacatggcgaaaccctgtctctactaaaaaatacaaaaattagccaatcgtggtggcaggcacctgtaatcccagctactcgggaggccgaggcagggagaatcgcttaaacttgggaagtggaggttgcagtgagctgagatcaggccactgcactccagcctgggtgataaagtaagactctgtctcaaaaaaaaaaaaacaaaaaaaaaaaacacacaaacctaagacttttgaggccttaatgaaactttatctgtgcccagtctatggtgctaacttgaacatctgtctctagggaggttctgaactatctgacaggctttaccaaggtgaccaggcttctcctttcttaggcaataaggaaccttcaaaggtctctattggcctctgtactggctgaagagataaattcacagaaaaagcatctcttcattagcttcatctatttcaagaacttattcaaaacactgaagagattgtccctgcatcctaacttctggtcctctcatctaacctccctctgcgatggagtctggatagtcaatgctgaggaccaggtaaagcttgaaaggaaaagagtcacttgcttcatgatctaggtcctggagcagatattgataacgaattgtctgatagctaaacacataactatattaatcctcttggttataagtatctatgatgttctcagaatactttttatgataatttctaataacgttgtgatgttttctcctaattcaacaagttttctcttatacatcgtggaaacatttctcacctagacttcctacagactcatttccaaaattcttcaaatttgtagcagatatctcaggaaactggggtataaaataataaggatactaacttattcttttcagaaaagtaaattaatttttttgcaaataaggtcatactaaatggtttcttccaactcattccagctagaatgagtaccttggacaagtttacctacacaaaagttacaggcaaaggaagaggcatatgctggttattctagaacgatagtaccagaacgaggccagttaagtaaagccacttcaaaataataccaaatttcatattaaagagcaggaggaaagattgaaacaacatcttaaaaagtaaattatgaaaccaagatgtattttattttacgtttaacaaaatttaagttatactgcaacattgccctggtaactagagcaaagcaagaataaactctgctgacatttttggaacactttttctgaaaaaatattcatataacatgatccaattctttctttacttttgattttgcaagaaaaagaggtttatttttgtgaatatattggaaggattcattattttttcccaaagttctctcctattctttgtttttccaaacataccttcatcattttccttgttaacactctcttccttcattgtcaggtgacctatttctgcctgagtcttgtttgtcatattccaccagctcagctccatcactttcaataacttcataaaattctacaacttcagccagatttgcaagtttgtttcacaaatacataatatttgccttgtaatacggaatcttcacgtcagcaaggaatggactaacaaagaggaattccagagaagcagatatacacaagagatctctgaatagaggtcaattttataagaggtcaattaattagagaatatgataatgttttgacaacttccctacacagctcataacaacctggtcttggataccaacgccctttgtacttacccgttcaggcagatgagatggaaatggaatcaaactctactacacacaaatgacgtcacgagagaaaaaaagattggaagaccacaatttgtttccatatcttgccacaccttgagattcgttaccaggagtaacaattcaagagagctgactaggggcattttgtacttgcttcctccactaagaagaaccaatatagtgagtagataattatgcttcaaataggtcacccaagagagaatactggaattcagtagaaaagtggcaggcaatacctaaagtaaagaaggagaaggaagtaaggaagcctgcttagccaagatcagctgtgagccaaggaagactacaatacagggaaagggtgagtgagagaccctcagtagtccacattatcaccatggactcctgcaatcctagccatgggagagctccttgacccatggccaggtgcggtggctcacacctgtaatcctagcactttgggaggctgaggcaggcagatcacttgaggtcaggagatcaagaccagcctggccaacatggtaaagccctgtctctactaaaaatacaaaaattagcccagtgtggtggcaggcacctgtaatcctagctatttgtgagtctgaggcaggagaatcactcaaacccaggaggcagaagtcgcagtgagcccagatcgcatcattgcacgccagcctgggcaacaagagcaaaactccgtctcaaaaaaaaaaaaaaaagaactttgtcttcaatagactgaatgctatcctgcaacccagtagcaccagggctgaggtgcgggagaagcatgagctgctgccctcagggcttaggcacaagcaaccgtgggctaccatacccaggtaggaggcatgatcaagatgcaggctacaaccagggctgagcaaggcaccattctagagccctacccccaacagagtatgcactatcctggaagccagcagtgctgggacagaggtgcaagagaagagctggctgttgaccccagggcttaggaacaagcaaccatgggctaccatacctggggctgaggcacaagtggcacacatgcttaacatctgctggcctaggctgccatcactaaaaacattgcctctccaccaacaccacccagtggcattctgccagtggcctagaggttgccccattcctgcctaccatggccaacacctgtacacagaactgcagggccctgaggaccagccagcctagcccagcttcaccctcccctccatgccagagcatacagtccaagggccaggggattgcccagcctagtctaccaccactggcacctaaaccctcctcccaagggcctgaagttgagcttacccaccaagccactacaaccacagctggcacctaccagcatgtgctgcctgcaggcctggaaactagtgtgcctagcccattgcagccaccaccaacaccagcatgcattacttgggacttagaggttagtcctacaactgccactaccatcactcaaacataccagctgctcaggggcatgagaacccttctacctgtccagcccatggttgtcactactggcatccaagtaagccacttggaggcccaagaatagacccaactggacctgctaacactagtggcagtgtatgccatctagggtccccaggataggcatgatatcccactgatgcctccccaggagactgaagactagcctaccttgtgtcccagtctccaccaaaactacaccccagcctccaataataactacagcctaagccactggggaaatctcagatatcactgacactgtttatagagaaagaaatcatacagagactgcacaactgtactcacccagaatcaaaaccaaagtaccctacccaaccaacattatagattcatcctcaggaaaaaatcttcccatatgaaagccaattttaaaaattagaagtgactattataccagatgtgcagatgtcagtgtaagaacacaggaaacatgaaaaagaaaggaaatatgacacctccaaaggagaacaatgattatccaacaatagatcccaatcaaaaataaattcagaaaatcatggaaaaagaattcaaattgtttcaaaagaagttcagtgagatataagaaaagtccaaaaaatataaataaatcagaaaaacaattcaggatacaaattagaaatttaccaaaaacatagatatcttaaaaaaagaaccaaagtggctgggcacggtggctcacacctgtaatcccagcactttgggaggcggaggcgagtggatcacctgaggtcaggagttcaggaccagcctggccaacatggtgaagctccctctctactaaaaactacaaaaattagctaggcttggtggcaggcacctgtaatcccagctacttgggaggctgaagcaggagattcgcttgaacctgggagttggaggttgcagtgagccgagaatgcaccattgcactccagcctaggtgacagagtgaaactctgtctcaaaaaaaaaaaaaagaaccaaataatactagatctaaagagagagatagactctaatacaataatagcgagggactttaaaacccccactctcagcagtaagcagaggttctaggtagaaaatcaacaaagaaacgttggatttaaactggacattagaccaaatgaacataacagacattaacaggacattttatccaacaactcaacaactgcaaaatacagttcttctcctcagtacatagaacattctccatgatagaccatgttaggctaaaaagtaagtctcaacacatttttaaaaagtgaaatcatatcaagtatcttctcagagcagaatggaataaaactaaaaatcaataacaagaggaactttggaaactacacaaatacatggaaattaaacatttgctcctgaatgaccattgagtcaataaagaaactaaaatgtaaatagaaaaatttcttgaaacaaatgaatgtggaaacacgacataccaaaacctgtaggacaaagcaaatgctgtactaagaaggaagtttatagcaataaaatgcttacatcaaaaaagtagaaagattttaaacaatctaataatacacctcaagatactagaaaggcaagaacaaaccaaaccccaaattagcagaaggaaagaaacaaaaaagatcagagcagaattaaacaaaatagaggctaaaaaacaacacaaagcatcaataaaacaaaaagttggttcttcaaaaagataaacaaattaatgaatcgctagctagactaacaaagacggaaagacccagaccaaaatcagaaatggaaaaggagatattacaactgacaacacaaaaatacaaaagatcatcagagactattatgaacaattatatgctaacaaactgaaaaacctagaggaaatggataaattcctagaaactacaacttcccaaggttgaagcaggaagaaataaaaaaacaacagaccaataatgagtagcaagattaaataagtaataaaaattctcttaaaaatgaaaagcctaggactggtggattcactgctgaattctaccaaacatataaggaagaactaatatcaatcctcctgaaactattccagaaaattgaagaggaaggaattctctctaactcattgtgtgaggccagcattaccctaataacaaaacaagacaagaatagaacaaaaaccatgaaaactatagaacagtatccctaatgaacatagatgtaaaaatcctcaacaaagtactagcaaaccaaattaaatagcgtatcagaaagataatacattatgaccaagtgggatttacaccagggaaacaagaatggtttggcatgcaaaagtaaataaatgttatacatcacatcaacagaatgaacgataaacaacatatgatcatctcaatagatgcagaaaaagcatttgataaaatccaatatccttcctgattaaaaactctcaacaaactacgcatagaaggaacatacctcaacataatagaggccatatagaaaaatatcaacttcagccaatatcatactgaaggtttttcctccaagaaatggaacatgacaaggctgtctacctgcaccactcaaattcaacatagtactggaagtcctagccagaacaataagtcaagacaaagaaataaaaggcatacacatttggcgggggggaaaggaagatgtacctctttgcagatgacaggatcttatatttagaaaaaccaaagactcaggtatgaaaactaaattcagtaaagttgcaggatacaaaatcaacctacaaaaatcagtagaatttttatacaccaacaatgaaatagctgaaaaagaaatcaagaggacaatcctatttccgatagctaccaaaaaaataaaatacctagaaaaataatgtgaccaacgaggtaaaagacgtctacaaggaaaactacaaaacactgatgaaagaaactaaggaggacacaaaggaaagacattccatgctcgtggatcagaatatcattaaaatgaccatactacccaaagtaatatacagattcaatgcaatccctatcaaaagatcatatttcacagaaatagaaaaaaaagaaataaaattcatatgaaacaaaaaccagaagagccaaagcaatcctgagcaaaagaacaaagcaggacccatcacactacctgacttcaaaatatattacaaggccatagtaaccaaaacagcatggtaatggtataaaaccaaacatatagactgatggaacagaatagagaaccccaaaacaaatccacatatttacagccaattgatttttaacaaaggcaccaagaatattcactgcaaaaaggacaccctcttcaataaatggtgcagaagaaattggatatcagtatgcagaagaatgaaactggacccctatctctctctcaccatatacaaaaatcaacacaagatggattaaagacttaaacattaagattcaaaactatgaaactactaactaaaaacagaaaacactttcctatgaaacataggaaggtgtaggcaaagatttttttttagggttttgattgctagtttttaatgtttttcttcttttattattatactttaagttctaaggtacatgtgcacaacgtgcaggtttgttacatgggtatatatgtgccatgtttgtttgctgcacccatcaactcatcatttacatcaggtatttctcctaatgctatccctctcccagccccccaacaggctccggtatgtgatcttccgctccctgtgtccatgtattctcatagttcaactcccacttatgagtgaggacatgcggtgtttggttttctgtccttgtaatattttactgagaaggatggtttccagcttcatccacgtccctgcaaaggacatgaactcatcatttttatggctgcatagtactccacggtgtatatgtgccacattttctttacccagtctattattgatggacatttggattggttccaagtctttgctattgtgaatagtgccgcaataaacatacctgtgcatgtgtctatagtagaatgatttataatcctctgggtacatacccagtaatggggattgctgggtcaaatggtatttctagttctagatcctagaggaattgccacactgtcttccacaatggttgaactaatttacactcccaccaacagtgtaaaagtgttcctgtttctccacatcctaagttatttcctgactttttaatgattgccattctaactggcgtgagataatatctcattgtggttttgatttgcatttctctgatgaccagtgatgatgagcatttttgcatatgtctgttggctgcataaatgtcttcttttgagaagtgtctgttcatatcctttgccctctttttgatgggcttgtttttttcttgtaaatttgttggaattctttgtagattctggatattagccctttgtcagatggctagattgcaaaaattttctcccattctgtaggttgtggtctaggcaaagattttatggctaagacctcaaaagcacagacattaaaacaaaaatagacaaatagaactataatatactaaaaacttctgcacagcaaaggaagcaatcaagagagtgaagagacaacctgttaaataggagaaaatatttacaaactattcatcaacaagcgactaatatccaaaatatacaaggaactcaaacagctcaatagcaaaaaataagcaaattataccattaaaaagtgggcaaagttgcctgttcactctgaggatagtctcctttgctgtgcagaagctctttagtttaattagatctcatttgtccattttgacttttgttgcaactacttttcgtgttttaatcaggaagtccttgtccatgcctataaatgggagaaaatttttgcaatctacccatctgacaaaggtctaatatccagaatctacaagaaatttaaacaaatttacaagaaaaaaacaaacaaccctatcaaaaaatgggcaaaggatatgagcagacacttctcaaaagaagacatttatgtagccaacaaacatatgaaaaggagctcatcatcactggtcattagagaaatgcaaatccaaaccacaatgagggctgggcacagtggctcacgcttgtaatcccagcattttgggaggctaaggtggaaggatcacgaggtcaagagtttgagaccagcctggccaatatgatgaaatcctgactctactaaaaatacaaaaattagccaggtgtggtggtgtgcacctgtagtcccagctacttgggaggctaaggcaggagaattgcttgaactcgggaggtagaagttgcagtgagccgagatcgggccactgcactccagcctgggccacagggcgagactccatctcaaaaaaaaaaaaaaaaaacccacaatgagatagcatctcacgccagttagaatggtgattattaaaaagtcaggaaacaacagatgctggcgaggttgtggagaaataggaacactattacactgttggtgggagtgtaaatcagttcaaccattatggaggacagcatggtaattcctcaaggatctagaaccagatataacatttgaaccagcaatcccattactgtgtaatatccaaagtattataaatcatgctactataaagacacatgcacatatatgtttattgcagcaccattttcaatagcaaagccttggaaccaacccaaatgcttatcaatgatagactgtataaagaagatgtggcacatatacaccatggaatactatgcagccataaaaaagaatgagttcatgtcctttgcagagacatggatgaagctggaagccatcgttctcagcaaactaacacaggaacagaaaaccaaacaccgcatgttctcactcatatgtggaagttgaacaatgagaacacatggacacagggaggggaacatcacccactggggcctattgggtggtgggtggcaaaaggagggagagcattaggacaaacacctaatgcatgtggggcttaaaacctagacaacgggtggataggtgcagcaaaccaccatggcacatgtatacctatgtaacaaacctgcacgttctgaacatgtataccagaacttacagtaaaataaaataaaataagtgggcaaaggacatgaattggcaactctcaaaagaagacatacaaatagccaacaagtatatgaaaaaaagttcaacatcactaatcatcagagaaatgcaaatcaaaactacagtgagatatcatcttaccccagttagaacagctatgattaaaagacaaaaaactaacagatgaggatgtggataagagggaactcatacactgtttgtgggaatgcaaattagtacaactgctgtggagaaccttatgacgatttctcaaaaaaataaaaatagaaccacatgatccagcaattctgctactgggtatctatccaaagaaaaagaaatcagtataacaaagggatacttgcactcacatgtttattgcagcactgttcacaaaagcaaagatatggaatcaaccttagtgtacaccaacaaacaaatgaatttttaaaatgtagtatatatataaaatgaaacattatttggccataaaaaagaaaaaaatcacatcatttatagcaacatggatggaactggaaggcattatgttaagtgaaataacccaggcatagaaagacaaatattatgtggtctcactcatacatgggagcttaaaaaaagtcagtctcataaagatagagagtagaataatagataccagagtccaggaagggtgggtgagtgcaaggggggataaacaggtaggttaacgggtacaaatgtattgttagatgaaaggtatgagttccatcatttgacagcagaatcgcgtgactatagttaacaacaatgtattgtctatttcaaagtagctagaagagagttctcaacacatagaactgacaaatcctcaaagtgatgtgggcacctcaaataccctgacttgatcattacacattctatgtatgtaacaaaataccacatgtaccccataaatatgtaaaatattatatagcagtatattataaataaatactattataaaaggatttttttaaagattagttaccattgtgtaactagcagtaaccccaggctcagggatgatactttcccttgtcctttgagatttactgtgaggtatttgcagtgttaccttatctgactctggattaacaagtcttttccagtttcagatgccatctggcaatttcattctgagaatgggggagtaatcacaaatcaatcttaggaaaacacagaaaggaggtgtccacaaatgtgatttagggaaaagctggagttggggtaagtaaaatagaagaggaacattatcaccaattgggtagacattgagaaatgagttgaaaggggtcacacttcacaaatgagactaaattcccaataagtcatattttcagggcaaaattgagtagcataacacgctgaatgtcttatctacaaccataattggaccaaggacccaaattcccacccacccctcaatctcatgcagcctttagttagttgtgttaatacaaattgtgtatatttagtacattttcctttattgtgtaattgtcttgctgatctgagtagaatttgagtccccagggagaagaggaccacatgtcctgttaatttttttaatttcaccctcctgtccttcttcaccacttacttcctcccttccttgcacacagtacatgcttaccattttgtttatcaaattgaatctaagccttcaacccaacactaaatctcatgtttgcaaagaaagggcataacaagccatatcagaaaaggtcctgaggtgtaattcttctataagtctaaagttagaagggaagaaaaaaaaggagggatgatcctggctattttagcaaggttacatggggtgaggcacaatggaaaacctttatatttaagccatcttttacccaatgcctttagaatagaactgaacataacaagctgtcagcagccacaggatgacataaaaggatgcccttgatgttcaacattcctgaattccatctcatactatgaaagcaaagagatctacaattatctcttcctagtttgaagacttccaggtactgctcatgttacaagccagtaacttcatccagcctaagatgctcctttaatcactaagaatttttaaacaccctgaaaagagatctctcgactttagaattgttgagatctttttcaactagttgatgccaaccagtgcccggttattttccctaacaatttctgcatctagtgccttcccccaaagtattgacccaataaatagtctactgggcatctcttgaagagtccatgtgagctggctttaaaaaaaaaaagaactttatttcctaataccaccttatgcataatgattctgttattaccattgtttcactccattcaatctaagcagaaaacagttgaaatatatatgtaacttcaggttctttgcagtgttcattaatctttgaacaatctttgaatgtgtaatcgagaactgaacagtgacccaattacataaccttggtaaagattttaggcttcttgtataactgaacagtgacccaattacataaccttggtaaagattttaggcttcttgtatcatctgagccagtctaataatcctctgcttaaattaagtacaaagggatgacagatgcagtctcaattctgtattgttttaaacaaaagtaatgtattggacagtcatttaagtccaatacttaaatacataatactaaatgaccccatctaaaagatggagatatgaagtcatcacttaagcacgtattgagtagctgactcgtcatggaggacctgtcagaatgctgttctacttaaaatcagctattgcactgggccaagtcagagttttattttgatcaaggtattaaattattaatactcctatttttatttttcaccatagaaataatgtttttccattttcactgggatggaattcacatatctcaatcaaatcacaacaaagtgacaaggaagatttaaggttctttataggcatttttcagctgatgcatctgtgaagagtatgcgcctcctgaaaagagcaaaagacaagaccctataatgacacactgttaggagcctcctttgcatctggcagcagcatacccagctcttctatgaagcagctcagaacggacagaaaattcggacctgactgcaatccagcaacaatcaatggctccctgaaaacccctgatatttgtgagagagaatccagaggacttgttaactaatccttcctctacagtcccaacactgcacctgtgttaagaaggcaaagaaaggaatgttcgatttggtcctgaaaagaaacatctttatgaggctgtggctggatgttacacactcatcctttctttcctcaagatcaaggcttgcgcagtccatttaatcagtcattaaatcactgcaaaagtgcagcataagaatgttgtccgtggtgttgtccaatgtctctttcataaggtcccacacaataaattcctccttgagtatccaaactcaaagaaaataaagaaaacatgataacgagtgttttcccatttttccttatctgtcataaaattcagctaaattcagtacctaatcagtgattttaatgagatcatctgtaatgcctactcatttgcctccttctttcctttaatgacatgttcaatcctgtaagatgtttcaaatcatgttctagagacaagatagatgacatatgccactcttcagtaaaagcctgttttccaggaacaatcttacctgcttatgagtctatttttcaccaaggcggtaaagatctcctgaaatagtttacgctgaggatgtttgctgaaatttctctcattcttgtagtttatactgagacaaaacaaacagaaaaggattttgtaatagagatcaggctgtctcaaagttgccagtgcagacaaagatcatctatattcaggtaacatttttattattactaaccactatactaatgaggattcaggcaaatattgaaggagccttgcgtttaacatgttgctaaaagcaactatcagctgttaaaataagaagtagaaattcaattataaggttaaaaataaaatatagtcaagcatatgtatttccttttatcatattcattaaattattccctataaacactaatggctaaaattggttggagggaagaaaagggtaaatggagagaaagaatgattggggcacattatttagacagctgtgtaacaggaagagaagaattccctctccacttttccacataccctcgaccccactggctgatcttgctatcaacaccagtggttatcatttataataccttctagataagaagagtttattaacacagtttatgcaccttcagccatgttgactgtcactgttgattgtttatatggttttgtgtgtgtgtttaaaaaattctgagatattccagcttcagcttctttttgctgatcttacagcccaccaaagaggttaaaaatacctctaaaacattctattttaaaactagaaaaggataagaaaaaatgaaagggtcacattgctaccaaatacatgatacaatatttttgtgcataattaaataaaactaattttcagatctagaacaaataagctggaattccatgaacatacaacctcaaaggaaaggtgtgtaaccttatgttgccatgcgtaatgttctgccttctcagtctttcagatgccattggacagcatgtccccatcctagtcacctgagggctgtaatggtttcttagtacacgggcactggtactcactatatgacaattttttaagtatttaagtgttcctcactaaaaatatatttttaaaatatgaacacatgaaatgtcatgtaactttcccatactattaaatttgttgtcataagatgacagggaaacaaaaacaaaatctaggccaaataaacaaatgatccttctagaatattcatattgatatttcatgccactcactatttacatggtacttagtgccaaatgacccaagcacactgtaaaactgagagaaccagctcccgagaggggagtggcccacaagaatgtgtagctttgcagaggtctgcttggcaacagagatgaacattacctgacactttcaatgttagaggtgtgccgcaagcccttcaactgaaaacctcagttgttttgacaacgatatactttaaccaccacatctgttcacagcaacggctccttttatgccatctcattactggcaagatctagacagacaaagattgggacaagcctaaccaggtcaataatctggaaccacttcctcattgagcaatgccaaacgcatgtcagcatagggtcctaaatctcccaggtcagttccacctgtacccattaaacctgttatttacatattatttctgggaatggtttaagcactaactgaaaatattaaattaagaatcgctatggtaaattttgaagcgggttttaaattttagctcctgggataaacttaaataaaactgtgagctaagcagaataagttgctgaagacgaaggagatgctggatttcttacctaaaattttcaagttcaacagcttctgtggattcatgccactgaccccgagctctgtgtccacccgccctgatggcgggctcagacttcgtcatgctattttgggcactatcgaagttaatggctggaagctacagaaatagaagcatagagtacatgaggatcacaattcagcacgggataaagaaagtaacaaaatatggggaggatgaagagactgagattttttccaggccaataattaagataacaaccctttcaaatgtaagggttttccaagattcaaatcaagtgtctttgacttaaacatctaccttacactgttttatttttcttcatagcttgtaacaccacttgtcatatctgacagttatttatgtacttttagtctcccttgattacaatgtcacgtcaacacaagcaggaacttgcctgtttttgttcaatgctattaccccagcacctaaaacagatataggtttggggtgacacctgggcatcaggaggttttgaagtttctcatgtgattcaaacgtgcaagctgactagagagctcctggatccaggtagaacactctgatatagagcagagtgcccaaattgagaatgagtcatcatacattcattcattcttcaatatttaccaggtgtacacactattttcctggtgttagggatataacaataaagaagattctaccacttttaatcagtctgaacatcctgattactcaatcatatttataaaagacattaaaatatattatcaaatttaccataagtaaaaatttaactacaacaacttcactatgcttcacttgcaataataaattgtcaggttatcagtattcaaatagtttcacttaccagtatttgtctataattggggtaaccctaaggtttctgataacacaataaagttgggcatggtatagacaaatatcctgttttttccaaagtacaaatgaaggacgttctataattagctaaattattacagatgaggtaagcagagtataacataacaaaaaaatcatttttcagtaaatttttccattttatatattaccaaagttataatatgttgcacttgttgtcttatttcactgaagtatttaatgtaaatcagtatgaagacatcattttcagccaggcgtagtggctcatgcctgtaatcccagcactttgggaggcccaggtgggtggatcacctgagttcgggagcctgaccaacatggagaaacccgtctctattaaaaatacaaaattagccaggtgtggtggcacatgcctgtaatcccagctacttgggaggctgaggcaggagaatcacttgaactcaggaggcagaggttgcgataagccaagatcgtgccattgcactccagtctgggcaacaagagtgaaactccgtctcaaaaaaaaaaaaaaaaaaaaaaaaaaagacatcatttttttattcaaagagaatatgcctgactttttataatgtcagcttacagaaaaatggattataataaagacattgtttaatagttaacaaaaaaactaaaatccttttttatcatatgccagccacagtcagattttcaaaatgttaataataaatcttccatcctataaaactacttttctatctcaattcggtcagccaatctacaaccaccaaaagacaataggctgagccagcaatgcttagtggttaagagaacaaattccctggccagattctatgaatttaaatctaccattaactagctgcataatcttagaaaatttactcaatctctctgtgcatcagtttctgtatcattaaaatggaaataataatagtatataactctagggttatgaaaattgcatgagttactatttataaaacacttgttatgtgtcaagcatagttctaattgctttgtacatactcttttaatcctcataattattcctattatacagatgaattttgctaaacgaataaaatttgtcattacaaattaggtgatttctgaatatgaactattaatccaaatgatatctaacatgaagtagcagcacaagcaaattttcccatattatactcaaaatatcatgatataccgcataaaagaagtaggttttccaggcccaagagattctaaacccccttaccattagtacaactcctagaaaagtttgcaagagagaaattagccagcacagagaaagcaagcccaggtgattccaagagaggagtggaaagctgccgcagcttgcagccattccctttgcaggcagagcaggtggcctgtatcggaaatcaactcatggaaaacgggtggataagatggatttggcatcgatagttgcaaagaccaggaacctaatagtaggcaccttgaagcaagtagcacttcatatgaaagaaatgtacattcagaatccggttcaaaacctagagtcttttctcttgggtccccagtttgtctatcttctgtgtgtctgatctctccacacctgggcatctgcagcctgttactcctgatcttgggtcagggtgtgacttaacctcctgacaagcacttgcccaggccttcctggatagagttgttcattcctttcctggtggcaataccatgcttacctctctttcaaaacttatctcaggctagtataatgtatagcttacgcaacatcctttccccttgaatttggccaccctgagggcagcatcacatctattaatctttgtgttcttagcacctctcacagagctgggcatattgtaggtattcaaatgtgaagctgtggaacaaatgctcactttgttcccagtctctttgccaaactaattcatctgctaaaccaccttcagaaaagttcatccattaattcagtgtatttgttgcagacacatcatataccagacattgcttgagacactgtatatatacagtaagcagaacagtcatggtctcttgtcttcaaggagcttacagtcccatgggtcacggaagggggttgcagtccatggaccagaatgtcaagaaagtcgtgtcacttctgcttgcaaacttcaacgttctctgttgctgatggaatcaagtccaaaattcacagataggctttcagacattacatagtgtcttccagctttatttatcgaatagaaatgtctagtcacccttttacttaaatgcttgtcattttccttccttcagatatttgattattttactcacttcacctagaatgccctttctatcaattccactgacggaaaagcagcctattttttaagaaccacctccttccctgtcattcaagctaaaattggcttcctattcctcaaaagctatatgctcactgcatgcatcattcaaccaggatggtgtcttgccttataccataattatctgtgcctactcccgctctctcaaaacataagaaccaccaccatgccttatacgtgttctttctacagcatctatcaaaacctttatttcaagacaattaataagcccataacaaattaattttcttctttcttccatctttttttaaaattccaaataaattccttagcttcctatggctctaaatgtggaggaagaaaataatctgaattccaggtctcatcaggttgcttcaagatttgtgaaaagctctggtgacatctccaatcagctttgtagtttcactttgcctcagtaatcctggggcagttctttctcttgagttattgggttttcctggattatgattattctaagcctgctcatcctgaaggaggcctttctgcctctgtgtgtctctgtctccagttctgtcacattatgagactgtcctagagatatgcagagatacacagagtgtaggtcaggacaaagaacaaaagtagaacactggaacacaatggaacaacaggggaagtagcctcgctccttagagatccagaggaagggcattcagttctctgcactctctacctacaaggtagatttcctctgtaacctgaatttggccagcctggttcatttgcaaaaaacaggccacaacttgttagcgcagaaatgcagctgagtgggccttaatcacaggtttcacttttcaaattgagtactgaaaatctccgaaccaaatatgttgcccatgtgtatattttgttgagcatttctgcttgaccccaactctactttgctcccaacccttgtttttctcttattttgggccctggttttaatgtatgacaacctatcacactttctgtctctttataagctcttaatgactctttctggaacaagcaaagtataaataagtgtaacttgagttattttctccaatatcttccctccctataaatgtctccacattattttaccaaaaggagaacagggtaacatttcttatttcaaaattacaaatgaatgaaacttttataaacacaattaggcattaattttgtaaacctaaggatcttcattaaattgacagtatttttatttttttagcaccatctattttctgaataactcaagcattacaaatatacatttttgtacatgtgaaagattttacaaaaatatatgccatgtaaagttgtcccacaacagattgcaaatttgaaaattggttaaagggggaaaaaaatcactaaattaactttaattaagcctgccaggtgttatcaagcaagcggtgttgaaagggcacacgagagatccagtcagcataaacttcaaagttggaaaattagagccagaaaaactatattggtttttggttttggttttttttgttttttgccctggctaggaggttatacatcctcatgtggtgacccatttctcaagtcacaattcaatttagcaaaatctggccaagaactcatcaaatatagtgaaccagaggcaaaagtcaaagttgctggcattaggaaatacaagatcttgtcaggaaataagacacgtaaacaagagtttccaaagcgcaggagaaaataatgccacagcagtaaaagaaggagccttgggaagacagagatcacctctagaatggaaactatatggaggtaatatcattagagttgggtcttggaaatgggtgagattttataagaaagaaatttaggagaaggaaatagtaaaagcaaaaagtagaagtctttgatattatggttacatcacaggatgtacagtgggaaagaatgggcactacactccaaactgtatgcctagccatcttgtttgcctctttaagaaagaacggacttaattttgcaagtcatttaacaggtatctcagtatttagaagcacacactgcaaagatagggtgtctgggttcagaactagacttcaccaattaggaggctgtatgatcttgggaaagtcacttgatttctttgtggctgtttcctcatctgtaaaaatgggagttgtaattattaagcagggtaatgcaggtaaagcagcgggcacatagaaagtgttccctaaatacgaactatcattatttggcttttacatgccatcaaatcattttccagtataagcagataaaaatgctatagttctctggtaaatgtgattgatataacaaaaactgtcagggctggattaccaaacaccagagctcttaaacagatttacttaagcaagaacaatgtagactttagagccagactaccagggttcaagtcccatcccttccatttatgagttaaggtgctaaataagtgtctgctattttcattattattagcattgctatgctgttccccaagcctccctggatggcctctaatgtcatcactttccaaagtctcacaggtgcaaaaccaaaatgaaaagtttggagataaattcaagcagaagtaccattttttctctaataagaacatgaaaatgctactataaaaatagccaaaaatcactccttgcccctctgtttggtgaggtacattgtgcagcagcctcaagagtggcactgtagcaagggggcaggattgggaagagtaagggggaaggaggagaaaaatgtggtagaaagtgctttgaaaataacaatttccctaaagctcagaaaaccaaaggttggccgttcagtaaaagagtatgcagtttgtttacagaccgaagaggaaagggtttgctaagtaggacacagggtgagaagcataggctaaagcagggcctggcctgagagacgaatgtggatgccaaatcttggcaaagcctgaaccaggtgtcagagaaacagccagatgaagaaagagcaaagatgtgaataatgagcaaagaaaagcagacatatcattcatagatatgttaaatggagccctttggaaacatatgatttttcttttattaccaagtgaacattctttgaaaacgctacctgttgtttgcttgattggacgttcaaaaggcaccgaagtcttttaagatctgaatagtccctaggagagagaataacacaatgtgaacccacagaaggctccaggtgaacaagatcgtgttacccactgatggcattgccacttggaggcctgcttttatcaactggaatgaatacacacactaaacattttctttagaacactagaaatgaccagatgtttcagtaagcactgtaactctgaatagtagttgtcaagagtcttctctatttctcaaaaagccattaaatctgttcaatggccactgcctgagttaacaattagcaaacactcagtagggagttacctgatggtgatttcttgctgtttatcagttgatttttctgtggtcttcacctttttatcttgatcaggcattgtaaaacatcaatgccccagaattaacatcgcattcctttaaaattaaaccagagggaaaattttagttgggttgcgtgtgccaaaatattctcagttaatacagacaaaacccacttataacatctatttaaacatggaaaacctagatttagttctaatacaataataaaagtgttaatatgaataccacttactatttatcattcaaaggacattgggaacatttagggcatgctttaccctcactcaaaagataagtatgggtttgccagtagacaaagaacaattggtttgcttttatttttcttaatcaatttctaatgcaattattttaattttcagaatagaaatagaaagttgaagatgcccatattttcaattacataacaaatacaaaattaagtgtgttctatgggtttaatttgactggatgtaaaattttccaactgtgcttcaatgccacggtttgacttcaatgtgttgttcaggcatgaaaaagtatgcattattgtcttataatagcatgcttcaatgtattgtgaaatctatggtcaaaatccaagtgtttcagaagtatttagaggcaaaaggaatgtaccaatgggcatttcacttccactgaatctagtgaaatttaattttgtgaaatgctcaaagacagtttaaggatttaaaaatgattttcccaatatatttgtcatatttttgacaaatagttgggctacaattaagagccagggaccaagtctctcagcacaggagcacaacaataacaggtacaatattaacactttaggattgtaccaaggatataacaccacctctttcattcaacaaatatttattgaccctttactgtgcccactctcagactgaaaactgctaaaaggttaaagaagctattacaggtatgcgtttctaccacaagcaaaaaaacaaacaaaaacccactcgtgaactttaaaacatgtttgtgaggtgttcaggtagagatttagcatctatttttactctaaaagaaagaaagagaagggagaagggagagaaggggaggtaaaaagaatggaggatctgcaaggtagtgtttaaaagccaaagacccaagtgcttttaatatgcaaatacaaaaatgccccgtaagttctaaaataaatggaaatccattcaaaataaatagaatctaactttactcttccctcaaatacagaagaaatactctacatagccacactgtcctgctgttggcttcgaattcctgctcaaactatagctacagactatagtttagaagcagaaaatagaagccgcaatgacaagcacaggagagcctatggagaagctcacaggcttcttctgctagaaggggatcgcgtttaccactatcaaactcgctaaacaccctgtcttattctcttgcttaatttccataattgtattgaacaagtatgtgaacaggaaataatgatctaatcgttatatctgtttgagatcagcatgtactctgtgagctggaaggctgaatataaatgactctttggaaatgttgcacttaactaaacagtaaacaaattcaccagtatcagcagaaacagataattgtctttaggataaaaaacaaaatcctttccatttaatggctgcttaaatggagatattctgaaaaaaagctttgagaagttgggaatgctttaaaatagttaacctaatcccattttaaattaacaaaaatgattacattatactaatgtctacactataatacaaaatgggagatgggggaaggaagggcagttcatatgttaagttgcccaaaggcagacaatgtattaagaaagcattcccaacagaggtcaggcaagggtgctaacacaaaagctctctagagggtagctttggtctaagcccatggaggaatgctgcagtgtagattagtcctcagagttgtctaaactgagagaagtgagagcctggctctcatattcctgtagccttcagtcataactccccaggcactcctctcttgtggtagtgactccaagtcacttagaggcagtcctctcaaaaagacatacagaatctagctgttaaagcagaacattgaagccaatacgaggacacacagtcccaaggaatgggagaggctctgggcagagtgcccacatatatccactaaaatcaacgactccatgtggaagagctgtgggtaatgaaggtaaaggatctttgctatggatacaaactaagcagcgcctgctgcattagcttccaactactgagttgaatttccctctttctttgcttgacctcgccagatgttgttatgatctcatgtcctagcagctcagtccttggtcctcctcccttctctatctgccccctctcccaaggatctcttgcagtcccatggttttacataccatcagcaattataaatttatatgttcagccctaaccccattctgacctcctaaattcacaaagtcactatatggatgcctaatgagcatcccaaatttaacataccctaaacagaactcttgacccccaccccctagtaacaaatgcccctagtgctcctcatcttggtaactggtaccacaatggctctctagacaaaagttcaggggacattcttggctcctctctttcctctacctcccatattcaagccaccagcaaaactagttagctttcccttctttccactcctactatcaccctactccaagccaccatcttctctgcctggatgactgccacaaccccctcaagagtctctctgcttccactcttgctcctctacatcctcaggaaccccagggaatgctttaaaatgtaaatcagatcataccactctgtggcttacaaccttcctgtggccttctattggacttggcttccaaccatgactttcactgctctgagcttgcctcctcccctctccctcttgcttcctccacttcagccatgttggctttctagagagaaacatgaacccacgaacatgccaaatgctatggtttgaatgtctatcctctccaaaattcatgttgaaatttaattgccactaaaacagtattaaaaggtaggacctttgagagataattgagccaagagtctgtcctcatgagtgggtttagtgcattttacaaagggctttcaggaatgagttctctctctttgctcttctgccatgtaagaaaaagtgtgactcccagagaaaacagcattcaagcctccatcttggaagcagggactgggcacttaccagacaccaagcctactagcaccttgatcttggacttcccagcctccagaactgttctttataaattacctagtctgccaggcatgaaggctcatacctgtattcctaacaccttcagaggctgaagtgggaggatcacttgaaggtcaagagtttgaaaccaccctgggcaacataccaagactccatctctacaaaaaatttaaaaataagccaagtgtggtggtgtgtacctgtagtgcaagcttcaagaagctgaggcaagaggattgcttgagcccaggaggttgaggctgcagtgagccctcatggtgttactgcgttccagcctgagcaacggcacaagatcctgtctcttaaaaataaactaataaataaataccccagtctgtagtattctatcatagcagcacaaaacagactaagaccatttgtgcccatgaacatgccaactatattcttgccttaagcactttctgcctgcttgctgttcttttcccataatctcacactggcttctccatatcctttgggtttcaggtcagatgtgctctcctaagtggggtctcctctgatgagtatctgtgacatattcacccccacacactcatacttaccacagcactctgttttctttccttctggagttcatcaacatcggaaatcctcttgtccatttattgacttctttgaactagcttataagcctcctatggcagggactgtgtctgtttcatccacaaatatgtccctgacacatagaacagcacatagtgcatgacacagtgtaagcatggcataagccctcaaaaaatatgtatcacaatctgtaaggagtgacttattttgtcagttatttgcttttaacagttattttaaggcttagaacctcctctgacatcccaagtctggtgctccttctcgatgcccacagagcagcctatactccccacatattgttattatgtggtaatcaggaaaatccaatatcaaatgtatgggtttgctctgggaggttttgatgttgcaattgccttattaccacagaaggccaggaactgggcttccactattcaccagagaatggtgagttgtaggcaaataataaatatttattgaatgcaatgcctaataaatggatgaacggataaaaggattattttaaaaaaaacctgtgttattacttttttaggtcaacaaatcgctcataaaactcttttataaataaaatcagttgatgagcatttgtgatgttgtaataatcctgagcacattcaggaattattcagtcattgggggaaacttagagttctatataagaaaatactcatcgctgtgcttctgaaactatctgtaataaagaactctttaatttccaatcttttatggactgatacttttggttcaaatcctgttcagtgagacaatgccactggtgatgtgcctaagatgtcatggcaatgctgaagtgctgtaaatatttctaaactcttattctcaatttctgtctttatctgctcatggaccagtgacacaccagtctgaatatcacctgaataccactggtctggattattaaagtctatctttttaagtaacaaaactgttttcacagcaaccctagatgaatctctaattgagaaccacagccctaagtacagagtctgaggggactaacccagaaattgacaactccatgacaaccaggagagggcgagagtgaggctgggaaaggagaactgtggccaagcagttaaagctcaaggtggactctccatttaaaccaaagcaatcttacttctctggggttctgcatacagtttcattagagaaaaggattctattgctaaaataaaaatagaaaaccactgattctctaacacttattctaccaatgagattaggccaaaaactttggctttttacaaaaacttttggccttatctgtaaaataagtgttaagagaatttgctacacaaacacttgtacctatatgggtttttcttccattctaatgagaaggtggaaattaagtttgttattttgttatatagggagtagtcacagtagtgaaagattatatataaaaaccaaaggcatgctactttaaaaacagaaacttttggtgtctttgctttttttgtacacctcagtcatgggacctgaataccatctcagatgggagagaagagacttttccaaacctcagggtttggtgcgtacagccctagacaagtacagctataatcacagttatgattcattgttgaatttttaaatccattttttaaaagaaactctcagaagtaatttctatcctctattgtttgaaatttgggttaatgctaaagaagtccctagagaggcccctcatttgctcgtgatgtcttggtaattgctgagtaaacacatgtgacagagaaagaaacacatgccatggcaaaattacctgagtgtaattaatctaaattgtgcaatattaacctactaactaaataacatagggagtatttgtgatatggttttcagatctctacccagaaacccgtttttattccatggttgccttagctactcaaaagatcctcaggtggcctcatatttactaaatataaaacagagtcatttgaatcattatggtaaatcgcccacaaatccacaaatatcttttttttcctactaatcactcaggttgcatctttgtaaatactccattttatttactacatttactaatggttaaaaacggtacttataaagtaataacaggccagggagtggtggcttatgcctgtaatcccaacactttgggaggccaaggcaggcagatcacccgaggtcagttcaagaccagcctgaccaacatggtgaaacaccgtctctactaaaaacacaaaaattagccaggtgtggtggtgcatgcctgtagtcccagttactcaggaggctgaggcaggagaatcacttgaacccaggaggcagaggttgcagtgagccgagaccgtgccactgcactccagcctggacaacagaatgaaactccatttcaaaaaaaaaaaaaaaatcaatcaatcaatcaaaaataaagtaataacagtgaaaatacatcagattaaagttaattaccattttggctatgtcaggtttattattttgaaaaaagcactaaaataaactgcaatgaaccctaccacaaaaggaagttagaacttcctgtactgacaagaagtctctgtttcttctgatgaataatgattaacctttcattttagatgacaagttacagttctgtctgttttcaaagggacatattaaaagaatttagagaactttcagccccataactaactagaagtacaaaatggaaaatcatttctctaattcctttactgtagatatttttctaaaaattcctctaatagtgattctttgagaaaagtagttaaaataagataaaaagtcacatagagcagccagagataagacaaacatgttaaaatgcactggttaaatgtttagttctcagttttgatgactgtaacatggtgatgacaaatgtcaacattaagggaagctgagtgaagggtatatgggaattctgtgctgtttttgcagtttctatgttacgtctaaaattatttcaaaatacacacttaaaatgtattcaccacttcagcagtttatgtagttaaagtgctttgagaataaagaaacaattttctttttgcaaagaatatttgcactaaatctcacaaatatacagtgcttggacttttcaaattatgtatgctttagaaaactataaatcctccacagaaaatgtcaagttaaattggtcaaattgctggaaaataaacacacacacattttcaaaataaggtgagcaaaaagttgaggaaatcctgtaagaaacataacttgctaatacccattacagtttaaaaaggacatctggttctctagtctaaactgttgtcttgattttatcccttatattacattgttattgttcttcaatgggaactatatgtggagttagcagaaaagagacagctatgacaagaataaacctcagagaacatgcagtatcaggacgtctaacaccctccaggcccaagaacagaatgtaaatgaatgaagagaggtgtagagagtggtagagcttcggtcacacatgagaaggcacattctcccaagagggattcaaaagcacataaaaaatgaagcaaaacaagaaaagacacttgcacaaaataacaaaacaaatgtataggtcaccagttgcagaccatgattcagctcccttctactagaggaggaaattaagacccagagaggaaaaatgtgtcaaaggccacactgcatctttaggagtgaaggagaacaaagcgcacttcaccttcaggatctaaatcttcatggaaaactctaaggcagatgggaaaaagagaacttgttgatattggcccttagccaagggcagagggtgatataacaacaactgatgtttgcataacttcacctcctggaccctggggtgcttgcaaacatccattcattcatcctggttcactcatgtgaaatatgtaggtggtgtgttttaatcatcatagagtggtaaacaaagacacggttggtacagaatctccaagggcaggagtgtgtcgtcagctaaggacaagcattattatcatggccttgctcctgagtcagtacatttgccaccttccttgcgcaaatagtcaatactttaagcaattttctattttatatgtaaacaagcacttggggataaaaagaaccaagaattctaatagtattctaaccctctcccacttaatcctcgaaatagttactgaccacctgctatgatgatggacactcctttaagtgctgattttcattttcctctggctaatactggcccatgttggtctgagggctgctccaaaattaactagaatatgtgacaacagataccactataacctccctattttctgatttattctcattccaacttatatcttttattgtaaagggaaatctgcagatataaatgtaggttctgtggatcccctccattgtcattgcataatgatatttgtggtatgctatgtctgtgccttgcgtagctgctacagcatccaattctactcatcatatggtttacaatgtgcctgtgttagagcaaatgaacctgagacttacatattaagcagcaatattgaaaagaggaaaaaaggtccagatgatgtgaaggaagaatttatattaacccgtcaacaaaaataactaaagtagcacactaaatttctcttttctcattgaccccaaatagaatatgagtatattctatttcctgattttgtgagaaacagaaaggtgagaattatatttattcattactccaagaaatatttattgagtccctagtatatgccaggcactgaggatacaacactgaataagacatggttcataatgtcttccaataaaatagttaaccatcattgtaataagtaataaagtaagtacagattcaacccaaacccctagaactttcacaagtgaagagaagactgaatcaacaaattgatgttcatatgtttggtggcgctgcaaaaactagaagtactttctgagctataaaataaaattgaatttcatctaataacattttatttcaagtgcattttattatttactgtgctctgactgtgcacaagaccactgggcactacaaaaaaaaaaaatctctttacaatccaatgtgtgtgggaaatcataaatatgtagggtaaagcatatgaaattgctgataatgtctctttgtaaaagaagacattttttaatggtttaggcaaatacaatggattaaataagaacactagaagtgtcaaaaagcagaaaaaaatgtccaaatgagattataaactgaatgaaatcagaggaaagattatagaaagattttgtgaactgtgaacttgaagaaggtccagaaggatgggcaggggggtgaacaacgggcctggccagtgaacacagggatgcaggcaagatgctgaaagtggcttgaggacacagtgagtagatgagttgagctggagctaaaggatctggaagaaggcaagtgttgggaaaaggagtaagtggcagccttcagtctgcaagccagcttacggaactgctaatggctaagaagtttggaagcaatgctattcttggaaatgtaaaacatctatatgcagatcattcagcttattatcacattccattaatctttggccaactcttttggataaagaggaattgacctgagataatgttagagtgtccatggaattcaaagaactgcattaagtagcaggaacaccagaggtaattatatgaggcaaggagaatgcaaacatattaggtgggcgcaaaagtaattgtggtttttgccattactttcaatggcaaaaactgcaattacttttgcgccaacctaacacattcattcatcctgtctcaaatagtcccaaataagacagagtcctttggcatggacgtcagaaaaatgacaccttcctcttcctcacccccgtatctgatatttggctactaagtcctatttttctattaaatatgacacttatctgtccaccgtcactgccaacgccctagtccaaacttacatcagtgctcacctgaactaccattatcacttcctaaatgatctcccaacttccaatttctccctctccccaactacaacaaaaaaatctatctccacacatcaataaaagcactctttttatggtacatatttgaccaattatgcccttatatgcttcccatttctcctgggataaaaagaaaatttaccaaggtctgagaggtgctgcgtgcaattggcgctcctggccacccagccagctgttactcacacttggtcctgaactgccaccacagagttactcctcctgaatatccccaggcctttactcctggactcaagggccacagtggtatggaaaggctggatgtcgcatccttcatgtctcaactgaagtatccattctttgagctgacctcctagacagggtcacaaccctgccaagcattgccttgcagcttttgacaaacaggctgattcaggtcataattcaataagtacatatttccatctccattagtttactgtaaactagtcaagcatatggaggacagctttttggctcattcccagtatctagcacatactttgtagtttacaacaaaagagggatttaataaataattgctgaatgaatcaatcaatgaacaaatcccaagttaaatgtgattgggaagctccaaatataactggaatatcatgatgtagatatggagagtagagacaacgaaaaagaacagcaaataagtttgccccagctgaccagtatccagtgattgcagcatgttgatttgacaaaatctctccataaatacaaggaagccacaaagaaaagaatataaagtattacattgatgttaaagatggactacctcaagtatacatgaacaggacaataaggtttcctaaaggaaagatgagtattcacattgtgtcaagtgtagcatacacatgtgtattatatgaatgccactgtctccactgatgcaagttgacaagtctgggaatgtgaattcttctggttataccactggaatatagtcaaaaagaataacagggttagaggagacttggtttccacttgcccactgagtgacctcagaaatgtcactggagttctctgattattttctcattgaccaaaaattagaaataacaacatgcctatgacaaggtggcagtcgggactaaataaaatagtgacacctctttagaaccgtcaacaactagataaatatgttactgttatgatagctgttgtaagtattaacttttttgtgtgtgtgtggagagtgcggtctcactatgtcgcccaggctggtaataatattacttcatttgaagagtttgtgtatttactttatttatttattttttgagatggagttttgctcttgtcacccaggctggagtgcagtggcacaatcttggctcactgcaacctctgcctcccaggttcaagcgatagcgattctcctgcctcagcctcccaagtggctggaattgcaggcgcccaccaccatgcctggctaattgtgtgtgtgtgtgtgtgtgtgtgtgtgtgtgtgtgtgtgtgtgtgtgtgtgtgtgtatagtagagacggggtttcaccatgttggccaggctggtctcaaagtcctgacctcagctgatccacccgccttggcctcccgaagtgctgggattacaggcgtgagccacagcacccggccatgtatttattttaaatcatttgtctatattcattgactttgactcattaatgaaaaatactagagataaaattaaaaatagagtttaaattcaatgtcacaaatggttttcattttaatttttaaaaacctattaagggttattcttacaagcacattagtatattcatttaatcctcaaaacaaccctctgaggtgattagtattatatctccaacttacagatgaagaaactgaggcactaaaatgtcaaggaacttggccaagatctcatacctagtaataacaacagtcataataagagcaaacatttacatggtagtgccagcactgttctaagtgctttctatacattacctaatgtaacactcctaatgaatctgtaaggtagctacccttactgtccctaatttacacatgaaggaaatgaggcccagtgaggttcattcatttgccaaggtcccacagctggtaagtggcagagcagagatttgaagccaggcagaacccttcctgttaatctaatgcagtactaactctcatttattggtggcatttatccagctctctattcacctaagtgaattttctagataaatatttacttctttaataaagaaatattattttattcatacttttcatattaactgtcttttgcaaaatatactaactactgtggaacattttcctcatggcccaaggtcagtgttatggctgctgtgctttatctgtcctgcttgtagtttttactttaatttttacaggagggcttaggtatcttttgtagacatgagccagtcaattgtcattttgtcactttgattctgctgactgctttgaagctagaatctgtgtctatcataactatttctaatataagatttaataagctttgaattgatgccaactgtatggacttaagtccatgactttcattatgaccatggcagattttagctgagatgaggggagtttgacctatagataagtaattattttaccaaataaaaaaactatgtattttatccagtgctcatattcctgtttttttgttttggttttttgtgttttttttttgtgttttttttttttttttttttgagatggagtcttgctctattgcccacggtggagtgcagtagcacgatctcagctcactgcaacctcctcctcccagcttcaagtgattctcctgtctcagcctccagagtagctgggattaccagcacgcgtcaccacacccagctaatttttgtgtttttaatagagacggggtttcaccatgttggccaggccggtctcaaactcctgacctcaagtgatcctcccgcctcggcctcccaaagtgagccatcatgcctggccattcctgttttttaaatcatgatacatatcaggcatatacatgagtttgtttaaagttcactttcatctagaagatgaaatctttcaaaatgtaagacttattcccaaatccaagccatacaccctgtccacaagctgatgattactattccctcatcctgctttacttatttctctccttgtattgtgttccaaatagaacacaatacaaataaataacatttacatgctcctgaggcatactgaccactgttctaagaaatttttccatattaattcatgtaatgttcacaaccaccccattttacagatgaggaaactgaggtgcagaaagattaagttaacttgccaatcccatatctaggatttggggagctaggattacaacccaagcagtctggctccagaatctgtgttctatgaactctgctctactgcgccctgagaactgtcctaagagaatagtgcctttgttttgttcactgctgaaggcccaggtgttcaataaatatttgttgactgtctggatgaacttccagctcctctctgcctatccaagtgctcaacccagttcactttgacttcagcctcaaagcttgactggctgtgacaggcagagtaacattccaggcccttcttccacctcctgaagactttatttgttgcactgtcttttggctcaccctcactgggcatggagccccaaacccattagatggtcaataaatactcactgaatgattgagactcagagctgtatcagagctgtcgccaaacacaaaagtttgtgatcaagtactataacaacaggatggtgtcctagaaattgcacttgactgaatcaaaagattgatttttaccttttgtaaactcaccatgacaatttcacagctctagacttcagtgtgttcatttttttttttttttttttttgagacggagtttcactcttgttgcccaggctgtagagcagtggcgtgatcttggctcactgcaacctccgcctcccggttcaagggattctcctgcttcagcctcccaagtagcggggattacaggtgtgcgccaccatgcccagctaattttgtattttttgtagagatggggtttcaccatgtgggccaggctgatcttgaactcctgacctcaggtgatccacccacctcatcgtcccaaagtgctgggattcacggcatgagccaccatgcccagcccagtgtgttcatttttaaacgtgaaagcttactatatataaagcactatacctttggtatgaattatgtacatataatctttaaaagaatcctatgagctaggtgctattatacccccattgtgcagataaagaatctgactagaggctaagtaatttgttatgtgttacacaattaaaatgctagagctaggattcaaacccatgtatgtatgactccaaagcttagctcttgcacaccatgctgtactgtctctctctttaccattttaagcttatgtcatataataacagctaccgtgataatgattatggcttgaactataaactgtgaattgaagtagtttccaattactaagggtcttgaaattaaagtaaaacctgtaccttttataacattttttcaatatttaccttttataagcaaaagcttcattggccatttctgacttttctggaagaaataaagataccatggcaaacagtaacttctcattttagagattcagtcagttaacaagtatttgttgaacacctgttacgatgtcttgcactgggctaaatgctggatatatataacaatagtgactgagacaaagatggtctctgccgtcacagaggcagtccagagaaagaaacagtaatcaagcaacatacagaaaatgattggggagtgagagcaggagtgtgggggtgcaaaaaggaaagtccattccaggcagtgtgagcaacaggtgagataattacacacaggagagaatgtgacatattctgggaacaatcaagatggaactgctgatagaaggcctaactaaagattggattagggtaatggggaatcattgcaggactttaagtagggaagggaaatgcccttatgtgcgttttaaaaagatcagtttagccgggcacggtggctcacgcctgtaattccagcactttgggaggctgaggcgggtggatcacctgagatcaggagttcgagaccagcctgaccaacatggtgaaaccccttctctactaaaaatacaaaaattagccaggcgtagtggctcgcgcctgtaatcccagctctctggaggctgaggcatgagaattggttgaacccggaaggcggaggctgcagtgagctgagatcgctccactgcactccagcctggcagcacagcaagactccttctaaaaaaggagtcttttttagaaggactccatatatatatatatacacatatatatatatcagttcaacaatggtggggaaaaaagtggattggatagatagggccagactagaatcggagaagccagatgggtgttgaatttaaccaaccgatggtggaaattgagacagtaaaaatagagatggtaatgtgggaattgattcaacacctattaagaagggatagtcttgataattgatagagatgcagaggaagcagcagtaagtgtcatggatgtcgtctagagtgtagtttttgaaagctgaatggatagtgatgcccaaaatagggaatccaagagcagcagcagacatggggaagatggcgttcagggttgcacatgtgtggcgttaacttggcagctggattttggggtctgacagttagtagagcaggctaggttccagttggagactttctaatcatcgtcagatagatggtgcctgaggcgaggaagtggaagggctcaccgaagtagggcagaaaagcagaggggcaaagtcaaagcagcatcctgtaaggagaaggcagaaaagcgacgctcatagagatgaagaatgaacctccagaggcgtcggagcagattggaagagacacattcaggctccatttaaccagaataattccgttatcaaaatggaagcgccaagaagcatcgttgatggcgctttcccaccatccatccgtccaacacaaacccacctgctttgaaaagactgcctcacgcagtgactcacttacccaccacagccgcattctctacctctgcctcttgtctagtgaagctggctcccgaggcttcggggccgctccacagggacctgaggacgtctccccggagaccctgactcaagctgctcgccggcacagccgagcaccggctcccgcctactcaccgcgcgggagggacggtccctccttcaggccaatctccttatcattgtccctgctgctgtcacctgctgctgcagaccgggggtcccgtccagtctcagcccgtcccgtcctccccccagcctattcccggtcccctcaacctcagggacaccgcggccagctgcaccgttggttttccaatcaaatcctcctccaggccaccaaccagcgctggccaggccaatgccgacaattcttcctccgccacctggggcgcctcagccaatcgggagcagccatgctgcgcagtgcagaacgccatagcgacggatgacgcctgccggggaatcgccgtagcaaccagagacgcgctagatccaccaccaagcttgcaagcagaagaggcagcaagtgatgctgaaggctgtgctgcagccacttcaccggaacctagagctacctgtgaacaggtctcctacacgttgaagatttttctggatttagggtgtctaacctttgatgggaaagggcagcttcatcttggagtgtttactttcaagaattgctatgggctaaaaatcaattctctttaaaagcaaagatttaatctgataaggaatcaatgcagcatgctaaatacctttcatatggcatgaaaacgtcttcagttactcaagccacaggcaatgagaataaggtgccacagcaccgtatttttcacaaaaagagtgacctgggattcaagaaacctgtatagtataactatcgccagttcgttttgtggctttgggcaagtcacttcaccttttgtgaaagtctggagcttctttaaaatttctgaactgcattagataacgctttaaaaatatacctgacattctgtaactttaaataaatgaaaaatgccaatctattaagtgcttaattttgtgccgggcacgatttcaaattctttccttatttcacttagttataaaatggaggcacaagaagtttcctaagtagtccagtatggcagagctagtgatggagtcagggtaaaacctacttcgagtctggtcttaaccacgatgatgctccttcgacgatttcttcgagtactgggccctgttcaacctcatcttggtatcactaaacgctcgtgtgtgtgtctggtggttacatcttcccaaactggattttaaatgaatacagtgaaccctaacgtttttctggtgtggatagtaagtaggcccattggattaacaatacttaagcttgggtaattgaaagcattttttaaaatgaagacggtcctattttggaaatgcagaaaggcgagatgaaagccaaactctggtgagtatagcagaactaattaaacttcagagatctaaaacaatcaggattaatgttaccaataaaacaaaacaaggtgacggggcaggaagaccgatgctgagtagaaaaagtattctgtacatacattctaaatgttaagcagtcggcctggcttggtggctcacacctgtaatcctagcactttgggaggccgaggcaggaggaccacttgaggttaggagttcgagaccagcctggccatcatggccaaaccctgtttctactaaaaacagaaaaatcagccgggcatggtggcacatgctagtccctactactcaggaggctgaggcacaagaattacttgaacccaggaagcagaggtgcagtgagccaagatcatgccactgcactccagcctgagagacacagcaagactctatctcaaaaaataaacattaagcagtgagacatgactgcactgaacttctcatcttcaccagaataccaattgtgcttcccatctttccactactcagtaaaattaaagtcttaaactaatgttttggccatcccagaatattcctgaacttccctgaaagctgcagcgattaagaggcaagaatgacactgcctctaaaagacacatacactatcatctcaaatgttaagggtccctctgtaaaatgacacaaaataaaatcccacaagagatcttgcaccaagcttatagcttatatagcaaggctcaaaactatgaaaacatatttttctaaggcctttttttaaatgaaatgcataacgtaaattatacagttcaaaagtaaaacagcataatgtcctaactacagcataaaggtaacaaatctgcatgtaagtagatattcaggatcacctcaacaagaagataaaaccacttcccaaaatttataaatactttagcccaatggtctagaacaagaaaaggctattcacacacacacacacacacacacacacacacaatctaagtggaggaatgagaatgatcttgtagactgaaagcagaaggctgagtacaatttgaagtaaaggcagaacttaaattgggctttgaaagaaaagcagaaaggttttctaaacagcagaaatgttttcattaaaagcacagaggtaggaacgtatgggtcaaccatgaaaagaagtgatactcaagagatcagatatgcctttattggccagatcaaagagagctaactcttttcctctctcctcttgcagaatctcaaaggtctgtagctaggaattataaattgacaaaaaaaattttcccctaaaataaatgtaaactacattttcaaatgaaatttccaaaaacataagtgtctatccccatcttattccaaaggctatcaaattcatggtgaggttatcagatgtttttcagtgcagaaaacacaaaaggaaagtgttccacacatgccaaatgaaaaacaaaccaagacctgtaatttgctattaaggaaaataattcctaataaactaagtcactaaaaacaaagaaagaggccggacgtggtggctcacacctgtaatcccagcactttggtaggctgaggcgagcagatcacgaggtcaggggatcgagaccatcctggctaacacggtgaaaccccgtctctactaaaaaaatacaaaaaattagctgggcgttgtggtgggcgcctgtagtcccagctactcgggaggctgaggcaggagaatggcgtgaacccaggaggcggcttgcagtgagcagagatcgggccactgctctccaacctgggcgacagagcaagactctgtctcaaaaacaaacaaaaagcaaacaaacaaacaaacaaaaacaaagaaagaaaagccctggagagttcggtattatcatgcagatcattacacatcacgcagcaacatttctaaaatcggggggaataaatggatcagccttttcttagctttaatatcaattatttcttaactatcaaacacctttgtgaaacaaacactattttatttttttctcagtgtttcctcttttctctctcctactgaagcctaggaatattaggaggccggaaacagacatcactcattttccttcctctcctatcccatctcaagctgagagagagatgtggctcttctaataatcagagtacaaagtaaagacaatagccaacaactaattaagtagacttttattgctcaatcaacttcagtaacatctccaaaaaaatagttttcatctaacaattatgaaacaaatttgaaaggcaggatgattcacaatatagacccagtagaggcttatacttcatataaatgaaaaatatcagttctacaatttaaatgtttactttggattttattatagaagaaaatatcattgtaattataaaagccataaaaattggaactgtattgtgaaattacatcaaggtatcagattttatataaatgaacaataaaattcaatttttatttatttaaacgtagttaaacattggaagacaatctcccccatggggaagaaaaaaaaaaaaaaccttgaataataaagcaacaaaagccacaacacaaaaactaatcagtgtgcaaaaatctgattaaaaaaacaaaacaaaactggggtttaacaattaagtcaaatgttcaatatgtgctaattaaatttcattttaaaaatgatctttggatgattacatttccaactatgttttcctataattgacatttaatgttagtttttgaaaagttagaaaagaaaccaatttatatgaagattgccaaattttgcaatttgaacactattttaaactttgaatgtccttaaagtctttaaacttactttctaaaataaataattgttggaataaaccaaaagacatttcacatatttgcactgcatacgataaaaatgatgtgatctacataaataaatttaaaacattaagttatttcatataaacatttttaattacagcgttatatcaatggcttacacagttgaaatctgagcactttaaaacaggattcacatgttaaactgctgagcacatttatagaactgatgtacatcatataatcctttaaacagcaagctctggtgttatacctcagtttcagaaagcatttttctttcaacagaattttgaacctgcctttgtgaaagaaaaaaattagaaagctatattatacccacacagaaaatttaagtacgtggaagaaataaacttttttggatgaagaaaacaagttaattttgagtggtaaacaaatctggtttacaaatacatgcattagcacataaaatatttcgtcctagacatctttacagaagacttggcaaatatgaacaatgggatgccacagctttttaaaacaacttttaacagatataagatcagtatcattcacattcacacaaacatacacacactttagaaagactgtgtgcttggcttcggcatatttaatatcattaaagaatatatagaatcatccttttatcataaggaatttacatcattgttttctcaaaagctgctattttagattgaaacagcattcagaaaaaaagtacatttcagatggtcagcatcaggatttactacagactttgtaaacagatatctataaataaataaactagggtggagaaaagaatatcctgaggtggctctgtggccagggtattcagtagcactaagctccattctggaaatcaaggcatctaaagaaagtgcagggctgaatttattttgtaaatggaatatgtacaggtttaattattttgcaccttgaggtaaatcagtacatagcaactactactgcttacatacacttatttaaggcaactttatttaaaaatcaatatatgtagtaaattatatctgtcactgtctctcaatgaatgctatctttgattatttttcaaaaacagtggaagaaatataatcacttaaaacaagcagttaattacctaaacatgagttacctttgctcttaaatggagtagtcagatcattttgtcagtcaagtagtcaaaagaaagcagaaaccagtaacatttagaagcattgtaaaaacattttgagtgcaaagtattttgcaagtgacggtttttctggcactggataattactatacacaattaaataaaatcacagaaacactatgatcccaggtagttttcagttttaaaatttcttcctgtaaagtaagtacagttgttacccctgatgtccagacacaaggaaatgatgtgaggaaatcctcttgttcaggtacatcaggggagttttaaaaatagcagcaaatactggggtctttggaaataattatgctgctacaaataaaaaggaatcattacaatggaagctcataaacaataataagcaccgtgggtaatactctatcaattgccaatagagtctaactctttttaggcagtaccaaatgatgacagctacatattttctaaagaaaagcagctacatttccaacctctcatccgaggcagaagttgaatccatcattttaacaagactcttacaatatggtcttagaggaggacattacattagttaataaatagtttataatgaatttaaaacaccagacttgctaaaatttcagcttttggcattcctcatgatcctttattagattaattatgtatacctttgtaatttaattatatggttaaagggagcattggaatttcataaaattttcatcctaatagtgatgtcaccatttttgatatttctgtggcttctcaatactcatttgatttttgtaaattattctcttgtcaaatcagtttcacaaccccattcatccagtcctacaggcttaacaacatttatttcatgtggaactaaaagtatataaaagatgactaaaaagatttgttagactttaaaaagctcagaaaagcaaaaactaatacacaaaataaaaatgtcattaatctgagctacatataaaatgtctaatttccttttaaaatataaatatggcagtgctttatatcaaagatgtaaaatctatcaattgctttaagataataaacataaatgaaagtaagcaccaactatttacattaacaatttactctatttgttacttttccaaatgtttatataatatttaagcatcatatcaaaataaatattttaaaataaaatcacaggtaacaagctattaaatgtaatctacaaaagtgaaagaataacataaagagaaaatgaaaggtaattcttaataaagtaatactgatcatagacccttctgagagaattctaactcctgattatttacgcctactacttataagagaataatagtcaagaacttgaacctgatggaaactaaagcattttaagacaaagagagacaaggcagagaacagagtgggaatcattggctttaaaagagcataaggattcagaaaaaatattctacaaaggcatcaaaatcaactattgcaaactggcattgtataactttttaaattcagaagttataaatggtatgggtgcttaattatcaaatcacctgcaattttacttgtctgtcacaatggatacctagatatgaaggttttaagatttaaaaaaaatttaaacataaaagttaaaaactatcattattaaagtttctattgttctacagtcatctctatggctaagaaaacgccagttagtgaaacacgatggacatctacagaaatgaaacacaaatagagaagccctgaaatgttaccatttttcccacagcactggtatagactccctattcttcccataaagcactaacaaaagtgaaataatatgtgaaaatttcaggaaacacctaaaaattataaacatataaacaaagtatcacttaaggtttttacgaattgccactgatgaacagagatttaagaaaagtagactgaaagcatttctccacatccttctattgcaaaacagaaaatttttttttctaacagaataaatatttgaatagttaagaaccatgtacctcacttcaaagagagcatttcattaaatacatagtctccacggtgctcattacaaactccagacactacttttaaaaacccggtagtcacacataaacagcatgacatacaatattcttatatatagtgacatgatacgcacacattacatatgtatatatctatatgtataatgcctcttggttcaattctataatgaagtttcagcatccacgtatttctttcttggttcatcttcaaaacttattttcacactcacaggtttatcaggactatttaaaacaaagaattaaaataaataattttaaaatataaatattcaattctaaacatggctaacaatgagtatactaaaccttctgagattactattaacactacaaacttatgacttgctaattttagcttttctaaatcaataaacataactggaaaagcaaatattaaaaattgttttttaaaaattgcaaatattaaaaatcctctttgcaatttaaattcatgtttttcttacaactaaagagggggtccttaaaatagggcagtatatggtcagaatctgttggattacttttatttcacatatgaacagttatagcatgagacttttactgaaaaatctattaatatatgaatctttgttaatatagataggtatcaaataatttccaagaaggttataaatttataaaacttctcaccccaaatttgattcataaatacaaaaccaatacatctattctatatattctatatacatattggttttgtatttatgaatatgtattctacatatatatagaacaaatatttgaaatatatatatgtttttttgagagacagagttttgctcttgttgcccaggctggagtgcaatggcacaatctcggctcactgcaacctccacctcccaggttcaagtgattctcctgccccagcctcccgagtagctgtgattacaggcatgcaccaccatgcccagctaatttttgtagttttagtagagatggggtttcaccatgttggtcaggctggtctcgaactcctgacctcaaatcatccactcaccttggcctcccaaagtgttgggattacaggcctgaaccactgcacccggccaacctattctatattttcaagttagtatcacacagtgactccacatacatggatttaattgattaattgtaacatatgaatatctgggttctggaaaaagttttcagaaagtgtaaaaacacactatggtttgctgtcttctccagacaaactgaagaatagaccccaatccccaaacattttcctgttaaacaacatagccaagatattctctttcttcctatgtgattttgaagtgcagggcaacccaaacaaaaggcagaagcataaaagatgttagttattattgtaaggcctttattttttatgataattatactaacaaggccagaggtgctgacacagtgtgaacaattactaatagtaaaaagaatatttagaaaaattctggctgtactgaatgatccaaaattacaaagagtttaactttaaaactttttaagatcaaagacagaagaaaggaaacagccagctgagaaattagaactcagatgacagaagagaaaaacatatgatagagagtaggtaggaaaaaggttctaaaagagggtagtgaaagaatgagaaaaagctaatcaattattgtcagaagacagagctaagacagcaagtgaacaaaaacagctatatgactgaaggcctagaaaagttttcatctgatgcccaagcagaatatacagacacccaacatagcatctcacacaaactgtacataaaaaagaagaattttctgagtatgaatgactgagcaccctagaagacagtaattcatttctccagaggcttaagggattaaagtactaatgattaccaaacagaatccctgagggcttagttcttgaagtgagaacaaaagaaagaaaaaaggttacataacaagaaatgtaagaaagaggttacaaaatactttcaatacatggtccactgtaaaactgaatggtctttatgtcaatggatttgatttcttccaaatatctccaagcaaaatgtttacctcacctgaacaaatggcatactaaaccaaaacacaagaagggaaacaacttgtgtttttctcttttcttagaccatcacagagcatgattgaaatagtattcaattacagtatttaatccctaatagttatctaatctttatatggtttctgatcttttttatgtttattccatactgctatatgaaatttacttttatgataaaatagctcagattattattactattttttgagacagagtttcactcttgtcccccaggctggagtgcaatggcatgatctgggctcactgcaagtgacctcagatgatcctgacctcagatgatctgcccgcttcagcctcccaaagtgctgggattacaggtgtgagccaccatgactgactcaaattattttttaaaataggtaactgtaaattaaaagacaaaaacataattattatttataccttattccaagtatacattaaaatgatggatgaaagaaagaaaggaatgaagctatcataagtaaatgaaaattggctacagttagaaaacacacaaatagttataactacctcatgttagatctggttactttggcattctcagtattcatggaaagtgccttccactgtgcagttttggccatttcatctgatatgttaacaattgagggatcaacactgaagaacaaatacactttttggttagtattcagtacttgcaaaagcattaatattgtcattcttattatctgctttcatcaactaaattgagaaaacctttgccagatatcagaatttgaattctgttacaaagtccttatgaagaattacgtctttctttctaatcgaaactaggagtaagattaagattaagtaagttagcaagatttatttatggaactttgcttcagaatccaatttggggtttcagtagtacttcggcagcactctagcaatgatgccctctgatcaccttggctgaaaatatgttactgaaataacatacgactatgttaatgtgcttatacatacaaaaaaaaatacaatctcaagtcgactagaaaacggttataattggcacacatttaatcttatcaaataaatactcaaagtatgtaaggaaaacttaagattatgatttttaaaatcttatttttcatagcttttacaaatcattataaagaatgcttggaaagataacactctgaaattgaaaacaaagctctgaaaatatttcaacagctaacacaaaatagcctcatgagtaccacttttacctgttattcacatatttagtgtgataaaggtggtattttatcaagtttatcaaaattaaaagaacagagtaggccgggcatggtggctcacgcctataatcccagcactttgggaggccaaggcgggcggatcacgaggtcaggagttcgagaccagcctggccaacctagtgaaaccccgtctttgctaaaaatataaaaattagccgggtacggtggcactcggctgtaatcccagctacttgggaggctgaggcaggagaatctcttgaacccggggggcagaggttgtagtgagtcgagattgcaccactgcactccagcctaggcgacagagcaagactccatctccagaatttaaaaaaaaaaaaaaaaaaagagtactatccatttattacaataagagaaaaatgtttctgtttctatatttctatgaaaattacttcaagacctcaaatccaataatatccataaataattaatttggggctcaagattgtccatcataagtaataggaaagtatcataaagttaatacaaatacatttgcaagtcctttttcttggattaaaaaaatacattcagacaaacaagatacaaatacaaatgtcaaattaggtaatgttaaattaacagtgtgatggcaactagtttacaaatgactaaacagcagtcatttagaaagtgctctgttcatacttaaaatcagaatgttgtttacaaatttaagattgaagagaagcgtgaggaggtcactgaaaagtctctatgaatggcttctttaccttcaccaggtcagatttttaaaagtacacaaaatctgaatacccaagtttataatggcatagccatccaacttgaaactttgcctaccccgagtaaacatttattcacttggttgccaacttcaaataagtgaagaaaggaattcctgataaaccttctagcttctaaatatcctccactatgaagaaggtatatatttttttccctcaaaatgaaattagataggaaaaaatttgcctgcattacataaattattttcatcttttataagggctttacagtttccaaatactttcatatactatctcacttgatcttccacacaaataatccaaagctatttaagatataaaattctggcaaataagcacattagccatttcctggcattcctgatggaaaaaactttaaacacagccacattaatcatggcttatgacaccacttaaaagacaaaaggaaaactacagatatccatctttttctttatcagactatagactccacttaaatttgtcaaggtccatatataattacactgaaaaagtgataaagcaggatataaaaattaagcacaaatactctcggcaaattggtgataattactaacaaccatcatggtagttcctatactctttttagaagtacatcaatgaagctaatatattaaatcttttaacaagtatttctagaacccagcaaagcagatcgctgtggctggatatattaaatatccatattaaatgcctctatgcttggcatttaaagtatataaaaatttgagggaaacattaatacagaataataccaatagtgaaaattaatagcaaaacgtatagagcaaaattagttgaattcattcatcacaactaatcaacatgtacaagtcaaatgttactcctgtaaaagctataaatagctaaaaaaaaagagaaagaaatggaagttaactaaataccaataaaacattttctatcaactggtcaggaaagaaacctgtatattttctaagactgatttcgctaactaatcagaaatggaatagatgtgtagaaataggagggccaggcacagtggctcatgcctgtaatcccagcactttgggaggccaaggcaggcggatcacctgagggcaggagtttgagatgaccattgtggccaacatggtgaaaccccatctctactgaaagtacagaaagtagctgggcgtggtggcaggcgcctgtaatcccaactactcgggagaacccaggaggtggaagttgcagtaagccgagatcacaccattccactccagcctggggaacaagaatgagacttcatctcaaaaaaaaagaaaaaaaatacaaatcaggtgtgtacacaaatgtaagttgttattattatcattatttttgagactgagtcttgctctgttgcctaggctggagtgcactggtatgatcttggctcactgcaatctctgcctcctgggttcaaccaactgtcctgcctcactgtcctgagtagctgggattacaggcaccaccacacccagctaatttttgtatttttagtagagacaggtttccccatgttggccaggctggtcgtgaactcctgacctcaggtgatccacctgcctcagcctcccaaagtgctgggattacaggtgtgagccaccacaccaggcctctaagactgatttctctagctaatcagaaatggaatagatgtgtagaaatagaaatcaggtgtgtacacaaatataggttaatcttttaaaactacaaaagtctgcatttcccaacctctatatctttagttcttaaatttaaatataaatcatcaaaatcacgaataatgaattatacataaaatattaattcttgcatcatatgaaccctcaccgccaataatcaaatcacatctttgaaaactaagagacttctagggcctctaaacatagttacatattggaaggctatcagaaaatgaattactggtatttgaatggacactgacaaagattactgaaaacgtttattttccagcacccaccgaccccagccctaatgaagggcacaaaggaaaaagccacactactgggaaaatggaaatattctcagactcatgtactgattttaaacttcactaagatagatggagtgatagaagacaagcaaattttattggcttggcatggaagttagtttaagtccagcttgggttagtccaagtccagcttgggtgggaaaggagcaagggacttccttttcaaattgtgtgaagccctcctttagttgatacaccatatgcagattgtatcatcttttataaaatagaaatcatcactttaaagaagcattatatgacttattaatacatttgacatgcatataaaagttttagagcataaagtcatatctcacctatattttagggccttgactggaatttgcaagagacttcccccttcaaatggaaggtgcacagtatcatcatcatcttgaagcatccgttcagcttcctttataacacatgtgtgaagaggttacttttcccagaatattttccaagagaattgactaatttataacattttacagacttagaaacccaaactgacattatttaaatataactgccattactgaaaaattttataatcatgaacacatacttgtaacataaaataaaaacaaccacttgtaaaacatgactaatttaactttcatttctttatgtaaatcactgtcacttatactatttaagatttaactacaatttaactacataaatgtgattatcaattattatgtaggtttataatgagagataacattctgtgaaaccttatcacaatacaatatgggcagaatgtcatttggataaggcagggtttctcaaccccagcaatactgacatttagggtataatatttatcttttgtagtagaagtcctgtgtatatagagtatttcacagcacctcagaattctacctatcagatgccagtagcagcccctccagttataacaatcaaaaatatctcagaaattgaaatactctcggcaatgtctcaaatactctcagactaacaactgagagttgtttaattccctccagcccaccccagtgataattactaataaccatcatggtacttcctatactctttttaaaagtacatcaatgaaagtactatcttagatcatttagcaaatgtttatagaacccagcaaagcagaccactcaggctggttaagattaaggctcaagctcaggttgagaccaacttggacagtggacacggaagaaaattatgatgttaataatggcggtgatcgataggacagtagaggagacactgagagaacattcatatttcttttccttattaatagaaatttgactattttgaggtgtcaatttgcctagatcctaaaaacaaacaaacaaaaacaaaaacaaaaacccctaaactgaatctcccagcattccttacaaactcagtaggatcatgaggtgcaagtagaacttactggatgacattctggaaagactccttaaacttgacaatatggtgaagctattttgccttctatcccttcctttttcctgctgtctctaatgctaacatgacagctggagtctgacagccattttgattcatgaagtgaagatgaggatggcaaccatatgctgaggtcaggagaaaagtaacaaggagcccctgataactttgtggggcttaacactgcatcacttgctttcaagaattcttttacttgaaacacaagaataaccttgtgtttaaaggccacttttacttttgttttttgttatatatgacgaacctcattctaattaatacagaaagtaacaaacaggcaatttggcccatatattttataggtaaattatattctatttgaaaaaatcatgaaaaactcatacaggccaggcacagtggctcacgtctataatcccagcactgtgggggaccaaggcaggcagatcaccagaggtcaggagttgaagaccagcctggccaacatggtggaaccctgtctctactaaaagtacaaaaataagcccagtttggtggcgggtgcctgtaatcccagctagcttggacccgggaggttgaggtggttgcagtgagccgagatcatgccactgcactccagcctgggccacagagcaagactccatctcagaagaaaaaaacaaaaaaccctcatacgtatttacatatataactctgaagaaaaccaaaatcttaattttaaaaatctggtgtcttaattcaaattaatattctaattagtatctagttaaagaattttaatttttgttgaaaaataaacataaaatcaataaaattttaatctctatttaaacaggaccatacatttaaaaatatgtgtctttcttatctttgattttcaaacaatactctgaatgggaaaatggagcaaggaactacaatcaacaaaaccatcaatgctatatactcaagtctctacttttccttcttattaaccgatactatcgagttggttattaaaaatcaaattccaattcagaataaagttatttatgcttaaatctcagcatacaaatcaactaatggtggtacacagtaagtgcatataaagactaaaactttattatactttttaaaaaagataattacttaaaaatcctttttgtcattatgtatgccaattattaaaacgctattaaaattaaatatatgctaaaatttatgttaaatgtatttaaagttttctcagataatatactctgaggtataactattttgtgttacctatattttaatattgctaaaactctaattcttctaattgctgatttagtaagcacatgatatgtaatttttgaaaagtattactgtgtcagagctatggaggtacaacacagtgaaatggtgaagagactacatttggaacagttacctaaccactctctgcctgcttcctcatttataaaatggagataacagcagtacctactacacttttataaagttcttagaaggatgaaaggaactgattcatgtaaagtgattataatggtgcctgcaatatggtgcaaaatattaaataaggaagtggtgtaagtttaaaattgttatctttttacctctttctcttttttctttttgtcatcttctttctttttcttactttctggcataagatcatcaagccaactaagttctctcttcgtgaaacacaggtccatgagtttgcgcacaaacactaatgcaagaacctttaaaaagtggggaaggaaatattaagtaacacataatacaaactgtatcacttaaagaggaaaagcatatttattaaatcttataaaaaatgcttcatatagtttaaaaattattcacacatcattttgtttcaaaggaattgagtcaattatttatctttttttactttgtgctaaaaaaaaaaaaaaaactataaagagaggaaaaaaggaaatggcattcttaaccttctcctgaataaatcccttgcactacgcataaaattatgaagcaggttaaacactgaatatcaaagcaaaaaacaattaatttttaagacattacatattatgtaagtatatataatttttaaaaatctcttcagcaatacattagagtacctattcccaacattaggttttaacttttcaatcatatgggagaaatgaactaatactttaatttgctttaactgctgctgaagatgagcatgtttttgaatgctgactggccaataagatttccacttctgtacctgctatttcctaaacttggactgttggtttttatgacttttgtttatgcatttatgagttctgtgtagtttgaatagaaattttttatctgccttacatgttacaaatattttctcccagttcacagtctgatttaactgttttttatactttttgaacatataagaaacatttaattatcacgtcaaatatagcatatcttccttttacacttgggttttcctatcttctttgaaaagttagtcccaatcaatggattatacaatactcttttacattttccactacaatttattttaccatttaaatactgaattcaattttgatttctgaacatggtctcagataaggagtacaacattacttagcttccagtatacatttaaatcgtccaatactaaattctcccatacaaaagaaatactacctttaatgaaataacctgcttatggtattcaagtgataaaattccaatgtattcagatacatttctggacccatttgtctatttttctgatttgtctattcatatgccaattctatattatggtggctacactgacttgtcagcaatttttaaatatttggttattaaaacagtacagtatcagcacacgaacagtgaagtagatggcaaagcaaagccctctatgctcaatcctagccaggaatccttcttagttataattatcattatcttgttattctctagtagttatgtctttctttctaatgaatatgtaatttacatacagaaaaattgaaaaatagcatgtgtacagtttgatacttttgacaaatgtatatactactcatataatgcacacccagacaagatacagaacatttctaccatccatgtttttgagtcaggcatttattttttatttatccagttccaaattatttatccagttcacaatgacaccaccccccaccccaacacatacattcagataaaactccagtagaatctgtacttggcactatattacatttaaatgcgatttttcagaaaactgcaagttttataatatgaaatctttaaaacaaagaacacagtatttgttcaggtcttatttgctgtcccttaatactgttattgattgaattttgttccccattaaagacagttaagtcctaacctccagtacctcagaatatgaacttatttggaaataagctgttgaagaacaccatgtgacaacaaaggctccaacttcagttacccagctgcaagccaaaggaatgccaaagacagccagcaaacctccagaagagaggaagagacaaggcaggattccccgctggaggcttcagaaagagcatgtcactgcccacccccacatactgcctctggtttgtggtactttgttacagcagcccttggaagctaatacaaatgctattataaagcctttttctttaaaggggtctttcttttaaaatttattcttaagtactttatggtttttgatcattgagagagactgcctactaattcatcaagttttctaacatccagccaccctaacacaattcttattaattctattaagggctcagtcttttttgtttttaactaaaatcacttgggttaataggtatacaatgacattttcaacaaatatgttaataattgctttgaagccaaagtatcattgtctatctacttaagatatattactcttggaaattctgctaaatttgtttacttgctaatattttagtttaaggtttctgcatttatattagtaagaaggcagcataaatcttttgtgcaacttaattagccttgggtattaataacttgtcagtgttttttgagaaaaattgcataggtttccatcttttcctttggtctagaataattcaagagggtactgtaattatctgttctttaaaattaagcttttaaccaatctgaccctgatactttaaggacaggtctttaaccacttttccagtttcttctatgcaactgggctatacacaaattttatacttccagtgtcaattttggaaatttagatatagtatgaaaataatccatttgttccaggtcagaggtcagcaaaccatagcacctgagttaaatttcatccaccatctatttttgtatagcctataacctaagaatgtttttttacagataaacatttggaattaatttgatggtagaaaacaataaccatgaatcccaattaagtaaaataatgtcaaataaaaaataattccattcttctaatagtcctatatttttaaaattattttttaaatttcatcaataagattacataagtacccacataatactctcgtgacctataaagcctaaaatgtttactatctggccctttacagaaaaagtttattgacctctgctctagatattcaaatttattgatattcatgcaagtgttattttcatcaagtcccttgaatcatctccatatctctggttatcgctcttttctcctccttaatcttgtatatccattctctcattttcttctttacatgtgcttgggagtggtttatccattattgatttttttaaaaaaaacaacttagttgcattgaagtcttcttgaataataaaggcaatgaagtgcatacaccttcctctcagtgtaactttagttgtgctcaaagttttagacagacattgttataattttctctctttcaatacctctagatggttttttaactgttttctattcagaaattatttagaacagtgtttaatttccaaatatttaagattattttagtggctttccattatttatttctaatttaactgtttttagaaaatactacttgagtaatttttatagctttttaaattctgtaaggttttctctgtggccatgtacaaaaccaatttttacatagcatttacagaagaatgtacattctctatttgtaaaatgcaatattctgtgataatttaatgaattatattgtcttattaaagtcatcggtagccttcattactttttaacttccacatctgtcaatttctgaaaaagatatatcaaagtattttaataatgaaccatgttgttttggttcctttgcttttacatttgaaaatgtatttgttccatgaacgtcctgaattctgaagttatttaaaaatacaaaaccaagtcctatagcctaaggactaaaaagcaaaacaaacaaaaatttacaaagtaataaaattgaagctgggaaacaactgctttgtatctagtaacagctaattcacattttcaaacacctaaggtacttaaaacgcattattctttttctcaaaatcaattataaatattaataaaaaattactgtaaacatattattaattagtgacaaaataagtctgaagaaatcttaccatcatgggaaaaaccactgcagcagctgaaacttttatcacccataaaaggaccaaacaagtaagctgaatgactgtgaaaatatggaccttccagagcggcacataacggaggtatatcaaatcaggctgatgcttagcaggcattccaaataattttatacggtcaaataactacatatagaataaaaaacaaagaagttttcaataaaatatttctgctatttaggagaagaatctatactcaactttaggattttgtgtattaaattgtaacttccttgacattttctgatagtacaggagaatgttacagcaagcattctctggatccaaagtggggtcgggtgggggagggtggcaggtgggaaccaagcaaccacttgcactgctgtaatttatttaatcagaaaactcaagccaaaatgtttaattcagaggattaaaatatctagataaacttatctgctataattgaatgcacaagtcatttatctctttgttttgtaatgttcatgacaaaagaatagtctgagtgacttctaaggttcttcacaaatttaaccagaaaataacttgagataacaattacaattcttcactaattgaaaataaaactgagcaaatgccttcatctttttgagctttaatttcctcattaacacactgtgaataagatcagccctaatcatctcacaaaactcttaaaaatcaggtgagataaggaaataatttcttgaccagtgaagagtaggtcctggatggtgttgaaaaaataaagatgttttcctgccactagcctatgagttggaaactttagacaacatccttttcatgagaagaggtggtcatgtagcgctaactgtgctttatgatcgttttttttgtgtgtgtttgtttgtttgttttttgagacagggtctcactctgtcacccaggctggaatgcagtggcatgactacagctcacagcagcctcaaactcctgggcccaagcaatccgtctacctcagcctcctgagtagccagcactacaagtacacacaccacagccggctaatttttaaaggttttgtagaggcaggatctcactgtgttgtccaggctggtctcaaactcctggcctcaggtgatactcctgcctcaggctttcagagtgttgggataacagacatgagtaatgatagccagcctaaatgttttatactaaaattatattagtacaaatcttaagaagttttattaggttgtttcccagtaactattaaaacaaaacaaaataatgaaaccactggcttagctaataatcttcaataagtccttctatttctgtttcctgatttatattaggatttcttcctttcctctctcccaactggttaatgttttgaggatcacaaaatgatgtatatgctaggcttcataagctgtattgtgttacacaaatggcgggtcttgctatttttataggaaactaatatctacctttttaagtaccaaaactttttttcaatacaatccttttgatcctccctctcactattctagtctttattgagttatagggcttttcattggcttcaattaaaaacaggtaaggaccatgtcagctcatgatctcactctctggaggaaaaaatgtacagtaagcaaacaatcacttggcaaatgtctgaagtcatcagttagaaaactaacctcccctcaaaatgtcagagttgagaataaatcactaccatcattaaaacaatctttgcatacttaaaattatcaagtttctatagaaaatcattaaatacttaaaacttgcctggattccttttaatgaggaaactcccatataaaggaaaacaccatacagaacaggcattggaataaactgtaaataaaatgaacacaattagaactcatgagtagtaagtaaacaaaaacataatcagtgagtaattatagggctagaattaaaagatttttcaatcatgaggattagaccgacctaacatttccacacataagaaaattgctaatatacaataacctgcttgaaaaatgactcatcttctacatgctgcttcctaaaaagggagtatgttcacttaagatcaggagtactgcagtcagacttagttttaagtcaaacttaactttctgtacctcagtttctatatcagattgctgtaaagattcaatgacttcaaatacataaaacactcagaaaagctctgatacatattaagcacacaaaaagtgacaaccattgtcattgctatcactacctgctgcactgaatattaagcagtagcctttactgaatatagtaagtaaaatccacctccaaaataaaatccttactactttggcagttatgatgatcccaaactgtctacacagttcacacctattcatcctgcaagaaagtctggctattaacagagcccatccatttactcaaaaccacaaaaagcactctgacctaagggagaagtgtactataaggaacaacaaattaaaaaactacagaggaaaaccacatctactacatctcttctaaacaacctagcgtgtctttctaaggacactggaaaaaaagaaaacagtttacgaagcagacgtattttaaaaaatctaagcaatgcctgtaatctcagcatttcgggaggctgaggcgggcagatcacttgcggccataagttcgagaccaacctggctaacatagcgaaaccatcatctctaccaaaaacacaaaaattagctgggcatggtggcacgtgcctgtagtcccagctactcgggaggctgaggccaagaatcatttgaacccaggaggcagaggttgcagtgagccaagatcatgtcactgcactccagcctgggtgatggagtgagactctgtctcaaaagaaaaaagaaaaaaaaatgctaggaaaaagaaataagaatgggaaaagctcatgaaaattaaatctataaatatcaaaataactaaaattttgtagtaataattttcataagactgaagaccaatataatgatatgaaaaaaggagaaaattttctttaatagcaagggggaggagggataagaatattagaacaaatccaaaaggtctgagatctgtttagctggagttgaagaaatttgtaacagagacaatagacgaaaagggaagtaaacaggggaagaaaattctcacagcagaaggcacaggtttctcgagaaaaccaacagagactaagcagggtaaatgaaaagcccctaactgcctccctaagtatctgaatgagttttcacaaaaacaaaagttaaaaaaaatttttttggtttatcttaaagagggaaaaggtctccataaaagtacaaaaaccaaatagatttcagatttctcattagaaaattggtctccagaaaacaatgactttaagatccaaaagaaaactattttgaatatctaactatggatcaaatgttgaggtaaatagagacattttgaaatatgcaagaactctcaataagttcaccgctaatggtaccatgtgtaaaaagaatttatcaatacaaaaaatgaatacaagaaaaaggggaacctgcatatacaatttttttacagtaagggaaggtagcagatattagaaagacttatttggtcttcaggcttgggctggagtaaaatagagtatatttctgcctccctgcaggcaactcacactgcttagtcctcacaatcacactgcttagtccccagcaaataccatcgtaatatcatttatgtgttcccagagggtttaaatttctataatctaacttacaggagatgcaaggaagccttaattatcatcatagcacaaaatgtaaatgttaataacgacttttacaataataaaaaaattaaaaataaaagccaacaagagggatgtgatggaagacagaatgaggatggagtcataggtgaaagacacaactttaggtcagcagctctcaaactctgtggtctcaagactcctttatactcttaaaaattactgaggtcatttcccctcccccacaaatacttttatttatgagcgttttatacatatatttgccatattataattttttttgttttttgagacaggatctcactttgtcacccaggttggagtgcagtggcccaatcacggctcactgcagccttgacctcccaggttcaagcgatcctcccacctcagcctcctgagcagctggcaccacgggagcatgccaccatacctggctaattatttttatttttatagagacagggtctcattatgttgcccaggctggtcttgaacacctggcctcaagcaatcctccttccttggcctcccaaattgctgggattacaggcgtaagccactacacctggtatacattattttaaaaatatatacagcttaccactgaaatgcttgctatactaaaaacctaatgaaattatttcccaagtaaactgtggaaaacaaacctaattttaggtattttaagtatattttaatgtttcatgttcacataactaagtataaatgttataataagattgtaaaacacggcaataaagaaattttacctttaggactgaagtcatgaacacagagaggcccattagaataaaaatcattagccctgtaacccgctgttcacgaattcccaaaaacttgggttgttcccctggagcagaacattcagattcaacttttaagctgttgacatgacttattgacaacactgttgcagccacaaaccatggaagtcccatgacagagcaaactcccaacataacgccaaccatgagcaaatcaaggtgatagccagctcctttctgaaaagtgaaatgaacataaatatctgtaagtctaaatggttccctcaatttaaaattctacacgaattataaagagggaagaagctaattttcatcttacatcttttaatgttctaatcattacaaaaacagctcaaacccttgaagaatcacaatgcttaaggcaaaattctaaaattaccttcaatttgtgttcctttctgtttataattacagctgtgatttgttgatccataaagatgagaatggtacaaagcaaagcaggaatagcagctattaataaggtccaccaaggattatctcccagtgggcttatgatccaccctctctctggatgagtaggctgttaaaaaattaaatataattttcaaaaagtctccttgctgtattgcactaaatttccataacatagacttgatctgttccaagaaatacccaacgaatgggaaataacttaaatcttgaactacatggtgaattattttcaaagatggccacagtaattcttcctatccctataactatacctcctgtcatttgactcagtcaatctttccacctagaggtggagtctgcctccttcccccctgaaaccaggatgaccctgtgacttactttaacccacagaataaggccaaagtgacactatgtgatttctaagtcttaaccttaaagaaccttgcagcttcttctctaacctgctttgaaccctgagattattacgctgtcgagtaagcctagataagctttcttgaggataagactatcctcaatatagtctatatggtagtgggtgtcgggggcggttccccaggcaactattccagctgtttcatccatctgagctgaggcctcagacatatgaatgaaggcatattgcccccattgatgactgcaccccacagagcagaccacaaaccagctaagcctagtctcaactgccacagaattataaacaaataaagggctgttattcaaaagtttgttatgtagaaattgataagcaaactggaatgtcatttccacatgttcctgcataattcatataaggtgaaatcaatctatccactaaactcctaaactaaactgctttagtctagtcctgcagacttagtgattttgacagggtcagtactaaatcagaactggtccacaatacatggtatttccaaaggaactactaacaaaaatctggcactttatgagatactaatacattttgacagtacaatgtaagattttatagcaatttttttttaaagatcaagagagtttagtatgtttgggagaatactgcatatatagaaacctaaacatatgtttttattacctcaacttggtattaagcttgtttcttcttcatgaaaacatttgtcaatataaaagggaaatttaatactttcaaagttcaggtaattcaatctttccacactaatatatattaaactacctcacactcaatgttgtgtatgaacaaaaatattttattctacttatacaatgccatttactcttaagagttccttgatttgcttcctcaagtatattttatgccccttgaaatcagcctattacctgaaagccatatcagtaaataaataacaaggacatatttaagaatcagaataaggaacttaggccaggattacaggaaattacatcacgttttgaaccaatattaattcatagtttcatttatttatatattctcataaaataaacctaaagtttaatattttcatatttttacattaaaaacataagactttctaaaaattgttggcagatcattttccacctgtgtaccctactttaaagaccactgattttaaaaataacattttggtctcagtgcaatattataaaattagattttataatataaaataaaatgatcttcattatattccttatttcggatcccctttaaaccagctgcttctgaaagaagtcatataacttgttaaattaaatataaccagtgacactattcacaatgtctttccttttagcataagcaaaggaggatggaagaaaacaaaaacagagcagaaggaaaatgaatatattcaaatctgctaatgaaagcagaaaattcaaatggatgctcagatcatttttcttatagaacacacttcgttttctccttatgctactggaaattgttacatggaattttccaactactgtcagatatactacccttctagaaatttaactagaccctctctgccactcctagaaaattgaattttaggttactttttttttttgagatggagttcccctcttattgcccagtctggagtgcaatggcatggtcgcagctcactgcaacctccgcctcctgggttcaagcgattctcctgcctcagcctcccgagtagcgggattacaggcgcccgccaccacgcctggctaatttttgtatttttagtacaccatgttggccaggctggtcttgaactcctgacctcaagtgatccacctgcctcggcctcccaaagtgctgggattacaggcacaagccactgcacctggcctgggttacttctttataaaaaaataaaggctgtttccttctccctggaaggtacagcaagaactccaggtaggagagcaaagacttttttttttttttaatggctccctacatcttaccacaaatattttcattcactctctctaatggaccagcggtgatacttttaagttcacatgtctcttttctgtccatattgtcattgtttatatacatatgaaaaacacatataaattatttcctttcaaagcatcagcccttcaaagagactacatacttttaaaacaataactactgagaaaatagtatcttgctttaaagtagtgtggtattcccaagtaacaaatagccacttgttttaatccttacctcaaatttttcaggaacatgaagtttaggagatggaactcctacaaggtagtcaattgtaaccattattactattgtgagaaatacagcaaaatcactgattgtcgatcgcacctatgttaaagggattatgttaatataaacacagaaatactatgtgttctttctaaataattcacatcttttattgataaaattgtcactacaacgtacaaatggagcttttaactagtgacaatgttaacagtgaaacacatttatatttaattctttccaaaaatataagaaacacatttcgcaactaacctagcaactcttatggtaccatcatcttcctactgtgagctcaggcacgtaatatacatttttcactacgaataatttctttattaaccagttggcatggagtattaacctcaaaaaatatattactgttttgaaataaaccaaggaaataaaaaccaaaaatatgaatattaccagaattccaaaattatatcacagttaccttggtaggaaagtaacgcttggtcttaaattgcttgaggaatgaagacagaaaaaatgttgtgaaaaacaagatgacacaccaaaagagcacatctggaatataaggtccatgatgaccacaagctgaccccaagaatacaccacgaagttttttacattcctggaaaaaaggagaaagaaaaagcagaatgggggattcttacgtattcaataaattattatgagcttcattgactcgtaagatgcaactgattgtaagaggcaccattactttgtattccttataaagaaaaaacattgtccagccaactataacacactaacaactaattgtaatacatatcctgagttcaagatattataatttgaaaaatacgtgcatctcaaatcactaaaatacagtattttgccaagtcacttcaaatactcctttctttcaattccatattccctatactgaaagccttgtagtgagtattatttgtgaaatgtttcttctgcattcttgcttgtccacaattttaccgcttttcgtttctgaacaagtggtttaaaacaaaagcagcagatagaaaattaatactatgctcttttatgatgctggataagagatggctacagtacctaaattaaaatcagtaataaaaattgtctttagcttttctgacttgattcagtaccttcagactaaaagcacagggaccataagcagtaaaatgaccgttaaaatatttccattaataaaatcagtaacgtaataatatagcataataaaatgcaattatagaaactactgacttcattttcctttagggaaaaaaaaaaaaaactgaaaggcaatcagagattaatagaagcacatgccactaaagttctcctttttcttacttataatctaatgaagctcattttaacaaaacaagtcagttgtacccaaagaaaaatagttaaatgttccattattttcacatgccatgtgctgagattagtaaacctaatccattccatggatcatgaaaataaaagctataccattaccagaaaaacaaaaaaacccaccctgcatggccctttgggataacatgaaaacacttatatctatatatcaagacatctgacccatcatgaaatgaattatttgtaacaaatcactttcatttgaacacctctattaactacacctcttccttaacaaaaatgactttttaaatataaaatagtaaagcatgaatctatgttttttcttttatttgtttttagagacagggtctcattctgtcgcccaggctggtgagcagtgatgctatcacagctcactgtaatctccaactcctgggctcaagtgattctccctccttagcctcccagtaagttagctacaggcgcgagtcaccataccagggtaattttttaatttttgtagagatggtgccttgctatgttgcccaggctggtctctaactcctggcctctagcaatactcctgccttgtcctcccagagtgctatggtgtgaaccaccatgcttggcaatttttactgctttaaatcagcactgcccaatagatatattagatgatgcagataatgtaacatttccatcacagaaataatggaaatacaggagccagcagtcacatgaattgactgaacacctgaaatgtggctagttaactgaaaaactaaacttttaattaatcttaagtttaaatagacacacgtggctaatggctactgtattggacaatacagtcttaaattatcagtgggataaaatttcagataatatccttcaaattatatagttaggaactatcacctttagtgagaaaggaatgacctacagttacttatatgatataaaaagcacaacggtagctcaagggatcttagtcttaattctaactactggcaaactttacatatttatttctaactcccaggcttggaaatgtcaaaaataaatattctaggattaggacaatactcccccaacagaacacaaacatctgtaatagtattcagcacacagtaggtgttcattacatgtttttaattctttttcctttctcttcccttaatgttcgacccagactagtcttgatgagttagacaaggttaacttagacattaggacattaacacagcacttcatgatctaaattagctgtcgatggagcagatgaacagataaaaaggcaggacaagtggatataaaatattgtaaaggacagtatatgtagccacagtcccagtaaacacttcctttgaacgtatcaatctaagtagaattagaaaacagaagtatattcacatctttatactgttcatatcttggaagtcaaatataatccacctttatctctcgtgccagtttcattcttttcagcctacactttcgagcgcatgatacataaaaaagtagcaactgctatctggtcaaaataacactacattctgaaaacatactaccgatccatcaatcaagagaaaatggatgtctgattagaaaaagctaaaagaaccagatcaatatctattacaaaaccctttatttcaaaatatactcacagaaacagtaagatttctccaggaaatattgtgtgctgttatattatctttcttccattgtgctagagtttcattgctggggtttggaggttcagtacatacacatctgagaaattagagtaggatacatttttaaggatcctgaatttcatgcttacattttactaaatcaattatacaatgtggtagattttaacttctttttttcccacattgagaagcatggagactagaaagtggaaaatacatcagaaacaacagaatggaataaagtttgggttatagaaataaaataaaaccaatacaaatatcaaaacgtttagttaatgaagctagttatgtccttggtgagggcactattttacttaaaaatctaagatgattccaccatgtttagcaagattagtctccactaaagcttatctactcaacctccatagcagttactgctgtctccctccactcccccatagcacatatagattcccaataagttatactaccattaattctttataactgacaagccctacctactcacagtcaccctttgttgatcttaaggctcattcttaaagaaataaataaaaaatagtttctcatcaggacaggactaggagagtcataaggaaatcagagttcagttcatatccagaactatttcaactacctaaagctagaacacacgtaagcaaagaaacttttaaatacggacttaaaagatgaaaagtaataatcatgaatgttccaaactaggttatgaactgtttgaggaaaggcaagaagacagactttggagtccatccaggcgcttttagtagatgactgacctccaagttttaacctccaaggccatcagcttcttcatacacaaaaggggctatgatgtgaataagtaacactacaaatataaatttataatataaattaggcaacactcctaacacagtgcctgcagacgctcatagaatgttggccaaataaatgtaattcacatgttaattacccagttaaccagaaggaaacactgctctaactggctgacactaactataaaagtcatgctttataaaggtcaaagaagcaaaaggcaaggaaagaaagatttaaaaaatgtgtttaaattaaagcttctaagaggaatgaagatagtatataacagattcggcatcatagtgtcactagtatattcaaataggtcaatgtcttccaggaattttcataccctctttattctgtccgtcaaagttgagagtgtgcaaggaaaggcagcgggggaagaacgaatgaacaaaagagggaagtacatgtatctggggcttaggtgggtagaaaaagaaaaactgtatccttttgtgtcttttggtaaccatatttttccctgtaaatcaatcaaatgcagttccatatttacgccaagcgtgactgctaaagacagcaaataaaggcatctacttaaatatgtctacttttaaaagcctattttacacttattgaatatacttgccaaacttttgtaaccactacacattccttttcaaatcctactttattctagaatttaaaaagattttcattgcacttttttttttatcaaaacgaaaacacatattgaatgtactgaaataactttcagtaaaaattatcaagcttcagccgggcacagtggctcacgcctgtaatcccagcactttgggaggccgaggcaggtggatcacctgaggtcaggagtttgagaccagcctggccaacatggcgaaactctgtctccactaaaaatacaaaaattagctaggcacggtgatacgtgcctgtaatccctgctactggtgggctgaggcaggaagatcacttgaacctgggaggcagaggctgcagttagctgagattgtggcactgcactccagcctgggcaacagagagagactccgtctccaaaaaaaaaaaatcaagcttcaacaatattaatgaagatgcaaaatttgaaaaatatataaaaaaaagtctacattctattatacatctaggatttaaagaatataagatccaatgtaataattgcctgattcaaatatatagtggatcagttgccaatcaaatttaaactggccaatccaattcaaacagaagaccaaaacatacacatgtgaataagctatctcagtgaacaaaaaatactgaatttgatcaactatatttttgttcattgaatgctgtgacaaaatctcatctgaaacaaccatgtcactatcacatggctagttaagtagttatagctagttacactatcacactgcaaaaaaaattcattttctgaggctctgacatctctgtaaaaacacattttaatattaggagaaaagagaaatacttacgagtagctggtcagtttatctaagttgttgtgcatattaaatgcatatgtttctcctaaatcaaagagcttctccaaagcctcgtagatgaatatgatgcaaataagggctgcaaaagcctcttctgtaaatcgagtaatataacacacaaggctgcttgcatctgttgcaaccaaaacaatgcacaaaaaagaagtccacagaccaatactggttcttaaagacagataagaaagttgataatctctgtttagaaagaaaaatatgaatatgataaacatatgtggaatagtatttgtacctaaaatttttcattgcaagcaatgggaacagcaagaaaacacgattcctaaaagagaatgaattacagaatgacaaaataacatctagaaataactctatatctttttctgcttcggctgaagactagcttattagtagatttattattaataaattaattagtattaattattaatagtttattacacttatataaaagatttacagtgaaaatctaccaggcgataaatatttcaaaatcattacagctcactttataaatcagttatgagtaaatgacaggtatggtgtctatatgaaaaaacaattgcatcttactccctctaaagatccagacatcatatgtatcaatacagtaaccagctccaacatcattaccatcactaccactaccctcctctcccaccattatcaccacagaaagtgatttcttattttaaacttcaagaaattaccagaatctatacttcgggtcactgcattctctattagtctatgtggcatgccagattggaatcagattaagcttgtttagtgagtacagaatcagaaaaagagagctggatccatcaaatatgtaatagcatcaagttgtttcaaactaaaatatacaaacttcatttatgtcacaaaaggaagagtactagaggctgggagcagtggctcacgcctgtaatcccaaacttggggaggccgaggcaggtggaacacttgaggtcagttcgagaccagcctggccagcatggttaaactccatctctactgaaaataaaacaattagccaggtgtggttgcggcgccagtaatcccagccacttgggaggctgaggcaggagaatcacttgaacctgggaggcagaggttgcagtgagccaagatcgcaccactgcactccagcctgggcaacagagtgagattcagtctcaaataaatgaatacataaataaataaaataaggaacagtattagccatgctgaattcaaagtctaacagctacagtaccctatattcatttctacagtgtgaacaacctcaccgatggaaactgacacttcactctgattgcttcaacccaattcagattaacaccttcttactggtttaaatttgttagcacaaaggatttgtatttagccctcaagtgatctgcttatcagcattcaaatccactgattttatactcaaggacaatcttactttcttcatctccaagttactggattaagaatggaaggggccagaggatggtcaatcatacagtagctcaaaaataatgagaatgcatatattgaccaaattacttttaagcaattaaataattcccttctaagttaataaacaatttcatatataacacatgtgataagtagagagggctattacttacctgcagaatttatataaaattttttcaaacactagaactggacctgtgctccccaatattgttagaggttgcccagcaaacaatgaataggcaatcccagttaatgatgctccaaaaagagactctattgcactctgtttaaggaaaaaagaaatgaataaaagcaatacatcataaacatttctctaacgtactataatacatgtaagacatctggaaaataaaaatacccatcaagcagttataaaaccaacaccactttgagtttttaatttaaaatataaaaaattacaaatacattttaaatacacaagaaaaaatgctttctttttgcatattaaaaagaaacttttgtgatcatccttaattcaaaactcaatacaggctgagtatccctaatccaaaactccacactccaaactttttgagtgccaatacgacactcaaaaggaaatgctcattagagcacttcagatttcagattaaggatgttcaaccagaagtataatcctaaaaaaaatccaaaatctgaactactcctggttcgaagcatttcagataagggatactcaacctgtgctgtgggatgaaaggagcaaagagtaaatgggagagacacatactagggcttcaactttatctatatatgttttatttcttaagtctgtgagtacagaaggatatgtattattttgaatacttttatatggctgaaatagttcattttaaaaataaaaaatagtaaataatatggtgctacaaaaaagaactgctataaaaagatctttcgaataggtgataaatcaacatgtgactatctttctcaaactgatttctaaagagcaaaactttccacatattttaaagaaattaatctaatatgataggcttaatcaattatcaaaactgaaatatttaacaaaataaatgagaaaaatctcctcaaaaaaatttatagcaaccataaatgacaaagtatcactaaagtttggcaagaaaagatagagaaaatgaaagactaagagaatttaaatcaacgttagtatactaattttgtacaaccaccaccattacattctaactaattaggctatcagatgattagctatgccactagaaaaagggggaaagaatcagaaagtaaggaaagaatagtttaccatatacaaacatcaaggtcaactggaacgtactatccagaaaagccagcccattaattggtaaagggaaggagaaaagaagctcgtaagaaacaatcctgctgaaatgagaggcagcgcagcaacaggcaaagaggagggcttccgaaactagatttccagtgggaagactgactgctactaggtgttcagccatggccatatcttaacctttctaagcctaagctttctcactttgaaatggcggtgatgataactagaacataaatattatttgcaaaaacacctagcaagcatggtgtctggcacacagaatatagtcaatgaataggtagcaattctcatcatcagctagaacagcatcttccaaaatcaaaaatcacaaaatgacagtatgcaatgaaagtataattcaactattagaataaaaacaggatcaaactcaaagataaacaaatttatcttttggcagcataaaggagaagtgtccgtgttaatgacacatttgttaattatatgggctaaatttgttttcttgtctgtggagaaaaatgttcttaaaagacactgctaagccatcataaaatccttagttcaattacaataagcatatttaggaatgaatttatgcagagcttaagtcaaaggaaaaaaatgggccgggcaccatggctcacgcctataacacaagcactttgggaagccgaggtgggtggattgttttgagcccaggagttcaagaacaacctgggcaacatggcaaaagctggtctctacaaaaaaatacaaaaaattagctaggcgtggtggtacacacctatagtcccagctactccggaggttatgagggaagtccagtgaggtcaaaactacagagagctgagatcatgccactgcactctagcctgagtgacacagtgagaccctgtctcaaaaaaacaaaaagcagaaacaaaggaaaaaaatgtctaaatggtatacatacagagaaaaaaagcaaaacattgagacatgaagcaaggagatgtcaaaaaagacattaacacaggcaaatcggtataaaattaaggttcccctctcctaatcttgggctgaaaagcagatattgccatatgaagacctttttttttttttttttctaatttttgaactgtttctatgttcactgccatactgttacctgtcttttcccctaaagaaatcacagcctggctaggcacggtggctcacgcctgtaatcccagcactttgggaggctgaggtgggcagatcacgaggtcacattatcgagaccagcctgaccaacatgatgaaaccctgtctctactaaaaatacaaaaatgagcccgccgtggtggtgggcccctgtagtcccagctactcaggagactgaggcaggagaattgcttgaacccgagaagcggaggttgcagtgagctgagatcgcgccactgcactccagcctggtgacggagcgagactccgcctcaaaaaaaaaaaaaaaaatcagcctattaccctgcctgcctacctcattctcacattcagaagtttccattgtacccatcagaaggcctacctacccttaccttcccctcacacacctataaatacaccttctctactgtactaccctttcaaatcatcaaatactcctgctaatcttccctcctcaaaacctctagtttggttttcacagaatttcatcattctgattcctcttctaggtctgtgtgtctaatttgctgaaatcattttcctcctccatcccatccctccttcattccataaatctgggtaatttcacacttttcccctctccttctctccctgtaaattatctttcttgttaacttcctctattctatttcaaccttcactcctatataaacgattcccaatctttacatttcctcctcaccactctacacactctgggaccgtatctcctaatatctccatttccacctgaagttctaataaagcacctgataactaatacatatccttttcactttcttctataatatttctgcttcctctatttctattacttcaaatcctacagctcttcctttatctcactcacgtgtggcaaagcactatgtatatactattttgtctttttcacttaatcacttttgtctttttcacttttttcacttagaatccttgaggacaggagatactggctcttcttacacttatctatattcctccaatgccaaacacattgtcacatgtacaagatatcaaatagcaagattagatgggcaggtaatgaatgacagtccacggacaaagaggcagcaattccatgatggtaacagataaaacacatttccatggggactagcagagtgacatgcacaatttgtgacagcacataaagcaacttactaaaaatatggacctttgatacaatgattaaagactaaggtaaaaagattttacataatccaaaataaattcagagttgaaagaaaatttcagttgttaggtttatttcatgtttagatcatgaaatattttaattcgataattatcatgccttagctttggttattttttaacctttgatctataaaaaaatgaatgttctcccaagaataaatacaattaagtaaaatgcacttaagaattacaaatcgtctcatttaaatgccattaaaatgcatatcaacaacaacaaagaaatgcctttcaagattttacaaagcaccatagctctgaatacagtataaccaggaacaggaaaacataaaaactttcattttagtcatatcaaagaatggatgaagctttcaattatattttccaaataaaagttttagctattttcacatagacttaataacagcaaaattaaatgccacttcaaaaagccacagtttccataattatgttctattcttccagtcgagtataggcttaccagccaggactgaggagttaatattcatcctgtggctctaactaatcctatgataccttacaggatatgaagtagccccactgataaaaacccccatgacccacccagaatcagttcaactgttgtcttctcccagtccaccccacctcaaaagacaatccaagccttttactcaatttataaaaccattcatccagcaagccaaagtaaacttttttttaatttttttttacctcaactgtgcatcttctgttcaaatggcttccccatgttttccacagcaattacctttggggaaagtctgctttgggtcacgttaatcatgctgtgggtagactcttcaaataaaagtatgaatagtgagacaaatgcatacagacacttgcctctgaagagctaaaagcctggccactaccaatctttgtactcactattctgccttctgtagcttctccaagcagccctccaaaagtgattacaggagacatacaggcacagtataggaaaagaatcgaggccaggcactgcaggcttaatgcatccttgaagtcactcaagaaaaaaggtgctttccttttgatgtcaagtatcaaaccaccaaaaagcctaaataggtgagatgaaactcgtcaaactgtacactagaggattctagctacttcaaactaaaactatgggctacacaaaactgctggtgcctaggtgttttgtcaacaaaatgttaaatccaatttaacttataaattacagaagatacactcatttaatctaatctaatgatagaggaatgttatatttcattaagagacaaatatctgtattttacggactatataatgaaaagactgcaggcaaatgattttatatgagtaaatgtaattttggacacaaatgtgcaaggcaaggtataacaaaataaacaaaacccaacaacccatttatgaaaatgtgcataagcaattctattaattgtctatattaaaatcttaaaggcaacaatcacaaatacaaggaaggcaattattatccaaatacactttaatataaatgtagtatgttgtgcttagatgcacaagtggtatgaattcagtaactttaaaaactttcaaaactagtacttcaatcgtataaaagggggaaagaaatccctaaaaactatttcagtatatttaatttactgtgtatgtagacaaactaatatgtacattaataaaactaacaggtttcaattagtagattaaaaatctgtttgtacatcaaagctgtaccatttcaacatttttaacaattagtcttttggatacatctaacttgaagacattccaataaaatataagctccatgaggggagactttttcttgttcactgcgttatctacagtgtctagaacactacctgggaaatagtaggcactcaacaaacactggtgactaaatcagtaattcgttttaatactcaaaaaacagaaaatcattcaaatcccaactgcaagaaaattgaccaaaaaaactaacattaagctttcaaatggatatttcaagctttaccgttgtaatttttttaagttgatactgaaatcctaaacacaaattgacaagtagtactctgttcataatctgacagcaagggaaatcagcttgcaataaaaaaggtgccatcaataatctaaaatatgaatctacagtatatcatcaaattgataattacttaatagagggcatacagatgctctcaggtgactgagatcagtggaggcctgacacagtgcttctcaatgactaaccctatcccagtatgaagaagcgataatagctaataatacaacagtactgttcacacagggtcaaaatcttttctctattgtattcacagagacaaaaacacttcattagtcaatgaattaattgtgaatttcagtttctctaaagtctatattcagtatgccagttacttatttttatgatatagtaccctttaaggatgtcatcaaaatccctaagattgtatctgtataagattccctgttttttttacacaaagatttaatatttaagattatttaattccatactgaccaccagtggacaataaagaatcaatagccacatgcttttccacattatgaaaatactataacatttatctacttctacaaaatattaaggcaatgtttgcatctgccaatatttctattttttgttacaaaaattaacttcttaaacaatttttctagctaggtttccagagagcaatacaatggtttaatcatgcttgtccatggaagattacctcatgatataatgctcatttaagagttttaaatctgtgcacatatacaaagaaattattagttgtaattactctctgttcccataattctctaactcaatatgaagaattataataagactctacaccttcttcaagaaccttctgtataagcaatggaaattaacctacacactatataactgcaatattctgaatatacagtccattattttccttttaaagcttgatacatactattaaaattatttataaattcttatatatttatacatataaattttccttatatataataatgcacatttttatacatatgaaaaaatactgtacaagattaggttccaaacacttggaaaaaatataatatttatgttttcatcaaatcatcccccaaacccttcaaaatatcagtatttgcacccaccgtccagtcctctgtagctcaggcccagcatgatgagcggcctctttaggagtctcacccagtgtgggggtagatccattgtgaaacacaggaatctttctcttttcctgaatttcacaaaaaacattattttcagaattctattttaagaaaacttgagatggcatcttcaattagagtgaatatcagattttatattgattatgtatctaatcagttctcctagaaaagaatggttcctaaaataaactctcttctgaaatagattgctctttaaaaatagaagctaatgtcagtttctattaatattttaaatttgcaattagctttttgcatcttatgttctaattatcaatatactataaaatatattcatacataccatttcaaattcctattcaccaatagctacaaacgtaagtaacctccaaaaaagcatctctcccaccaaaactttaaaaatactgctcctattaactattgaaaattacgctttacattaagagaaaagcaaatgtcatttttcttctactaaagtatttcccttaaaaaataagagctgtttgataaacatgttcccacaaaaatccacttcccattacattttattacaaattcaagagtactattcacatgatacaggatttctccccctctgttaaagacaaagaaatgaacttttaacttgttacatcaagagatgctggggctaaaaatatgtgtgagcatgtgcacatacaagaggaaagatggtaggaaagatggaagaaaaggaaacagagaggtaaagggaaagggagacagagatctgacatcccaggaggtttactgggtcaaaggctctaggtgaataaaagacttaagctacctggtttacatgctccatatttagagagtagcaaggctcatctacaaatataagactgccatttgaaaacgtcaaaatctcacttacaaaatttcaattttcaaacttacatcttaaagaggaaagggataaaattttagactcctaggaaacaaaaataattttaaaaactacaaattataaaagtaattgtggttttggctattatttttaatttaattaatcatttaactgatttaatcatttaattgaattgattaaaaataatggccaaagccacaattacttttgtgccaacctaataaaacccatgagacccagccaaagcacattcaagaaaattaagcaattatattaagagaaatgaaacaaggaaaaaaaagtgaattaaacaacttcctcagaaaatgtgaaaacaaaaaatctttcctggaagaaagtgaaaggaatgaaataaaacagctaacagcagaaactaagatacaaaataaaatgcattttttaaaagtactaaaataacttttaaagactgctgtttgaaaaatacaatagaccttcagctaataacaaaacaaaaaaaggaaagaggcaataatttcatagtgagcacattttatatacatacacaaatacatactacatataactccatgcaaataaatttgaaacctagatgaaactggtaatatactaggaaaatgatttaccaaaactgacatcagaaaaaacaggaagttttacatataccaatttccaaagaagaaataagctaattgttgaagtctacatgacaaaagattcaagctcaaaaaactttacaaaggaattcttccaaacttttaaaatcaaattattccacaccatttaaaactgtttaacaaaaatgaaaacttacaaacttgtttatgaaacaagtatattgatgtgaagtataaaatgtgaagatggcacaaaaatctataaaccaatctacagtaatacaaactagtagacacagaccactaccactttaaagtccaaactgggttgactccaggaattctttcatattcaaaaatctattcatatgatttaccataataattgataaataaaattaatataatcatttgccagagatgctgaaaaggcatttgataaaattctacatcaatttatattttaaatgtcaataaaaaagaaataatgttactttcttaacatgatgaaatgtatattttggctccaatgtcattatcttacttaatgggagaaatactagagacatttgactacagtgagaaacaagtttaaaaatgcctatttaaagcccatgctacttaacactgtactagagattttagttaatacaattagacaacagaaaacaattacatgtataagatttagaaaaggaggaataatactatctcttacttacagattatttgactgaaaaactattacaaacaattaaggatggtagcaggattaaaaatacacagttgaggccaggcgtggtggctcacacttgtaatcccagcactttgggagaccgaggcaggtggatcacctgaggtcaggagttcaagaccagcctggccaacatggtgaaaccccatctctattaaaaatacaaaaattagccggacatggtggtaggcgcctgtaatcccacctactcgggaggctgaggcaggagaatcacctgaacccgggaggcagaggttgcagtgaactgagatcttgccattgcactccagcctgggtggcaagagcgaagctccatctcaaaaaaaataataaaatacacagttgactcttgaataaacaagggagttggtaccaactcccatgcagttgaaattttgtgtataactccctgaaactcaatctaataagcctactgttgactggaaagccttactggtaacatgaacagtcgaacatatatttggcatgttagaggtgttatatcctatattttcacaatacagtaagctagcgaaaagaaaatattaatggaaatacatcataatttctatttcactttatttcatttctctaaaaatgtggacagtaccaatccttgtttccttcagtacccaaaccatagaaggatccatgttgcaaaagaagtcaaaagcaatcctgaataatcagaacccttctgccagatcagctgatatcaatttgttttctggcactactacttctatatctttgtcctcatcaccagtaccggttaagcactcatctccatcaagttgtgttctgttaactcctctgatgtggtgtttactagtttttgagcttctccaagatccacatcttgaaacccttcaacctccaccttttttgccatatacacaatttccttgagtggctctgctgtaaaacctgttaagtcatgcacaacatctggacagttttctccaagaaggaatttattgtttcaggctcgataacgttcctggctttttctataataatgatggtgccttcaacggtgtaatccttgcagactttcatgatgtccttgctttccaaggttctcttccacagcattaataatcttttctacatagcatctaatgtatcaagacttaaaggttctcagccccctaatctagagactgaattagagacattgtgcttgggtgcaagtagaccacttcgacacctttggtgctgaactcacaggttttgggtggccagatgcattgtctaatatcaaaaagattttaaaaggcagtcccttactggcaaggtacttcctgacttcaggaacaatgcactgatgggaccaatccagaaaaagggctctcatccaggccttctcatataacaaaaagactggaagctggcatttatcttttcccttcaaagctcagcattagcagctttatagagaagggtagtcaagaccataaattggactgcatttgcacaaaacagttagctaacccttcctgcattaaatcctggtgctcactaatctttcttactaataaatgtcttctgtagcattatttccagaacagagtattttcatctgcattaaaaacccgttcaggggattttcttaacaggatctgatctgggaactcatctgctgcctcctggatggcagaagctgcttctccagttattttgacattttttaagccaaacttctttctaaaattaccaaacaatctttgctggcactaaattatccgatccttcgcttttcttttgctttatgttgtcgtaaaatgactgctttttcttggtcgtatcagaatctataggtatgtctttcttatagtaatctgcacccacataaaagctgcattttcaatatgagataaaaaggcattttgcaaaaaagcaaaagtgttcatgcctgctggcatagctacagtgacgactttacgtttccttttctttttacaatgatccttacgctggattcatttatcttgaaatgacaggcaatggcagacttcattctatggtacataccaagaattcaacttcatcttacatttgtatgacttttctctttttcttaggaacacttactagtatcaccaacaggacttcctatgagtcccatgttgttactcaaaagtttacagtattgcagtaaacatgatgaaaaatatatgagaacctcatgatcactttttagggtaaacacaatttactggagagacaaactgctgatgtggagacgatgagcaacacacagcattttacgcatgttaacttgcaacacttgagctcactgcaatagcaacaggtagtaactatgaaattacaatgacagtggtatggtatttactatagttaattttatgcagttaggatttaatactgcatctttacttttatttacatttctctccactgagaatggtgccatgtacactcttagtgtgtataagtttttgataaattttagctttttagaatagatttgtatatatcttatggtaataaattattattaaagaagactagtacatacatatattttatgcattcaggaatacctaattaatcttaattttttgatatttctaggctatgaagtttgcatgcaaattttttcaaattatcaaaaaactttccaatgtttattgaaaaactccacataattagaactgcacagttcaaactcatattgttcaagggtcaactgtgtatgtatatatgcacataaaaaataacaaatagccttcatttcatataaaagcaacaaagatacaatactcatgaatatactcaccaagaaacatgtaaattataaggaaaacttgacaacattctttaagaatacaaaaacttgcttgaaatagaaaatcaactggtgagagacactccatgtttttgaatagaaagactcaaactcatgaagacgtcagttctccctcagttgaatgagaaatttgtcatcacaactttttaaaaaccattacgcatatttctgaatatagaaagctgattttaaagcctacacagaaagataaatatgcaagatagccaagaaaattcagaaaaacaagagtaagaaagagagcaagaacaagtctagacctaccagacattaaaatataccaaaaagcctcaaaaattggagtgtggaattggtccacgaatagacagaccaatggacaacaaaacaaagtccaaaacaggcctgaatacaaatggaattttagctaataaaggcagcatcaccaaccaaggggagcaatgtttagctcttaatgaacagggagaaccaggcaggaacttagaaaaaagatgaagctgggtccatactcacataaaatacgctatcataacctccaaaggatcaatgaacaatttaaatgttaaaaaaaataaaatgtaatgggaagtggatttttggtggtggggcaatgaacaaaagataatcaggaatattcaacctcactaattatacaaatgcaaattaaaacctcattaaaaggccggaagcagtggctcacacctgtaatcctagaactttgggaggctgaagcaagaggatcactagagtccaggagtttgagaccagcctgcacaacaaagtgagacagcatatctacaaagtatcaaaaaattagctggggctggtagtgcacacctgtggtccaggctacatagaaggctaaggcaggaagtttgcttgagcccaggaaactgaggctgcagtaagccatgttcatgacattgccctccagcctgggtgacagagcaagaccctgtctcataaaaactcaattaaaaacctcattaaaatacttaaaataggaagataaagatacctattagattgacaaatatccaaaagtctggcaacacacactgtcggtgaggatgcagggaaataggccctttcatacatcactgcaggagtccaaaacactccagctgatggagggaattctggtaatatctactaaaattataaataaattcccctttgacccagcaatcctattactggggatctattctacagatacatctgcaaaagactaaaatgacatgtgatattgtcatgcatggtttgaaatagcaaaagactggtaacatcagaacccaggaatagaataaattatggtacatccatgcatagaatacaacaaagctgtgaaaaagagaataaggaatattttcatgatttcttatgtcagatctcctagatacaacttttatatgaaaaaagcaaggtacagaacggtatatgcaatacactaacttttggtgacagaaacaagactacatgttcatagtttcaagtactgaatgaaaaatgaaaaggataaacaaaaaactagtaaaaaatggtccacccacaggaggtaagtatgggggtaagaaggtaaacaggacgaggtggggataaaacttctctgttttggtttttgaatcacacctaatcaaaaaaaattttattaaaataaagtaagtcacagaagaatagctctggattcttacctgagaagggacactttttggtggttctatgcgtatagaaggatcccactctcctggaggtaggacagttacttgatctaaaaattcatcaattccagataagaggtcatttctgtcttttgctttataagctacatcatggaaaatctaagtgaaaaaaatattgagtaaaagattttaaagttgaaaaaaatttctacacatagtaaatccactctggatatcataaatagcttcacaataaagataacccctaaactcttatctcaggcaggtattcagcccagcctgggtaacaactataaaaggtaatccactcagtattatcagatgaattaacaataacaaacaatgaaagagaacagttacatgttaagacagaacaattttttaaaaataaaattttgcctgggaaatagtaattgattagaaaataaaacactgtagcgtgtcattctacttctatgacatttaaatgtcatttatcctaagaaaataatcatggatatgcaaacaactttacttaaataatttatttaatgaccaatatttactggctacctactaactgctaaaatacaattctaagcattgtggataatgcaatggtgacaggtaaggcaaggtccctatactcaagaacctttttttctaggaggaaaaacagtgaaacgcgttattaaataaataaataattataggtattgatagacgctctgataaaaagaaagtagggtacagaaagggaaactgatgggaaagaacaaaggagccaggaaaattctcttaaaggaggtaactgaccaggcacggtggctcatgcctgtaattcccgcactttgggaggccgaggcaggcggatcgcctgatgtcaggagtttgagaccagccttgccaacatggtgacaccccatctctactaaaactacaaaattagccaggtgtggtggcgtatgcctgtaatcccagctactcaagaggctgaggcaggagaactgtgccaccacacccagctaatttttgtatttttagtagagatggggtttcaccacgtaggccaggctggtctcaaactcccgacctcaagtgatccacccacctcggcctcccaaagtgctgggattacaggagtgagccactgcgcccggccaaaagtttaaatttaaatttcactatatgataggaagtcattaatatctttggactaaggaaatgatacattcaaatttgcatgttactgagagtgtagagaaaaatactatacaataaatactcataaaggctacttgaatcaacaaataaaaggctaagccagagaaatggcagtagagatggaaagaatatgacagattaaatgcaaaacacattgaagaggtaaaaagaatctggtgactggctggttgaaagaggacagaaaaatgtgacaggcgcggtggctcacgcctgtaatcccagcactttgggaggccgaggcgggcagatcacaaggtcaggagattgagaccatcctggccaacacggtgaaaccccgtctctactaaaaatacagaaaaattagctgggcatggtggggtgcacctgtagtcccagctactcgggaggctgaggcaggagaattgcagtgagccgagattgcaccactgcactccagcctggcaacagagtgagactctgtctcaaaaaaaaaaagaaaagaaaagaaaaagaaaaagaaaaattaggtcaggttcagatatggggcatttcaaatacccttgggacacacagcactgatgtttggcaagaatctgattacaaatctctcttcaaaagaaagacaaggtcctgattagtatgtaggttatcgtcaaagatcgggaccccatatcagagaaatttacaggaaaaaaaatgttctgaggaaaacctagagaaatgatatgctgaaatctaggataaaaaaaatcccaaaatttcgaaagttcaagaaggtagtcaataattacaaatgtttaaaacaaaaaaaaatttttaaatacccactgatcttgatataaaggtcttaaaaacctaaccgaaggcaaataggagaagcaaatatgagataaaacagtatacacagcaaggaaaagttttagagcttcactatgaaagaaaagagaactgtaatctaatatatactatatgctgcataattagtgtctacttcaaagagacttggagtattctgattacctcatctgtcatgagagtggctattgatcgtccaatttcatggtactgtggtgccttgcccgctggacccaataacaaaaacaaaaacctaaggaaatatgaaaatacagattttaaaataaacatcatacacccacaaagctaggcaatcataaaaaagaaaccattcaaatataaacaaagaaacaacactcagacatcttttctactcccccacaccaatcactgaaaaaagatggcaactccacccggactaaaggaaatcagaaaactaggaaaagcaaccataattaactaccaaatcaaccttctaccaaactcctgacctcaggtgatccacccaccttggcctcccaaagtgctggaattacagcagtgagccactgtgcccagccgatatttattttattgtactttttagttccaggaagaaaatgattttatgccctattcacaggagtcttatattcaaagtatttggtacagtggctgaatattaactattaaaatgagattttggctgggcacagtggctcacgtctgtaatcccaatactttgggaggccaagacaggcagatcacttaagtaggagttcgagaccagatgggacaatggcaaaacaccatatctactacaaatataaaacttagctaggcatggtgctgcacacctgtgatccagactactagggaggctaaggcaggaaaatcgcatgaacctgggaggtggaggttgcagtgagctgaaattgtgccactgcactccagcctggatgacaaagtgagattgtctcaaaaataagataaaattaaataaaataagcttttattacataaatcaacatgcttgttcattcgctggattaaaaacttgtagattttgaaaatgcttagagaatgttacttggaactaactctttacctggttggaacagggacctcagtcaaccctgtaaggaggacagcaggagccagtctcacaaatgcaattattggcctttccaaaaagtctacttcgcccaccaggacgttggatgcctcagcacccgtaggaatttttctcatgaaattcatatcaacctattgacaaataaataattaaaaataaagtttccgtggtatttgtaagactagagagaaacaggaaagaaaaactgctttataagactactatttgctaatcaaaacttgtgatctaatgaatgtttaaaatgtcaaaattttcacaaatataaagaatggagtagacatacaaaaaagcaagcaaacttatttgaatcaatgctactgttttaactgtcacaatctttatcaaacatgaacttgagaaatttttcaatgaatactgcactattcattaaaaactattaaggacaaatatgtagttcacaaactaacaatggttcatgaaattatacacagtgctaaaaaatattcatggttttatattacttaaccttagaaaacctttacattttatgtaaagtccccctaaaaacaaaccaaaaaattactctgggcatttcccagtcttttcattaactggaaaaaaaatcattacttttatttcattagtagtatttttgagacaaggtcttactctattgcccaggctggagtgcagtggcaggaacatagctcactgtaaacctcaaaatcctggacttaagcaatccttgcaccttggcctcccgagtagctgagactacaggcatgcgctaccacgcctggctaatttttgttgtttttttgtagaggtggggggcttgctatattgcccaggctggtcttgaactcctggccaagtgattctcttgcctcagcctcccaaaacacagggattacaggcatgaattactatgcctggccccttgtttttatttaaaacaaaaatctatagcccttattggcacagatatatgataatgctataatagtaaaatttagctttctgtgtataattacaaggaaaaggttacacatgataccaaattatgtgaacttcatttatatgcagtttcacacaagtcactaaacaaccacttacagggctatctatgaaaagtaaaaccagcacttacagcgggcctcttgagtcccacacccagtgtgccacaactacagtgccaggaggcagactcctgcccaacaggagacaaggaagtatacacaaagataggccaagtaaaaaaaagtaagactgtgacagaggaacaaaaataaacggcaactgccatgcctagaggaactctataatgtaaattatattaatttattcatttaacaagaaataaattgcaattttgttactaagtactttgcactatctgaaataacatgagcaccagtaaaatgtgatcaggatagatcagaaaaatttaaaatacaacagcctttctgcacagccaatgtccgtaatgctaggcttcctatagttttagactacaacactcaacaaagctataatgcaaaccatttaaactccttttctgtaaaatatatcttgtagacttttcatcaaagactaaaaggcttaagaaatgaaatcagcttgacataattacatttattaaaaagtcttatactggatacaaaaatattaaaataccatgagcatctggtattttactatagcaaattaatactactaaaaaattagtggctagatagaatcaattgttcataagaaatactcataaagtacattttacattcagttacaatttgaacttagtagtcttttgccctgttcttttaaattaaggtttatctatttcaacaaaatactcatttaccaaaataaaaaaatcatagttcacataggtatttttttgtaatccatgcctttaacctacccatggggaagcaccaatatatttctcagtgacattccaaaagtactgacaccataagacagtaattctgggatcgcattacagcccaggaaagactgaatcattagtgctgtaacatcactcccagaattaacgttctagtggtggtagctccagaacaaatgactgtagttcaaaaagtactgacgtttcacgatatctatgggtaggtatggatggaaatatcgtattattcacatattctttttcagaatttctaacactagtaatggtgtaaagttattcaagtactcacaggttaactgtaacccttctcacagtttttaccttaaattaacatatcacagacatcacatgcaggtttgtaagcaccagtctactaaaaaattactatcatcaatgttaataatattagccacaaattactacttatttcctcagtaagaataattatgagaattttcagttaatgatagaattaccttgctgaagtcaacagtactattttctctgcttccaccacttccattacctttaatttctccacttttactattgtccaagtttccaggagcagactggggagaggccaaaatacctatgtttaaagacaaattccaaattagtaaggagaaaattcactttgcaacctgattctgctcacattctgaaagtgatgatttatgaatattataaaagcaaatgtgcaaggttaaaaaaaataagtgcccggtgttagtaacataccagcaaaactagaacaacattttaagcaataccaaagctatacattttaatatttaaaataatacaattagaatttacaaaaattgtggccttttgcaaaaagaaataaaacgtgagttggtgtgaaccacaaaagatggaagacctgagtctgattatcattaaaaatacttagggaatatacttttaattatcataaacatgtgaaatgcatggaacttaatgaagcctagctgtacttagcatgctttcaacaataaattctctgacaaaccctaagtgtaactcagaaaaaagctacactaactaaatgcagattgaattaacataatctcccataatcagaagtttcctaaagacttttcatttttctttgttaacatttatgtctataatacctattgtcattactcctaagaaatccaactttaaaatataacaagcaagttttttgcaatgaaattggcagagtaagagttttataaccaaagggatctgtgtttaaattatgcactctctgccactttgtatctatgtgactgtaagaaactcactccatctctaagagtcagacaaactcataaaaatagcttatttggattagaaatgatacttgtttggatttcaaaggacagacacatattgaagcattagtatattcatttcaaaagtgacattcaacaccaacatttcgcaataataaaaacacagcttaatatgagactaatcattaacactatgaattctaattctgcaaaaaagttaaaatttaaaaaatttcaaattcagccgggtgcagtggctcatgcctgtaatcccagcactctgggaggcagaggtgggtggatcacctgaggtcaggagttcaagaccagtctggctaacatggtgaaaccccatctctactaaaaatacaaaataagccgggcgtgatggcgtgtgcctgtagtcccagctatttgggaggttgaggcaggagaatcgattgaacccaggaggcggaggttgcagtgagccaagattgcaccattgcactccagcctgggcaacgagagagaaactccgtcctaaaaaaaaaaaaaaaaaaaaaaagggccaggcgctgtggctcacccctgtaatcccagcactttggaaggtcaaggcggacggatcacctgaggctgggagttcgagaccagcctgaccaacatggagaaacaccctctctactaaaactacaaaattagcctggcgtggtggagcatgcctgtaatcccagctactcgggaggctgaggcaggagaattgcttgaacccaggaggcagaggttgcagtgagccaagattgcaccattgcactccagcctgggcaacaagagcaaaactctgtctcaaaaaaaaaaaaaaaaaaaaaaaaaaaaaatttaaattcaagtacactacacagatttctactactaggttggtgcaatttcctttgctccaacctaatattaaatgcatctcatttttttcaaaacatccaaggttttctagtgcaagaatatagactaataattcctaaaacactgaacattataggaggaaaaggtactgaaatacaacagactttactttttgttttaactgtcccatgcacagcaacacatggaagttcagttaaaatctgttttgtggttagattctataagctctgaagatgtactggtaatcaagttccagaatttaaagtacatcagatatacctgacacatctaaaggagttttcacttttgtaaaacagaatatactataaccaatgaatactgaaactaagtcatctgggtttacggcttacgctttatgacagagactgctgtcatcgtcacttctctgtaaatacctaaactacaatgttgatgtgacgaaaaatcttaatttgcaatctatttagccatgtgctcactttctggaaaagttaaacaattccgaaatacaaacgatttcccaagcctcaactcatttcttacaaccttagcttggcacaccaagaagattcctcttctttgacctttgtccctaaacttccagaagagtcccttccttgctcaagagataaaaagttaaccagtgtttttcagtgacttccaactacttccacacaagaaaactgagagtaccatttggccctggtggcaaacgcagctgagcattacatacttccaaaggctaaatgtattccacctgtgtatatatatcatcaaaagcatacataacgcacagttttccagaatagtcctagctgccagatatgagggaaaaaagtggaatgatgagaagactctaaggaaaagtaaggatatgccagcaatgagaagaagaaataatgaagaactcaacattgacaaagttagcaggtataacctgaagtcacatggctaacctggtcatcttgaaaacctgtccctttttcaaaactggcacactggatgcatgctacagttcttcatcattatgatttgtgtagtctttcccaacctcagctaaactaaaactgttttctcaatcagtaaagtctccctgctcctataataaattcctagcattcacaatgagcaaattacaaaaaaataaagctatcattagcacaaacacagaaggactatattactttgctttaaggaaaaaaatatatgtataaggaaatcaaagatatcagcattttctttaaatttttctttaaatttcaaattttaaacttttcattaaaaatttgaaagtgaggtagttacagcaatggtgcccaactaggaaagattatgacccccaagggacttgtgacaatgtctggagacatatttggttgtcacaactcgggggtgctgcaggcagctagccaaggatattgctaaacatcctataaagcacaggactactcccctgccacccaatcacccagccaagaatcatccagcctaaaatgtcaatagtgccaagattgagaaccactgagttagaaaaaggtatttacaagtactaaaaataaattcacttctttttttttttttactttccctagagatgagggtctcactatgaactcctggcctcaagtgatcctcccctcttgaccttctaaagtgctgagattacaggcatgagctaccatgcccagccacaagttttatacatattaatttatacaatttataattttatacatataacttttatacatataattatcttctaaaaagtaactaatgggaaataccacttttttattataggtatgcacaaattatgactctatgacacaaaaatccatggtgttagtcgcttgagacataatgatgctgaggccactttcttccactaagacagtaccaggcatcaaggaaactccattagagtttctagatgctttaagcaccgaaagtaattgaacagagaatcatgtatagctgtccctatttttcctcagcagttacatactatctacagtcgtctttttaactgtaattcttgtctttagaaattccctctctcctctccactctaatttcttctgttcaaaaaggccgataaatctcatcacaaaaactcatgggaaaaaatgtatgttggattctcagttaatttatctccttaacacggcctaagaagccaatgtgaacccatctcccccttctttcctatataaaatttatagttcctaattatttataacatagaagctggtaaaacaagacatgttcattgttactgatcaatgtaatattggaaaaaatggaaggaagtagcttttaaaatcacttttgttcaaggaaaaatagtaaatcttgttagttcttaagattagaatgctgattacttctgaataattatttttagggttgttttcctcttttatgttcagttacttcatcattaagctttatctttttcacgaactgataaagttcacaatgaaatactctagtatagattttgttgtaagtggacctgagttcaaatccctgctctggttgatcttaacatctccaagtcttttttcactgaaaaacaggaataacaccaacctcatcaaatcgttacaagaattagaaatatggtatttgaaaagcacttatcgctgtctctggaacaaactataaaacaatggcagccatactactattataactaatgtcataatgatttagccatgaagcttctatttgtacttccaaaagtatatccttttttgcaactacaatgagctttggctaaatgtaactggtgtgtttccataaagccaatagaaagagaggtttacttcataatgataggaacacaaggatttccagtcagaggatttaggccatcagttactagttgtatgatgcaggggaagatgactaacttttctaagtttctgaaaatgggtgtgtccatctaacttacccatatttgtatacacattaaataggctaataaccaagctacccactgaagtgctggatgttgtattttggagaaatgtgataatacttatgtgattaaaaccaatggttagcattagtatccatcacattgaggcttagctgaaataattaaaaagaaaagttactaaaatatatttattttatattaggcaaaaagatatatgtacaaatgtacatgtagtcaacataaggataaaccaaattttcatactttatagcccttaagatgagttataggctgggcatggtggctcacacctgtaatcccagcactttgggaggcccaggcaggcagatcacgaggtcaagagatcgagaccatcctggccaacatggtgaaaccccgttgctactaaaaatacaaaaattagccaggcgtggtggtgcatgcctgtagtcccagctacttggcaggctgaggcaggagaatcacttgaacccgggaggcggaggttgcagtaagccgagatcacaccactgcactccagcctggcgacaaagcgagactctccatctccacaaaaaaaaaagagttataaaccttttctccactaaaaaataataattttttgctaattttgcacatacaatttttttttccctaactacaggaactctggtcctgaaaatttcaaggtaaatttggattaaagataaataacagcatgaaacaatggacaactaaaatctattccaaaacataaatccgagtctgtatatgattccaggcagtcagtcattagagaacttcaatcttctcaaaggcaaaatgagaaaaagaacacttgatcctatctttatttaaaagactaaaatgtggctgggcatggtggctcatgcctgtaatcccagcactttgggaggccaaggtgggtggatcatttgaggtcaggagttcaagactagcctggccaacatggtgaaaccccgtctctactaaaaatacaaaaattatctgggtggtagtggcacgcgccgtaatcccagctactcaggaggctgaggcaggagaatcacttgaacccaggaggcgaggctgcagtgaaccaagatggcgccactgcgctccagtctaggcaacagagtaagaacctgtctctccaccccacccgcccaagcaaaaaaaaaaagcctaaaatgtactacattctttggagaaaagcattaaatagaaaaaaaggtatggctgggcctggtgactcacacctataatcccagcattttgggaggctacggcaggaggattgcttgaggccaggagttcaagaccagcctgggcaacacagcaagataccgtctctacaaaaaacttagccagatgttgtggcatgtgcctgtagtctcagctactcagaatgctgagtcaggaggattgcttgatcccaggagttcaaggctgcagtgagctatgattgtggcactgcagtgagctatgattgtggcactgcactccagcctgggtgacagagtatgactctatccctatttaaggcacatcacttcactataatttatttgtatgtgttcattcaccttatgagtgaactgcatgcacacacacacacacacacaaaaccaagctaccaaggcaagacgcaatcaatggcccacacctgtaatctcagcactctggtaggccaaggtgggtggatcacttaagcccaggagttcaagaccagcctgggcaacatggtgagacctggtctctacaaaacacgaaaattaaccaggcatggtgacacgcccctgagtcccagttaactgggaagctgaggcaggaggattgcttgagtccaggaggtggaggttacagtgagctgagatcatgccagcctccaaagcaagaccccgtctccaaaaaaaaaaaaaaaaaaagttcacccagcctggccagcatggtgaaaacatgtctccacaaaaaaatacaaaaaattagccagacgtggtggctcagtcctgtagtcccagctactcaggaggctgaggccatgagaatcacttgaacccagggagcagaggctgcagtgagctgagatcacaccactgcactccagcctgggcaacagagtgagactcggtctaataaaaataaatacataaataaatataaaataagttcatggcaaattaaaacattataaaaaatgactatgttttactgaagtgttcaaatgtcttgacctttaaatctaagtgaaactttttaaaagggcttaaattatgtgtagtcttctttgtagtctttttgtaactcaaatttttaataatcttactcttttttattaggttggtgtaaaagcaattgagttcttgccactgaaagtaatttttgccattgaaagtaaagcaaactttcaacggcgaaaaccgcaattacttttgcaccaacctaacacaatctatcataaagaaaaaaaaacatgcagaagtcaaaataaattataagcattatctacatatgctgcttaagctatgtgctaaaaggcattccaagtgcaagtgactcagaggcagaaagcaccacacatggaggattttggatagttgcctggagttaagtcaacattttcctcattcttctgctcctcgcctttcagcgctgcttctaagtcttcctcaggcggatgaattactactgtgggaatatcatcactggcaggtgaaaccagtagttctggggcctgacgctgactctcttgggaacttctggaggtcaggcggctgatgctagggctagaaggaggactgttttgaggggtgggtactggggttgtacaccttgagcctgcaggggttccagctcttgaagaaggaagaagatgaccaagaagaagagataaaggtgattctcctctcaaggaaaggtttgaggcagacagacctgttcgcaaagagtggcgggaggctgaaaggccttcccctgagataaaacaaataaatgaaaaatgatgaagtccactgcagaaggcaaatagagacatttaaaaaaaaatcaatttacactataaattgcatacttcaaaggcccaaaatttcaaagtcatgtgatggttagcatgtcaatcgggtttttacatgttagaaagtcactaaaaagttggttaaaactgtaattagttctcagaacacataaaaaaaaattgttaatgacagatggtgggggcaatatcctgttagaaattagaatgaccaatagcatggcatttttaaaaaggacaatatcaatacaaagtcactgcttaaacaataaatagcaaatgaaaatatgtaatacacaattaatataactcaaaccaaaaataaccaaaactaatagcttatatttagcgtatttttcctacattttaccaaacagctacagacaattatctcttagagaaaaagttcatgttaacattaagtaataatttctaacttaaaactggtattaaatatttacaatattaagtcagtaagacaccatctacaggtggtgctgctctgaagttttaaaaaaagacaaataacagaaattttttaaaaagagaaacacaatgtcaattttaaaggatacatattcttgagctctctaaaaatattaataaatgtcctaaagtatgcttttcatttctgatatgtagcagatacattaaaacaaatacatataattttttatttcactagctaagaataaagtacttctcaccaacaacagcaatatagcagtaggtctaaaatatttcaaaaggtcatgcatacttttaattaaacccctcatatttgtactaagtgtatcttaaaagaataacattctttatgaaaaacatgcaaatacaatattcaattccatatggcctaatcaaagttacatgctcaagaggtttcagaaatagttaaactataatccattaggaaacaccatttaaacaataagctacatgcaggaaaaactcaaattataactatatttcaacaaaagaacatgctaaaatggcatttaaaagaaaacagtcaatgtcttctgatgagcaaattacaattggacaatagtgaggaacaactgcatacgaagagtaaagactgaatagggtccctctggataaatgaacttatttcaccaaaggagagaatataaacaacaaataaaagacaaaaaagagagttaaaatgcgctatacattggcttgtttttacattgcattttggtccataagaggtattcttttactcttaagattgcttaaatacaacatggcataattttaaatggattaaaaagggttttcatggccaagtggaagataaaaaagatgattattttcaactttagaaaaactagaccctatcacctatgcttgcttgttggtagaacacttaaaagtcatactattatttcaggggtaaaaaagatgagcaggcactgtgccccatactccactagtcctcactgtaatcctcacgagctttgggtaatagtagcagcttacagcaactactggaggctacagtgactctccataagccactctgatcctttgcacccgggttttccagactcactgtcagagttctcaaccctactgatgcattcctctgctttacacagaagaataaagaaaggcaaaacctccaagtgtccagcattaggacaccaacagaggtaaacgactgcaaaaacactgtcttcccacatgccacacaacctgcctgtaacctaagaatgagagtagaaaggtggaatatgtagacctgggtctgagccattctcaatggattagaagacaccaactaggtcacccttagtgtaagactggaacagtcataaaagcctttcacaagttgtacaaataaagagccgtgaaatcagcaaaccaatccaaaaacacttgtttataccagcaaatcaagtatgttcaggagaaaaaaaaaattaggaaaaatctaaaataaaggttcaaacccaagatttagaatttcaaaaaggtaatattaaaaattatagatcataatttatgcctctttaattaattatacaagaggccttgaaaagaaacaaagcaggaaggagaagtaattcagaggtaggtatagtgagtgtttaaatatccccaaatgttaatcgtaacatactggaaagctgttacagtagaagtgttagcaaaaattggatgccacaacttatctcaccattcctttcaagcaagtgagggtcagaatgtttcttgcctatatctgcaaaagatcgaacaagaggaatccgactggtgaatcttttctcattctgatgatgatgtctcttcagaagagcttctctgacattctctcgtatggactcgtctaattggccagaagctatcatgttgtctaataccatatctattcaatgaaaaaaaaaataaattactaaacactcagatgaccataatataggaataaactgtgagtgaaaccttatgacaaaaattagaaccttaaatagctctagaaagttttattctgtcacaaataatcaatgcagaaatgaacattatccaaccaataaaaatgaattacaaagaccgccttattttaataaatactattatttataaagaggctactattatatactaatagccttcctatagctgaaagtgcttccctgtatgaatacaataaattctattaagctgaatattcaataatactggcttcctaagatgtaaaggtattttattgccaaacctcatattctcccccaaaactgttccagcagatgaatatcaggacccactcagtcattaactattcactgagcgtccgctgtgtgttgggaatacagcaatttaaaaataacaaaacagagccaagtttctgctctcttcgagaggtagagaaaccaacatacaaacagataaaacgtcatgaggtcataagttctaggaagaggagtaaaatcaggttgtgaaagggatgtggggaatggggaaactgatggcaatgccattttatacattactgaggtgattaaactttttaatttataaaatatatattaatagttttaaatagtggtactaacttggaagaagagggtcaaattttcaaaactacatggttactctaaaaaaaaccctggaaggaccagcctaataggtaaactgttaaccttaacacaacagctacagtttagcaaacaaatgaacactagattatacaacatatactaaaagtactacatggtattatgtgataattgcaaaccaaagtctgaaacccatatgtattatacaaattcaatattcccaaccttaatttttcagttattcatgtgagacaagaaagtaaggacaattcaaatatttgcagcacacagttaaatctaacagtaggctaaaattgaagtatttctagcctgagaaattgtattaagttcatggttctcttgaagattaaatactacagattttttgtttttccatgggagcaatctacaatggtagtcccaccatcaaattcattactaccaaagttaattttggtttttattaattttagttagtggacaaaaagctgattacagctgcctttttctactttctacctccacattatccttcaaatctccccctttcattttcattgctcaacctaccagagctctttctttgcttagactgttcctagccaataactggcctacttgcttctaaactcttcctaatccaaagccaccctacattctgttgccagaatgatcttcctgaatgtgtatctcatatcacactattcctcaacttaaaaaccatcaagaccaccaaaatgcctaccaaataaaatcctatttcttggctaggcaccgtggctcacacctgtaaacccaaaactctggcaagccaaagtgggcaggttgtttgagttcaggagttcaagaacagcatgggctacatggcgaaaacccgtctctacaaaaaattcaaaaattagccaggcgtggtggtgtatacacctgtggtcccagctactcagtaggttgaggtgggagatcacttgagcccaggagacggagactgcagtaagccaagatcgtgccactgcactccatccagcctggatgacagtgagagaccctgtgatcccccccttaaaaaaaaaatccaataattcaaggctagtcacaatctcatctctaactgggtttcccaacatacctcctaacactactgaagaaatctgtatattcacacagaactgactttcctgagattcctgtctatacttctctagacttttctttactcttccttaaaatactttttctcttgtatcacctactccttggttcccatgtgttcacattttatgagtaacttgtacaattaatgttctctgtggctattccccacatccccattccaaaaaacaaggaaacaaaaaactcttttctgaatttccacagaacagactctgtattcgcttgtgccactattcactctcttactgatactacacttatgtcggtttaatttaatctcatctgcaaatttatcaaagacaaaaattctatcttatttccttatactgcactccacagaatagaagctcagcatatagttgttaaatgaatgtctaaaattccactacaccttacatattttttaaaagtcagtttactataacctgctatttcatctagagtgcttgctctcatatccagcatgactgttccattgaggatgcaactccttagttcaaaaagactgtgcaaagagagagttgccacataaggtttactccatcggtcaccgccatcttcaacatcctcttcaaatttcagccatctgaatgcataatgtataaaaatattttataagtaatgaagattccatttgtttatcttaatgtgataaagaaacatttgttctttaaagaaaaaaaaaaaagaaataaagaaaaccacgaccaaacacgttttcacaaattaggttaatggtctacaatatctatagtcacaaatttcctttgtagttcctctttctattctaggtatcataataataagcctacaaaaacaaactatggaatttcatatagtttctacttctattcctcttctaaacttgcaatacacaaaattgtagacattaaaatctataatgacataatttctttatgaaagtataaaggattatttaagtaaacaaatttgagaataaagagaaaaattaaagatagaatttctatcaattaataaggaaattctctgctcactggtttaaagcaccagatatctcatactttcaacttaatattcccattacaaaaagaaatcaagtaatgccaatttaaaaatgagacttaggccgggaacggtggctaacgcctgtaatcctaacactatgggaggcctagacgggaggataacctgaggtcaggagttcgagaccagcctcgccaacttggtgaaaccccatctctactaaaaatacaaaaattagccaggcgtggtggcgggcgcctgcaatgtcagctactcgggaggctgagacaggaaaatcacttgaacctgggaggcagaagttgcagtgagcccagatcgcaccatcgcactccagcctgggcaacaagagcaaaactccatctcaaaaaaaaaaaagagagagagacttagcagtattacctagcagtttctttccattcatattcttctccatctctgtaacacagttcatccatttccgtgaagagatcatggggaatatgttcttcatcatcatcttcagtaccaaggataaactgaactctctgggatggtgtatctttacaaaataagaatttacatatactcaaatttttcctcaagtcattcaaagataaattcacagttttgaaaatgaaacacttttgttacctgtataaacaaatatatttcatcaaaactctcttaattattgaactatcacaattctgaaaggaaacaagaaccaacaatccaggaaaaaaaaaaaagtcacagaaagataatctctatagaaaaaaaagaaaattatgttgaaaataaacaagtcaaactaactttataactgatctaaacaaacaaaaataaaagtaacattccaaaacatgaacataatgctcaaaggcagccctttttcctcaccaaaactacatggaaaagttagaacagaacatttaaaatataagctaaggccaggcactgtggctatgcctgtaatcccagcactttgagaggcagaggcaagtgtaccatctgaggtcaggagctcgagaccagcctagccaacatggtgaaaccccgtctctactaaaaatataaaaattagccaggcatggtggtggacgcctgtaatcccaaatactcgggaggctgaggcaggagaatcgcttgaacctgggaagtggagattgcagtgagctgagattgtgccactgcactccagcctaggcgacagagactccgtctcagtcaatcaatcaataaaataaaataaaatgtggccgggcacagtggctcacgcctgtaattccagcactttgggaggccgaggcggttggatcatgaggtcagcagttggagaccaacctggccaacatggtgaaaccctgtctctactaaaaatacaaaaattagccaggcatggtggtggacacctgtaatcccagctactccggaggctgaggcaggagaatcgcttgaacccagaaggcgtaggttgcagtgagctgagattgtgccattccactccagcctgggcgacagagcaagactccatctcaaataaataaaataaaataacacaaaataaaataaaataaaataaaataacataacataacataaaataacaaaataacataaaataaaataacataacataaaataaaataacaaaataacataacataaaataacataaaacaaaataacaaacataacataaaataaaaataacacaacataacataaaataacataacataaaataaaataaaacaaaatacaatgtaagctgaagagttaactttacaatgtaaagttaaagagtgaaaaatagaaaatctccaagttccaaaaaatgatgagaaaactcaaagctccaactatacagaaactgtcttttcctactatcatggagaaacaaaactgtaagcttggggttttggggtggaacaagtcactacgaagaacagataacccactcatggcgtctgaaattaaactacttgtgtagtataggaacccgaaacagatgaattagcataaatactagtccaggacagttgaaagccctagggctccatataaacaaatacaccaccacaaacagttaccctgaatatgagagatgagttctcactcaaaatttacacctaagtgaacaatcctccaagtacttgtggatgcaacaaggatatttaaacaggataaagagtagattcaatggaattgttttcgtaaaagtcagatctgagaaaatttcagagaatgcagaaacaacagataagaaggaagaaaaccaaagattaagagggatgcagaaagtcaagaactccaggacaaggaaaataaaagaataggaggagaagcatataaaaaacatatctgaaaattttccagtatgtttatgtcatgagccttcatattgaagaaataacctaagacctaggcaggattaaaaaaacacatattgtgattgaacttcctactgtattaaactttccagcatttaggtcttgcacaaatctttgtcagaatgatccctaaatactacttttagtgctaccataagcaataattttaattccaatttctcattactcattgcaactatatagaaatataattgattttatatcctgggacctgctaaactcacttagttctcttaagtattgtagattgcttaggatttgctacctacatgatcctgtatctgcgaataaagaccattttactttttcattccaatctgtatgccctgtattctttcttgtcttattacactggctaggtcttctagtacagtgttatataaaagtcatcagagaggacatcctttccttttcccaaatcacagaaaatattcagtcattaattgtgaaatgtgatgttgactatatggtggttttcttggtttttgtagatgctctttatcaggttaaggaagtttcctgctattcttagtttgcagagagttttatcatggataggtattgaattttgttaaaggcttactttgaacctatttagatagttgtattgcttttctcctttgtattgttaatgacattacttagttacattgacagatgtttaagttttaaaccaaccttatgttcctagcttggccatcatgctagtaacaaatttaatccacaaacctggtggattaaataacacaaatttattctcttacagttctggataccagaagtccaaaatgagtcttagagggctaaaatcacggtgttggcagggctggttccttctggaggctctaggaaaatcaaattcccttactttttccagcttctgaaggcagcctacattcctggggtcaggatcccttcctgacgtcactgtagccacttgcttctttttgtcacatctatatccagtctgatcgtctgacctcctcttactaaggatccctatgattatatcaggccaacctgcataatctaggataatattcccactccaaaattcttaacccagccaggtgtggtgactcacagttgtaatcccagcactttgggaggccgaggcaggtggatcacctcaggtcaggagttcgagaccagcctggccagcatggtgaaaccccgtctctatgaaaaatacaaaaattagccaggcatggtggtacgcacctgtaatcccagctactcaggaggctgaggcaggagaatcacttgaacccaggaggcaaaggctacagtgagccaagatcatgccactatactccagcctgggtggcacagcaagactccatctcaaaaataaaaacaaaaataaataaataaaaaataggccagatgtggtggctcacacctgtaatcccagccactttgggaggccaaggtgggtggattacctgagatcaggaatttgagatcagcctggccaacatggtgaaaccctgtctctaccaaaaatacaaaaattagccagccatgatggcagaggcctgtactcctagctacttgggaggctgaggcaggagaatcgcttgaacccaggacgcagaggttgcagtgagccaagatcgcatcatcgcacaccagcctgggtgacaagagtgagactccgtctcaaaaaaatatataacaaaaaaaattaacctaatcacatcagcaaagtcctctttgccatataatgtaacattcacaggttcgagggtttaggagatgaatatcttgcaggctatcactcagcctaccactcccatgatatattatcctttttaaacattgctggatacaatgtaattttgctaggaattttctaatccatatgcacaaaaatattttgtccgtagttgtatttttcctgtaatatccctgattagttttggtatcagggtaatgctggattcattaacaaaattgagaagtgttccctcctcttatgttttctagcaaagtctatattatttcttccttaagtttgttttatttcatccctgatgccatctgagagtaaattttcattgtcagaaagttttagactacacatttaatgtctttaatccatttcttcctttttcatttacttattttttaagagacggtatctgttgcccaggctggaagtgtagtcacacaagcatggctcactgcggcctcaaactcctaggctaaagggatcaatccacctcagcctccccagcagttggggagatgcacattgccatacccaggtaattttttattttttgtagtgacagggttttgctttgctgcctaggctggtcttgaactcctggcttcaagcaatcctcctgcctcagtctcccagtgttgaaattacaggcatgcgtcaacatgtctggcttctttaatgcatttctgtttgctagtttatattcttagaggaacttgtccatttcatgtaaattatcaatttagttgccacaaagtcatccataatattctcttattagtttgactttttttttttttgagagggagtctcactctgtcacccaggctggagtgcagtgacacgatctcggctcactgcaacctccacctcccagattctcctgcctcagcctcctgaatagctggtggcacgtgccaccacacctggctaattatttttagtagagacggggtttcaccatgttggccaggctgttcttgaactcctgaccaggtgacaaggcaggtgatctgcctgcctcagcctcccaaagttctgggattacaagcatgagccaccactcctggcattgattgtagttttgaagaatggactaaaatgtccctaatatttcacccttaatgaattatcagttatcttttatattaaatattatattgaatagatcttgtatatctttagagaaacatgatctttgttgaaacacagactaacctattaatccttctatactttgtaataaacaactcccaaatgggttttatcccatgaaaatgtgacgtcatccacatgaaatgtgacgtcaaaaactacagctcattttcttttttttttttttttgagacagcgtctcactcccaggatggggtgcagtggcgcaatctcggctcactagcttccgcctcctgggttcaagggattcttgtgcctcagctgggataacaggcatgcctggttaattttcgtatttttggtagagactagggtttcactatgttgcccaggctgttcttaaacccctgagctcaagcaatcagcccatcttcgcctcccaaagtgctggtgttgtagacaaaaccgggttctggtcacatggcagggaaagattaggcacgcggacactttgaaaggtgaggggttacgaatttattgggcaaaagggaaaaagaacaacacagcaaagtgagatggagtcctgctaacaggctgtccatctcaccaactgaattcctggttactatcctggaacagcaggggccaggctgttcccctctgcaaatggtgtgaacattttgctgctgcaccccatcctcccagtgcttgtagattgtcttgggagccgtttttacttggctgtctcactagggttacaggcattagccaccgcgctgggcattctcttttttctttttttctttttttttttttttttgagatggagtttccctctgtcgcccaggctggagtgcagtggtgagatctcagctcactgcaacctctgcctcccgcattcaagcaattctcctgtctcagcctctgggtagctgggactacaggaacgtgccaaaacgcctggctaattttttatttttagtagagacgtggtttcaccatgttggccaggctggtgtcgaactcctgacctcaggtgatccgcccgcctcggcctctcaaagtgctggaattacaggcatgagccaccaggcttggccctctaattagttttctaatttctgcgggatgtgtatcgaaattttctaatactggtgatttgtgggggttttttgtcctctgatcaatctggctttagagttatcaattttaataatcttttttcaacgtactagatttaggtttgattgaggtctgctattgtttttttttctgatttttactttattcattctcctggaattttgtttcccatctcctccttacaatgtgccctattttttttccttagtttcttagctagaagtttaagtcactgatttcaacttttttctgttctaatataaggattaaatgctacaaatttttctctaaagtactgctttagttgcatctaacaaatttgaatgttagtcctcactctgcacagtaccatgcatgaatcctgtacataccagaactgtccttacttggcaaaaatctgtcttggttacctgcctgtactattttcattttcaatgagttcaaaatattttctaacttctgttgtgattatttccttaacccatgattattgagaagtattttcttcaatttccaaatacctaggaattattcttgagacatttctagtttaattctattgtgatcagagaacatactttcacttcttttaaattatactgagacttgttttatggactagaatatgatcttggtaaatattccatttgcactcgtagagaacgtattctgctgtccttgggtgaagtgttttataaatgtcagtatcaatctggttgggcaatgttattcaggtcttccatatccttatcaatattctgtttatttactctatcagagaggagagctaaaatctccaactcttaattgtggactgatctatttccaattttatcatgtattctgcacctgttgttatatgcatacacattcaggcttattacattctgattctggcaatctgattcttatgagccattatatgttttctttatgtttcttcttgggttttgttcagctccttggatctatgagttcaatgttttccttaagtttgaaaattcttcaactataattttttcaagtatcttttctgatatcctcctttctgggattccgctcatacatattagactacatgatattgtcccacaaattactgatgctcccttcattctttttcagtcacttcattctctgtgtttcattttggatagttactatcactgtcttgaaaaccgctgattacttttctttcctgctgtagtaaatcttcagttaatcctatccagtgtgttttccatttcagatactgtattttttcctctctagaatttccatttggggcttcctcctattttcaatagctctctttaacagtcatattcttctctatccttttgagcataaatatgctagttgctttaacattcttattttctaattcaatcaactctgccatttctggatctgtcttattatttttctcctgattttggctcatattttcctgcttctttatatccctgataatttttggattccagatattgtgaaatttaacatggtcaggtgctagattttatcttctttcttttagtagtgtaatactttgccctggcatatagttaatttaattctttcaagacctgcctttaagaatcttcaaagcagattcactgcagtctttgttgtaaaactaatctagactcactactaaggccagagccttctgagaactctatccaataccctgtatgtgtcaaagtctttccattgtggctgaagggaacgcaaactattcccagccttgtgtgaaagtacagaaagtgcttagcctactactgttttctggtagtttttcccgggccacaggtagtttcctctcacacatggccagaccagtgatcagccaaacattcaaaaggatcctttttcagatctttggaactctgagtactctccactctcttgaactctacacctcaaattctagcctctttgacctccccaaattccaatctatgctcctcaactctaggctctgtttgggttcccctccctgtgctgtggcctggaaactgtctctgggcaataagttcaggtcatcataggtattctctcacttgcttctcctctctcagaaaccaaagtcctgtgctgcctcttatacaatgtcttaaaactactgtttcatatattttatctggttttccagctactttaaatgggatggcagttacaaactttcagttattagataaatgaattctggggaactaataacgtacaacatgatgactatagttaataatattgtaatggctgggcgcagcggctcacacctgtaatcccagtactttgggaggctgaggcaggcagatcacttgaggtcaggagttcgagaccagcctggccaacatactgaaatcctgtctctactaaaaatacaaaaaaaaaaaaaaaaaaattagccgtgcgtggtggcgggcacctgtaatcccagctacttgggaggctgaggcaggagaattgcttgaacctgggaggcagaggttgcagtgagctgagatcgtgccaccgcactccagcctgggtgaaagagagaggctcagtctcaaaaaaaaaaaaaaaaaaaaaaaaaaaaaaaaatatatatatatatatatatatatatatagtgcccttgaaatttgctaagagagtagactttaattatgtgtattctcactatacacaataaaaggcaactatatgaggttaaggatgtgttaattaacttgattgtgataatcatttaactatgtgtgtgtgtatatatatatataaaaatcatactgtacaccttaaatgtatacaaattttatttgttaattatacctcaataaagctaaaggaaaacgcattggaaaacagcccccaaataggaataattattaaaataaaatggtgagaaaatttaatccccgttattccatcctgtttagaagcaaagtcctgtgtaatccctttagagagcaaaaacgaagagacttcatttttagcacttccttggatacaaattggtagttaagacaaaaacttcagggacataaatcttttctaggaatagttattcctttgaaaagtcaaatattttcttcattataatctatttttgaagcccctatacttaacacttttaatcccatatcctagcttaaaacatcaaaccacatacttaggtgaacatatcaatatactaagagttaagtaaacaatatttctgtccataaaaatactgtgtgcctttttactcagtatgaattagagaagcatactgatccatttactcacagaagaacctaggatatcctaaactgaatggctgtgatgtatagaacagttttttactgtttaagtattttttacttctaaattacttagtatcaccaaaaaaaagttcactagtgaccctttccaaattcagtgtttgtttttcctttgctagctacatgaccacttagtattatatttactagatttactaggtcatcagtatctcttagtagagtttttttttgtttttttttgttttttttgttttttttaaacagagtctcgctctgtcacccaggctagagtgcagtggcacaatctctgctcactgcaacctctgcctcccgggttcaagcaattctctgcctcagcctcccaaataggtgggattacaggtgcccatcaccacagccagctaaactttttttttttttttcagtagagacggggtttcaccatgttggccaggctggtcttgaactcctgacctcgtgatccacctgcctcagcctcccaaagtactgcaattgcaagcgtgagccaccgcgcccagctgagtagagtttcttaatagattcctgtcagtctcactgggctgaagtttcctcatctataaaatgaatttaatatttgtatttttaaaatgctaagatggttatatattaaaaatactaagatggttaaacataagaccatttgtctagggcttggtagaatgtttagacacagaatttgcactttagattttactatgccatcagtattttccttcctatgttcatgcagtaactatattatacataacaacttttttgttctttgccttttcacaaaaactttcttttagcatagcatgcaaccgcctataggatgtggctcacatagcacatagctctctttgctagaaagcaaacactaggacccatgatgtacagatggccttatactaataatgccctgtatgctaactaagtataatgcctaagaatcctcctcaggttttacagccctttttttttttttttttttttttggctctttcctttcccactctcagggccacttaaaacatggctatctatgctcgtcatcagataacagtcttgttcctgcttttctttctgatttctattggtaccactaacttctctgctttcaagtaacaaacaaaaaaaccctgtccttttatataactaatattatcaaataagagtactcttttttgcacagaaaaccaaataatccagcctagtggataaaatcttctggccaaaactgtggtgtaagaaggaaaaaaacagccaagcatggtggctcacacctgtaatcccagcactttgggaggctgaggcaggtggatcacttgaggtcaggagttcaagaccagcctggccaacatagtgaaaccctgtctctactgaaaatacaaaaattaccctggcatggtggcgtgcgcctgtaatctcagctacttgggaggctgaggcacaagaatcgcttgaaccctggaggcagacgttgcagtgagccgagatcgtaccactgcactccagcccagccggggtgacagagtaagactccatctcaaaaaaaaaaaaaaaaaagaagaaggaaaaaaactttaatcacttccatgacagccttagcattcccaatgtctatccattgcatatgtaagtaattaaaaatttagtacaggaaatgaaacactactaaatttgagcctaagtgactaggcataacttttacaatttcaaggatgggatacaatgaagaaaacaaagccctttattttttcacttacatgaaagagatcttgacctataaagatttttcttataaaaattataaaaaaaaaattattacttcaattgatattccccaatacaatacattccccatacaatgtgactacattaatgcatacatacaatttttaaaagaaatattcaattaaaagaaaatactttccaggaaaataggaactttaaactgctaaagaagaactgttttctcttaccataagaaggagattcccgtccatcttctttatctgattctttatcttttcttctccggtggtgatgtttgtgtccgcgatgcctatgacgccgacgactctctttactaaacgggacgtgaacaccaatatatacagctctatgacctattaaaaggttcagaaacatattactagctttccaaaagagaaaaaagtgatatatacaaaagtactccaaaatctactctgataaagaatataagttcacgtaattaacaatggtagtctccagttacttctcttattttataaagcactacacagaatattgtgcccagggctaatatcactgacagatgattacactaaatctacaaatcacttatgtaagtatttgcacatctaaaaagatatctttttttttgttttgtttttgtttttgtatttttagtagagatggggtttcaccatgttggtcaggctggtcttgaactcctgacctcctgatccgcccacctcagcctcccaaagtgctgggattacaggtatgagccaccgcacctggcctaaaaagatatcttaagaaagaagagcttagcccatctgagatcatactatgtagacatatatttattccatctacatttatggccaaccatagttagtagaggtccttaagagatatattttaataacaattaaatactttataataaatataatatataaataacattttagtaacaattactttataataaatataatgtataaatatttacaaatatttatttactaatttttgagttttgaaaaaaaaatcaataaagaccaaaataaaaataaagtccaaattactgagagctacattaaatgtaaataatccaaataaaggttagaaactgtcagattaaataaaaaagcagtaagtaaagttattgcatgcttttaaactagaaaaagctactgctgatattgcattatcctaactttgcagtataataacaaaatagttatgaaaggcagtctgtttttgaccactagatgaaactgaatcaggaaagctacagagctaggagcactatgtcaaatatcaaatgagtgttgagtgaagagggatgtgaagtacaaggtcaactaatctgcaactatgtacacaatttaaaaagttaataggctgaaatacaaatgattaatgacattcctttcctaaaaattccataaaatgctcagaaaataagtatttcaagaaacttaggactgccatctttatatgtgacttgaaagtacagttgatcctcattattcatgggattccatatttgcgaagttgctgactcactaacatttacttgtaaccacaaaatcaatacttagggagatttcatgccatttttcggacaggcacagagcagcataaaatttgagttgcctgacactcatgttcccaggtaaggcttaaaaatgtgatactctgacatcttatttcagctgccaatatattaacctcataaataatcaccttttaaattaaaagagggacaacttaacaaaacatactgaactatttgtttaaacttctcccagtactcagcctagcacatggtaagtactcgataaatgtctatggaattaaatctcaactactagaaaacaaaaattccaaatgtaaaagctaattatacagggtttatttttggaattatagatatgtttcgagaattagacagtggtgttggttgcataatatagtgaatacatttaaaaaagtgtgtaatttaaatggttaattttatgttatgtgaatctcatttaaaaagtaataagaaataaatataaaaaaactcaattttattttaatgaaactatttccttcaaaacataaagaaaagtggaaattaaagagtcaaattcccatcactgcactgggaattacaaagttgttcctccaattagtactaatgggtcttggcacagaagccccaatgcaccaagataaaaataaatgctatgagtgtgcagtttagaaagaaagggatagataaaataaataaaaacacgctagaatccaaagattggtagattaagcttattgtgttttcttcttttactattgcctctagtgtcctctgttttaatctttttctttttctttcctttttcttctgcccttactttattctatcaaaagcctatttactcaaactctcttaaacttaatctctccctcaaacttgataccaaacttgaagatgtgtacaaagtatgcagagcttagggcctgtgataaccaaaggaatcgaaggaatatccaggttatgtataggtgagggttgacattaaacattaaatgtatgactgtacatttgaattagtaaaattaccgctaaaaattttaacctccctagctcctataattcacaggatctaaccataagcttctagataactgaggttctttttggaaaccctaacaagcctaggctcttaaagccaatttttagagttaaaaaaaaaaatcgtttagagtttaaaaaaaagtcttagaatataaatgaaaacatttacaacataaatcaaactttgtttctctgtccatctcttttttattaaaataaacaataactcaatatagtactagctctcacagaagagtttaacttaaggatgtagttcctataaacatcccccaaaaatgtctatcaaaatatttgccttaaacaccactttaaccacatgttcatagttaacatcatcaataataagtcatgttgatatcatattgtccacagatatggtgcactgaaaagggaacattacttctgtggtatgcttcccaaataaccataacctccacctactcatgccaaaacatcagactaaacccaaactgagaaacactgtacaaaatatctaaccactactcttcaaaagtgttaaggtcatgaaaaacaaaaaaagaatgagaaactggtatagattaggagactgaggagacttgcaactaaatgtactgttacagatcctcaactggatcaactgaatcctagaacagaaaaaggccattagtggaaaaactagtgaagcctaaataaaatctgtggtttaacagtaaactagtaattagtcagattctaattaaatttgtaattaaccaatgttaatttcttcatttacacaaatgtatgatggctgcgcaaaatgttaacattaggagaaactgggtgaagtgtatggaggaactatgtgctgtctttgcagctattctgtaaatctaaaattattttcaaaagaaaagaaaccatttgccaggacttcttcctgtctaaggaagaaagatgggcaaataactcagttgctctacaactctatggagaggttattgcaacattttaaaaggctaatgtaacacctataaaatgaatgttgagatgacaattaatgataactgtggtttattagtctggcactctagtgtactcataacacaaattactcagcctgctagaaatgaaaaaaataagagttaactaattttgtgactgtgtcctttcagttttccaagttaaggtaattaatggtaaccatcactaaattttgagaagcattatgaactctatcttttgccaatactttcaaatggcactcttctcaatgtacgctttaccttacaacaataacaaaaaaactcaacaaatactaggtaaaacttaaaaggatacttaaaaacattaattagtaaattatcctactaagcgaagtaagttattttaaaccaacttactttctagttcttctttttcaaacttggtgttcacagttgagctagttttgccaagatccacaacagcttcttcatcaggaccctaaaaacaaattattctcattgactcatgagatcacaatctattgaggacctattatatgcatcctttgaaatggcaacaaaatataaaacagactgctttctctcaaataactgaactcattacagctaattgcattcttttaaaattatgtttacaagctttttaaatccacagaagaccattcaaaaatcccagagtgagaagtgaaatggcaaagatttttaaatggttttccatgcaaattaccaaataactggtaatatattcatttcatcctcaaaagacagaccttctagggtcagagattaaagaaaatgtgatgtgagaggaatccttagatgtcaacatgtaatgctttctttcttgatctttgctcttaagtctcctaaataacaggaaacagctatactggactgaattatggtcaaacataaaattgtcaaaaataagcagactcaacatgcagtaccactttaactgattaatcaagagctaacaaaagttaaaagaactttttcttttcccccaaagtaaaattcatgccaaaatttaacctctagggaaattctagctgcagttgtgaaaatcccaccttcataattttgttctcttttcagttcaacaaaaagactaaacatatttattagaaaatgttgtataggctatttttaagaggataaaattttagctttaacttcccttctcaacttgtaataactttcaaaaggacattctaatcatcattaactacttattattaacttattatacacaagattctatgccactgctagagagagaacaaatacccttccctcaaaaagtctttgaagccgggcctggttgctcacgcctataattggatcactttgggaggccaaggtgggcagatcacctgaggtcggagttcgagaccagcctgaccaacatggagaaaccccatctccactaaaaatacaaaattagccaggtgtggtggcacgcgcctgtaatcccagctactcaggaggctgaggcaggagaatcacttgaacccgggaggcagaggtattggtgagccaagatcgtgccattgcactccagcctgggcaacaagcatgaaactccgtctaaaaatgtatacaaagtaaactgacatacaattgttgctgctatggaaaccctcggtgtccaaattctcagtaagtaaactcaggaactgaactgatttgattaaattttcaaataaattccttgctatccaaactaccactatttgttatccaaaactcagaacaggacacagtatattaagaaaatgcagatcttttgatatccaaatttactttctaaaggctagatatccaaactgtaaatcaaatatatttggatatcaggagatacatgtatatgactctgaatgattggtgttcaatttaatataggtaacagagatattaaatgacttggctatagttccatatttaaaggagtgggagcaggccatgtagaccatgagacaatttcatacaatggactaagaagatgggctaggtgtggtggttcacacctgaaatcccagtactttgggaggctgagatgggagtatcacttaagctaggagtttgagaccagcctagacaacatagcaagacccccatctccatttatttaataaaatttttaattaaaaagaaacttaaggctaggcacggtggctcacatctgtaatcccaacactttgggaggccgaggttggtggatcacctgaggtcaggagtttgacaccagcctggccaacgtggcaaaaccccatctctactaaaaacgaaaaaattagctgggcgtggtagcgggcgcctgtaatcccagctactcaggaggctgaggcagcagaatcgcttgaacccaggaggcagaggttgcagtgagccgagatcacgtcactttaccccagcctgggagacaaagcgagactccgtctcaagaaagaaaaaaattttttaataaaaaacaagacagacaaattaatcaagccgccttacagcattcacttcctcagtaacaaggaaaagccaaagtaggaaaccaaaccaaaccccaaaagtgcaagaatgaataataatttccatccatcaaccaagtcatattctaaaatcttgagctacgtgttccaatgacttcatgtcatttagtctctgaacatgcacaggtacaaaagataagctctcctaagtaaaaggcacagaagttgtatcctgagaggtagcatactgcctattctaaaagggattaactgctcccattccaaactttcatttaggtcgcacaattgccaggatatgaagcaaaacaattaaccctcaccttcaaataacaacaaaaaggactcaaaaacagcttaagttatataatctcacaatacttataaatatattatttactatacttatttaaaatacacataccctttgacctctaaatatctatcatagataaatgctcccacatgtaccaaacatgacatgttaaaaaaaaaaaaagagcacatcctctcatggtctacacaggctgctcccactatatactgtctgtgaagtcttgggcaagagaaagttcaacttctctgaactttcattttcactgaggcattgtttccaatatttaaaaaaatgaaacaaaaatgtgtgtcaatagtaaggagacaatctcataccaaggagtgctaggaaacagtttgagaaaccagacccaaaaaatggaagtagatctatgtgtcctggtaagaaaaggtctcaaagatagttgtttactgcaaaagcacattgtagtgaataagatcaagtttatgttaaaaatatttacaagactaaaccaaaattttatttccacagacatgttttcatatgtatttatttgtattaagtaaaaagccggggaaaaggcttgatgggatacacaccaaattcttaactgctcctttctggaaagggaactgggtttgaatggaagtcaagttaaaatatgaatttattgttattgtttcagttttcaatgagagtgttttcatgcgtaacttgcataactaaattttttttttttttttttttggagacagagtctcattctgtcgcccaggctggagtgcagtctttgggaggccgaagcaggcagatcacttgaggtcaggagttcaagaccagcctagccaacatggtgaaaccctgtctctactaaaaatacaaaaattagctgagtgcggtggagcatgcctttaattccagttacttgggttgaacccaggaagtggaggttgcagtgagcgcatagagcgccaccgcactctagcctgggcaacagaacgagaccttgtctcaaaaaaaaacacaaaaaacaaaacctagttcataaatttaaaaacccagcatcaacacattacaaaatcaaaattcaattcaacatgaaaatcccagcaaaatcaaatctagttttgttagaaacagatttatgccttcataagatattttactaattcctctcatagttatttatcttgcctgaaaaagcaaaatccacaatttatatttttgttggtcaaattatcaaaaatgacacttaacatgccaaaagcaaagtattagaaaaaaaggatgttaaaagacacctttaaaatatagtgtctaatatccttttgacaccctaaggtttacaaaaatccattaaaacagccatcagagatccctgtcacaaattaatttttccattatataagacatatggctatagcctaaagtaatgcctcccataaattatgatgaaccatatggagtaaattcatagttatcgaacactttagcttcaaaacacacttaactattaagataaagtgatttctttcctaatatcttaaccaaataatttttaaagactcgttcaagtaatattaactatccaaagagttagttttatagaagaataaagatgctacaattatttttaactttacacaaggaattactcttcaacagatgacttccacagccaaggacacaaaggatgatactattctaagccagtgctaataagcctgacatttcttcaagcttcactattaaactctgattcaaattcgtttgtaaataaaagacaagatcataattaggtacatacaggtaacttcttctccagacgaaatctttccatagtaatatagaaatgccttgtttctgatgatgtaatgcagtaactcccttgaagattccagggacagtgagcacatatctgatttaggtcactgtgctttgcagagatgaattcttctaagttacttttatggtacagccaatcactgtgttctaagttacctaatcttccaagctaataactacaacttacacagggtcacagcataacagatttggaaagtaatatacacatttagttataagtaaaaataccaagaggaatgcagcaatccgttttcaactgaaacctttctgcaatgttagtacaaagagtgcatactctaagaatatatgtggatggatgtgtgagagtatggtttataattatcattgtaaccaaaaaacaaagtattaatatggacaatagctagaaaaaaaaaagagtagcacccctctaactactggacttgggattctctacattcttaaaaattcctgaagaccgaaaaggaccttggtttatataagttaccacatcaggattaaaacagaaaacttcaaagtacttattcagaattatttacacaataataaagccattacatgttaatatacataacattttaatgaaaataacttttcaaaaacaagacaaaacttagaggaatacctctgttttacatttttacaaatctcttcaattatctaacttaatagaagacaactggattctcatatctacttctgcagtcaatctgatgtgatctgcccttggttaaagtatatttaaaaatccatattcacacagatattctgctggaaaggggaggcatatttcaatattctcttcaggtagttatggacattcctctgatagttcatcaaactcaacaagtatattgtttcttaatagttgcaacgtagaatctgaaaccattccaaatgaacattttacacattgttacatcaaaatccatttgtctactatgcactttgaatggatctctcacatttttggaatgtatgtgttcacagggtattagagcttttccaaatgtcacatttcattaaacaatatcaaaaatttttttaaatcacacttgttaataatatcaccaacaatctcataagtccaagtattgagaaactgtcaaagtcaggttagcagatgcaagttttccaaaattctaagttttgcctgaaagtctgaattattatcatgggtaacaaacactatcagttgtttttcttgaagtgacaagttcacttcattcatttttgacaaaatatctgtcaaatgcccaagtatgattaaccaagtctgtcattttttctttcaggtaaaaatggtgttccatgaaaataacagctagttgagttcacaattcaggcaattaaccagtgatttttctccaaacaatcattctatttggatatgcagcagaaatgtttttacaaatgcttattttgtcattcagaatattaaagcaatacacaaaggcaaaaatttaataagataactagtttttactgcttcatcaaagtgctctttgtgtatacagatttgtttcttggtaccctcaattctataagctagcaaaatagatgatatttaatattttctataaaaatatttatatcccacagctaaagtcttactacccagctcatcctggagaattcactgatgacgtgcactaaataagtagcaaaataagaaataaatctttcacaactttacatagggagactgactgtacgtaacaggtgatagacatgtcatacacttcaaatacaactaaggcttctaaacttctccaagaacagaaatcccaataacaccaacagctaaataacatatataattaattacatatttgaaatcttcacccttgttatgtatgatatatacttggcaaataaacataaatctaaagaatcaaatacaagaataagacatatgtcagtcaatgatttttttaaattctcaatacattaagccccaaagaacatctgcaaacaatcaggttaaaaaccaatttctggctgggcaaggtggctcatgccagtaatcctaggaccctgggaggccgaggtgggcagattacctgaggtcaggttcaagaccagcctggccaacgtggtgaaacccccgcctctactaaatacacaaaaattagccaggcacagtggtgcccacctgtaaccccagctactctggaggctgaggaaagagaattgctggaacccgggaggtggaggctgcagtgagctgagatcatgccacggcactgcactccagcctggacaacagagcgagattccatctaaaaaataaaaaattaaattaaaaaaaattccaaaatgacctcttgaaacatacttcctatggaaaatcttggccctccccaccagtacttaagagcttaacctcctggtcaagcacatgtcctttcctcccccactggattataaaaaccataagcatagggatttgagtgggacgaagggaaggttaagcaaccccagagggaaaagaagaagaaactaggtgcacgtagactttttaatttcccaaatacaaaacaaaatattatacaccaaaatacgaaagacacacttctccaacgtttcccatttaacactatcatggacactaccaaaccaatattccaataaaattttaaaaatcaaggtttataggtgaaatggtgaagttagttttagtttaatacattatttgataaaataaaaatataaagtaactcaacaaataaactttaaccaataggctttcgtttggctaattctttaaagatttattttcagtataattttatttaatagcaggcacacacaaacatctcatttgatcccttggtctcttcactccattttcagccttctaatatttttatgcaaatggaaatatatatattcttacaaaaaagatagcattcattacacacttactgttttatatataacttgcttttttcacttaaactacatttttaagtaatttatcaaattaatctgtaaacagtaggaaaatccaaggttacagaagtgcccccaaataagcaagcattcctcccattcccacttccactcatgagatataattacattctgttgtgtcttgtaactctttagttgctagagttgccattataactttaaatactttattttatgtcttggtttatcaattttaaacagtatctttccacaaaaagaaaagaattttctccaacacacccatatcctttcatttacaatctctcttccacatctcagtgttatttatatatatatatatatatacacacacacacacacacacgtgtatatatacacatatatatatataatttttttttttcttttgagacagggtctcgctctgtcgcccaggctgggtgcagtggcaatcttggctcactgcaacctccgcctcccaagttcaagcaattctcatgtctcagcctccctggcagctgggattataggcgtccaccactacgctcagctaatttttatattttaagtagagaccaggtttctccatgttggctaggctggtcccaaacttctggccccaaaagataaccacccacctgggcctcccaaaatgctgggattataggtgtgagccactgcaccgggcctatatttttttgtatcaaggtgcataacatttacattccattcaatatttataataaagccttctaagctctgtcctctggttaattctaaaactgaaaactcatattaaaaagcatctgaagtactagaattaaatactgtattgtctgtgcagaaccaataattaaaattggaccatctgaatcaatgtcaccaaatccctactgctcacaagagactatttcaaacgctaaagtaaagtagatccctctattaatttattatcaagggtgttttcccctagtttgtctgagtgatgttcagctcatattattcctttctcattttcatttaagaaggccttgagaaatatgcttcacgatgaatatatgggtgataaagaaaaccttttcatgttcaaaaatcattttactcgatacgtattttggatagataccttctctcaggtactgcgccatggcctttaagaatctagtgctgttgaccagaagcctaatacccaccaggtttttgtttctttgtttttccacttctggctcaataatttcatcaagatgtgtctagatgtatgtctttaattattccttcaagactcccagtagacctttacaacatgactcaagtataatgaaaataaaatgaacctgttcaaaagtaataaaattataaccagaaaccaagagcaaacatactaaagtgtaaaacactaaagatttcacttgttacgcgagctgcaagattccactgtctataggaaaatccatcaatttgaatgtggagctaatgtaatgaaaacagaacaaaaaaacaaaattatctttatttgcagatgatgtgacagtgtacctagaatgacagattcatccaattagcacacacacacacacacacacacacacaaaacacattcatttggccaggcgtggtggctcacacctgtaatcccagctacttgggagactgtggcagggagaattgcttgaacccagaaggcggaggttgcagtgagccaagaccacgccactgcactccaacctgagtgacgaagcgagacactgtctcaaaaaaaaacaaaaacaaaacaaaacaaacaaacagattcatttgaaggcagccaattacaagataaattaaaaccaatagcttttctttaagcagtaacaggccaggaatggtgataatcctacaactttggtagaccaaggctggaggatggcttgaggataggattttgagactagcctaggcaacacagaaagacctcgtttacaaaaaaaaaaaaaaaaagaataaataaaaaggaaaaatggtatataaaaatggattaggaatatgaaccatggctgggcacagtggctcacgtctgtaatcccaatactttgggaggccgaggcgggcagatcacttgaggtcaggagtttgagactaggctggccaacatggtgaaaccccatctccaccaaaaaaaaaaaaaaattagccgggcactgtggcatgctcctgtagtcctggctacacgagaggctgaagtgggaggatcacttgaacctgggaggcagagactgtagtgacccaagattgtaccactgcactccagcctgggaaacagtgcgattccatctcaaaaaaaagatgatgaaccaagtaattcccttacgtaaaaataccaatggccaataactaaagggacactctcactagatattcaacaaatggaatttaagacccatcagattagcaaaacaaattttttaatggaccgtacatgagatttaatttttctttccataaatttttttaaattcacatttaaaactagtaaagatagggagacacagacacttttgtacttcctacttgggaatgtaaattgcccaaaactttggagagtaaactagcaagaattcatttacaaatttttcagcatacatttggtgcagcaatatgacttctgtgtatctactcaacagaaacaaaaccaacaaaatataaagtcaagaacgtttggggtttttaaagaagacacgttcgcaggtactggggagctctggtcaacccactcctgctcctgactcacattatgttcctgagtcattgatgtttggtgtcactgaggaacaagttgatcaggaagcaataccatagccatgcttctaaagatactggaaagaaccagaggtggagatttgacaaatcggaattatgctaagcagtcgcaatgtaaaatcgccgaagatgatgtgtgctggcttgaacagaggcgcaaaggaaaggaatcttaaaaggaccagttcagatgcctaagactttgagaatcactacaagaaaaactcacggtgaaggtcctaaaacacgggatcgcttccagttgagaatctaaaagcaactcagacttggagaatccttctaagattgttaaacagattacttccatcactactgcattagtaattgaggctgaagttaccactggagatgcttaactatttaataaactgattacgagttgggtttaaaaagtgtttactgttcaaaccgggaaaaacaaagaatctgaaagcaaaaaagaaatggctgattaccatggaatattataatgatattatgaacaacgagttacaattacaaagtcccatgcaacagatgtcggtaaaatattaagaaagcagggactgggcgcagtggctcacgcctgtaatcccagcactttgtgaggcgggggcagaggtgggcagatcacccgaggtcaggagagaccagcctggccaacatggcgaaacctcgtctctactcaaaatacaaaagttagggccgggcgcggtggctcacgcctgtaatcccagcactttgggaggtcaaggagggcggatgacgaggtcaggagatccagaccatcctagttaacacggtgaaaccccgtctctactaaaaatacaaaaaataaattagccaggcgtggtggcgggcgcctatagtccagctactcaggaagctggggcaagagaatagcgtggacccgggaggcggagcttgcagtgagctgagatcgcaccactgcactccagcctcggcgacagagcgagactccgcctcttaaaaaaaatacaaaaaatacaaaaattagccgagcgtggtggcggttgcagtcagccgagatcgcaccactgcactccagcctgggcaacaagagcgaaactccacctcaaaaaataaaaaataaagcaagcccaatgcggtggctaatgtatgtaatcctagtgagacagccaaataaaaagggctcccaagaaaatctacgagtggcctgcgcactgggatgaggatggggtggagccgcgaagtttgcgccatttgccggggggaagaacctgacccctcctgttcccatttgcagcggggaagagcctgacccctcctgttccgggatagtaacctggaattcaattggtgagatgggcagcctgttagcaggactccatctcactttgctgtgttgttcttttcgccggctaagttcataaccccttacctttcaaagtgtctgcgtgcctaatctttacctgccgtatgacaagaacccggttttgtctacaacaccagcactttgggaggccaaggcgggctgattgcttgagctcaggggtttgagaccatcctgggcaacatagtgaaaccctggtctctaccaaaaacacgaaaattaaccaggcgtgcctgttatcccagctacttggaaggccgagacacaagaatcgcttgaacccaggaggcggaagctagtgagccgagattgcgccactgcactccagcctgggagcaagactccgtctcaaaaaaaagaaaacacactgttgttttaatatcacattgtcatgttttcggaaggataaaacccatttgtgagtttgtgtttatatgaacacaaaatatagaaggatatataagttagtctgtttcaacgaagatcatgtttctctagagagattaaagatctattaattcaatataacattaaatataaaagataactgataattcattaagggtgaaatagtgacattttagtccattcttcaaaaccacaatcaaggcagggagcggtagctcacgccagtaatcccagcactttgggaggccgaggcagaggtcaggagttcgagaccagcctggaaaacacagcaaacccctatctccactaaaaatacaaaaattagccaggcgtggtggcgggcgcctttaccagctactcgggagggtgaggcaggagaactgcttgaacccgggaggcagaggttgcagtgagccgagatcgcaccactgtactcccgcctgggcaacagagcgggactccgtctcaaaaaaaaaagccagccagccagcccagcgcggtcgctaatgcctgtaatcctagtgagacagtcaagtaaaaagggctcccaagacaatttacgagcactgggaggatggggtggaaccgcgaaaagttcgcgccatttgcagtgggggaagagcctggcccctcctgttccgggatagtaacctggaattcaattggtgagatggacagcctgttagccaggactccatttcactttgctgtgttgttctttctttttcgcccaataaattcgtaacccctcacctttcaaagtatctgcgtgcctaatctttcccggccgtgtgacaagaacccggttttttctacaacaccagcactttgggaggccaaggtgggcggattgcctgagctctggggtttgagaccagccaggacaacatggtgaaaccctggtttctaccaaaaacacgaaaattatccaggcgtgcctgtaatcccagccacccgggaggctgagccacgagaatcgcttgaacccaggaggcggagtttgcagtaaaccgagatggcaccactgcactccaagcctgggcaacagagcaagactccgtctcaaaaaaaaaaaaaaaaaaaacccacaaacctacaatcaattcttgttttaagtagatacaactttaataaaaaagcaagtaacatttttgaaaaagcatttcacaaggtcagctacctacagaagatggttcaaaattttcctaaccattttcccatgttctaaaactgaactggtaggcacagtaaaaaaaaaaaaaaaaaaaagtactaacatttttactgctttacaatcattacattatataatcaaattaactgattttttgaaatcttaaattcaggaaaaagaaatactacacagcttaaaattctaattgtgaatttcaatcagccaaagcagggggaaaccgagaaattttaaattaggtagaaaactgtacaggaattaggccggcaccgtggctcacgcctgtaatcccagcactttgagaggccgaggcggacgaatcacgagatcaggagatcgaaaccaccctggctaacacggggttttctctactaaaaatacaaaaaattagccaggcgtggtggctggcacctgtagtcccagctactcgggaggctgaggcaggagaatggcatgaacccgggaggcggaggttgcagtgagctgagatcgccccactgcactccagcctgggcgacagagcaagagtccgtctcaaaaaaaaaaaaagaaagaaagaaagaaagaaaactgtacaggaattaaagtgattaagaaagcatatgtagtatccatttaagttcctttacagatgggaaattactttttctgtacaggaacataatacaggaatgtaactagatgtaaatgatactgctgacaaagcagagggcccatgttttctctttatatgacagaaaagggggtacattggctgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggtgggcacctgtagtcccagcaactcaaaaggctgaggcaggagaatggtgtgaaccccgggggacggagcctgcagtgagccgagatcgcgccactgcactccaacctgggcgacagcgagactccgtctcaaaaaaaaaaaagaaaaagaaaagggggtacattaaggtgcacaattttaattatgagaagatacgttttaaattctttaaaatttttactttcttggacagccgtggtgattcacacctgtaatcccagcactttgggaagctgaggcaggtggatcacctgaggtcaggagttcgagaccagcctagccaatatgacggagccccgtctctataaaaaaataccaaaattagccatctctataaaaaataccaaaattagccccgcgtgctggtgcgcgcctgtagtcccagctactagggag

SEQ ID NO: 207 - DNA, 243381 bp, Homo sapiens
aaacaaataaacgtttcaaaaacactatgctgtttagagcttggtttgcttcatcattttctccctgaagtttttattctcccccacatagacaagagtcaggagggcactctttaggggataacagcaaaccttccacattgcaaggcagaaacccaagcctggccctgagcagatcatgaagtctctctaaaccttggtattacatctacaaaatcaaatggttaggatacaattcctccaaagttctttctaactcaaactctctatgattgcatttgaggaagagcttcaatcatgggacaatgactgtcactttatattagcataataaaatctccttgtgaaccagatttaggataaaataagagtgaaacagaacttgaaatattcgacaaacttaatcagaattagcaattttaatgcttgcaagtccacaaaacatctgtgcaaagcttttctctaaatgaaacagtctacgtgaaagccctttggaaggcataatatgctatacaaatgtgaagtattatgaacatcatcatctccttcagttgagcccatagacttggcataagcagcccatacatttcagctgtaaccaatcaccctgggtgggcatggcggggcgggaggaagagaaaagggaaagtggatttgtttctcctgctttgtagtttctccttattctctgagcctgtatgtctgtgacatagtataagcaggtttttcttgtttatttttgcaagcattaagaggtgattactttctaatagatagacaaatagctaatcaagtctttttatgtgtttagttttagggaataatcactttaaatttgcatttctttatttgagagatttttagacaaagcaggtggtatggtacatattttaccatcgtatccaatattttccatatgctagcttatttcttttctaaaataaactgtaatttgtataaaatccttctaattggtaagtgctttaaaacaagaattgctagttatgagtcactgcaatgatgttagactgcgtgggagttttatctgcatttggccataagagaaactgaggagttgacacaaagagcaataactagacctcccagccagtctgcagaatgccaaatatttggaaaataataatggtagaattataatttgggagatgcctgagaatgaacaagcctctctgcatagatacctaatccccagcaagtaaatttgtgctgtcttaaaatcatataacctggcttaatggcttattagatgttgctttttaaattgaatgttgaattgcatgaagcttttagaaaataattgtgaacaattacaaattaggttaagaagaaaaggcaggcctagcacttgcttaaaattgtattttcatcagattttatctttctcataagaagataattgcgtaaacattgcatcttggcctggggattgaggatgagagtggcgactggagagaatcttgcctttacgtttttcttctccaatttccagtcttggataagccattagtcaaactccctcatcgtaagggaatgataatgtcaatatcaaaacttccagagctgttgatttccccaaaggcttaccaaaattaactgctcatctcagcttggggtagaggatttggagcttgaaatacaagtctttctcaaacttcagcatttcccatgtatcctctgataattataaaaggaagtcaaccagtgccgttggaatgcacatgatgtcagttgttaagtgattaacagtaatgtttagagcttctgtggcctggagagcttttaatggcattacgtagcaagtgccatagtattacccagaaggtgaaaggaagatcaaattggtgagtaggagaatgagggctgtttcaatttaaactacagccagagaaactcctttctgcaataagaaacccaatccttcacaaaggcatggaagaggagaaaagttaacaaccagttatactgtgggcagggaatttgtagcacaaagcattacacagtgattccctgagtaaacaaaagaaacctaaaaaacatcagtggtcagaactttgaagcaagaggtagacattccaacacagactatggcagggaaataagaacaaaatgaatcaagcttgaatcaatataattaataaattatgctatcagaacccactgcatcattaagatagtttattacatacaaccttctatatgtagcagggtaaaaataattttaaaatttgttaacagtaacagctaaatttactcttagggtgagaacagcttttgttaagaaaataacattgttaactcacttggtatagaaggtgaagtcctgtgaacagcggaaggaggcagcaagccatgaagtcaaactactctgcacaagaaatcttaggaatgttcaaccctgggaatggtgaatcagtaaagaaagggattttagaggagagacagaaggctaaagtacatggtgggaaactatggtcgacagattccagcgagaatccctgtggggaggggaaaattgccacctgccttttaagaacagagatgcagataatcagttttaagttgtttcagttctccaggctgttatcccgaacctgtcatacagtctgctacatacaattccttgcacagaaagtgtgtggggaataactggctggggatggtgagcagggcctacagagggtgaagcagtacagaaccgtggaagcagaaactcagagccagggtgactcaaagaaatgtaaatacattcttcccagccttcccctaccccaaaaaatctctggggccatgatgacagcttcccatctccagcatcccagtctctcttctctgcattgcaagtgtggagaagttaatatcctggggccactctcaaccagtgtggggtttggaggcacgtggataaatgcccaaccttccttttctctcctttggggggtaaagtttgaagtgtttcacatagtttctgaaaaggtctccagtgagactgagctctgtctgcccacagtggcaacatgctcattaacacactctttggctttattccctttcctgtcccactttctttactactacacttgtgcttcctgccattacatctcatgaatacctgcacccagtgcttaacttagggtctgcttttggggaaaaccaaactaagacagccccccctcgctgttcctagtcacactattctaatcccacttctgtttcttaccttcaaaaaaaattctttgcacaagcaagtatttatacatatatgtatgtatgtttatatatatgcatatatatgacatacgcttttaacaatttctcaactatcaaaaatagaaaaagtccataacctaaacaacagcctaagatagctaagtttcttttataaaaagatacatctgcacttaaaagagaacgaatcttacatggctaatcacattttaaaatcatgcataatgcatgccatttggcctccactgtgttgtcaacgggtagtcaagggctcatggttccttagtggcttgctgtctactgtacttattttatgtcagcacagtgtataattgattgcacatacatgaaatatgtagcacactggacttccaagcaaggtagttattatatctaaagtaataacttcaaatactttaaagtatttgttgtaaaagatcgaaattttacattaaattgtcttaaaattaagaactttaataacatttgattttaatggtgctatgtcttaaaagttattttaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagttattttagtgttcaaatgttttgtttattgtactgactatccacgtgctaaaccagcaaattaagttagttctttatagcctactattccttctgtggaacatgtgtttttctccagcacatggatgtgatatttactgttaaacctagtactttttgttaaattttaagagattagtttcttgtgatcctaatttgatcttattactgtttgcctagagttgaacataacctttctaaagttagattctagggttaacgtgctatgtggatttacaaatatgcacacatacacagatatacatacacacacatacatacctactgttttatatttactatgggaattcaaaatggaatgaatgtcagttggatcagtaatccaagaataacaattagtagaattctcttttatcattaagttttgcaggcaacttacattcaatacaattatactcagatgactgagtatcataggaactacttttttacctcagggtgagtcaacttattttagagggggatgtacaaaatcagctatgttgtcatggttttttggcttctttgagttcttgtgaaatgtctttgtattttcacatgatgtatcttcacattatttttaaatgctgagcagaacatgagatcatagctgcaatcagaaacaaatatcaggaactcgttttaatgtcctctctatagcaggtgaacacttcaaactgtgtattattttccatctagaaatactttcagcttgtttccctaattagcaattttagtggcattccttttttgccatcccgctgatatattctgtgcacggatttctttctatgcttccttatcaaaacttgatctcaaaatatatctggatctaattcactctaatatgtgacttagggatgtaatttgttttctggaaatttgaaagtcatgggggaaaatttgcttggagcatacaaaagttggaagctgggggaaatttaaacatatgtaaaattggtttattgagtagttcaacatgggttataaacatgaaatattttcatttttctcctgttgctttgtcaaatgtcacttccctcttcctgaagcacctcttggaaatgtgccacacctctcactaaaagttcaggcttgtttaagactccgatctcatattggctttctcatttgttccctttcctcccttcacctcttttctctccccagttgtccagccttgtggcttgaaatacttggagtggggagaaggaatggtctcattctggttacttccttccctgccctatttcaaagctcacttccccctgatttgggggattgggagaagatacagggcaggcagagatcttttggggtaatagattacctgctgctggtgagaaggcaactaaggtctcaatatgactcagattgattctgtctgctcttctgatataaatgtctccacacagatgctgtgcatgctttcttgggaaggttttcggtcagccatcttagccactgggttccctcaaaaaggggcatttttgtctctctttagtgtctcttaagtagtccatgtcccaacctcccttagagtggggcatctccctttccctctccctgagagctttgagaactggaatgagatgaccctctatcctctcctaaggcacaccaaactaacatctgttattgcctctctgctgccagatattccctcaagtcttcttcctttgcagaaaatgtgctggcaccaataatgagttttacatataccaacaaacttcaaagaatgggcatcaaaccttccctggaactcccctaccatgctctgctcttgtccattggggccactaggacaggactgcagtgaagaaagggattcatgtctcctcatctcaggcgacctcttactatactcgcagagctctataaacatgtcttataacatcctttgtgatagaattctcagatagccctcaagattcctgcccatcggtgtacatgccctgtgtaaagttctgtccttgagtgggcagaacttgagaatctgattatatatcactctttgaatcaattattaattattggattttgagttaaccaaaacggagatgtctatatgggcccaatctaatcagtttagcacttaaaaggaactggccctcccttcatgaaggcagaaagattggatgtataagagggcatggcagggaccatgtagccaagacctgagaatgacctctagaagctgacagcaattccacgccaacagctagcaagacaagggggacctcaatgctaccagttcagggaaatgaatttgacaaacttcctgaggaagcttagaagcaaatcttttcctagctgagcctccaagtgacgatgtggtcttgctgaaacctggatttcagcattgtgagactaagcagagaactcagctgaactgtacccaaggaatctctgagataatatgtttatgttttcttaagccattaatattggccattaagccatttgttatgcagacatagaacttgtaaacttctcttttctctttctgttcttcgattatcctagagtgaggattgctgctggcattatatctaggaggtaacaaggccaattcagcaattttatagcaaacctaagactatctggatgaaattcttgatgatgctcctcagaatggtggagattgggggaatgattaagacatctttgtccttaagtaggagccttaatcacaattccagagcatcaacatattaaacatgcacaactggatgttttagtggcttccttatattgttcaattctattgagagtgagagagagattgtgtgtgtgtgtgcgcacacatgtgtgtgtgtgtgtaaaacttggcttaattatgaaattaacacaacgaaaaactttttttgcactataatgtaccatacattcattcaggcaattaaaaggttgtagccctcattcaacatttgttgagatgcgtctctgtgccaagtctttgaatttgatcttaaatatttataattgaagacaaattgagcctcaagttgctgaacctcaaggaatcaattcattcaacaaattcaacaaatatttactaactgtcctggaaatgaaacctgaataagggaaagccctcatcacctaggagtgcagcatactgaagatggtccaataaatattgaaatacaatgacaaacctggacacactatcaatgtctggacatgtcagaacaactttgtagaggactgtgtctaagtcagggcactttatgcaaaattctgtgtatgtttttttttcctttttaatgagaaaagagtccataactgcatcatattttctaaggagtccatgtctaagttaacaagggaaggttgtcctaatcagagggagtaagatatgcaaagacaaagaggcaacacaatatattgcttggtccaggtaagtggattgatgtggttatcttacagggtatgtgtaggtcatactggcatctcttctctttttattgtttttttttttttagaagatcgcaaatacatgaaaataataaaaactctcagttgagaaccaagcaaaataatcaaggttttccaaatttaggatgactaatatcaaacaagtacaaagaccacttgctcccagaaaaagtaagaaaaaaagaaagcagctctcctcatataaactttgtcccataaaaccaggctacaaccattagcagcttcttttatcactttgtattaacaaaattaaattttggaacctgggcctgtgtccaatttgaataacaattgtttattttatatatatattcatatattttatttgttgatttgaaacaaatttataccacaaaaaataatggaatctgagacaacaggaatttgatcccaagagggatttggagtctgttcaaatgtctaacaagtattttgcaacatacttgcaaagtcccagactgcgttgctggaccaagtctctctagacaaaaggtgttctgcagtatcgaggtatatttccatcattcactccaaaagctgcttgtttgcctttatttattttggtggagatctagttttgcattagattccaattattactttctggatttaggtaacttgcaattgtgtgactttgcctaatgatatggcaattgaaatgttgcttacttctaagaactcttctttattaataataagtatgttcctaagtatccagtgaaataatctaaaattgcatacatttctatattaacaattttcctatgtcataaaaatatttcattggaagtgaagaccaaaaagcaatgtaagtactaaatctcaaggatttatcaacagaaaacattataattttataaagactataaaactataattataattataaccaagttgtaattatataattatttaactataattgcaaattataattattcctaaaaattactgtaaactttcttcacaaatttgtgaaaccaaataattctttccccattactagcttttcctcaactctcaaaatgttctgaacctacacatattaactttttcagagactttttttatttaatagtgagcagagcttccaaatgaagttaagacgtatgacatgtgaaacatgaaacaatttttaaagagccagccttcctaaagtccctgacatatcttcactcatgttatgctccacttcatggttggattagactggtatgtgtgatcaatagccagtttcctgaatcttcccattgtgtctgctgttcatgtgcataatcgatcagagaaattccacaaaccatactactttgtgcctgtgtgcgtgcatatatatatatgcacataggtctgaaatgagcaatcctaacacaaggtttagaaatgtccaatagctatataaccacagttttcagagtcatggatcacctcactcatctgattttattctgacaagtttgtaggcctgattaagacataatgatgacactaccttctccttccaaccattccattttagcattacagcagtgctttgaaagtgctcttccgattctgatattcctccttattcatacatcttatttacacatttgggaattcactgctccagggtcaatgttatctcagatcttgacgtctttccacaacccaatctcaagatggttttcccttccagttgacaacactgacctttccacccattgggctaaatagtggtagcaaaatgttaggctaacttatacatttcataaagtaccttctactggacagaaattttgttgttcatagacttaaatatcaggggaatgaaaaatttctccctttctcttccctaaattctgtactttcagaaccagagaaacccatatatatatctatatatcattccatgactctgaaaattgtagttatatagctactggacatttctaaatcttatgttaggattgctcatttcagacctatgtgcctatgtatcttttatgaaggaagatttggattacaaatccagacaattacatctggtagtattctacaaatcagaggcccttgctgtgtgtggcatctctcagaacactggatttcaaactggagcaaaaagttgttaatgtttttgtatgtagtgtctttttttttttctttttttgagacagagtctcgctccattgcccaggctggagtgcagtggcgtgatctcggctcactgcaacctccgcctcccgggttcatgccattctcctgtctcagcctttcgagtagctgggactgcaggcacctgccaccacgcccggctttttttttttttttttttttttttttgtatttttagtagagatggggtttcactgtgttagccaggatggtcttgatctcctgacctcgtgatctgcccgcctcggcctcccgaagtgctgggattacaggcgtgagccaccgcgcctggcctgtgtgtagggtcttaaaacacttatctaatggaaagagtgacctaagccacccaaagttactgcatcacagagttatcatgacaatattataacacagtacatacaaaatgcctgatgtagaacaaggcatgtagcaggtgctcaaaaatagatactgaagaattaagtcttagccaacttgtcctgccacataatttagtttccactgtgacaagctgaggtctcagttctttgtcacagaagacttgagtatatgctgcacaatggtcactttccattatatttgttttttaaaagctattggtatataattgacgtacaataagctacatatatttaagctatataacttgttgaattttaatacacctttgaagccctcaccatgctcaagataattaacaaatctattctcttgaaattgttctcttgcatcttggtaatccattcctccttcccctgcctccttccctggaaaatcacgaatctgctttctctcactgttaagtagtttacatttttgaggcttttctagaatggcctctagaaattgaggccctcagtccttcaactgtaggaaactgaatcctaacaacccttacagaagcctggaagaggactctgagcctcagatgaggttgcagctccagccaacacctcaattgctgcttgtgagacactgagcagaggacccagttatgtcgtgctcagatgtgtgacctacagaagcttcgcgatgctaaatgcatgttgttttaggctgctaagtttctaataatttgttctacagcaatagaaaaataatacactgccaaaacagtgaccctatccaggctaccatttctgaatattttaaacagtcccattacattttaatgagaaggttttttttttttcgaagagtccagtaccatttttatgaccaccttcctaaacgatagctaaaaatgtaaactgaaaatctcctttataatagcattgatctgccgagatgctgtagctgctgttttattgttcacagaatctctccagtgcatttgatcattctgatgacttatcatttctctgcatatgttagtcaaggaaggatggaactggagagtattttcctttgaagcttggcatggggaataaaagaattatgtgtatcagaactctagttctttgaatctccttttcctcttttgttctcctactcttagaaccaaatgaaattgaaaatgcaagaagaagccaaaaagcatcagtaagatacacttgacaattttgattgacacttcctactgcaggtgaattccacatttctacacgtatactttgcttcagagagcaagaccataaatactggctctcaggctggttggaggataatgtttttcaagttctaacattgtgttattgatgtaaatactactactataccaccattttgccattttcatgcatattttaaattttatatacagtattttgggtaaaaattaactttggagtcaaccagcctgagctctactgcctctctcagttacttgccatgtgcttgtgtgtaagtgagctaacctctctgaacaccagtgtattaatctgtaacataacaatcagagctcccattgagtatagttgtgaagattaaatgagaaatgtatgttgtttacttaatggtgattgacatacagatagtaacgttattactattaatgtattaacatgttaacttattaatggtagcaagtcttaaggtaaatttattttaaaatctgaacattaataaattcagtcaaacaaattccaaacattcattacctctacaagtattatatgcaaagtattgtacaggaaataagcaaaagtctaggctaggcagagtggtatttttcaattataggttctttttaaagaaaaatgtcctagtgtatctgtgttaatttgaatgatttttattataatattacaaatacacacacacacacacacacacacaaaaccttgtaccatgtcttatgaggtataatataaatgataggcatcaatttgttcatcccacatgaacacagtagtaatagttatcttttgactgtcatgcaatttttacatgtgatctcatttagtcacctaatagccttggtaagttcaatgattatccctaactctctgagtgattagaaaaaaaaaaaaatgaaatgtagcaggaaaagggttaggagaaatatctgagctagagatatatactaaaaactgatagttgaagatgaaatcatgaatacgaaatttcaagagataagaaaaaggatgcttacccttctatatataagtgaatggctaagacatacataagagagtcccatttgaaccacggtctgtctgacccaaagattgtgcacttaccactactttgtatttacaactgggctagcagtcagacctagttttatgcatagtgaaattaataagctttagtgttccaacactactattcaattcacaatataaggaaatgaatacactttgctgaatagttgtgactcctaaaccttgtcaggtctaatattatttgcctaggtgaaaattatcactgccacattgactacaataaaaagatttgaatccagattttaatgctatgttctttctatctgtgttatcaatgaaagaccacacagaaatcaaaaagaagagggcggtttctagaaagcaagtctagaaaggaagagtaaaaaataaatgtttatttgggagacactcttttggcctttgtcatttccaatattctgttcatagttgtcctattagttttgtggtctacggaaatattacgaaatcttcaagaccaagaaatacacactgttccttccagaaggccaattttctttgccaaactaaacagaagttcttcaaaaatgctctgctatgctggaatgtatgaacatcatttcagttcagccttgcctattcagttcctaagaagggaatcgttatgaagtgagtatgaaagccactcaatgtgtgtaaagaagatgaatggcaatgctgtcttttcaacttctcccatccatagttaaaatggaatcatggttgtccagctaaagactttatttggcagccttccttgcaatgaggtgcggttatgtgattaagtcctggctgatgcaacatgagcataagccatataattgttgctaaaaaatcagttactgtttacttatgaaagtaagtcatgcatttaagagaaagcaatgtgcattccccttaattgtttcccatttccagtggatataatgtggatatgatgactagagctgaagaaatcatcgtaatccacaaggtggaaattgtccacacagctgcctttcctacactggatgcctttcacctgggctgccatgtgagccagaaataagccattttgtttaaactactgttatttcagaaccctataacaacgattgtatctacagcctaattaattttgaatttgatactagaattggtgttgccagctcacacctgtaatcccagcacttttgagaggctgaggaatgtggatttcttgagcccaggagtttgagaccagcctggacaacatggaaaaacccgatctcgacaaaaaatacaaaacttagctggccatagtgacgcatgcctatggtcccagctactcgggaggctgagacagaagatggcttgggcctgggaggcagaggttgcagcgagccaagatcacaactgcactccagcctgggagacagagtgagaccctgtctcaaaaaaaaaaaaaaaaaaaaaaaatagaattaggattgccacaacagaatataacttcctgggttaacagttggacagtaggtagaaaagacacagatattagaagctagaaaatggtgattctaccagtattttggaaacatgtttagaaaaattgttacctctgatacctcagaaggcagaacatatatgagtgtagcctgtgactctaggagattactggaaaaacaaacaaacaaaaaccagaatgctcgtgtgcatggcagcctgttgaagcttttggaaaaatcctacagaaaagaaggactcaagctagaactagaatgtttgtgagcatagatcgaagggaataaggtagtttttctctgcatgtagcctgaaatctactggacaaagaatctagtaatttagaaatacgcaacactgaaaaagttaattatttcttccaaaactgaaatggggctaagaaatagctctaaagatgaaggcttagcagaaactaaaactgtgtccaggcttctctcatacttcttaccataagtactctctgctagtcagtgagtctagtccagaagcaatgatcagattaatgttggccctttcccaatcaatgctattgttctggatggcctcagataggctactaataaaatgggaatgggcaaaggcacaagtccaggtaaaaaagaaaaggtctccaaatgtaagaagtctgactagagaatatctttggctgcttacttatgaaacccgctggaagccagtagactgtaagccaactaagattttgggaaaaatacgttaccccccaaaaacacacttctagtatgaaaaaaacctgtgtcagttggacctacaaagcagcccaaacctccaaagctatacatttcccaagagcaacatactctccagcacttcctaaagtttctatggaggaaaatggacaaggaagaatgcctcagaagggccacagagcaaatggagaaataagttcctcagagagtataatcagcatttccaaatgaactaaccaagctgccagacagtttgcaatatcatcctcagcaagacatgatgattactaaaaaccagtgactgttctttggtttcccactcttccccatttcaactgcgcatttggatgtcctgctcttcctctaacatttttattaagtttgggtgtgaagaggaagaaacagatattttttaattgtcatattcctggaccataataagcttcatcttcctaatggggaggaccacacatgacctatgaccctagactttgttgattctgtaactgaattgaactctgggattgactcatttggaaagagacagaatgtgttagactgctcattgtcttctccaatatttattctctgctttttcctcagttacagaactttcagctgagaatatgggatgcccagtaaaaatctatacatcccaaaagttgtgatttgtttttgtttttttctagattatgtccttaaaggaacatctacatcctccctttttccttcctattggccaaaatgcagatgtgatgggtggagctaaaggaaccatttttgtccgtgaagtatcaattctaggttgaaaactatagaacctcaagcaggcccaccaataatatttttagggtctgggaattagagttcagatggaagaccaaataacagagacacaaatatttaaaagttatacatctgcgagaaaactagtaaatataatatgtcctaacctcctatcttgacaaatatcaaataatcttgtatgccaagttaaagtgtaaaatccttgaagtcctttgaataatgcaccagaatatggtgagtgcaggaatacccacctagcactggctcctggcccatgtctattctcacccaaatatagctccatgctgcactgcaagggacctcatggcatgtatatccatcccagctcacagatctgtttcctatgaacagttgccacttagcgaccccttgccttgagcctaagggagtacagaccagtaacacagatcatgctggggtagaggtatgcttgggccctggaagcagactcaggtccacttaaactgggtatgctgaattgtgagtacctagcacttggtctagactgtggtggggagccaaacaggttccacataggcgtacatccttggttttgaagatttcttgctctgtggaaaatgcacacatctggagaagggacaaggcgaaaccctcaaagacagggctaaggggaggggccgttctagctctagtctaaggatgtcactggaagcaagataaagagattcatatctctgacactggggagccatcatgtctgccctagaatacttactcttaaatattttcataagaaataaacatattttatattgtttatactactgctgttttgagtctttgttataataattatacctatatcctaactgtaatgctaggtgtcttcaggcaggttacctggattttattgccatacaatattatacaaagaaatacctgaatcttttctccaaaaaccctaatcttctttataagacatttccatagtatttttctgtcataattgtggataattatattctatatataaattataattatatatagtttcttataggtatggttaatgtcagctacatatctttcctttttagcttgtgcttccaatgtccttttcctactggctgaacttaaacattgctgacaaaataaatggcaggattccactcaggttggacctaaacaagaacaaaataaacacgtgcctgcaaatatagtaaaaagcatgacactggatgtttcctgtgattaggatgcttttctctcttttaagacaatttaaacactttgctctaaatatgttttttcagcatttttgtttggtctgtttataaatgaatagaccaaactatacacctatacttaatgcactccttagtatccatatgttgccaattttaagcgttggtcttcatagatgatgtagatatgtcagtttctcagaatgtcatatgacttaagttagtcaatttaatatcttctcatctaatgaccactgtgcccacatcctgaaatcttgagatatccagctgtgaaagtttattggtcctaagagtgataggatggccttggccatctctggatttgaatcaatttaagaaatggtagactattgagttctttctaagacacataaattataccatttgttgtatacagttacctatttaataatctaaaccactctgaggtaaatacaacaggtagagaactcagaccacaaactgaagagtataagaaatacaaatttctaatttattcataatgaaacttaatttgtacattaggcctctattctgtgaagtggagataacttaatctcacttgtattaagaatgccaagcttttttttgccgtgagttggcatctaagtactggaggactttatgagtggcatggtaaggatcatagtgaggataactataatcctcagtttgcattttatagccactctgatattatccgagacagcaacattcttcaggctctagatctgtgttatccagtgtggtaggtggtagtcatctgtgatgtttagtacttgaaatgtggctattcagaatcgaaatgggttgtaagtgtaaactacacactgactattaaagatttagtaccaaagaactccctcacttataatatttaattgattacatattgaaatatttggggcatgtttgattaaagaaactattgttaaattaatttcacctgtttactttgtaaaatatggccactagaaatttaagattatatatgtgggtcaggagccgtggctcacgcctgtaatcctagcactttgggaggctgaagtgggtggattgcttcaggtcaggagttcaagaccagcctggctaacatggtgaaactctgtctctactaaaaatataaaacaaaaacaaaaacaaaaaaacacaaaaacaaaattagctgagtgtggtggtaggtgcctgtagtcccagctactctggaggctgaggcatgagaattgcttgaacctgaaaggcggaggttgcagtgagccaagattgcgccactgcactccagcctgggaaacagaacaagactgtctcaaaaaataaaataagataaataaataaatataaagattatatatatggattgcattatctccattgggcagcacttctctggatctctgctcacttcctttctcccagccacaaagctaccttagtcaagcaaagtcatctccattaatattacacctagtatttttgcagattagtggaactattatgaaaaagttaactgaggttactctggctcaattgcacagtgttgcttagatattcttagatatcaaatcctataggtagaaagaaatctatttcaatttttctaaaaatcaaaatcaccattctcttttgaggatcatgtaggaagttttcttctacagggctctgacgaactcataaacttgttcattggatatttagaacaaaaaattcatgccctgtttctgactaccaggaaaacatcaatttttgtcacaaatgaacaaagacgtttccatgattttttctttaaattgggagaccgctctgaggggagtgcagaggttgatgctattataagatacggtactattcgagccattcagtttccaaaaggaaaaatcattcaatgtcccggaagcaagaatgtgtagaatgttataaaatgccttaaactgatgggggtaactgtctcaacaggaagcccaaatcaaagttaacaaagtcactctttaggaggacaaaacactctaacaagaacagggccgagcatggtggctcacgcctgtaatcccagcactccgggaggctgagactggcagatcacttgaggtcaggaattcgagaccagcctggccaacattgtgaaaccctgtctctgctaaaaatacaaaaattagttgggtggggtagtgcaggcttgtaatcccagctatacgggaggctgaggcaggagaatctcttgaaccggggaggcagaggttacagtgagctgagatcaggccactgcactccagcctgcgtgacagagtgaagctccttctcagaaaaacaaaacaaaaacaaagcaaaacaaaacaaaacaaggatattctaacagaataggaagcagagaagacagaaatttagtgactctcatttcctgggaggaaaatcttggtggtttgggaaggatttggcaaaacattttgtctctaccccttgtgttagaacttggaaaaaagaaaatagaagctgttgaggaaacaattgtttctccctgtgtcttcctaaggcttgctgaataaagacaagggctagctaagggtttaaggtaggcagctgattggagacacagtgcttttagttaatgggctgagagcagtaagaaaactctagcagagttaccactcacagtcatctagtgagaaaaatgtgactgtggcgtgatgaattaagatgacagttttaggatcctccagggtagctctctagttgtcaaaaagaaagtcaagtttgcttaccttttcatagtgatactgtaataaatagataattaggaacaaaatacccaatctccatccccccgctatcccccatacacacacaggctcagaagcaacatcagctggcaggcagtaccagggtgagggaagttctccaaagcaatcaaagcagagagagccagagggctgatataaaccacatccaagagagagcaactgccaagaccaaaataagaaaagtcagactagatgtcaaattgaatgggggcacaaggtagcatggaggagagaagcccaaatgtccaggagtcaatgaaatgtagaagtgaaatcaaggtcaaaaggtaagtgggcacaaagcaatattcatttaacaaagtgaatacctgttatgtgctaggcaaaataggtgctgaggatgcagtaatgaacttgtctttaaggaacctatggtctagttgggaaggtaataaataaatagcccattacacacagagtgctgtgtattgtgggagcacataatcagggcacataactcagttttgggagtcagagaatatttccagagtacatggcatcaagacttaggtctaaaggatgatttcaactcagcagccaagatggtttctcaggaagtaaggagggaaggcaacggaagagacagagggaagccgagaacagcttcccaggacaagggcagaatacacaaaggtttagagttaagagagaatacaaagaaatacaaataaggtgaaaacatgaaaaattataccatgttgaggagtttgggctttacactggtggctaaaggaagcatctaaattgtctgcttttcagtaacactgaaatatagacaataaatttgtgggaggcaagactgaaggctgaggtaacagtaggaagctctgacagttatataggcaagagatgacagcgacctgagctaggctggttgcagtagggttgaagaaaagtggacggattctgagatctagacatcaaattgagaggatttattccatggttgaatccaagattcagggaactcaggatttggatctggacaaaggcctgagcttctggtactttttccaagaatagggacagactcaccttagtcccatattctagaaacctgtatggtcagcctactatgtaaaggtggagtctatgaggattcctagttctttgagcaaagctgccctgtgcattgagggaccatcagaggaaagttggggcttctctgttctgatttgcaacaatagcttctgagagatgaatgaaaaaagaacagccacaaatataattctttcaaatacagaccagatcctggcccagctggaggtggagccacaggggaagcttactgttgtaaaagaaactctatggcaaataattttgtaacataaagactatttttatatttcaaggactatgtatcagtttaagcttctaaaacctaataatgacagtcaataaaaaactggatctagcagagtctaagaggaaaagatcatttatcaacaccagcaccaatatcttacgggtcccaatgcactttatgaatagcaaacatgaagcaaccattgcggaaatcaccaacttaccagaagcacactgaccataggcagtggtattcagacaagacttccatagtgggattatgattttttccactaattttgtaggataaaaaactaaagggttcttcctaattttcctaatcatacctacaaattgatattttatatgtaaaaaatatatagatttttctcagtgatgaaacatcactttcaatctgattttaatgtattcaaagctattgactttatactttatatataaatatagcaaagaatattggaatggaataacattacagattttggaaagcacaaagggaaaagaataagccacataaagtaatagtaacaagccacataaaaattgagacattaatgttaatagtattttttatttgaaagttatgttttgatatttgatatatttgaaataactgaacttgtttgctgagtacttttgacatataattcaatctgttctgtaaaatattgtttttcaccatccagtgtcttactcttccagaagaaatttttattttctcctctgaagactaatacacaaaatttatatttaagtagtttaatatgcatattaaaatccaaattattttctatattagtacacaatcaactgcttacaggatatagtctataagatatatatgtgtgtgtacccacacacatacacacacacacatatattcacaaattaactataaattttgatggaacttccaaaaccaaaacaatttggatgaagtctgagtagttaactatgtttacatattttcatatgtgaagtcaccatttcacaaattacaattttcctgttatctttaggctgtcttatgggagtataagtaatcacatttctaaaggaagcctccataagctttctatggaaaaaactcttacgtctctaaagccttaaaatgatacttggaaacaatagtaccttcaggaaaggccctgaacacagagcgaggggtaaaatggctggccatgagaagtatgaagggagagaagcccctctctcatgttcttacagactagaaacgctcaccagggcagtggaaaaagaggtcccctatgataaatgaggttttattttgaaatttactggccaatcaggatcagccaggcaggagaatttacagggccaaacattcagttcaggcttttcatatctagaaggaatttttatatcaatatgatgatatgaactggaaagttacacaaattacactgttttgaaaggacaaatattcactctgatgcagaagcattgtagaaagaatgctgaggtaaccaaatatacagggcaaagatgggaagggttggttacctaaattgattctaactcagctgcctgagttagcaagttccaacacaaagaaaaattggggagtgaaaaaaccagccaagatttcagaatcaaaggccagttaggagaaagctgagaatgggcaggaagtgtattggaggaagctcacttttgtgggaacagccagagagttgaatgtacaaaggcaaaatggtttagcaaggccaaaagtgatacaggcaaatgctaggaccaagaaaaaagaatgtaatgggtaagtgacagcagagaggagccatacaacaacattactacaagaaaattaggcagggataattggatcacaatcaattctgaattgtaattggtggtttgaaggacagaacctaacctcctagaagaagtgactgagaaggacttgttggggaataaggaaccagtcgaacaggccagggttttagaaagaactaatagtgaaaatctgagttgagaaataaaaaataggagttagggaaattgaggtacagtcctacttatataacacggaaagtagagaaattctgaaattcataaacgtgtatgccttacctggaaatagagcctgtaaggaggtgataaaggttaatgaggtcaaaagggctgggccctaatctgatagggatggtgtccttataggaagagatatcagcattctctctctccgctatttgaggacacagcgtaggtggctgtctgcaatccgaggagaaagcctttgccagatactggtcctgctggcaccttaatcttggacttccagtcctcagatctgcgataaaataaatttctaaattcaagccacccaatctatggtattttgttgtggcaacctgaacagactaagacaataggataaaatccagaccccctttatatagcattcaagtctgcccccagccaactgctatccgatcttacatgtctttttatgctaaatgccctgtcctgcttattcctctaaccacacacctgcccaattctctcgctccaacttgtattcactctttcagacactactctgacgtcatattctctgagaggtagatgactgttatgggttgaattgtgttcacccaaaagttatgttcaagtgctaattctctggtacctgtgaacataatcttatttggaaatagggtcactacagatgtaatcaagttaaaatgaggtcataatggattcagtcgggacctaatccaatgatccatgccctaataaaaagagagaaatttgtgctttttaaaaacaaatgttattgtgtatatttaaggtatacaacatgatatggggtacatatagatagttaaaaggttactacagtgaagcagattcacatgtccatcaccttacaatagtgacccttgtttttttccgagggcaaccaaaatctactcatgtagcgtgaatcccatatacagtacaattttattacctctcatcctcatgttcatttagtctctagacttgttcgtcctacattatcggctattttccatcctctgactacatctccctatttcctccccaccccatgccctttcctgttaaccactgttttgttctttatctatgtatatttttagattccacacataaatgagataatgcaattatttttctatgtctggcttatttcacttagcataatgttctccaggctcatctatattgtagcaaatggtaatatctcattcttgtttatggctgaataacatccattgtacatatgtaccatagtatttttatccattcatccatcgatgaatacttatattgtttccatattttggctattgtgaataatactacaataaacatggaagtacagatatcttaacaaggtggtgatttcagttcctttggatatatgaccagaggaagaattgctaggtgatatggtagttctatttttaatttctttggaaacctccatactgttttccataagggctgtacccttatggaaattctacaattcccaccaacaatgtacaagagttcaatctacattcacaccaacagtatacaagagttcccttttctttacatcctcatcaacatttgctatcttttgactttttgataatggccatcttaacaggtgtgagatggtatttcacagtgtagcacagctcagccaaggctctgattaccttggattcgaggcactgcatctgactggtcccagaaagcactgccacataggtcagccagagcctctgaatccctgggagtgggatgtcacaccatttgcggtgcttctagaagatgaaactgctccaatgtaccagagacttggagccctaggagggcaggggctgcctcagctgtagtgctggggacagagacagacacacaggaagaatgttacatgacaagggaggcacaaattgaaattaatgctgccacaatccgggaataccaagaattgccagcaaccacaagaagtgaggagagaggtgtggaacatgttctccttctgagcccttcagatgaaactaaccctgcagacacccctttattttagacttctagcctccagagcagtgagagaataaattaggttttaagctacacagtttacagtacatttttgaacagcagctctaggaaactaatacaatgacaaacaatattcccactctttctccaatcctgaaataattaattgcactccataaggctttgtttttccctgcaatcttagaacaaaatattattgatgtctatcgtatataccaagcactctgctagatgttgagagtacaacagagaccaagagagacaaagttgtagatttttttttttttttttgagatggagtcttgctctgttgcccaggctggagtgcagtggtgcgatcttggctcactgcaagctctgcctcccgggttcatgccattctcctgcctcagcctcctgagtagctgggactacaggcgctcaccaccatgcccagcttatttttttgttttttagtagagatgcggtttcactgtgttagccaggatggtctcaatctcctgacctcgtgatccacccgcctcggcctcccaaagtgctgggattacaggtgtgagccattgcgcccagccaaagatgtgattttataaaatctactgggaagacagattaaaaaaaaaaaaaaaaaaaaaaaaaaaaaaaaaaaaaaacaaggaaacaaacaaatacaaggacacataataatgaagattaaaagcaaagtagaaatggaatttaaagtgtagaacttgtggtcatcaacacctttctaaggaggtgacacgtaaaccactggagagcttcccttcagggaaaacagcaggcaccaggtttctgagtgaggaagtgcttagttccttgtgagaaatgacagaagcccagactgagttggttaattttattaaatgaggatggagagataagcaatggccaggacctacagggctttcttattgttttttaatcactttagttcctatgaattggaatgggacgatggtgtctggaggggaagtatgagaagcagataaaagtttgtggcaatagttcaggagagataacagtttcttggatgagggtgatggcagtagcaatggataaatgtggatagatttttagatatacattggagtagaatcagcgggagttgctgatagactggcaaataccattataacagcactaatgccttatacttaattcaattgcttatatttctatctaccctattagactgtatagttttgacagcagggattatcagaatcatctttttaatttctaccacttagcataaagctcagtaatcagttgttgaaatacatatgtctacacacacatacatatgtttgtatatatgtatatatcttactttgcatcatacagtttataagatccaggtaagccagatgcataatcataaaactgagaagagatgatccagttaactctgggttgactgtagccatatgctgaaataaatgtgttcagtttctaaatgaataactcttacattcacaagcaatagataatcacctgaaatgagacaattttatttttggggaagggagggagatcaaatgtgtctgatattagaaacattagtcattgctcaagtacttttcatttcccacaagtgatggtttgtattacgtagactttaattcagcctctctttgggtggtccctttttaaaggggctccttatggtttgttcatcctgttgatactctcttctcatcaaagcagagtaagtgttgcagggttgatgttaatagaatctgcagtgagatcttagctggagaacacaaaaccacattaactgatatttcctcttacatagtgtgtagatgatctctaatgatcaggagtgtttaagaccatgatgctcttgcatacattctacatgtgaccttagaatagtctctaggtttttgttgtgattcctcataagccagaaagatggcaaagccttaaaatgtgggataatgaatcactgagtacagaagtgaactgtttagaggtctcctcctgggtttaattatttcatttaaggaagaagtcacagcgtcagctcacagtccagatctagtctgctgtttgtttctaaaaaatacttgaacaacaatggaatatttaaaaatataagagatcatctaaaaaatcctggatcttgtgtttcttttgaaattaaagaatggaatctctaacaatgttgggcctgtgtggattctgcttgggagctgagaaaagtctccttttgtaagagtgtgctgcctgtttactacagcacccccaggcccactttactcatttccatcttttgcttggtacttgtgtgcttttgtgtttgcaacccctgggctagggtcactgtaaccattaggagctactgaggcttggaaaatactctagggcaccccaggattgtgggtgaaagacagcgggccccgcacacagcctgagccagaacacagggcatcaaggttttcaacttccccaaaagcatgcttctcatttttctcagttgtttcaagttgggaagctgtgtgtacctctctctagagatgccacataagaagctaagttgtgtgcagttcagtttacactgcaactgaaacttggcttctagcttcttgttgacaatgtgctcatataggcaaaaagctttccttaatacattttgtaatacaattcagaaacattaaaaaataagtgtttatccactttttatagatcctggagtctgtatgttttctgaataggtaaaatagtctcgtgtgaagacaagaattttgatgagaaaattttccaagggaatccctctacttaaaattttcagggccttccctgaccagatatctaaataaattcaacactgagtaatttgagaaaatgtattctagggtcaatatagaagaagattttattataaaagattagcaccctttgatttaattgaaacctcctaaggaattcaaagtgctttatggattacatctcatttccataccatccaacaaactaaatgatctctagtttaaatgattctcagagtgaaagttaagaattgtcatcacagctatgtaaaggctttacttttataaggctaaaattatgtaaataatgatttaagtaacattttaaattagaggatattttttctgggggatggcagatgcccatttctcaccttccccatcttttctcatgctttcccagtgtggaaaataaagcagacagatagactgacagatacacagaccgtcaggcggagagaaagtgaccgtgaacaataaatgattagatagataggtaggtaggtagagaacaaaacgaggaaaaagaggaacagagggggagttgcgggggagagatgttatcagaggaaacagataagactaatgttttctctagaccttccaaaacgcagtcaagaagaaacaagaaatgcaagccaacaagctcctttcttcctatgtcctggtatcatagcaggttttgaatactagttttctgggttgtcaagtttcaattccactctcttaataaggcagagtgattacatggatacatttaaggcattaaagacctcctaatcctccccacctatattatttagccagaactgttaataggaacagaattaactaattttggctttattcctattcctaccctgtcctgattaaatctcaatctgtgccaattaggtcagttacttaaaaccagatgtgaaagcattcaaacttgagatttgtccttcatagggtagatatgtcagacctggctttcatagaaaagttcaatttatccagataacctttcttcagtcatatagaaggactatttttcagccaaagataaaaaagtagctgccatcttttacttggatctccaaatgattaatgcttgaaactaataaaacccaaatgataggttctatctttatacatctccatgaaggaaactgtactcagtccacacactgatcactcagcctgtgtgatcatacatatggtaggatatcactgacagccccagacagatcacagggagccaatttacatggtgggtggtaccctaggctgggcatggcactaggggtttcctgccttagatgggcagcactcccagagagccaagtcatgtgagggttgatggctaatgatggggcagtgactcacagcaccactatggtggacaaggaactgagagggaaccattcgctcttgagaggagcaccccctttctccatctggttcctgggcaaagatgttgttgtgagttgagcatcagaaagaagaggatgcttgttaaacaagcaaataagcagacagcattccaataattcacaaactatatacagggtcacaagctgtatcccaagctgtgggccaactgtgtcttagaactcaaaattgtatgtattttagaaagtattaaagtgtatatactgcatattatatatctccccaccagggcctgaagcgctattctgtgatcaaacacaacagtatttctgcagcaaaatatgtgaatattcacactacgtgcattaaataaacaatgtacattttagggaattcttcaagactctgtcagattaggtctgtttttacctaaagaaaagaatttcagtgttgagtgggtttttttttttttttttttttttggattttgtgtttttttgaaatggtgtcttgctgtgtcacccaggctggagtgcagtggcgtgatcatagctcactctagtctcgaactcctagactcaagcaatcctcctgccggggcctcccaagtagctaggactacaggcttatgctatcatgccccgctatatatatatatataaatttatttattatgattattttttgtagagatggactctcgctatgttgcccaggctgggctcagacttttggcctcaagctatcctctcgcctcagactgccaaagtgccaggattacacgtgtaagccactgtgcgcagcctagattttggaaatgagcataaaagatcgtgagcctgcactctgcttcaacttaaagcagtttaaaaataaagatgctgcaaactctacctctggcacttttcttgctgctttatttttgcgatttcctcccaaatctactctgtcaccctggaagagtcctgagttatgctgcatattaatgcactgcatccacaaactgactcattcaataaacatgactgacttattggacatgtactatcagctggcatcacactagggacagatagtgactcagctattctattgagtggtccactggagtctaaggccatggatttccaaattctagacttcggagtttaccaaggctattgaaattaaaacaaagaaatttttgtctttacaccttatactcaaaggaattcaacggtgaactctattcttaaattagcatttccaagtcatctaacaaaatgccatcaatgaacaagtttatgtgaaatttaatcttgggcagcaagtaatacttgagaaaatatttgtttttaaattgtgttttattttcttttccatttacttattttcattgagagatagttgtctgaccattgctgatttcctttctaggaacaagtttttattataaaacatcaaagcattaatccaaataatccaaagtttattcattctctaaacaaatgaaaatcataggaaagacttattattccacatgagttagaacttggtttaatttgaaaatggaaaaattactatcttagagagatgtaagctgacacactggaactaatgattcctgtttaagggtctgtgttgttttgtttttattctaatacagcacatccaatattccattttggtagaattgtatttcacccttaagtaataaagtggtcatccaaaggattttaagcagccttccagatttgaaatgcttctagtttgataaagacaactcagagaatgacttaatgagaaattcaaaagatgtgatcataacacaatatcatgtcaaaagaggaaaaaaaccagtaggggtatatttggtgttaaaatgaagaatacaaaaattatggctctgaacttataggaaatcaatctaatatttttagctttttgccaataccacacctggaacaaaattttcagccatgatgaagtattatttacaccttcataattttttgtttcttatgccagcagcctacaggaaaatgcaacccacgagttacaagcagacaatctaggtttactttgagaaaatttgatggataaaaaatttttttaatttaattttttttttttttgagatggagtctcactctgtcacccaggctagagtgcagtggcgcgatctcagctcactgtaagctccacctcccaggttcacgccattctcctgcctcagcctcccaagtagctgggactacaggcgcccgccaccacaaccggctaattttttttttttttttgtatttttagtagagacggggtttcactatgttagccaggatggtctcaatctcttgacctcgtgatctgcctgccttggcctcccagaaaatgttaatttttacacttcttacaaaccttactgcccaggggatgaataagtgaaaagctttcagtcagttgccaaagcatgcatgtatatatattttatatatatatataaaactacaataatctgacatgttatacactgtggggaaataggcaaaaaattatgcatgctaaaacagaatcttgtcactatatgaaatattaaaactcaatgtggttaaactctatcaaccatatagagctgaatgcaagaatcatgagatgttagtggcacacatttgtagagcagcccgctaactacaattcaaatattaggtttgtgggctatttagctacataggaatgttaacctcccacaggaaactcgtaatggaaaattcacagcccttggagctaaaaaccttcaccaatacctgaatacaaaatatttattaaaacagagccttacttctaagagataattctgcttgttcagattattcccatatttaaactttattttgggtatctttttccaaatgttaggacattttttaattgtgcactcaaaaatttcatcggctttaaatatgatttattcgctatttttaatattagtcatctagcgcaatgctactcagtcaatgatgagcataaactcgcttttatgttgtgttgacagccttgttgactacatttatatagcacatttaagatgtttcataaaataagcactgatacttcctcactaatagacctgatcagtcccatgtccgtgtcccaccttcagaatatagtaatattgtatattctttcaaaattagtcatctgatagaaagacatggttttataaaaccataacaataagatatgtgattactggcttcaaaatgagaaaactaaaaaatatgtctagaatccaattcttaaagcttgtaagccgcaaattgcaattttgtgcatagtattaagagaaggaaaaaaaaaatataaatccacatttttttatcttatttcagtcctggaatagactagctcttcctagaaatgaaatctgctcagaagtatgatcaaaggtcactgtactctttggaccctgttctatattgatgccttcagtgagatccttggccatgaccaaaatggccctggcaattttcttaccaaagtcatccttttctacctcataatggttgcaatttgtacatgtttggaaagtgaacagaacgcatgaaatacgaattgaaatcatgattgaccctctaattctagttgagtaaaataccttgtgaaaattaggtaaataattctaccaaaaatgtggtttcatttcgttatgtcaggaactaaaaagccaaagtagaatgaaaaacagaattcaggcttccaactttggggttcaacactgctatgaatttcagaactgtaagccaacactctgtctgacatttattactggaccaaaggacagatattcctgcttgtctatttcactttttctaggctcctttctaactattccaccctaatgcgtcttaaaagcatgtattgttttgtacacccaagatgacgtctgaactgcttttccttaagcagtattgacatccagtggagactcagataattacaggtgtgttaaaatccctaaggaatatagctcagaatggatgcctggtttaaggtagttatcacaattcagtaacaaagataatttttcccatgcacacaattgaaacagaatgaaacaaacaatacttgaacagtagcaaacataaaggagaaaatgtttctgacctgaggttgggaagcatcaacctgaggttgggatgcttagatatagcatcaaattgaacatcaaaattaaaactttttctctacccaagacacagtcaagagaataaaatgataaactgtaggttggggaatatatttgcaaatcatgtgtatgacaaaagactcatttccaaaatacataaagaactctcaaaactcaatagtggacatctgcttcaacccaaataaattaacagggtctgaatttaccttctcgaggaaaacaaccaaaataatgcaggtgaaatatatgaaacaatagtttttgagatactggaattagatgataaggacagtgatcattgagggaggggaaacggtgattatcacctcactgccttgagagggtttacagcatgcagtacaaggagggagaacacagaaagctcagagagctccctgtgctgagggaaaggagctgagaatctggggaggtgaaagaggctacatttcagaagttacggttaagaagagagtctgtcttattcttattcttcattgtatgccagccacacacagaaggactggcacatactacattcttgaaagctattggatggatggacagacagatggctggatcaatagatgagtgctagggaaaatggtccccaagtgggagcaagttctgaaagaaagatttgtgaatgaaataagggaagtattcctccattcttagaaagattagttggtgtatactaactacaaaacttctaatctaacttctcgttggcctatgacttgtttttgtgtgtattcagtggctatctatcatacattgtgtaccaactctgttgatgtaattttaaatttcagtgtaaaatagaacttaaatggggcactgtggaatgaaaatcaggctccgactttggaagacttttttctgaagtccaagaggtgctgatttaatgttctgtatttcttataagtccctgaggttgtctcctgtgctgattgagggtggggctagacagcaatttttttggcccagttaagcatattctgttgaaagctttcttgactcttgtcttaatacttcttccctaacatattagcttttctaaagttccctgaaaaatatgtttcatttaaatgtccagtctttaaatggcaccagcgctagaaatttaatatcaaagtttaccagttatatctttaaaagattattgttttatgcctttggaaagtccaaagtgatctaatagttttattctacttccttctgcttccataagttgcttgggcaactgatacttttgttagccatcttctgcaaacagtctagatctgtgaaagctagatgtctcaaattaatattctagtctgttctaggagtggttgtaggggaagtatatttgtagcatattatacacagcaataggaatttatgttttctgttcacatttcttctgtgacttacaaagaaatacaccattgagtaaaatttgagaattgacagaaaatggtggagtgaatcaaaactcctaagaattcttttcctctttttattaaaacacctgtagaatcatccaaaggaaggaaacaatttagcaatttccaaaataaatgtaagtaggcacattcctgtctgtgttcagtagtattgaggcaaccctgatagccaacctgagctatagacattgtctcaagaaggacttctgacagaaaccacacggccctgtcccaggccctccagcataaacttcagcaacaggcaggatttcttgtttaacccagtttctcctcttgtctaaattgcccagtacatttagtaatttcctatagtgtctcagattcaagactcaaccccgttttttccattccaaagccacttattttgttttctgtctcagtgttttataccaggtctctgcctccctgtctttacactgctatttcgtttgcattttgtccttggatcttgactcagttttcatcactcaatgctaacttcctatcttactttttatcccacttttaaacccacaggtcaatcaagtcaatctagactcacctgtatgctgttcctggaacctcagcccctagtatcccagacacatgaaattatgagtaatgcaaccacattgagaaaatagcccaaaacaaaagaaaaagaaaagtgcagaaaataaaccctgaaaggaaatgctcaagtaagaactattaactatccttaacaagatgggaaaaaaagaaaagaaacggcaagtatagaccaggttgaatttgaggactacacaggttgaaagtagtggcactaaaaagcctaggaagtcctgtgaggaatcatattagtgaaaccacaggtagattccaggaacataatggaggaggcatgataagagacattaatgtaagagaagatgacaaatgttgaaagtagaacataaactagaaattaatatccatttctgaaggaaaatataagacaaacatattaggacagatagccaagagtataattttaaaaaattttacagatttaaaacaaaaccataaactgcctccttcctagttatgaatggcttcctatagcacaggaaacaggtggtcaaacaacaggaaatgtaggtcctccattctggctatcttctatcatcttttcaactgcaaaacactactcatattagacactggagaaaatgacaaatatagttcttgtccttagactagtgacaatcagaaaacagacaaaccaataagtacaatccattgtgatccatacagtaatagacacataattctaggagttttaaattatttttacagtcagcaagaacaccaactaatcaggacggaagctggccaaagggctggccttgggtcctggaggcttccaactgtactggcactgcccctttcattgctagatcacggggcagtccagagagtaatgaggtggggccaaggtaaccagggtattgggacactttggaggctcggagtaatggctgctatccagcctgcacggaagaattttaatgttttaaccactgacatggcccttcagcagtcttgtgaaatctgcatatatcatgtgggctcctgtctgttgcattcatcataacccccatttagtttatcaactgaaggcaacaaagttgctcccaagctggctaaattcaagatatgcaactaggaagttgatttctccctttgccacttactctacccttcccttctaaccttcagcagacttaattctcttagtatttcccaaagtctgatattcatatgatttgtaacacacataatgatgttagatccacaaatgagttttaaaaaattaatagctacgtatatgaaactagcaaatcaacccctaattttgtggatattatttcttagaacaagactattttttaatgcatgtattttaaaacccaatatcatagatgtgttagagaaaagcaaaaatcaggaaagtattaaatggaggacaagatctggggagtaccgccctatcttaactgagatgattttcttcattcatcttacatttttctataatgtatctccttgccatggttaaagaatctattttccccttctttctactcttctaggtctctcttttcccttcttcagctcaagaactacctctttttagaaataactatttccatattcatagcactagggagcttctgaaaaccagtgatagaaactcaacttgaactatctgaagaaaaagaagagaatttattgacttaaatgtctaaaccatatggagtggatccgacttcaggaatgactggatccaggagctaaagtattgtcagaactgacactttgttgtctgattactggcctcattcttccttatagcagatcaatttttttcatatcacagtccagggtcacaactttgtaatgtattatcaattaaacattttccaataaactcacttagaaaaattctagggaaggaatctgaacagaactaagtcacatatttgatggaaatacatatttggagtggaaggaaagcatttcttcaaaagaaaacttacaagaatggtgggataaaatgtaaaaatatcaactataaagaataaagagtgtcatgtaattttttgtcaaatttttgatgttttaaatgcttgtctcatattagagaacctcaggtttctgaagggcaaaaaattctgtaagagcatgtacagaggtgcttctcttatcttataaagggatcttaagattttacagatgtggagatgcttgaaggatgagtaatattttgctacctgagcagtaggtaacaatttagacaaaggaaacaatacatgaaagtcaagaagagataaaagagcaaagcccgagagaaaataatacttagcagtgtgctgacttatttcctccctgtcattcccaacagagttgtactgactagcacaaaaacagagtgctgttacaccgaccaaaagcaatagaaaaatgaccagggagctgtattaatcaggatagaccagctgctataggaagtaacctgaagatctctgaagcttaatgcaatacaaaatttgccttacgtcactgtccaatgagtaggaagggtgacgaagtctctgctccatgtagtcatacagggacccaggatcctactaacccatggccttgacattatctattaatagaacagtggctcttaaatattagtgtgtatcagaaccacctagagggcatgttaatacacatattgctgggctgcaaagcttatagcttgcagtgaacaccaagaattagttctcagacaattccagctgagcgaggagggggacagctcttgccaccccagaatccctctgtcaagtatttattgaaagggcttgttaaactacaaacatccactagatggttttttgaggtcaggtcgtgagacacctatggccttgtaaaagcactcaaacctcattctcaagaggctgttttcagcgttccttatcacacacttcactccttgtcctgttttcagggtcaaggagttacattctcatgcacaaataacatacacacagtgcctcagtatttttccatgctccgacctcaaatgccatgtacataagcttgaacatgttgccgtgcactcgcctcactgggcctcacctccagagtttctgatttggtaggtctggggtgggacccaagacctgcattttgaacaagttcccaagtgatgctgatgctactgatctagagacaacattttgggaaccactacgctaaagcccttagggtctgccttttcagcactcagctggtgaatgagggagaagacagtatttagaaaaagcacacttgctcttgccttagctcagaggtgacaaatatcacttctattcctcacattcataatggaactagttagccagccctacctagacacagaaactctggaaacgtgttctagcaatatggcagagaaagggagaagacatgatttctttcttttttttttttggacattgacagttaatattacagagtataacagaactaaaagcttaaaagaaaatatgaaattccctcctgtggacaaaagtgacgatttggtcactgaactatgagatcgaagaatacactcattttttagagttagattcagataatattttgatgttgccattcagctattttgttctttcatttaagaaaatacaaagatttagaattattctggatgggtttattagatagtttgctcacaagcataccttcaaactttagtttgcctcgtatcctacttttctttttggagtggagttagactgtgtcaaatcctttgtgaaagtagatagattgtaagttataaaaaaaacaaaaccatgcttatatttaaataaaaattgtttcccactgggagggtgagttagtaagcttcatttcagtttggggctcacaatccaggtaatgtttttgccaaaatcatccttgccttttgctaacttaatgataatttgagaggttaaaatagcttccctttgcttattatacaaatgagctgttatggagtatatgcatgaatatggtactcatctggtgcctaattcataatgcagaataaataatgtggcagttacctcccaagttgtaagttgtcttcacctgcagattaattcttccagctgccatttgcttgctgaattttctttcaaatacaaaagaacagtaattatgtcctatttttaattatgcatccaatctcaagggaagaaaggaatctgattgtttccatacacactgaaatatcttatcctcactctggacttgccattgctttgacttgccattgcactgcagttgaataaatggtttgtacttggcttatttgaattttcgactcttctgagattgcaattcctttgaatgacaatgtagaattacaaagatttttaagcaacagactttttgacatctctaattcattattccttgcagagagactttgtcagaagctacaaattgtggggcttgttaaattttatgaacatgcaataaaaaaccctggaaaactttgatcaaatttcaggctctcaagatatattcagcttctacaagcaatttaacgttatattaaattagtagaaacttattattaggagcattttttttgagattaatctttactcccctaatacaagagtgaagaaagactaaacctcagtaaagctaatacaggggtttaacagaagccacttccataatgagattataaactagaaaaatcaatggataatgtggaatccactactcttgcaaatatctagccctacgtgtctgtttcctaatataaagtactcggcaactggcatgtgataggcagactggtgtcatgaaaagagaggctttgctatcaaaagactccagatccaagcactctctcggcagctttctagttgtggccttgcattgttaatttaattcttctaaatttctgcttcattatctggaaaatgggaataaggccgtgagaaaggcaataatcttcactgcataaggctgtgaagatggcttgtgaagatctgtgtggaagcatgttgtgcaagtatctcttacagctgtaaatctgggttgctgtttcactgacccagtgctgagcctaagacaaacattacaaagtatgtgctttatggtccctgtattagtccattctcacactgctataaagaaatgcccaagactgggtaatttatgaagaaaaaaggtttaattgactcacagttctgcatggctgggggtgtcctcagcaaacttacaatcacggtggaggcaaagcagaagcagagaccttcgtcacgaggcagcaggaaggaggagtgctgagtgaagggggaaaagccccttataaaatcatcagatctcatgagaaatcactatcatgagaacagcttgggggaaactgcccccatgattcaactacctccacctggttcctccctcaatccttggggattacggggattacaattcaagatgagatttggatggggacacaaagcctaaccatattagtctccttgcctgagtcctgcttcctgggccaaccatcccctaatgccttgtttgcccagcctcacccgtttgtgctgcttctgtacttcactcagtcgatgctctacttgaaggctttgtctcaactatgctgtcttttggaaacagatgtacaaggtggatgctcacagccatgaccatttgaactggcagtggctttcaaaactttgaaatcattttgcatggataagacttttttcagctcttcacctagatgctggccagtcctgaatattacatatcttctctatcagttttgaaggtgccatttcaaccttgcagccaagtgtatcccaaactttgatatagagtagtgttcttgttttgaattttctgtctagatgatcatgagcaagtcacctaactttcctgaatccagtttatgtatctataaataaggaaaatatttccttaagactgtttttggaaggatttaataaggcaataactacagtaagctaagaattattgagcagttattacatactaggaatttttctatgtactttttatgtaatgactcagttcatcctcacaataaccctatgaggtcagattattatccccatttatagacaaagtccaaggggagtaagcaatttgtcccaaatcatacaaccagtaattgctggaactgagacttgaatccagaccacctggctccagagcccacatgtttatcatacacatcaggtactcagttaattgaagctgtaattatccacagcagaaaaaatcacaaatttactcacacaacatgacttagacaaggaaatgctagtgtagtaaaaggaacatagaacaaaataagttagatttgagtgttagtttgtatatgtgaacccaaaatatctgagacaggtctcaaccaacttagaaagtttattttgccaaggataaggatgcatccacgacacagcctcagaaggtcttgacaacatgtgcccagggtggtcggggtagttttcttttatatattttagaaagacatgagacagtaatcaatatatgtaagatgtacaattgattcagtctggaaaggcaggacaattcaaagggtggaaggtggagttccaggtcatatgtagataagagacagaaggttgcactcttttgagtcattgagcagcctttcactgaatacacaatttagtctggctcagtgaatctgcatttttacataaacaatagggcagaggaagcaatcaaatatgcatttatctcaggtgagcagatggatgactttctgtcctgcacctgtgaagatcagctatcggttaacattgccagggtgaaattcaggagaactgttttagagtaaagatcttgaggcctacaaggaattgtcttgtggccaaactgtgagggcggtctgtagctttatctttatagctaccttatttaggagtaaaatgggaggcaggtttgcctgacatagtttccagcttgacttttcccttggcttagtgattttgaggtccccgagatttattttcctttcacacttaggccagtgaaacagcctttgcaaaaaattataactgagatttcgtttctttttgcgtttgttgctaactgtgtgatctttgacaagccactaacttaattgcttctaggttgtttcctcctatggacaacaagaatactgattactaaattgcaatgttgtttgaaaaacgaatgccatactttcttaagaacgcctgacccatcaaagctggataaatatgggaggttttttttaagagaacattatttctgtttcctaatctctttttgtgcttctttgtagcaaatgtactctatcgtcttccacactgggaccccagacactcatggaggaggaaattcttgaccaaaaatatggtatgcttgtactgacttttttttttttttttgagatggggtctcattttgtcacccaggctggagtgcagtggtgtgatcttggctcactgcaacctctgcttctcgggctcaagcaatcctcccacctcagccccaagtagctaggatcacaggtgtgtaccaccatccccagataattgtttatatttttggtagagacagggttttgccttgttgcccaggctggtcttgaactcctgagctcaaatgatccacctgctgcggcctcccaaagtgttggaattacaggcgcgagccaccgtgcctggactacatattcttttattcctttctacagtttatgagagagagattggttaatctaaaagaatggctttgtaatagtggaatttcaagtaactgttttggtcacataggtgagctatttaaggccaaaggaattttctcaatgtgcttgaaatcacaaatcataccatgtaggtcacccctaaggcaggcgttgcaaactggcctaaacagtactgtttgcaacacagtgcttcaaaaaaaacaatggatataaatcactagaggttagaggctcaaatgtctcagtaacttatatcccttcaacttggccaccatcagagacaggtgaatttgccatttttgtagattagcacttttctagaactttggggaaagtttcagttgcttaaatgagccacaaaggattgaacaccatgtgctgtttttattcatttagttctgtactttaagggaaaagaccttagaatttactgtcaaagggaaaaataacaaacccttttggatcttaacctctagtcagttttaacccacccaaaaactccctaaagtacttagatatgttgcatagcactgatttatagggcaacaatatttaattaggctataactaaagaacctacaccagagatccacagtcaatgaaaacaatagtaacaggtttatactcatgagataatccagatgactttcctctctattaaaacctaccttggcttgcaaacagctgtgtaaaaataatcccttgaacggatttccacagtagtatttgcttaaacagctgcccgcagaattgatgagtgtaagaatgaattgataggaaggcatttgaggattaagactaggatatgaacatttcccaaaccaagtgaacctctggaatgctagacaggactattttaagagacaatgtgtgtaagttactatagggaatttgacctcgcaggcatcaactgtcatacctgtgaccactgttatttatttagcatcattagcaaaacagttgactctacaaagcataaaacaccaataaagtctgtacttcagggtgacacatacttcatattttgtgttaatctgagtttttccaagggaagttaaaggtccttagtccaggtgaagagactaaggtaagtgttctggagcaaatgtaccatctaactttttctggtgcttatatggaaagttagtcactcaggcccacccacaacacttgtagagcacagagcaaaaatacagatggaggttttgacatcatatgccaaatatttaacatgtactttcaatatataaaatttacacttttgctaccttgacataaaaaccttcaaaatgatctggaagatagggtttgcatttagaattctcagatctctccaagttccaagctctatgttagaacctggcctcctttctggggtgcatgaccttgcatctctcttacactgtgagggaccacaccccagcatgcatgtggacaccccaataagcatgttcaagctttatccacagccctgaaaacagccaccttttggccaaatcttagcccaggggagcacacactggcagcatggcagcatagaccatcctcagagggacagaccagacaagaggtcgatacaagtctgaacactggcttgggacaatttggctaaggaattctggggttgtcctatctggagtacaacctagaaaggctggggaccactaactctgggtgacacattcccttgactaatttgaaggtaagggcacagcccaaggagggcaagagcaggaccctctaatgtgagggatcctctaatgtgagggaccctctaaaattgaggactcaaggtaactcaaggtaggagtctcttttgcctcttctgcctaggtctaagagcaaaactggttctatctagaatgaaatcacagtactttatccatacttttatctttagcactcagtattggaaatacgcactggataatgtcataattctggtcagtccagagaattcacagaagcctgggtggttttaagctattctaaaaatttgatttggtcggcacctgagctatttttcaaggcgtctaactcccatggatgatgctaggctaaatggcactccaaggggtgtgccaagcaagtaatgtcccaacagctggttgtctcaacccagcacttcaacccttattccatttggagtaaacacttgacttggatgtttcaagttcggggtcagaaccaacctgacttctcagagtgtaagctacacttcttgtaaggattttttttccctcttattaaccaaccaagaggttaactaattacataatttgtatgcattgtttcagttttccattttttcacatacatttttccagagccaagcaatgtttatcattttcttcctcagagtctgaaatgcagtgcctttcataaaatatgctattataaaggattagctgagtttctcttaaaggatgaaagaaaatatattacatttacctagtcttgttttaaaagcattgcaattatcttcattttaatttttatttgtaacagaagttggaggttttcaatttaatcttctcatttcaaatggtggaaactgaagcccagagagatcaggaaacctatacaatatcacacagcataattcatggtagaactgattccattccagagtcctgtgtgctttgctagccccaatcaatcacagctttcattacatcacacaactctactttcgaggggagaaaagagagggactaggaaaattagggatttggggagccctggataacctgggtgcaaaggtcatgggtcttgtgttttgccatcttactattttttcttttcatctgagcctcctaagatggagcttgctgaggatggaggggaagggatatcattgattctgtttagacactttaaaaaactaaaaaaaaaaaaaaaatcaccagccaatgactgagaaacgagtgcaggtaataatttataactaaatgaaactgcttgttgcataaataatcaaaattcactacttatagcaaatatttctaatgtcttaaccatgtgatttcagtgttacagaacctgagagagaagaaaagtttcaggaagacgatgacagtcaataagatgaaatgatgaagtaaatgtaaacatgatacagactgaggccattggctctgaatatcgagacatcactggaatgttttgagaaattaactttgattgcgaagagattaagaattagaatgcagtaggaaaatgaattaacatctgataagaaaagaaaccaaagagtaaagacctgtagttctgcaacacaggtgctcatcagaaaaatgtgggtaactttttcaataataaacccctggacccaccccctggaaaatctgcttaagtatatctggggcagaaatgggaaatttacgtttttcttcaacatttcagatggttctgttggctctttaaaaattatggcctacgggtaacaggatgaagaaataattatttgccaactacggtatagacagtatagaatgttttcaacagagggaaaggagcagtgagtaatgaggaagaaaataagaaagaaataggtgggaagtggtggtcgagagccgaagttctcaggcaggggtccccaacccctgctgtcctgtgttgtctggtaccagtccctggtctgttaggaaccaagccgcacagcaggaagtgagctgcgggctagtgagcattactgcctgagctctgcctcctgtcagatcagcagcggcatcagattctcacaggagcatgaaccctattgtgaactgtgcatgcagttccttatgagaattccgtggtccttatgagaatctaactaatgcctgatgatctgaggtggaacagtttcatcctgagatcatcctccctcccctgtctgttgaaaaactgtcttccacgaaaccagcccgtggtgccaaaagggttggggactgctattttagaagacatgaaagcgtgctatctaaagtataggtggaagaaatagcatttggaaaggatagtggagatgtcttcctttgaaaacatgtaataaggaccttgaggataaaggttccaccatgttttgaggcaaaaatctggtagatggcttggatctcataagcagattaagtgatgatctaccaaggaaaatagtggttcagctggagtctggaggaatgtggcgtggttcctcagaatgccccactggagccactccagccagtatgagatgaatgattgtgcattagatgggctttaaatgttgaatgtagattttaaaagagtaaaacagaaaagattcacaggtgactcaaagtctaataatagccctaacttatagtttaacacatctttataaacgacttcttgtaggctcttcttgttttgctcttctatgtatccttccaccaacatttgcactgaaggtttcctctgcctgaagcattctgctcccacccccgactttagttaggttcttgccaaatcaccttgtcacagaaatcttccttgaccacctatattaaataggactaactcttctatctttcttagtctgctttttgtatacaggcttatacccgatatattatacatttattttttattgcgtttccccatcctaactaaaatgtaagctgcaaggaagccaaagctgatttgttttgttctttgcaaaaacctcaatgcatgtaggagcacccagcacatagtagatgctcaaagtatatttgttagataaatttaaaaatagttgctactactgccagagcctagcccagacacttctgcgtaattagccctcagcaaaagttgatcaatgttttgatgaattaaatgaatgattgtggcagccagctgtcaagatgacctccagtgtaaacccttgtgtagccccctccaacaataaatagggctgatttgagcaaccaatagaatattgtggaaatgatgacatgtgacttttgagacaaggacataaaagacactggggcttccacctcagtttcttcatcatttgatctaacctctgggagaagtgagttgccgtatattgaagattctcagtcttagggaaaggtctgtagagtgaggaccataaatctgtcaacagccagcaccagcatgccagccctgtgagtgaaccaatttagaagtggattatcgagctctagtcaaacccctagataaccacagccctggccaacatcttgactgcaagatctagttattccctgagacggaataactagctatgcagttcccaaagttctaagccacataactgtatgagataacatttatcattgcttaagccagtaagttttgggatagtttgctatatagcaatggacaattaataacagtagcttagagccagttttcaaaattttgtcccttctgtttgatgtcagggacagatctatcgtttatgaaatgtatagttttccctaaaaccaaataaaaccagcaggctgattttgggaacaacgatttcaatagatcttgaagtgttttctatgccttatcactgacaagattgctggccacatgaaaacctagcatgcatttataacatgaattcttcacacagtgatcatttaaagatccttaatatccagattctattaataatccaacccacaatcctaggagtcttaatcaaaggattaccaaagttccattacttcctgcatttagcttacttatttatttatttgatcattttctttgccaaagggaaagagaaaaacaataacaaacaaacaccttgttttacaatttactcttccttttatggatgactatgctcattttctccacagataagaatatgtgtgtttctttgtgtgtgaaaagaagccgccttgaaggatctatttaaaatttgactcagtgattagttactgttaggcaatgtgggcagacctctaagtgaagtcctggcaagtgtgactctggaaagctaaggaaatggagaatatagttaaaattctgacacttggaacctcatctgagagtcatatgtttttgtcatgaggtgggaggaattactgggtgagtgacacgtggaagggataagcaggaggcatgaattcttaagggcacttgtgaataatattattatgtctgaaagaaccacaagggagctgaaaattatagaatcacaaatttataaataatgagattaaagggaacttcttggattataactcaattttctgtttcttcagaggaaagagtcacatgatgatcgactgttttgagcaattagaaaaggaatatcctgcctttcctttctagggccacctacttcctagtcacaagaaactgaaaacaagtaaaaaaaagaaaaatactatactgttttacactgatttgagcaaaggcagagatgagacagtgtgaagtgatgcaaagatgaggagaggaagtacagcaatgtgactgcatttcagctgctgtgtgcctgggagaggcagatgacacagcaggcacagggcagtgcaagaaagctagagaggggaagaagggccagttgaggctgattctggatgagtggccaaggagttgccttttctttctatgtgcaattgagtcattagaaatttcaaagcaatttttaaactgtaattgctaaactgacttcaattgacacagataacatctgtttgctaaagtgttaaaatagagactgtactgagggttgaacctaccagttcccttaggctcactcttcaaattttgttttgtagataagctaagatttatatatctagcccagagggggtcagagcttttcctttgataaaagaaagttggaaatagagtcacatgtttctcaaagggggttttctgattttaaacacagtacaatcccaagtggccagtcacagaaaatagtatctagtctacctgaattacagatcaggtgaaaagcaggtgagaaaaagtccctgttctgttaaaaaaaaaaaaaaagccaacttggcctttgcatcttgcagcaccaatgtatgtagaccatggccataatgaagacggagagctggacaattgctttaagatgccagggttacccatcagggtggataagcaaagacaaggtcttcttttgtaaaagaagaggagaagattgaggaggggagaggaagggaggaaggaaaaggaaagaaggaaggaaaattagtaaaccagagtgaagtcaacctagcaattacagtttaaaattatttccaaccttgtttccagtacttcttcaagtttgcatagttccattgcatagtagcctgaccttgggctggtcatcacagtttataaagtagaagactctgtcaactgaaaaacacactgttattttatgtgacactatgaaagaacaacaaaaaaatgctgccaattaaactatgacactgtattgatggtaaagtacatctctatatcagagatgtcaaaatgtagaaaaaatatgaatcttaaaattagtaaaagcctcagtttccttttctgtaaaatagagatgacaatagtactgcataaaattctttgcccccgcccccagatcaatttccaacctctccacctggttctgtgcccttggatgctgacctctaatgcagtatttccgctggattcctggttgggcttagttgatggggctgtgaccataaattaatggatatgaggtgaaagagtttgagggtttgtatttcccttcattgctgtggggatgagtgagatagtagctgtgatcctctccacaaggccacacttcaacttggtggcttctctcctatggcttgggtttgcttcaggtttcatttcattcatcattcaggtctgccccttcagacctagggttggggaagaggtgggcagtggatcggcttcccgtgttgctgattcctggatgcttcaccatctcttcttggtgaggttaactttccccataactttgtaactaggttttcattaagttttgtttcttgctggaagcttgactgatacaagcaccaacttcacatgattgctgtgaatattaaatgaagtaatgaatgcaaggaacttagcttagtatgcagcatgggggaagcactctagataatcaggttttctgtttttcaaacacgttaaactcactcctctctttgggcagttgtactagctgttcgctccttcaatattcttgtctcaggtcttcgtagggccggtgctttcttgtcatttagatttcagctcacatgtcattactcagaggacactatcctatccaccttatctgttaatctaaattaattccccaggcatcccctatctcattgcctctcatttccttaatagacattttttcttcatgatatttcttggttacatatttgcttataccctagctctcttgaatagaatttaagtgtgatacattgcttttttgttcctttgcccctgatgaatcctgtgtccagaatgtagctagcatgtagtagggttgcaggacaagttacctgggagcatatattctgaggtagaatgagtgcaaaagccttattgggaagtaacacctaaatttgtgaaagaagggaggaagcattatggatagggagggccatcagacccttttctgacatcataagattttagcagcctagcaaggaactcttgttcgaaggtttctcattagaggagtcccacattgccaatacattgtctcgctactttattcagtcataggctgaaggtcgtccccagaaaagcatgacctcagctgtcatcaccttgctcactcattgtctggggcactccaaaaatagcatgactttagctacaaagctgaggaagaccctgataaagttgacatctaaagacagcgagctaaacaggctctttgcagctgggttctgagttctttctcaatggggaggcctaaataacacatctctgtgtctgccaataaatattttttgtggaatggaacgctcaatatgtttgttttaaaattttttgtcttaactttatcatcatacctaaatgaatcaaatcaagaacagaaggatgtgcaagcctctaatctaactgttcagctagataacagctaagttaatacacataccacaaggaaagaacatacttggcacttttgaaatactaaaatatagccagtggggctggagaataagaaactaaggggagaatagaaagagatgtcagagaagtagacactgtgagattttaaataaggatattacataatctgattcacattttaagaaaatcacttggactgctttatggagaataggtaatagacggacaagagcaaaagtagggagaccagaccagttagcaagctaaggtgaacatccaggcaagagctaagaatggctaggactatggtattatggcagagatggagaagcagacaaagttgggatatattttggaggtagagttttaggacttctaagatattagagctgagagaggaggggaggagactcaaggacaatgtcttgatgtttggtaggtggttgtgtcattttctaggataaggaagagtaattaaggaacaactttggaaaggaaagatctgctttggacttgtaacttttgaaatgtcataattaggcatccaagtgaatatgtgaaataagcaattggctctatgaatctatagctcaatggagatatcaagagctggagataaaatcatatgcaattggcatgaagatggtagttaaagccaagggactttcctggaattcatgcatctaaatgaatgaatgggatttccttcagggtgctgactctcctggggaagcttcatgatatatacatttttctaatgatgttgatccattggcataattttattgggcctcagattctaagtaaaaaaagaaaagaagaagttagtgttctgtgagattaacaagttttaaaacaaacaaaagaagtagattgtgattgaatatctcttattgcaaactgcgcagaccaccaagctcagtaaaagcattgagtaagtggaaaaacaatgttgtatgaaaggacatgaatgaaaactatctgggaaacaacccatattttggtgtcaggaaagcctgagttcaagtcatgactcaaccactcactgaccacaaacaaactgtaattttcataaatttttcacttattttcctttaggagataatagagattataacatcaatcttttggagttttttttttttttttgacagagtctcactctgtcacccaggctggagtgcagtggtgcaatctcggctcactgcaacctctgcctcccaggttcaaacaattctcctgcctcagcctcccaaatacctgggattacaggtgcccaccactgcaccctgctaatttttgtatttttagtagagatggggtttcaccatgttggccaggctggtctcaaactcctgacctcatgatccacccacattggcctcccaaagtgctgggattacaggcatgagccaccgtgcctggccaattttttggagtttttgtgcaaactctacatgactacagatagaagtatctagtaacagtaataacatagtgacggttcaatacattttaactatttaaagactcttttgatgtattagtaaattgaaatgaaacaagccaccataacatcatcagaatggatgggtgtttgcctaaagctaccagactaaaaatgtctactcaacagagggatcacagtgagatttactctttccatgggaaaaaaagggaatgaaacatggaaacggatgtgaatcccatgagctgaatgggtagtaggcttgtgtgttatgctgttgtgtctagcatggctgggggatctaaacttctttattgcttttccctattaataaaacatctttagcacaccctctctctaccactctccccttcccccaggcgtcccttctttggagaacaatggtctagaaaactgcctagcaaagcatctcaatggggcttaagtattttatactcaaaggttcacaagttggctgcctttggagttaatcagcctactgacatattttgtttgtttgaaatggcatttaacattctagccaaagtttaaacactgaaagaacttatatatacatatatttatatagatgttatatatatatgtatatataaacacataaacacacacgtacccatatataggtatacacacacacatatatatataagaaaaaaaagaaaaaaattgaatcttcccttaaaaaaattcccacatggcaagaattagctggatatgttctctttagtttgctgcactccttaccattccttactgttttccaaatgaggccaggattggctaccatttattattatgcttggattattatgtttttatagtaaaagcatagttatctaaatccacaattaaacataaaaattccccttttctatttatatcgactgactcaattttataagcatttacctttgctttccaattctacccattactgtttatttggcaattcttgagaagtaatacgttttgttttgtggtggaatatggccctgaaaagagtcaattactagtgctgattatggtaatgaaacaaaaatcaagaaaaactttaaaatgatggctcttggccaaaattacatagaagtttagaatggaatatttagttaaggattgaaaatgttattttatagtttcaaattatagtttattgcattataggagagaaattcaatgagctagtcaggtttgcaaatttaaagattctttaagaacacatagacacagggaggggaacatcacacactgaggcctgttgggggtcggggggctaggggaggggtagcattaggagaaatacctaatgtagatgatgggttgatgggtgcagcaaaccaacatggcacgtttatacctatgtaacaaacatgcacgttctacacaagtaccccagaacttaaagcataataataataataatactttaagtcctcaggacatgcccctaaatttgtttaattgtcttgagttacaggtcctgtttcttgtatctggattttaaaattcaatggtcacattcaaaacaaaatttatcagtagtcattgaggttgcatgatctactatattgtattgtatctgggaaaacattcctcaatacagaatcataacattaaagtcattccttttatctacccaggcctattgttccttctctggttgcctgctcaaagcacttaatcaattcatcaaagggaatgaaataagccataaagcatggggctttcttagaacaaagacatgacctaatttttccaatgggaaatgacctgcgaaaattcttctcaatgtaaggaagctatagttctcctcaaacctctcaattctcaaaaatgacatcatcaatcaacaactctcttttctaaactgtggctgaaatatgctgtagaagctattcattttatgtcatgttatcagcagaaagattattgaaagaactgtgcattttagcttccagaattataagactattgaattccctagaataaagccccaaatccatactgaggcctatcagatccttcatgggatgttgtcctgtaatctccccagacgagtcattctctccaacgttgctcatctcagcacaattaccactgccatgtccacacacagcacacccccaacacacataaatacacccaaaaaatacataaaacaaaacaacacacaaaaaaactcacatggtctcaggctttaggtataagttatcctttttaacattttagaagtaccccaatacaatagatacttcttcccgtttatagaaattcttttggagtattggagaccctccaccatcaggaattgaccttgactattctaattcttaaagggaatcaatggatgcaataattttgttgacaagtccgtctatgtacattcttcttggtatcttctgtgttctctgcaagtggcctacatggccttctaggatcctagcttgctatgaaagtgggaaggattttaaagcttatttggtggaaactgtatcttttgctgtagaatccaaatctaaaacaaatcttgcattagtctgccatcctgacatttcttgtaaaacatctcaaacaccctttgaggaacagtagtttgaatcacttaatttcatcagttcacatctagtgtccatgcctatctacataatttgccaagcccagtgcaaaatgaaaatgtgagacccctgttcaaagagcaggaaaaaagtagatctaaaagcaaaagttctaccttaaaagctctttacctttacctttaagttctaccttaaaaatatgttaatatttttaagatgttataagggtaaaagtgataaatgagtaacaacataaacttagaaattgaataaacatttttgtgttataattctatatcatataacaaaaattaattttattagtatgatatattgattgtagaaatcttttggcttggtttgctgaaaacttatttttaggtcattaaaattattcttttagcaacttcattttcaattgacataatggaaaatgatatctggcactcttggcaaatgcaatatcacaaataatttgataatttttaattttgagaaatatcttttttcagatgctactgctactagagctgttaatattttttatagactctgacaacattgggataaaattcagataaattatttcagaatataaattttaacacatctagagctaatgattctgtggaacaatttttcagaaagatttatttcttcaaaaaataagtctgaatttagttgcaaatgtaaatttatacaatggcattttaatatttcttctgacatttcttgtaacttgtggtgtttttgcaagaaattgagactaggcatagtggttcatacctgtagtcccagcacttagtgagactgaggtgagaggattgcttgagcccaagagtttgaagccagcctggataacatagtgaggtcccagttctacaacaatttttaaacattagctgggtgtggtggcatgtgcctgtgatcccagctacctgggaggctgaggcaggaggactgcttgagcctgggaggttgaggcaataatgaactgtgatcataccactgcactccagtctgggcagcaaaagcaagattctgagtaaaagaaagaaagaaaagaaagaaagaaagagagagagagagagagagagagagagagggagggagggagggagggggagagagagagagagagagagagaaagaaagaaagaaagaaagaaagaaagaaagaaagaaagaaagaaagaaagaaagggaaagaaaaagaaagaaagaaagaaagaaagaaaggaaggaaggaaggaagggagggagagagagagaaagaaagagaaagaagaaagaaagaaagaaagaaagaaagaaagagaaagaaagaaagaaagaaaagaaagaaagaaagaaggaaagaaagaaaggagaagagaggagaggagaggaaaagaaaagaaaaaagaaaagaaaggaaaaggaaggaaggaaggggaaagtttctttatgatttgtatatagtacaaaatgtttctttacatattctatcactgtatcttcaactataaaaaattttaaaagttgttttcctctcaattggttcatccacagctttatatgaaaatagtgttgttttccaatgactatgactatctttaaattcatttctatttctaagcctatggacacagtatttgctttgcaatgattcagcagttttcaaaagtagaggttctaaaatctgaagaattctagtaaccccatgatatattttttggactatccaggtgtacacttttatctcataataattcactgatcacatttacagcctgggtgccagcagttcctgtcccgatgctcaggcctcaaagatgccacagagacaggactggctatgagaaatgactggcaagttggcttcccacctgagtcccctagctgtccccaggcagagccctcctcttttctgggtcctggagtgctgtcatcactgcagatgcatctgttcctgatgcattcatagacaccaccaatgtggacccaggtaccagaatcagccaaccacttgggctcccatcgtgccctgactgccccagtgcatgtacacaacagggagcctgagcaactgctctgtacaagcttgcctgagccctcctgtgcacatgctgcgactcagtgtaacccctctattatttcgcaggctccagggtcccttaggacttctcctataaaacacaagtttaaatacttaaaaagttatgaaaaatttgaagatggtgacagcagagtactaaaccagacacagggctccttttgagagttgagccccataggcttgcatcggtccatgcccttgaagctgggcctgctagtatcctgagttacccatcattccttgtgcctttgctcatcagcaattcccaaaccgtgctctgcatgatgtggtttggatctatgtccatgcccaaatctcatgtcaaattgtaagccccagtgttggaagtgggacatggtgggaggtgattggatcatgaagacggagttctcgtgaatggtttagcacctccccacttagtactgtgcagtggtactgtagactgagtgagttctcatgagatctggttgtttaaaagtgtgtggcacctcccccatctcttttcctcctgctcctggccatgtgaagtgcctgcttcccctttgccttccaccatgactgtaagtttcctgaggccttcccagaaacagaagccgtatgcttcctgtacagcctgcagaatcgtgagtcgattaaacctcttttcttataaagcacccagtctcaggtatttctttaaaacagtgtgagaatgaactaatacactgcagaacaggtgttctgtgaaaaagagtgagaaatgctgcattctacgttcccctctgggggattcagagtgcttattagcaaattataggatcttgaagtcctgaattaaacgcacgtaatttcatgtagtccatcctttctgaggcttttctggcaccagaatcccagttacatcaagcacctctgaatatcttggggaaatatagtgtttagaataaaatttggagaatgctgtgccaagctgtggagcagactccattcaaaatctccacaggcttttttttggcccctaactcaaagtagccattctatttgaattactatcttcataaggatgtaagtaaactgagtctatcaaggcttaatataatatataaaagtataaggaaatatattttggcaataatacaattttaattcttaaaaaataatgttttattctaaaaattacatactagttactgcccatctaaagtaaaaatgatataattatcaggttatttgtctccatagaaagagtcatttttaatctcacacaaagtgtttttctgttaagcatatttacataaaacaattaaaatagatgagtaagtgatgggcccattgaacctgttcatgaggataataaaacattcaagctcacaatttcattgaaaaatgttaaaacctaaatcagattgtattacagccacttcttataatcttcaatggcttcttacttctctgagaagaaagtccaaacttcttaagatggcctacaaagccctgcctattttaaaaacctctaccttctccatctcattttgtaccatgcctctcctcatttaccatatatcagtgtattaggttgtccttacattgctataaagaaatacctgagattgggtaacttacaaggaaaagagatttaattggctcactgttctgcaggctttacaggaagcatggcgtgggcacctgttcagcttctagggaggcctcaggaagcttacaatcatggcagaaggcaaagggggagcaggcatgtcacacggtgaaagcaggaacaagagagaaaggagggaggaaatccaacacatttttaaacgaccagatcttgcgagaactcactcactatcacaaagtcagcaccaagccatgaggcatatgccccatgacccaaacacctcccaccagcctctgcctccagcattggggattataattcaacatgagattcgggcagggacaaataaccatactatatcaatcagccatcctggcttttacacattcattccacactatttattgagtacctgtaatgggtcataaacttttccaggtactagaacaatatgcaaaagaaataaggactatgacctcaacaaagcaaacaaatatggaatgtataatacagtatcaggtagaaccaagtgtggagacagagagagaagtcagaaagctcttgccttgggccaagtgaggcacaccggtgatttataccaaggcagctgtggtggagctgttgaaaaacagctatattcaggatattttaactgcacagccagtaggatttgctgagggactaaatgtggatgtgagagcaaaagaagagctgaggtttaaaggttttttgggctgagcaaccaagtacatggtgatgctgagatggcaaatgctagggaaggagcaggcttttggagtagaatcaagatctctattttgtactcggtgagtttgagccatctgttagacatccagaagatgtcagattgacaactagatggatgacagtgggtttcatgtggaggcaggaaaatggactcaaaaatttaaaagtaatctactacctcttagcccctcaaatgcaccagtctctgcctctagtcctttgcacatgctgttctctctgtctggaccccttccccgtgtccctccttttatttcttccattaatttttcagatttttgcttaaatgtcacttacccctggaagcctagattccccagaccaggttagacctctttgtcatataatctccttataagttttccatcatagtatagatcaccactggtatcaaataagatttttctgattaatatttgtctagcctgtgtcaacagtattacagcaataatgtctatcttattcacttttaattaccagcacctgcagcagtgtctatatgtagcaaacacttagtaaatatttgtggaatgaaagaataagtgaatgaatgaataagttctggtagacctatttctttattgccacttcattgcccctccaccctctcttgttttcccagcatatgaagacatatctgcttactgccagctgcacctgaaggttactctcaaatacatatttttaaatcttgtgaagatattactaactgggagtacagaagccaaatgttcagagttgattttatgtccagaattgcatgtagggtccaatttttttaaatgactgatagaattgtttttgagaaaacaaaagtgttcattgatgccaagaaataatcagagagagagattacttcagtgtgtctttttaccataaaagtaaattatgaaactgaaccatcaaccatataaaagccttctcaccaactgagtacagatctgtttttctgcttcattgcaataaattatagatagaaagttcaaagacttatttatcaagtaatgtttaatttactaccttgccttagctgggggagaagtgttcagctagagaactaaggcatttgaaaggtaattagctctttaaaaatctgttatcagatctacctttttcctatcatcagattaagaaaggatccagaaaaaacaaccttattcatccaattcgaatataagcctatttcaggtaaaagtatttaaataaatattcctgccatcccacttcagtgcccccatcttttatctgaatgagttgttatgtcctttaaattttaaacaaagctctggagaaatcttaaagtagcttataaaatcataggccacaataaagttggtatagatctccttcagtgtttgttttaaaataataaaaagaataaaaacttagaacaccccacaagaacactactactgacatttactcttggggaagacaaagctacgaggagttaattggataatcccaaacttattgtttctttttctgtttttctaatttaagactaatattgttctaagatacacctaaagtcactgaaagatagatcatttaggatgaggttgtttttgccatatgacatgatttcaggtagaaataatatcatgttgcatccaagtgaatagaacattagcgaagttactcctcagatactggatagctgggaaaccataactgaatggtttcaaatttaacttttttctaggaatcttgaacctgaaacttagagagtttatatattatttacattgccttcattagttgacagacattaatgaacaaattaaagccaaactgaagctctatgagtccagagttcacaaatgccatgttcattgctgtatttctaaggcccagcactgtgccaggtgctcagtgcatgctcaatgaatagcagttattcacacaaagaaaatctggggaaaatataaatgatggttgagggcaactataaaaccacatacttttaaacaaattaaccagttaacttgcattcggatctcaaaatttgtttattttgaatgagattttacaaagttactatatcattctcagcttctaggaataatacccaagttctctttcaaatctaaacatcttttatattaggtaccactttctgcaaatctctcattgaattttacaggactaaaatgttaaaacagcaatacaagtttactgtgtcaagttaaaaaaaaatagtgatcttcctcttctcttcttcctgccttactcctaaagtgacagtgttaatgcttgggtgtaaatccttccactcatacctgtaattaaacctgtatatacttctccctagatcactgcctctccagcccaaatgtggaacacacatgcaccttaccacccttctcaccttaccacccactccttctctgcttaattcctactcttctttcagacgtcgcctcaaccatcaactcctctaaaaatcccaacacctccctaaattcccccttgtaatgggaacaatagagtctgttcatcagactctatggtctcactctagtgtggtgttatgaaggcacagctaggaactacattgcccagccccctgttgcacttaggtgtgcccatgtgactaagctcttttatgtgcaagtgaaaggactggaatttatcttcccccagtcctcatgtccatctctcaaactcatatatctttggggagtcacaattattccttcataaatttccaccaattttttgggatagctctgaagcactgttgctttcatgtacccagcattcatgccctcttgttctgataaccctgattttcacttgaaaaaatgcctattcttcactctgagtcctgtgatttgcatggacctgactctaccctttacattccagggaagcggcacatgacctaagcctcaccgatcagtctacttcatttgtctggcaacaataataatgtgtaggcacttcaccaaagttgctcccgcaagaggaagccctgagagttttgctggaaattctttggaatatatactcttttgttgctactcttactctggtggtatagcctaaatatggagctaccaatggttatctttgctacaacatggatagagtctttcttgagattagcccaactgataggaaggcagagtcaaaataatatagaaagactgatacctggtagatcgtttgaatacctgatcagcctaaacctagtgctactttttactctgcagttgactgaggccagtaaattctcatttgtgttttaagtcagcttcagtagagtttctgtcagttggtactgggaatccttagagatatataccccttatcagtaagatccccaaactctttgattttaccttattgagcacagataccacattctatcttgtttaccctctttcccaaggttttaagttccatgagggtaaggatgccttaccattatttcttgtgtctcacagtgccttagcacagtgcctaatacttaataaattttgaaagactatatggacaaaacagattcaatggtacccaggggactgactgaggaaggtgaagacatagttcctttcctcaaggagtttataaattacaatgaattattcccagatggaggtatatttatcctaattcatcagccccagctatgaatttgaggaactgtaagttacatgctcctattggatggttctacaaataggtctactataaatgataataactccattcacccttagatgtttccatcactttgtcttttgtgggctgccttgcctgcttagcctgaattctcttcaaacatccttccagtcacataatattaattcactagcatcagagaagggcttcaggggaagggagagtgaaagagcagagaggacagaagacagaggaaagtgaaaccacataaaatgggcacagtaccaaaaacatttttgaagtctctggtgaagctttttctggcatcactacacaacaacagcacatcattttcattaacttgaacaaacaaaaccaagcagagattaaaaagcagcacagatgtgatatgactctcttctcctgtcctggactggacagccttgtggagtcacttcccttaacaaggcaggaaatgttctttcagcctgcccccggaaaaacagcacatggcaccaagatacaaccacaaatacacaactctgggctgggtcacttgttctcattctgctccttcccacaaggctcctttctgatgactgatatgatcctggcattctctcctccatctctcacctttttattccttttggtgctgaccttcatggtgtaccccatacctgaaaatatcttgctcccttagggctaagcaactttccctccttcctctcttatcaaactcttcctttatctgagccttccaaggctgatctcattgcaaactatgtttgaacaacatgactagcttttatattatctcatgaatcatgaccatctgaattccatttccatttccttggagaaaagcccagtctggtatgtgttccacatagcccaacatgaagagatggcactcaataaataacacattgtgatgatatcaataccatgaacatatactgcagaaatatttcacaatgaatgaatgactgttgggcccttggtccaggaactgaacttttctggccaccatgggctttggtctgagggtatcttacctgctgtgtatcagtggcttcccgactgtcagaagtagcaaatggttctttagggttcccagaactaaagggtgaatagaataacaaaaaacatgcaaagaaccttagtgatattattttcctggtgagaataagagcattttaggaattgcaatgttcatatagccaaatccagagcttccctatccccagagatttcctccggattaatccagcgcaagccataggaatcagcttcattaaagagaagatcttaccagcatgcattcaaagtaagataaacatgttccatgtgatccaggatttttcctgaccccttcgttggacttgcaatgggggcaccctatttacttgggccattgcactcaactccttctgggagggagcatgtgagaaagtgagtgcagggtctggccagctgctttgggcaacaacaaaagcaaactccatgcaggccctgcagcagggtgcctgcgaccccaaagcctcagaaggcatgttacaatgctcccttagctctgctgtttgtggacaaacagctcagtggtgtgtttgtgatgtgttatcagctcagtgggccccttgcctcctcacatggggtgactgccctctgccatcaagatcaaaggaccagtgtgacagtcttttttgggtacccacactcattaggtccccagctcttgtccggcatccaagaagaatgaagtcgcccagacacttgaaggatggtggaagtggagaattttatttagcaatggaaatggctctagtggagaggagagctggagaggggacaggacaggcaggtaatcttcccccaaagttcagctgtctcaggtcagctcttccctgaagtcaagcagtctctccaaagtcaagttgtctctcctccaaagtcctgccatccctctgaagtcaagtcacctctgtccagtcaagctgcttctcttccctctaccgagtctggagtctttataggcacaggagggagggcagggcaggctgtaggtagttttggaaaaggcaatattagattggcaaaaaggcattattcagtaagaaccaattgggagagagtgggcaaacaggaatagaagatctcactttgggctgtgggtttcaggtttctcagcttaaaggtggggtttcacctgggactcactgctgtttgtctcctgcatgtatcacatggagtggcaacctgtgcacttaggacatagtaggacatactctacttccactacccacataaagaaagagaaagaaagtagaaataacatctaaatactgcatgcgattccgccagccttgcactcaatgagcctgtgtccctgtaatggagtccagactggctccttctcaagttggcctccgggcctgcattccaccctggaagtatccctccacactgtgtctgactttaggatttagagatacatatttcttcatatgcatgacttctaagtaaaagccacttcttttatctggtgctcatcaaaagaatcaaaatgatctgctcctaacctgggggaaaacatgactgttgcttgaattgctgagagatgttattagtattcaacatctcaggggatcttcaaggtatttcaacgatgtataatggtgataatactcaccaatgttagactataacccctaataatgctagactataccccccaataaaatggaggaataatccaagtaatggaagataatgtgtgtattggtgatggggtaaggtgtactctctgctactaagagggggacaactaaaaatatctttgagagagagataaatttaggatttatacccttcttgagtgggtggcttaatggcatcaagtgaattccagctttttctcaggttcttatccctcccttgtatacaacaatagccagccatcaaaggatagtccctgttatgtgcatatactctcctagacagagaatatagatgtgaataaagcaaagtatctaccttcgaggagcttcaggtccaaaggagaaagatagaaaatagaagcaataaataaataagatcatttcaacttctgataaatgctatgaacaaaataaaaaactgtattttattaattttaaaatgtatttttttcacattttaccatttctgagatctcgaagcatcttgcaatctgatagcaacttttatctgaatttaattagcagcattttttttctttctttgtaatacataaaataattgtttacaactgatgacaaattccattcaatgaaaatgatacaaaatgtgggagacactaactactgtatctttgcagatccatttttaatatccatgctgaggtgacaaattaataagatgacagggagatatttcaaatttttataaatatgtttactttcttttagacagggggatatttcaaatttttataaatatgtttactttcttttagcctaacttcttttagttgttgacatatttctttccaacatgaactaaatttacactaatttaatttatccttgaaattcctacattgtcccttacacatatataaaaactactgctccagcaagattatctttccttacctttttacagtttatgtttcaaattttccatctcatcttttcatttactttttttttaatctccacctcacttttctccattcatttttgttaggcagtggttgcttcctccagcctttcatcagtatgtctctccttctcatagacttgcacacaaatcttacctgtctgtggtttcaatccgcttttattaatccctgccaattttcctccctgctacctgtgtttcctgaggtctgatgcccaccgacctcacgttgctgaagttctactgtgtattcccttagagtgtcaggttttcctttgggactcaccttcaaacatgtacgcaacatgttgggctttagcattgtccttcatttttaagtctcattttacttttggcaactgaaatgatggttaggagaactctttttttcttctaatgtttccatgtgggagcctctacacccaggcaggaagggtattgaggtaacatgtccaaccctccttctcccaagtccatctctccctccctcctcaccaagggagaagaaattacttatccagctagtaaatctggagcaagaactaagcatgctcagttctgcccttctgtatttcctctagatgtccctgtggagaggctttcttggctttgttcctaaggcagcccctgacctctatggggggaaagaggctgtgacccaggggttaagtatgtcaagtattgggaatccatgtaggtgctatctgaactgcttgggaatcgagtattgggaagtgagtgctgggaatccatgtaggtgctatctcaactgcttccaccaatccacctttacaagtgtagctgatgttttgatgcctatctgacacctgagctttacttttctattggctcagaaatagtgagagcggcaggaggcagccaaatgcctaggcaggtaggggcaggtccttggtgaaaccccacctccaagccaaaggcagtttaaagcctgaaatccaagctcaaaccggattgagaacttgtcttcccatttgacatgctttcctctaattgatccctacccttcacttattttacatatacctgccctttcctaattggttttctacagtgtcgtgccccacctttgagtggtgtcttcactttaaccttttttgcatactcacaaaccaatcagcatgcactccccattttgagtccataaaaggccacaaaaggctgttctgttactcaataaaattcttctccgccctcctcacccttcaatgtccagcatatccttattcttcttgggcacaatacaagagctcaggaaccactgaacacacgtacaagttataacaccagtgagctggggcacacaagcgtggtggagcgaggcctgggtgaagcatcactgcctgggggtgctggcttgcaaaatgactgagaagcaaaatcgtacatcaacagggcaaataaaagagagaatttgttttagtggtctccaaacatcccctccgtactatcaagagatataagaaaacaaatggcataatcagaagatgggatttaaaaaaatcagaggtgtttaaaaataaaattggctacctgagggtatagtgggcccccatttctggagatgcccagccgtaaggaagggaaaggtaaggtaaagtttattacacttctgctacatattataatttttttttttttttgagatgatgtctcattctgtaccaggctggagtgcagtggcatgatctcggctgaactgcaaccctgcttcctaggttcaagtgattcttctgcctcagccacctgagtagctgggaccacaggtgcgtgccactacacccagttaattttttgtattttcttagtagggatggggttttgccaagttggccatgctggtctcaaactcctggcctcaagtgacctacccacctcggcctcccaaaatgttaggattatactagaaatttttgtgtgcatttcttccatttaatacttacaactgcccctggagttggatggtattagactgttttcatggttgacataactgaggcccacagaccttagtcactgactgtagataccatagatgataaagaaaacaagattgtatttgtcagcttgggctgccataacaaaatgtcacagactgggtggcttaaacaacagaagtgtattttttcatagtttggaagctagacgtctataaccaaggctacagtcaattgagtttctggtgagggctctcttctcttctggcttgctgtgtcctcacatggcctttcctaagtgagttcattgtgtgaagatgaggacatgtagagggacaagacaagctctctggtgtattttcttataaggacactaatcttattaaatcagagccccatccttattacttcacttacttaaatactttcttagcaaccccatctctaaaaacagccaacactaggggttaagtttcaatatataaatttcaggaagagaacacaagcattcagtccataacaaagattcagctgaagtctatcagattccaaaactcatatatatgtcctctttatcacggtcacttatgctttaggctgatgactgctaagtagtatgagaccccaggacctccaacaaagccattactgtagatacagaagttcactcccttttctaaatcaacttaaaattatgtaaaaaaattacttacatacaaagcaaaactcaaattaataaaaataaatatacaggtacctgaatgaagaaggaacccataatctaagctggaaataggaactgaggctccctcaggaggtcctggaactgaatagagacctggggttcagagttctaaacctgtccagaaaacaggatcccagctgtaagcttcgtgcacagcatggagattgggaaatctctacaggctatcccatggttgccgcataaagagaaattttcatctagagttatgaatggaaacagaaaagctcaccaaaaccaaaaaccaaatggaaccacaagccatactttgcagaagtacagagccaaatattcactatccatgcaatattagaaacactaaaccaaggcaccagcatgaaaatgtagcctgcaaatgtggcgcatctaagaactgttccataacatcacatccacattctgtgcctccgctgatggagaactacacacaaaattacagaacacgtcattgcacatggtcatcagtatgtaaaagaaatggaagagctcaccaccaaggaactggaggttttaagtactatgaaagggactttaaataaatgaatttacaaagggatagaatccttaaaaacacagaaaggacagaggaggaaagagagaaagataagaaggaggagaagaagaggaaggaagaaaaaagatgatttgggaaaaaaaacaggtagaaattctagaaattaaaaaatacaatatactagatgagaaattttagggtggaaaggagggggggtgaaatggttcaaataagctgaaagtttcttctaagtctgtgcctctcttttcatttcatgatagagaaatcccaggtccaaacaaacctgtatctcaataagtgaatctaatttcctagttccaggagcccaagaacatgtttgtatccaatggactgactatggagaatatgttcatttgctgacatgatccccacccagatttaattcaatcttgcctcattcccttgatgatctcctttttctccttggaaagcccttagaacctgaaaacttgtaatgcctctgaatgtgcagggcagtggcctagcatcctttgacccctttgtcataaaagccctgttgccctctgcaagagtcagtgcaaattttcccctagcaagaatattttccaatattcagttaaccatgtagggtagtctcacactacaagaggttgagctcaggtgctttccacatgtgattacttcaaagagcatttccccattttttaaaactgaattagttaataagtaagcacaattcctctcttccttattctctgtggattaattccctttaattaattctcttttcactcaaaaaaatgttacttgtaaattttctcgtccaaattgtatttgttttgaatttgcaatttcaaatgaaagcaacgagaaaagtgagtttccgaggaaagtacactgaaagaaccagctgaaagaaactcaaaagctttttagcaatgtctttttttctgaaaagggagtaagctaagggatgatgtagagataacagtgcagaaccaaactattaacaagaaagccattgtgggagtaaatataatggctgagaaactcgggataagggcatctcccacagcctaaacaagcccattgctaattatgtctgtgtccccaacccctcatgagtatatagaagtgtgcttgtaaattgttgttagttgctttccggcaagagactaatttattggaaaccccttctggaacaagttttacgtagtaccttttccccttctttcttctgctttaggtattctagacagaccttgaaacctctgaggagtgtttgaatcctacttatttctccctcccctggaacagatgctggcctaggtctatataaatccaggatgtatataagctcacaaagatctaaacataatcatggagttcacagttatcctagagcttaaaaatgtagtcagagggctgtacccctgaaaattctgaaagactgatattttctgtaggtttatttttatttttattttatttatttatttatttttgagacacagttttattcttgtcagtggcgctatctcgactcactgcaaagtctgccgcctgggttcaagcgattgtcctgcctcagcctcccaagtatcagggattacaggtgcccaacaccactcccggctaatgtttgtatttttagtagagacagggtttcaccactttggccaggcttgtctccatctcctgacctcaagtgatctgcccaccctggcctcccaaagtgctgggattacaggcttgagccaccgcgccaggcctgttgtactttttaatacactagccttctgggaaaattttattttaaaagtcttgtatcttgtaaaaatgaggatttcattgaatgtctttaagtccaaacatctggagcttctctggctggagaaatgaatgggagaggtaacattcaccagctcgttcattcaacacgtttgtttccatgggagacaacatgtaagagcatggatttctttgaaatctcacaaggctgcatcccaatttcatatcaccctggcaagtaccatccctgatctctgagactcagattttacttgtagtgatagcattatctcacaataatcctttcctttttatattattattatccacttttatgtatagaaaaaaataaggttcaaaagaaaccactcagtgatggttttagggaggaagttagaattgagttctgtcttgactgataaatagaataaaaagaaaaggcttgccagaactgcacattatgagccagagcccaaagataaaagccaagaaagtatgttggggccgttagaccacccttgctggcacagagagctcgtctagaagaggagatctcagcatttaatatgtatgagaattatttggagagagtaaatttcatttttaataagtacccatttgttttattgttgtgtacatgacctaagaagcataccttaagaaagaatagtgataataacaggaaataagaatggaatatagatgatggaactcttgaatatcagactaaggagtttggactcaatcccaaagatgaagtgaaatctactaaatatttctgaacaggagagtgacatatgccaggcatttatttttaaacatggcaactcctgtgcggtacctctatttttcagagatgatatggtctgaaactttctgagcacaaagaaaagagctgaagttagtattttctcagactcatggtcaaatctagcttctctaaatctctggttaccttaaaacgtgtttacaaagtgcctaaaaccgaattaaaaattgaatagatcttgatgctgtgaacacttggagacaggagacataattaaaatgttacttttcaagtaactatttcctcataattttgcatttctttttctttaattttttcttttttttttttttcagtagagatggggtttcatcatgttggccaggctggtctcgaactcctgacctcaggtgatccacccgcctcggcctcccaaagtgcagggattacaggcatgagccaccacgcccggtttttttttttttttttttttttttcaagaaacagagtctcattctgtcattctgtcgcccaggctggagtgcaatagcacgcaatcacagcgcactgtaaccttgaactcctgggctcaagggattctcccatctcagctttctgggtagttgggactacaggcatgtgccataatgtctctctgggtttggttttgtttcgttttgttttggtagagatggggtctctcttgcccagactgttcccaaactccggcctcaagtgacttttccacttcaacctctcgaagtgctgggattacaggcatgagtcatcgcatctggtccacatttcttctttttctttttattttttctaatttgaagaggtctttatcaagcacagacagtgacagtctttttgatttatcttgtggatatagacattatgttcagagcttgaaattcacacccaagaaaaatgtcaggcatgattaaaagcaataatagtctccacaagccactcatgaataccaatcttatgacttaaagaatccctttataaaatgctatgaaaaatacatatgaggaaaaatatttattatatgtttcttgaccactcaaagaaacacaatatataatactacaatattgtacttctttattcatgaaatttaaaagtgatggtgcttcaattctgacagaaaagcctaaacatacatggtaactgagttactcatatcacatttaagtcattttaaccctagttagagcacgtaaagcccccactgatctcttctatatgaggctcttggttaatttggacctcactcctcatttcttgatttagtttctttccataataagtcccagaacaatgctgctgggtcatgtgccttgatgttaaattgatgatcaccataggtcaaaagcccgtcgaagaaagcaagcaaattttgctgatgaagtcacataagttgatgaaatccataaagccagctgttcttctagtcaagtcaaccaaaatttccttcagagtgaccctcaatttttttatcctatggtattgctggcagcccaagttttgtgctttggtgtgtgtttataaagcttcctgtgtgaatttaaggaaaattttggagaaatgaacttaataaggtattgattatgtggatgaagtctatatggtttcataagaaaattcttgactgaaatgaaaatctttgttccttcattacttgtttttatgtcctcatatttgcctgttagtatcaagatttcatatctttcttttttcgaccttcccacaaaccagtaaaaactgctttgctacacaagaaagaaaaagggaccaagagtaaagccagatgcacaaacattgagcacacactcatgagctgtctttggtcttatctctacagaatatacttttctaaatgtttcaaagactgcataatagcatcccacacatacatcgatgttcaatatttgaggatgatgtttccatcacagctaggagagtgacaggcagaactttcaacagtagtttgtccaatccaaaattgatataaattgtacaatttgtaaagatattttggaagaatgcccagtggactagtgagatttcactccacttaactcttaacctcaactctctttacctgtagaatttaatgtagtgtcagtttgaaaatggaatggaattcttattttctttcagaaagagaaatattgtgactcttaaacccacctaattttagaaatataaagttattcagcctacagggagactagaagagtccagagatggatcatacggtatttcctgcctttttttcttcagaataatttaaacttgtggatattgcacctggaaatgcttttcccactaagcagtctgaaaagaccatgaagttggtattaccaatttgctggcggactctgaactgaagtggcatttcacacataatgtaacagtctttccttaattcaaaacctccaagcagggttggcaataggccaacacatctgctacatatccctgtgtatatcatcaccatctaaatagagatgcattttgaaacttcaacattttagaataattttttcttcatttcttctttagagaatttaaaattatttctttgttattttatttccagattgtcagactgtagcctttgcacaatttgatatttttaataatcattaataaaatatctagataaaacatctatattgctgtgctttgtttcatgcactatgagatgctgagaatgttatgaaaagatttatttttaaaatgctatatcagaatgaaaatatcctttgaagtctaaagtaaattgttttgattttcttttcacaacagattttcttcatgctacatgaattccagagactatcttttctttcttgtgctcaacaaattatttttatgtgcctctaaagttttgaagtggatcttttaacaatatgtttagatcccctccttcaaatcaataggaaaaagacagacaactcattagaaaaatgggcaaaagacctgaacagacatttcacaaaagaggatttccaaatgtccaataaccataaacataaaaatgtgcttacattagccatcaggaaaaaaacgtgaattaaaactatagtgaaataccagttgatatggtttggctctgtgtccccacccaaatctcatcttgcagctcccataattcccacatgttatgggaggcacctggtgggagatgattgaattatgggggcaggtctttcccgtgctgttcccatgatagtgaatgggtctcatgagatctgatggttttaaaaatgggggtttccctgcataagtctctctctcttgcctactgccatgtaagaagtgcctttcaccttccaccatgatcatgaggcctccccagccactgagagtccaataaatgtatttcttttataaattgcacagtcttggatatgtctttatcagcagcatgaaaacagactaatacaccagtgtacaactcattagtatggctaaaatggacaagacagacaatacaagtattgcaatcatgtggagcaaacaggaccttcatattgctgatgggaaagtaaataggtacagccactttataaagcagtctggctgttttctaaagctggatatgtgcattccctataactcaacaagatcctagctgggcatgtgccgcctaacaaaaataccttcatgtgttcaccaaaatacaggtaacaaaatgttcttaaaagtactatttgtagtggccaggcatggtggctcacgcctgtaatcccagcactttaggaggccgaggcgggcagatcatgaggtcaggagatcgagactatcctggctaacgcggtgaaaaccccgtcctctactaaaaatacaaaaaaattagccgggcatggtgatgggcgcctgtagtcccagctgcttgggaggctgagacaggagaagggcatgaacccaggaggcggagcttgcagtgagccaagatcccgccactgcaccccagcctgggcaacagagcgagactctgtctcaaaaaacaaaacaaaaaacaaacaaacaaaaaaacccaaacaaacaaaaaaacccaaacaaacaaaaaggtactatttgtagtagtcaaaaactggaagttaaccaactgttttcaatagtagaatgaataagttataaacaatgggattctaccagcaatggaatgaatagtcttcaactacatgcgatatggatgaacctcacaaaacagtgaacactatgattccatttaaataaagcataagatttggcaaaatagtctatgatactggaaggcatgagtaaagtggaacacaaggtagtttgtggggttccagtaatgtactgtttcttgttctaggtgctgcttcaactacctgtacacctaagatttatttgtacgtttctgtgagtatattcttgtatttgtctgttcttgctttgttataaagaaatgcccaaggctgggtaatgtataagaaaagaggtttaattagttcactcttctgcaggctgtacaggaagcatagtggcatctgcttctggagaagcctcagcaggcttacaatcatgacagaagtccaagcaggagcagtcacctcacatgatgaaagcagcggggagaggtgggggatgaagggaggtaccacatacttttaaatgactagatctcacaagaactcactgacaagaaggcagcataaagcaatgagggattggctcctataattcaacatgcaatttgggtatggacaaatatttaaactatatcaattgtatttcaataatttgtaagtgctcagactactattcccatcaagtcttgttctaggaatttaaccatcaacttaggaaaatgggctttagacacagaatacactcctaacaaggacacttgtacaaatctcttttttcttgttggaactctccacgttcttcaatgcctgctttaagttttcgacttctttgtgaacttaggaacttctggaccatgccagccaaatgagctgctctcccttctccaaactcaggtcttacttttaatcagtacagtttgttcaatccttagtaaattctacacaagctatcttcccaattagatgctaagctttctgagagcagaaaggaccaaggtactttcctacttctgagtaaccattccccttccccatcacacctggcatggtgctttgtagtaaaaataaaatatttattagtgctcaataaatacatggatgattggtgaatcacaatgaaggcctctattaatgttgggtggttaaggaggagagctataaactcaataataaagaagggatgtaaagagataattagaatcagcccccaccgcttttaaaaaggtgaatgtttaaacttgggaggaccaagaatgcagtttattcattttaattacatcatttcagagaattcagttcttcccataggcaaagaagagcatatcctgtggcaaggccttgagaggttcttgggaatgtgtagggcatagaatgcagcccacaatccctaccgcccagtctgcgggtggcagagatgaagggagtggcttcacatggagtgtgttcatccatggcaaatggattatagcctttctttctaagccactctagccagattatttactgaagtatagtccttaagaagattaaggctaaattatcaagtaaagcatgtattcaggaattaaagtctggttgaagttactcgcttgcaaactctggacattatgattaggggaagcagaggcaggaaacaagattggaatcacagaatccctttaacaggtaaatttccaaagaggaacttcagggaaacaaacaagatcaagtgtttagcatccagggcaattaatacatggtggaagcatcacatcaagttccaactctgaaatcaaatcaagcttgacaagtagagatggaggaggaggaaagatgcagtgggaagtttggaaagggtacaacatgagggcaggtcaacagatctctgggccttaaacacgaggatcttcctgttctgcctgatcacagctccagctcacttgctctgtttctttcaagctccctacatttctttacaattaaaagccatcaattcatgtgtatcatatgaacccaaccactgtgcgaaatctaaaagaatagagagaattttttttctagtttccttggctaaggaacataattctttcaccttcctgtgttaaaagaaagagcgaattaatttcaacatgattttgcacctatttcctcactgaacaagctgataaaagaacctcatgtgtgttgtttttttctttcatgggtgtttcattgattaaaattcacctcctattccactaaaattaaacccaggtctccgtacaatctttctcatttgcagttttgcaaacatcccacagtgaactacttagtgagtacaaatggaaagctggaagagagggggtgtgggtttataaagtgtctcctggactttagcctcaggctacaataaaatgttaatgaaatgcattaaaaaaacagggaaataataattaaccatctagaacaccactgattcatttaaaaaattctccccctcccctgtcattacacctgtacagggagaacaggtcacattgaggccatctggcagcactgcctgagggttatggtccaggcaaaccagggagagcaaagaactccagagggagcatggatcatcttctgcttgaggtcaaatttggggaagttataggaaacatattgcactgaaccctgtcttcaaatccacgtttaaatgcctcctgaatacttctcattttcattttgaagatgctacagcaatagagactctactgaagatgtggtgtagaggatttactccttggtaatcttccaaaataatggatgctagttcatgattattctattttttccataaatgtgcatttctatgtttattccctatctgtcaccacactggatgcaatcagatttgtcatcttttgagaaaatgatttttgaaatagttttatgtgaggtcaaggaatgaaatgaattatttttgtagtggagatgagaagagtaggatgttctctcaaaggcacccgtaccctggtctgtcacattcacgggccttaaattccacagaaatcttcatacagcagagcaacatttgttttctgaaccacaggagaagaaattctaaaaataaaaacctgtctccagggacgcaaagtactggtaaagcaacacggcaacatgcataatgcaaaaaaaacaggtcaaatttagtgatggatgaacatcaaacgatttctagctctgtttcaatttagatacttattcaaagcatgtcgaaatgatagaaacctcgtgggtctacataattgagctaaaaaaactttcttgagcatttttcctcacagcattccctctctgtctctctttctttttctacccctctgttatttctttttcctttccccctctttgcttctttgcataaaatctggaatgtgaaagttaagaactacacaaatatagaaacaagcattgtgaaatttatacatatggttctgttggttagactaacatggaattctgtttttgttcagtccactttttcctactcaattgtattaaacctgcttctctttgtgctgtgcaggatgaggtgtttacctgacaaaaaatcccaattgtcttcaaagaatactttatggataacaaaaaaatataatgccaccatcttggaaatagaggtaacttcctttcaaatttttcaagttatttgtttttccaatacttcaataatgtatacagggatacatagtttcatccctgataagagtaatgtaaaggacaggaaactgagaatcaacaggcctcctcgagattccagttttgccacttaatctcttatgagtaaagttttcttgtcaataaatttggaagaatattaaccatcaatgcccttaaaatacaataaaaaggactagttatacctgacggtactgaagaaggctgccacgtcaagtctaagtataaagagaaatgacaaaacagagaggctcaaggatttgccccagaatcatagtcactgtgaagatctagacaaaagtcacaaaaattttggagttctaatcctgtggtcgcgcccaactcctcatgtcaatattctgaaatgtgtcatataaaattcttacgcaataacacttcacttacaaaaaaccctgcttattagcaacagattcagaaggaaggacggtaaagggaaaacaaaagacagcctctgaacaatctaaaacaaggactcaaatttcatgcactttttccagtttgaaccgctgaagccttccctaagactgtttacttttccttatatagaaatttaacaacactaataatattgttgccaacccataataagttagaaaaaaagaaagggcccactagacaaagacaacttataaaagacatttattgatgtgtgggacaaagtcgaggttctattgatgtgtggggcaaagctgaggttcggatataccttgtataaatgtaagtgatcttatcactggtttttagcagaatcccaagattttcattgtctaaaaatatgtcatgagaacgaggtctcagtacataattggagataggatatatgcagtcatgttagagcagagaggtgtggccacagatttcaagttatatagggctcttgaataaaaaattgccatgattttagaaagaggttcagacacagaacattctgttcataagaagcagttgttctggggtagaacatgaaggctgcactcacattcccccatccatccctgaaatgttataaattcaggagccctagcaactctgctgtagaaatacctactcaatccaaacaagagatggatactagccaaaaagagaaagttaagaccctgagacccagtctcatgtatctgcaaggaacgtaaagcagttaatagtggaaagagcatcccaaggagatttgaagtcacagatggatgagcttcaccacatcaaagtcgctaaggaaaatgcaagaccacagaggaactgatgctccgttacctccctaatctcatctcctactggtgtctcttagtctggcctacctaacttccttgcaattcttaaacaacgccctgtccctgtagggtctttacactgtacggttcgtctgcctcaggtatccacatgaataactcgctcatttcctctaagtctcatttcaggtatcgctttgtcaatgagtattactataagcattgtgtttcagattgcaacctccctccccaacatccctgattcctattacccttctgaatgtttttcatagcacataatgctttctataggcaatgtattatgtattatgtttcttattacttatgacagttatattattgtctgcttccccccagtgctccaggagagcaggaacttttgtctgttttgtttactgctgcagcctaaggccatagaagaatgtgtggcaaatagtaggtgttcaataaatattgattattttgatggtaaaataaatcagcagaactgtggaggaagcacaggcaatgagtatatccatagtaggcaacagacatgatagacagtgggaagagctgcagctgagggatgatagaagctggaaggggtatgaatgatgtgtaggacaatcctcccagaaaggaaagagccgagattctgtcacttgacaagtggggctacggattcagcagacttagatacaaatgtttaggatgaccttatttaagatctactgatctgtgggacccaggagatgttcaggttacaggtgaaaatatcccgatgcatctcaaaaatgtcagaggtcattgcctcctataaatggactttcaaagaacatgttcctgatgctaccttgagacatcaaaaaagatttatcatgcttaatatgctttgggaaatctatgaaatctctaggactatttccatcaaaggtatttaaaatataaagacagtaaggctaggtttccattatctgggaacctgtcttctgtaaacaacctcaaccctagacaatggagcagtggcaatgcaaaaccacaggcttgattctctgtcccagtcacaccagggatgttgtctcttgatttgaggtaaacaggaggatggggtcagagctgaacatcagcacaagaaacggatcccgtgattaatcacattaaggtcagggagatctagaacaaagttcccagaaaagaagatacacttaacaatcagtgggtggacccaggaagcatgaaacaaagataaaagctcaactctaaaatattgttaggaaactgtaatgctaaggacaaaaagaactttacatataaacattgtattcttataacttctaatggcctaagctgtaacaatttgagcaacacagtaaataatgatagaactggctaataagccaaagcatagaacaatatctataagtttgtactaatagaagtcattgattaaataaatgaggacaaatattttttattaaagaattccaaataataaatgtagaaggaattaggaaaatagaaaatcaccataagaacgccacagtaataattgctgcaggcaagatccatgaatgaatgctaaaattagtgactaaaacttttaggggaaaaatgatgtttgaatagactcaatacatctcccacaaaatatatactaaacactcatcattttaacacatgtccacaaattctttggtactccaggagaaggaatttgatatctctccccttgaatgtgggctgaacttagtgacttgcttcctaagagtatggaaaggggaaaaaaataagaaatcaggaaaaactctatttaacaaagtgataatcaccagttaacatcaccagtgataagccatgctgctatcctgtattccctgatatgaaaagagcacttcattcccgtggtcttcttccccaaaatacattacggtagtccaatcatgagaacatatcaaaccaactcaaattgagggtgttttacagaaaactcttcaaaagtatcaaggtcatgaaaagcaaggaaagactgaggagctgtcacagataagaagaaattaagaagacatgcgtaccaaatgcaatgcaatttcctgggttggatcctgaacagaaaaaggacattagtggaaaaactggcaaaatccaaataaggtccatagtttccttaacagccttgcatcaatgctagatttttagttttgataaatgagtcatagttatataagataataacattaggggaagccaggtgaagggtgtgtaggaactttctatgctacttgaaacctttctgtaaatctaaaataattccaaaattttatatatatatatgtatttacctataaattttataaaattttagaatgatattatatataaaaagtttattacatacaaaataggattaaaataactaccaggataaaaaataaaaataatatatgtaggaaaaaatacacagattcaactttaacataaaactgaaattgagaaaactcagatgattctcaggcctttggcttcttgttgccaataccattgtcttcaacaaaggcaggaacaagttaagaagagggtcattggcctactgaatttttatatgaatacaaaattgagaggagtcaacatctaattgatctaaaactagaatgttctgttacccagctcattgcaattgagtatttgtcacttaaaagaatggaaattaaaaaaataattttaaaaaaccatgattttctcatccacttctaaagatttggggaagcttaaacaagattatgtaaatcaaaggacttggcaaaatatacagaaggtggtcctacagggtcctctgcatcttctaaagagatgaaattataaactacatactttggaaagttaatgtattctagcagctggcatgctatgggattataagaaaggttcccataataagaatatgtaattaacataataagaatatgtaattaaatacaaacccttcctcctccattatatctgaaaactgaaagctttctatagtggactttaagtagactggaaggatacagagttacaagtaaattcacttcatttctcgggatatcattatctcaatacacagctaacaaaatgaaaacactcttgattgtctcacctgtaaaataaagaaatatgtagataatctcccaaagcctttccagtttaaaagctttttatgatacctatagtcttccaagaagagagaactcaagttaatgctttgcatgattacagttggggcattgggaaataaatccatgctatctgtaaggttgctgtagatttcaatgcatgtcacatgaaaaaaagtacagcctttatagtgaacatccttactatgaacacaccctgaggagattctggacccagtaatctctctaattgcaaattgcagtttcctgcctaggttctttgtgttccattatccacaccgctcaatctctaaccaccagtaatccaaccaaccaatgaaccataataaaaaatggcactacatttattcctgtctcagacattacagtgtatggcaatttatgttttctttacattaaggcctctgaatcaaggtgaaaataaacctcattaattgttttcaggcatatagatttgcctgacttcaagtaggcaaaataaaagaaataaagtatttttttccaactttgaccaattcataggaaaggaacttataaatctagtccaaataaatctgttacatatcagtccagaataattacccaagcccagctcaaactcagttcaattgaccatctagggccaatgtttttatctctgtgatgtttacataaatctcataataatcatcattcagggtttggcttgagggctgctgagagaataatactatttttttaatttttttttttgttgttgttgtggggagggcgatggagtattgctttgtcacccaggctgaattcaaacttctgggctccagcaatcctcttgactcagtcccccaagtaaattggaactaaagacctggatcaccactcctagcttgaaaaataactttcaaaggcacaaacttcatgttaaaccccacctttaccagcctgctaaaaagaaacttcagcatatattactaaatattgccttctctgtgaattgagagttacttaagatgtgaaaaagtctttatatacccccttctatttcagaggtgtgttgccctgaaacagccacagctactaacacatcttggcatcatataattaagagtgcttggtgtgatgtcaccaatctgccaacccaaaggagtgttttaatttatgcaaattaacaaatttgagtagacatattcctaatctaagttacatgtattttgggatttgaagttttcagatttgggagggataataaggctcatatgaagagtaccaaatagtatctccagcgaagtctgcagaagcacccaataaaacatgattatgactaccgtaaaacacatggatatttgtaatcggtgggataaataaaggttattactgacccccatcaattcaggacaagtttttccctcaaataaattatttttaaaaagtcactttcaagaacttcttggattttggagttgaggttaatgaattgtggacctgtaattgtgtgaaccagtaattatgtgtgaaccagtaagtgagtgtaagaaggatacattgaaaaaaaatcattttattttaatgtcctcttttctagtaaagaaatcgtttctccacttcaaagagttaaaataatcttttgagagttgatcctaattgagacctcagcacctcaccttcaaaaggatccatgtaagtagatcagcacgtgtatgtgcttccaatgtagactctatggtaatttattgcttccaaattccatccagtttcttttataatgttcacagattcagaagacagttctgctcacatctaaaatagcggcccacctgtttccatttatccccctttcatattaaggacaacgtaaccccaaacctttatcttcaacctttaaacatttcacacaggcccatttgggaaatttattgttgccttaaagagacttgtctttttcattcagtgtatcccactacaaaaatcaactcagtacctgttaaccatctggtctctgtatatatcaggccaaaatttccagattttcttcttggagttttctctgtagaagatgaatcctattaggtgaaaaataatgctggaagaattgcaagccattattctgagcacaaatgacactttccttaataagtgttcccagtctaaatcagctttgaacttcagatctgcctggattctggggtttgttttcaatagtcatagccaacatgatgacatctttggcagagacttacattttttaatcagcaaaactgtagtgtatgaaacaaattcaaatgctccttccttttccatgtcagaaatttccggaaacctaacttagcgattctagaacagagagaacaaaattaaatcaggctttattgtttcataacagccagtgtctaccagtaatttgaaatctaacaggattttgtaacaataaatagggaaagatttactttttgagaatgcataggatgatataatagtgatagcaaacaatggtgagcactcaataatctgagcaaaccattttaacagtttatgaatgattgtcttttcctccaggtcaatgtttctcaagtctgtcttcacattagaatcacctgagaaccttttttaaaatgccaatgctccactacatagcagaaattaaaacagaaactctaaaaaatgggtttcaaacgtctttattttaaaagcactctagatgatttaaatgtgcagccaggtttgataacaactgctatgagctattcattcacttattcaatcattcaacaaatatatgttgcgtaccaactatgtcctagtccttttctaggtaccaaggattcagaacaaacattcagagtgtctggaaaatagttattaaagttcacaggtgatattggatgggccacaagggccatgtcatgcaaaacattgaagaatttctggttttattctaagtgaaatggaaagccatcaaggggaagggggtttagcaaaggaatgacatgatttgatttatattttaaaaagaacattttggctgttccttggagatttagatcaagtccaaggacagaacaaaccacaagtttggggagcaagacaatagaagattttgggaacttgcttttatgattacctttgtcttagaccaacaaagtgatgtgcatgttgttttacaaagtcatcattcctctgggccgcatttggatgaattactctttcaccaacccacttagtgaccaactatggtttgaaggagactgcatatgacttcctttgctactagagagaactcactttcagagttcagtacatgtttctcagcttgatgatgcatggcggagtgcttcccacactaggcatttgcttagtaataggaggataaaaagaatctaggaaatgactctttccagctgagacacatatataccatgtagaaatgctaactctgctataggctgccaaacaggtgctcatgtctacaaccagggaaaaagctatagtctctaactaagatcctatttgggtgataactaaaataagatcctatgtgtttatcataaattgtaaagcaagcattttccctgcagtgggtttatatgtgagtcatagtacaaataaaataagccaatggttgatgaactaaataactcaatatgtgttgtgttgtaaccagaccgcaactgagagtcagtagcagcaactagggaggaggaaaaaagctggaactgcaaatcctaacaacacacaacccactctgttagcatcttttatttaccattgcacaaatttttttcttcagttcagactattctgaaatgtgatgcaaactaatactgataccaaggccaagaacgatgaaagagtctaagatgttcctgcataaatgggcagaaaccaagtagtgcagcatttcggttgggttttctccattttaatcaatcaatttattaattttagccaggaattgtaaaacagaatttttataagatgatattgaaatacatgcacaaaagtaattttaccattttgaatcagaaacacaatagctgataaacgctctcattgaaattgttgtttttataatgatacttttgagggtacacgttttcttaggaagcaaccgattttatcttaaagcagaataaaaagaaagtgaaaaaattatttgagattaggcaaactgctgcaaacgtcgatttaagcatactcactcttgaaaattcatacatttccaatctactgacagatagtaatgactttggttagtaatttacttatatttaaaacagtaatcccatttgataatacaaatgaatcagtcattcaacaaagaatcaccgggcgccagtgctaggcactgggacgtacaatgagtaagatagatagtgtttctgtttatccaaagcttgttgggctgggtgtctgcctcattttctgtcccctcactatgtttcatagcatttgtcattactcaattttgtgcatttatttattgttattttcctctgttagccttggagaggaatcaacttatttaatgctcttccatcagctctcagtcagtgcctgactcataattagcttttcttaaatatctgctgaataaatcagtgaatgaataaacccaagatcatatgacttataagttacagaactcaaaccaagcccagatctctctgacagcagaggtcacattcttcattatacactcccctaatcttcatggcttcttaaattatgataccttcaaatgagaaacagcatatatgttctataggatgggtgcccattcaatagaatggtacaaccagtagaatcaagttttcaaattacttttaatgatgctaaaaattgctgataacataattttgagcaggaagaaaagtaggataccaacttgcatacacaacatgagaaacattactgaaagaagatgccaaaacaaagctgagaggaagatgattaaaatgtttaaaataattaactctggatgattggattgtgataacttttgccttcttctttttaccttttcctattttctaaatgttctattaaaaacatgtaactacttatataactataaaaaaatttaatacctaagtgtaatttttagtggaatagaagaggaaaaaaaacctcactaggcaagactttcagtatcaaagaaacagaggaaacgattttcagaaaattaattcagctagccctaaggcactgtgggaggtagacactctccagatgtacttttgaagctaaattatagaaaatctctcatgctgactgagttcagaattcatctcaaagtaatagggagccattgagggtggttgagatgatggggaaatgttgtcaaatgctcaaagcctaagtaattgtgagaaaagtggcaaaacaagaacactaatcaaccaccatgctaatgattcctcctcattgataggtcttcggatttaacattccatatccagatgtcatagatccacacaagcatagatttacttgccaaaagctgtgttttgctcgaaattttttgccactgcaaatatgtcagtgtcccctctgaaacacctatcaaaagagtctgaccttaaaaatataacaaatgaaaaaccttttctcaaaatgtagagttcaactaggcattagttttctgtttctagtatttctatttgtttcttctaatatgaaattcatgatagaggattggcatataatgtaagagtatctttattattcatttgaatttcttttgtaaaaattctgttttgtgaggttttcatgccaggtattttccattttactttctttttccctttggtatgaaataaaatttttctagcactacatctggaagccagtcagccaagggaatcaaaggggacaaaaggaatagacatgttcccattaatatacatacttacgagattagtagagtgattggtcaaacatttatcttttattttctgcagagatagacatctgtagaaatttttaaaagttaagcatataatagaacccttttctaagcagggattcaaaagcctcatgaaattttctacgttttttaactctgaaaaggaaatacttaatatgtgcaccaatgtatgtaaaaatcatgtgtccaccatttctaccatgaaaactcatacttgttcttccctatttaccttaaatgtcaattttttggtgaggtctactatatttgaatcttttttatttcaagggaaagaaaccaaactcgaactagcttaaggaaaaaaaaaaggctcatataaattaaattgaagttttgacttatatcctccaagcttagcaaccacagcagaaagagtgcaactttttcatcacaattccaccaagaatcctagatttacctttcacaggactaggttgagtattatgcctatctctgggctcatcactgcggttggggcatgtaatgctctaattggtctgaagggatactgtctcagcagtcaagtgggaaatcagttctggacagagaaaataacaggaggaaaggtcaaaggcttagaatcaaaagagcatggagtgtctggggaattacaaagtatattgttaaggaaaaacatttagaaaggggggaaatgcagagatgaggcagcagagttagcctgcgactggatgatgaaagaccaggaatgtcgtgcttaagagtttggtgattatcctgaaattaggagggcagcagttgaaggatttaaagctagggactaatatggttatatttgcatcattagttagataattctttttgtttgtttgttttttattttttagttagataattcttaaagccaagtgaaagatggattggaaaaaggaaagtctatactgcataaaatttggatctatattagagcagttatactattaaattgtaacaattgttcatatgcctgctttccacacttgaccccctgctcctcaagggcagaggaattttttttttaattcatctatatagtcctattctgtcacttagatgccaaacaaaactcaataaaataaaattacttttcagtaaaatgaccagaagttttctatataaatcagaaatgaagggaaaagatattactgcaaattctatgttttaaaaattctatgaaaaaaggcataaaatattaatctaggattagtttgagacattaaaatgtactgaacaattacatacacactttttctctggattggagagtttgttttgctttagaaagactgttgcaaatgtggtagctcatgcgccattttatttttttcaattcatgccctacaacaggagttggcaaactttttcagtaaaaattcaaggagtaattatttcagtctttgtaggccaaatggtctctgttgcagctattcaaatctgccattgtagcataaaaacagcaatacacaattcataaacagatttgtgtggttgtggtccaataaaactttgtttatgaatactgaaatttgaatttcatgaaattttatgtcacaaaatattgttatgctttgttcttttaccagccatttaaaatataagaaccatttttagttcacaggccatatcaaaatgaggtggcagcaggcaggatttgacccccaggctgtagtttgcctacttctgctctactaaatctggagtaactgattttgttcacatcaatatcaactagcatgttgtgtgcctgctatgttctcatagtttaacatctttttctttttgttgaattttgttcagattatatgttcattaaatgctatcacaataccatcatctttccatctttgaaaattcagttcaatattttctccattttatcctttaaagtactttaaactttattttaaaataaatgaataataaaaacacttcttgttgtgatcataaaaagcaagactccagcctatcttgattctaatttatcctaattataatttaaaaagataagcaagatgttcatacagactaattatacctggcagaccagtgagtacttatatttatttattatgtttattaatcatcaacttgcaatttaacttctgaataagtagttaggaacccaacgtgagatttaagcgatgtgggaaaatcctcctgcccccagatacttccctttgccctagcatggtgccagaaatactagacgttcgtttatttgaatctcaactgatcaagtattcattcctttgtgtagggctctcagttttattttctaacaccttaaaagataaagaatagcagtcaattgaaagcaaaaaatacacataggactgaaacactatatataggctccaatcctgtggctacagggtaggaagaaagaggagagaaacaatggaaaggagggcattaggaaaagagtcttgaaagagaaggtagaacacagagaagaaagctatttctgatttcgtgcttatgcctaaaataatcctcacagtcctggatttcctgtgcgagtcatggcataatgtttcaattgtttaaaatattagtcttcttttttatgtgacactacctattgataagattgctaagggaataaataaaattattcttatttcctgagtcttttatcccctttcaaagagtcaagttcccaaacaatggtaataaatgaaccgtgatagagcaatctggggaaagttttacttgacctgtaacttagctttgtaaataattctagacagtcatgaaatgactatgcttgaaagataattgctcattgaggtagcaaataaactctgtttatacaattcagcaagaatataatatccacaaaagaatttactttaaaattatagtttctaactgtcatttgaatgtataatttgtataggatttttatataccaggataattgtataactttacattttacaaaatatatgttatacattctttaaagaaagaagagaaaatagtttagtattccaggatttttaaattttatttttttgtgaagggacacagagagagggcaaagggaggaggcagagtttgggatgacacgatcaaccgaaatcgggaaaacaaactataagtgagaaagacacaagtgctgccatcccaaagaataatgctttgatgtgtgggagcaaagagagggaatgaaagacacaatacactataacaacagagggttttatttttcttttttcctagtggaatagtcttcctggtgtctatctttcattcgtgcattccaaaatatttattaactttactgaacgataatttgttacatattatactagatgttttaaatactaggataaataatatacaatccctgactccacggacctggaaatctcattagtgaaagacatggacatgtaaacaagttattttttacattacaaatcagaatgaggtaaatcaaatatatgtctatatagtgcactttgggtaatatctacaaaaatgatcaagagataagagcctgtgaatgataacataatggaggctccttgggtgttgaattttatttagaaaaccagagggtaagtgtttgagctgattctaataatgctttgaaagtgttacttgtcttaaacacttggggcataagatagaagatgagaccatggacctattgagtgcgagattggaactaaaactcccacatcaaccataatcttcaatgtattgcattctcagtagaaaggtaggttagaacgatgggctagtcacaattcttattctgatatagagataagattgggaacttggtgtttccatttgggatccgagaggcaaaatctccttggagattttgtgactgcattcataaacacacacaatgttaaaatttgaaatttatactacaaaaatcatttgagaacacccaagcccaaaaattaatataacaatctgtccctaggaatcccaaacacagaaatgcaagaaaaaatactaaaaccctctaaaattagctcatagttttgaaaaaagtataaaacaataaagagttgagcaagaaccaatagagaaatagaagcccaagaaattgatagaaaaacaatatgaaagagaataaaaaattaacacatgtaaaatggaaaaaggccaaagacatacaacattaaaaaataaatttctagaaaaaaataccagtgacatggcattaaagagagacatcgctaggaagcaggtttctgcataggtgaatatgtacaaaatgactcttgtctttgttgttttaatgtctagataattaatataaaaacataagaaaaggaactgcaattctaaataaaactattataaaaaaacaaattgaatgaagaaacaaacagaatttgttcatgaattgttttttaaattttatttaatttcctatctgtattttcttgtaattttttgaaaactttaggaagtttattctgaattctttgtcaattatttcataaatctctatttcttttggctccattactggagctttattagtttttttggtggcattatatttccatggttttccataactcttgtgtccttaggtcatttgaggagatggccacctcttctggcctttgcaggtgttcttttgtagtaaagcttaactatttagtctagcctgatattctggatgggtggtctggcagcaatcccaacaggaagaccttaacaaaatactagtgaaccgaatttgactacataacaaaaagaatccatcataatcaagtgggtttcataccagggatgcagggatggtttaacatacgcaagtcaataaatgtgatacatcatataaagagaaataaaaacaaaaatcacatggttatctcaacagttgcagaaaaagcgtttgacaaaatccagcatcctttatgattaaaaccatcagcaaaattggcatacaagggacacacctcaacacaataagagccatctatgacaaacccacagccaacataatactgaatggggaaaagttgcacaaatcttaagaacagaactgaatatattttacacatgcatgaacatgggcaaccattttgcacatcaagatgcagaacattgatgcatggattcatcagcagagaatggaagccttatttctcaaggtgtttgaggacaacctttgtccaatcactggatgatgactaagatatgcagacacaaaggcaaactctagaagaccaaacttaaaaataaaaacagatcatatgagaaaagaaaaggaggcagagacatcagtggccacacaatacaagagagaaagttttcactgaccacctcagcaagtttcttcaggaaaaaaatgtcagaatctagcattgatacaatttactaatctaaaatgtcagcttttcaacagaaatttatgagacagagtttaacctacattcaggaaaacaagtagccaatacaatctgtttttgagtgttcccagatattggattttgcagacaaagacttcaaagcagctatttaaatatatgttcaaagaactaaaggaaacaatgcttaaagaattaaggaaaatcatgacagcaatgagttttaaaaatagggattctaattaaagacattacattatttttaaaaataaaataaaattttataattaaagagcataatgattaaaatcttttaaaattactagagggcctcaacaaatttgatacagcagaagaaatgatcaatgatttgaagacagaataatagaaattgttcaacctgaagaacagagagaaaaaagattgaaaaaaactgaacagttaaagacacctacgggacaacatttggcataacaatatatacataatgggtgtccaagaaagagagaaaagagagaaaaaggaatggaagaatgtgaagaaatcatgtttaaaacatcttaaataaaaatacaatcataacccattgtatacatttttatttttgtaatttattttattgaagaaatgtagtagttactaattcagctgaatactggtagactgtatagcctctttctgcaatattctgtggacacaagatgggattctgttcattatgaaattttatgtaatagaattgccaacaccatttgctcacatctaactacaatcaattctcctactcacccacatccctcaacatttcaccttttgaagttcagttgaggtatcacctattctaagaattattttcctaacatctgctctcccaatccttctcagaatggaataggtacacacaaattgtgcttccaagcactctatgaatatattcagtatttcgctaaaacatatcattgttttatagcaaatggctatatgattttcttttctccactagaatgaaacacatggattgtgttttatttatttttctatcccaaatgcttattttaacatctagtaaataaaaaaattgatttatttatggagagaatgaataaatgactgaatgtaggatttaggataaatatcattttaaaacacatcattcatatttgctctggagataatttcataatggaacaaatatagaatgtgtttctataatcatctatgaaagaggtgaaaacactggttaaatacttaggttctgtcctaatacttcctgatttccttgtgtcttcatcttttagtagctgggaaaatatctttcttttaaggtctcagattcttcatttgtaaaatagagatggttattgtaagggttaaataaatatatataaagcaaatagaagaatacttggaaacagttggcccccaaatagctgttaatcattaattcattgttaaatagatgtgtaaacataaatcaaatatagtttattaaagcatgacttgtattaaaaggcagaaaaaaaaaaagattcagaacatttccagcaccctagaaggttgcttcccagttcttacctctttcccaagggtaagcatactctgacctctattatcattgattaaatttgactgttatttaattatgtatagagaggataatatgacatcttttctttatatttgacttcttttattcaataatatatctgtaagattaatccctttgtttcgtgtatcaataatttgtaatttcattcatgtgtagtatttcattttatgaatgtaatacaatttatttacccattctatttttgatgaacatttgtgctagttccagttttttgctactacaaataaagttgttataaacatttttgcttatgtcatttggtgcacatagaaatggattcaggagtggaatttctctgtcatagagtgttccttttagttttcttacagatggagtattgccatattttccaggctggacttgaactctcttggactaaagggatcctcctgcctcaggctgccaaacagctaaaactacaggcacatgccaccatgcccaacttgagtaccttatgttttgtttttttaaagactgtcttccaaaatgattcttctaacttacattcctcatcaatgtaacagtttcagttgttccatatccttgctaatgcttattgtcagtcttttcagctgttctagtaggtagtgttattttattgtaattttaatgtgaatttatttgataattaatgttgcatatgtttatagacctttttgatagtctttcttgtagattggttcttcaagtctttgcctattttaaaacgagattatctctacttttattaatggtttaagggtcttctttatacatatcagatataaatcctttcaattggggtcaatgaaagactgtttgcactcctatggctggagactctgacagtatctgtctggtgaaatttctatagaccagtgactgctttgtatctttcattctgtcctgtttgtaattagatggcttttgtcccatcacttcacgtatttcaaatactttttccaatctgtagcttacctctttaccctttcaatgatggcttttttataaacaaagttggtgattttatagaagtatattttatcaatcacttcttttaaggttaatggcctttgtgactatgtaaaaaatatttgcctatctcaaggttataaagatatcctgttgtctcatagaagtataatttatttcacatttaggtctatggtccatcttgaattaatttgtacatgcggtttgaaatagtggttaaagttcattttttacaacatggaaatatagttgctttgacagcatttattgcaaagactacatgtgccagttattagggtgtctttcagccccaaaccttcccatctatatgctgctttgggatggtgggtctgggactttgcaaactacacttctgctttaccagttggcttccagttaggctctaccaatagggattgaaggaggcttcaaagctggagaaggagaagacttgtttcttcttgtttgttttgaggacttctctggctgatggtttctgtgagtgtcaccccattcctgtgaggccggggtcccagtctcacaggcctcctccctccaagatcataagcacaagcaccagctgggcatcagcctgcaagcccttctttagttttcaaagcttttccctttgatccttcagccagacgtgtggtagctttctgaaattgtgataccctacagttctcaatttactttttagtagttaataacattttactctgtgaacaatgctttatattaaattctctttgttcaattttctatctcctgactgaacttttactgatacaccatctgttcaccccctgagttgcagtggaatgttactgtaagtcaggtgacttcatataaatggatatgtttctggcatctactctatgttttaagtctatttgactattcttgtgccagtagcacattgtattaattactgtattattacgctaagttttaatatccagtagtatcagttatacagctttgtttttctttaagcattgtcttggcccttctagatactgaatttccaccaaaattttagaatcagcttatccattttcatttttaaaatacactgacattttgagtgggattgttgtgaatcttcaaatcaatttgtaaaataactgaagttttacaatgtggattttttcataacaaagatatattcatgaatatatctatttatttaggacttccataatttatctcaaaaatgttttttagctttcatcatagtggttttcacatatttcattggatttaatcttaggtacttggtgtttttgatgctgctataaaaggtatagtttcctatttcattttctacttgttttttgtcaatatattaaaaactatttcttattggtattgtattcaccaactttgttaaatttattacttctaatagtttataggtttcatttattcttttatagttttgataagatgtgattctcaagaaatgtgtccttttaaacaaagttgtcaaatttataagcataaaattgtccaaagttgtccataatatcctcttatttttttaatagtcaaaggttcagtaatggcatctttgttttactctttatatgggaatgctttttcctctattttatcatgatcatgttggatgtttattaattttattagtcttttcaaagaatcaacttctgacttttgtttttctctattaagtatctgtctttttattttgttgatgttttcacctttaatttttcctcttctcttcttctagtatttaatttgctctctttttataacttgttgaagattaaatatgacttcaaagcatcgatttggctgcatctcaccaactttgatgttgcatttttattttcatttagttcacaatattttctaatttttaaaaatcatatgttgcttaatttccaaacattttgttggcagctgttgtgagaccttggttcttgtcttcttagttcaaaagaatttaaacaaaagatacacagcaaaggagatggagaatagagtaatttattgcaaaagaaaatgaatattttcaaagttaagtgtagaatagacagtacaccctgagagaaagagacagaattcagggtgggctgctcataagaatgagatagcattgattattgctggagaaatgcctcctatgagagttttgcatgattattcataaggaggtgggaagaggtgttactagtaagcatgttctaggtggtcttctggatgcacatatgtagtagctgtacatgcttgttcatagattgcacttctcatcagcatcttaaatctccacccaggactgtgatttttattattataatgagtaaagggtcagtttgagaactggtctctacgtggtctctacacgggaaattcccaactgaagacagctttgcgtcaatgagtttaactacaatgcaaatgctggggcttactgtgttgactgaagggttgcacatttgcagtgtcctgaggacatggttacttccttgactacctatcctgcctcaatttaagaattttctagaacttttgttattggtattgatttccagttgaattttgtgttgctcagaaaacctaaccagtataattttaatctttttacatttattagtgtttactatgtatccaaacatatggtctcttttgccaaatgctgagtattcttcagttgtctggtatgatgttctataagtgtcaattaaagcaagtggagtaataatgtcattcaagttttctatagacttatttttgttgcgtcttctgttaattactgaaaaaatattcaacttctgttaattactgaaagatctgattatgggtttgtctgtatttcttttatattctgccattttttactatgttattaggtgcaaatacattttgaatgattatgtcttgttgatgaatttattaaaagacatagaacaaatagagagagataaaacagtttaaaataaatatgataagctttccaaattaaacagtaagctaaatgaagaccaatcaaaataccaacaacgttcttttcttgaaattgtcatgctcattccataattcatatagaagaattaaaagtcgaaaatagatgaaacaactctgatgaatgaatataaaaagggaggatttggattgttattcttacaattacaaatatacagaaattaaatcagtatggtaccataatagggtaagtacaaaaatcaaatgtatggaaaataaaatttagaacttatctatttttatgtctatctctctatctctaagagtttggtatgtgacagaggtaccattacaaattggtgggaaaagatggattaattcataaatggtcccactattattcatttgggaggggaaagtgtcatatatctacctaatatacaaaaaaaattgcacatgaattagagacctaagtgtgatttctggtttgggaaaagtacaggctagatactttgagttaaatttctgagaatgtatataaatgttaaaagtcttttaaaatactttgctaaactggcaaaaaaaaaaaaagaaataaacggaatgtgtagaagccaaaactgatggaatagtaggatcatgtgatacatgtgcactaaagcaagctctcatcctagggagtttggctaaatcctggacaccttgagcttccaatttgatgactgcatgggtcaaggacagaggacagcacttgggtctagccaaagtggggattctaacataaaacttccacataaagctggtttaccaaagggctctaccttccgtgtcaacaggaagaagaaataaactggctattcagtatgtttagtcctatgtgaaactttccattgagcgaaagtaaaaaagcaaaaatctaccctgaggatttgtaaccacaagtcatcactcacagtagtttatgagctgaattagcgctacctgtatggtctaaaaaaacctcaaacagaggattttatttaaagtggtcacaggttgttggtatcttgataaaataaacagaagtaaacacaaattatcttggagaacctcaactacatttcaagcttcaaagagctcaaataaaataaaaccgtaaggaaaataatcatctagcagtcaaaacacagcatcaatattgacaattgatcgagtgacaattgactggtgtgacaattaacaaattatttttgaaagcaatttttcagtttggcaatacattctcaagtggcccagcatttccattactagatgtattccctagagaaacttttgtatatgtgtacatagagatataaacgtatacatgatgtagagtacagcctgttagttattcaaaagttgaagtaaataagctgtctctcagtaggtgaataaactatggtcattgaaggcaatttcttacagtaggaagaattagctccccttgaataaatctaaaattacgatgctgagtttttttgaaaaagaatgtgagcaggttgttatcattcatctaaatttctaaaatgcaaattgcatggttatgtatacatatatttaaagcacaaaatcatacatgagaattgtaaacattaacctctgagtcatgattacttctggggagataaggaggaaagaggttttgcaagacaggagaaaataagactttagctatgtctgcaatatttacatttttttgtatgagacagatataaattaaataatgcatttgtacatgggagactattttattcttttcttgtcatatgtttgaaacttttcaaattataaaatttgaaacaaaatgaaaatgatagggaatcaaagccaaactcatgtctatagaagatatctgtaattagttgccttgtttaattttactcaattaggatataactagtgccaaataattcttttttacaattaaagctcaatttaaaaatcctaattgggtatgatttgaagaagaaatcctgaaactactacccaatgtgatctcactcacaaccatatttgtttcaatttttaattttcatgggtacatagtaggtgtatatatttatggagtacctgagatgttttaacacagacatgtaatatgtaataatcacatcatgaagaatgggctatcctccccacaagcatttattctttgtgttacaaacaatccaattatactctattgattattttaaaatgtataattaaattattattgactttagtcaccctgttatgctatcaaatactaggttttattcattttaaaactattttttttgtacccttccaccctccgctatcctttccagcctctggtaatcatcctcttactctctatcaccatgtgttcagttgttctcatttttagatcccacaaataagtgagaatatgcaacatttgtctttctgtgtctggcttattttgcttacataataatctccagttccatccatgttgctgcaaatgactggatctcattctttttatggctgagtggctgagtagactccagtgtgtatatgtaccacatctttttttttttttttttttttttttttttgagatagagtctcactctgttgctcaggctagagcgcagtggcacgatctcggctcactgcaacctctgcctcagggattcaagtgattctcctgccacatcctcctcggtagctggactacaggcacacagcaccacgcttggctaatttttggatttttagtagagttggggttttgacatgttggccaagctagtctcgagctgctgacctcaaatgatccacccaccttggccttccaaagtgatgggattacaggtgagagccaccgggctctcacatttcctttatccattaacgtgttgacggacacttaggttgtttcaaaatcttggctgttgtgaacattgctgcaacaaatgtgggagtgcagatatctctttgatatacagatttcctatcttttgggtatatgcccatcagtgggattgctggctcatatggtagctctatttttagtttattgaggaacctccaaactgttctccatagtggtggtactaatttacatttccaccaacagtgtacaagggttcccttttctccacaagcttgccagcatttattattgcctgtcttttggatataagccattttaactaaagcgagatattttctcattgtagtttcaatttgcatttctttgatgatcaatgatgttgagcacaattttatatgcttgtttgccattttgtatgtatgtcttcttttaagaaatgtatttttgaatcttttgtctattttctgatctgattattagatttttttcctctagagttatttgaactccttatagattctggttattaatctcttctcagatgggtagtctgaaaacatctcccattctgtgggttgtctcttcactttgttgattgtttcctttgctgtacagaagcttttaaacttgatgtgatcccatttgtcaattgttgctttggttgcctgtttttgtggggtattactcaagaaatttttgctcagaccaatgtcctggagattttccccagtgttttcttccagtagtttcatagtttgatggcttagatttaagcctttaatccattttggtttgatttttgtatatgttgagaaataggggtctagtttcattcttctgtgtatggatatccagtttgcccagcactatttcttgaagagaccatcttttccccagtgtatcttcttggcacttttgtcgaaaatgagttcactgtaagtgtatggatttgtttctgtgttctagaatctgttccataggtctatgtgtctatttttatgccagtaccatgctttttttgttactaatggctctttagtataatctgaagtcaagtaatgggattcctcagttttgttcttttgcttaggatagctttggcttttcttggtcttttgtggttccacatcaattttagaattgttttttctatttctctgaagaatgtaattggtattttggtagggattgcattgaatctacagattgctttgggtagtatggacattttaacaatattaattctttcaatccatgaacatggactatcttttcattttttgtgtttcttcttcaatttctttcatcagtgttttataactgctattgtagagatctctcactttggttaaactatttcctaggtatttaattttatctgtggctattataaattggattttttatttctttttctgattgttcactgttagaatatacaaatgctatggatttttgtatgttgattttgtatcctgcaactttactgaatttgtttatcagttctaatagtttctttgtggggtcattaggtttttctaattataacattatattatctgccaacaaggataatttaacttcttcctttcaatttggatgtcctttatgtctttctctggtctgattgctctggtgaggacttccagtgctatgttgaataacatggtgaaagtgaatgtctttcttgtattccagatcttagagaagaggctttcagttttccccattcagtatgatactagctatggatccatcacacatggctattatagtgaggtatgtttcttctacacccagtttttttagaggtatttatcaggaaggtatgttgaattttatcaagtgctttttgaacatcaattgaaatgattatacgcttttgtccttcattcttttggtatgatgcatcacactgattgatttgcatgtgttgaatcatccttgcatccctaggataaattccacttggtcataatgggtggtctttttaatatattgctgaattcagtttgctagcattttgttgaggatttgtactttaatattcatcagagatattagcctgtagtcttctttttttgatgtatcttcatctaattttggtatcagggtaataccggccttatagaatgaatttggaaatattccttcctctgtttatcataatagcatgagtaggattggtattagttcttctttaaaagtctggtagatttcagcagtaaagccatcaggtcccagtcttttctttactggaagattttttattatggcttctatcttttcacttataatgtgagtctgttcaggttatggatttcttcacagttcaatcttagtaggttgcatgtttctaggaatttccccagttcttctaagttttccaatttattggcatatagatgcttataatagccattaatgatcctttgaatttgtgtggtgtcatatgtaatgtctcctttttcatcactgattttattcattttggtttctctttttttttcattagtctggctaaagttttattgaatttatttaacttttcaaaaaaccaacttttgtttcgttgattatttgtattgttttcttcatttcaaattcatttatttctgctctaatctttattatttcttttcttctaataattttgagtttggtttgctcttggctttctagttctttaagatgcattgttagattgtgtattttaaatttttctcttttttgacataggcacttatagctatcaacttctctatttatactgcttttgctgtatcatgtaggttttgctatgttgtgtttccaatattatttgtttcaagaaatttttcagttttcttaattttttctctggtccatcagtcattcaggagcataattgcttaatttccatgtatttgtatagtttccaaaatttctcttgtaactgatttccagttttattttattgtgttcagagaagatgcttaatattattttaatttttttgaatgttttaaggcttgctttgtcacataacataaggttcacctttgagaataatccatgtgctgagggaaaaatgtgtattctgcagctgttgggtgaaatgttctttaaatatttcttagatctatctggtctttagtgcaaactaagtctgatgtttctttgtttattttctgtctggaagatctgtccaatgctgaaagtggggtgttgaagtttccagcaactattgtattggaatctgtctctgtcttctttatttctaataatatttgctttatatatctgggtactccagttttgggtgcatacatgtttaaaattgatatatcctcttgctgaatttatccgtttatcattatatagtgaccttctttgtctcttcgtatagtttttgtcttgaaatctattctgcctgataaaagtatagctatttttgcttttttttttttgggtcccatttgcatggaatattttttttccatcccttcattttcagtctacgtgtgtcattataggtgaagtgtgtttcttgcaggcaacagatcaatgggtcttattttttcatccattcaaccactctatgtcttttgatcagagagtttagtctatttacattcaatgttatacataagaacttactctgaccattttgtgtttgttttctggttgtttcatggtcctctcttctttctttctttttcatcttcattttaatgaaagtggttttttctgatgatatgatttaacttcttcctttttaatttttgtgtatttattgtacattttttgctttaaggttaccatgaggcttcaaatgccatcttataacccattactttaagctgataacaacttaacatgatttgcataaacaaacaaaccagcaaaaagaaaactaataaaaactctacaccttaacttcatcctcctgctttttaactttttgttgtttctatttatatcttactgtactgtctatgtcttgaaaatttgttgtagttattatttttcatgggttcatcatttagtctttctacttaagagtagtttacacaccagtcatagttataatattctgtgcacttactatttccagtgagttttctgccttccagtgattactcattgctttgaacattctattatttctgattgaagtactccctttagcatttcttgcaggacaggtttggtgttgatgaaatccctcagcttttctttgtctaaaaaggcctgtatttcttcttcatgcttgaaggatattttcgctgaatatactattctagggtataaaggtttattattattattattcagcattttaaatatgtcatgccattctttcctggcctgtaatgtttctactgaaaagtatgctgccagacatatgaggtctattgcacattatttgtttcttgtatcttgctgcttttagaatcctttctttatccttgacctttcagagtttattaaatgccttgaggtagacttctttgggttaaatctgcttgatggtctataatcttcttgtactcaaatgttgatatctttctctattggttacttctctgatgtcatccctttgaattaattttctaccctggtctctttctgtctacctcctctttaaggccaacaaactcagatttgcccctttgaggctattttctagattctgcaggcatgcttcggtgttttttattcttttttcttttgtctcctctgactgtgtgttttcaaatactgtcttcaaactcccaaattctttcttctgcttgaccaattctactattaagaaactctgatgcattcttcagtatgccaattgtatttttcagctccagaatttctgcttgattcttcttaattattttgatctctttcttaaacttactggatagacttctgaattccttctctgtgttaccttgaatttctttggatttgctcaaagcagcaattttgaattttctgcctgaaaggtcacatatttctgtttcaccaggattggtccttggtgccttatttagtttatttggtaaggtcctgttttcctggattgtcttgatacttgtagatgtttgtctatatatgggcattgaagagttaggtatttattatagtctttgtagtctgggcttgtttgtactcattcttcttgggaaggctttccagatactctaaaggacttggtgttgtgattcaatctttatctgctttaggagaccccctaggcccaataacactgtagttgttacatactcatagaggtaccaccttgatggtcttggaaaaggcccaagaggattctctagattatcaggcagacactcttgttttcttcccttaccttctcccatgcacacagtgtttctctgttctgagccatttgaagttggggatggagtgacacaagcacccctgtggttaccaccactgtgactgtgctgagtcagacctgaagcacgaacagcactgggtctcatgaagggcctgctgtaaccactccctggctactgcctttttgttcaaggccctggggctctacaatcaatgggcagcaaagccagctaggcctgtgtcctccacttcagggtggtgagtttccccaggccctgggcaggtccaggggtaccgtctggaaatcagggactacagtaaaaatccttacaagtctacttggtgttctattgtactatggctgagctgacactcaaattacaggatgaaattgtttctctcttttctctcctttacaaaagcagaggagcctcacccaatggccactaccaccacaggcccatgaggagtactgccagactactgttgatattccattaaggcctaagggctcttcagtcagcttgtggtaaatgctgccttgcctgggattcacctttcagggtggtgggctctcctctggccaggaaaggtccagaaatgccatccaagagccaagtcctggaatcagggactccaagagtctgcttgttgctctattcccctgtggccgagtgggtactggaggtgcaagacaaagtcctctttactttttactctgcttttctcaagcagaaggagtctcactctatagccaccacagctgggaatgtgctgagtctcacctgaagccagcaatcctcagaggctcacccaaagccctcaacatagtacctaagtatcactggttatcaggacccaagggctcttcatttagcagatgatgaatgtcaccaggactgggtcctttccttcagggtagcgaatttgcttctggtccagagtgcatctagaaatgtcttctgggagctagggcctggaacgggagcctcatgactctgactggtaccctatcatgctgtggctaagctggtatccaagttgcaagacagtctttcctcttctcccctcaaacagaaggaaaatatttcttttgaagcaacgagtatgcaatctggggttgggtgggggggtaatgctggcactcccttagccaccctggctcgtgtctcagtaggatgcatgccttcttctcaagtccactgtctctgggcttatttcgacactaagactctcctaggagttgccatccttgtgtcttaaactgcctttcaagtttatttagtgtctcagagccctttagcctgtggtggccgtagtggtgaagcttgtgggaatgctgggatcagagattctcctccggctagggctggtttaaatgctccctacatggggtaggagaggggtgtggtgttggtgaatcaagattgtttttttctacttcttcagtgcctctttctgaaatttgaggttaaagccaggtactgtgagggttcatttgaattttggttcttatagaggtacatttttgtgttgatagttgttaaattgatgtccatgtgggtggaaagtttagtggagccttctattttaccatcttgctccatctcctcccaccttcatattttattcaactataaactggtattattattctttaaatacattttcccaggtttctattgctgaaatgttcaacatctcacagaaaaattgaaatgctgcaacaaacatgcttataccttttcctagatgaaaattaacaatagttccaaaatattacctgatccttatacatctatctaatttcatctagtatattcaatatccaaatttcctcaactgtcccaaaaaaagaagggggagggtttatagttactttagttgaatcaggatacagagtccatgtattacactgagggatttctttttttttttttttttttttttttggtagtcttcaaaaatcttaaacaggcttctctatgttttctttcttcatggccttccaaaaagttcagaccagttttatagtagaatgtccctaaatggaaaagtttaacagccggttctatgtttttattttagcctcaaggacatatggaggatttgactcttgatgatatctttctttcagaaaattgttaggaggttaccaataccagattcaaataaatgagaattcaagaaagaactgtgtatacaatgtatacatatatgatgtaattcattttctggataatcaagtaacaagaaatcaatattgaaatgacatgaccacactggagaatggatgctaatcatgtattcctgagacaggacaccatcagctatatatgaaagctagagctgatggtttcctagagctgaggctcatgtgacccagctcagcctcatctctggtgaccccacgagacccaaatgcagagctgccccttggaaataacaacagcttcactatattgttgatgtgcatataatttgcttttctgtcctgactctttttttaaggctaagtaaatttggtgctggatgaagcctgttgagtattgtgtgtctgattgttcatctaaatgttagagtattgctgccagtagagcagaatggtcacgtagtaccacattctgtttttgtctaattcctgttcccaccatggtgtcatttaacctatacccctactcataaaatattttgtaaactggaagttacatgtacaggcataatgagattcagattaaataattttggcaaacatgcttagtagatggattttgtctattttactttatattgcatgaaggggcacatagcgtcattagttcctgcactagtttatttaggttgcgatagcaaaatgccataacctaggtggcttataaacaaaagaaatttatttctcacagtctgaaggctgggaaattcagatcaagatgccatcagattcactgtccgatgagagcccactcccttggtcatagatgatgccttcttgctgtgtcctcacatggtggaaggggcaaataacgctcccttgggcctattttataacacgactaatcccactcatgaggactctgccttcatgacctccccaaagacctcaccttctaataccatcaccttaggagataagatttcaacatgtgaattttgtggaacacaaaaattcagaccatagcagtcccagtctagtcataataggtttgattgcctgcctatggtatgggcatttagaaacaaaggtctggtagctcagcatggtcattgttactggagtttcattgctcctattattttttaagcccttgtagtgaacggaggtaggaaatacatgttttcttagtacagtataattttatgttgatattgccaattcaaattattattacagattttttaaacttattttgccttgtgtttgtatcattttttcttttatactaaaaaatcttcgctccgagtagtagtaatatagttatttatttgcttatcataacaatatagataataaagtttcaaaatgccaatactaatagtactactaggggtaaaattacttagtgaggtatttctttaaaagttttattgttgttgtttgtcctcagaatgtattaaactatgtacaatttcaaaagttacttaaaattaatctttggtgatgttatcaattttatatataaatgctccccaacttatgatggtttgatttactacttttcaactttatgagatgcaaaagcaatatgcatttagtacacttcctaacttagaatagggttacatctgagtaagctcatcctcagttgaaaatatcatgtcaaaaatccactttcaatttgggataatttcaattcacaatgggtttatctgtctataaccccaccgtaagttgaggagaaggtgtgcatttgagtcctttgtttctatttgtgttaaattttggtgttcactttggtttattttacatttaattctgcatatgtgaagcacttaatttaaaaccatataaaaaagtcaacagaacatacttttgtgggaatatattccaggaactctcactctcattcttatcccaccacttcattttcatgcttcctttatagataatcattttcattgatttctgttttatctttccttggctttcttttgcaaatatgtataagcaaatatatgtaagcacataagcaaatatatatacatgttatttctctttgtttcttacacacaaaaatagcatattataatattgattgatattttccttaacaatatagcctagatatcagtccacaccagctcataaagatactcctcattcttttctacaaatgcatagtaccccaatgatggaccatcatttagtcccttacttgtgaacatttgggtcatttccaatatattgctatcacaaataacactgcaatgaaaaaatattgcatttatttcatatttgtggaggtgcagctgcaaagtagattcctagacattgagattgcaaaatgaaaggggaattggatgtgtagttttgctagtggtttcttcatcctcttccatagagattaaaccattctgcaatccaatcagtattctattaaagggactattttctatagtctttccaacaaaacatatcttcaagcatgtggatgtctgttaatctgggaagtcaggaatgatatctcagtgtagttttaatttataattatctttttttgagggttatttgcatttctttgtttctgtagagatgagacctcatctacattatgttgtccaggctggtctcaaactccttgcctcaagcaatcctcccaccttggcttcccagagtgctgagattacaagcttgagccaccacaccaagccaattatttgcatttcttttccatgaactatctttatgttttcttcctcacttttatattgggtttttggaccttttcttcttgattgtaaatagccctttatatatgaaggaaattagcccttggagttacaaatattttctattagttggtccttcatcttttgactttccgtatagtagtttagatttttatgctacttttaatacacacaataatatggttatatctcatgcaaacatttgttattttgtggaattaaatttattaattttttattgcttctttatcttatgaaataatttagtagttttacttagcttccagattataaaagaattcaatgtttctttttaccatttgtatgatttattttctctaattcatttagatttcatcattatactgtgcaaagtatgaatacaattttttctttttcaaattctatttagttgctttaacattatttattgcacctcatgtatccccatgatttaagatgccacttttaccataaacaaaatttttaggtggctttgagtctatttataaaattttttatctatttattcctcaatgtcatattgttttaagtatagaggctttagaatatgtttttaatatctgatagcactaatacatgagtagccttggactggacattgcatcattggctcctctggtcctcaggcctctggacttaagacgaattacactaccagcttttttgattctacagtttgcaggtgacatattgtgggacttctcagccttcataattacataagccaattcctataataaatctcctcctatatatctctatataacctactgggtctgtttctctagaaaatcctaatataccatcattgattatattagctttagcattggtttttctaggtttccccactgagtaaaatatcaaattggggtctgatgtatgtgttgagtatccatagatttttattttattaattattttttgttttttcaggaataggtgtttaatttcattcaaagcattttggtgtctatgaagataattaaataattcttctcattattctatttgtatattagatatatttatgtttatatatatgtaatgtgtgtgcatttatatctttgtgacttaaagtgtgtgtgtgcggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacacaaaaactggaaactctaaaacgcagagtgcctcccctcttccaaaggaatgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaattttagaagaatgtataactagaataaccaatacagagaagtgcttaaaggagctgatggagctgaaaaccaaggctcgagaactacgtggagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaatgccacaaagatactcctcgagaagagcaactccaagacacataattgtcagattcaccaaagttgaaatgaaggaaaaaatgttaagggcagccagagagaaaggtcaggctaccctcaaagggaagcccatcagactaacagcggatctcttggcagaaaccctacaagccagaagagagtgggggccaatattcaacattcttaaagaaaagaattttcaacccagaatttcatatccagccaaactaagcttcataagtgaaggagaaataaaattctttacagacaagcaaatgctgagagattttgtcaccaccaggcctgccctaaaagagctcctgaaggaagcactaaacatggaaaggaacaaccggtaccagccgctgcaaaatcatgccaaaatgtaaagaccatcgagactaggaagaaactgcatcaactaacaagcaaaataaccagctaacatcataatgacaggatcaaattcacacataacaatattaactttacatgtaaatggactaaatgctccaattaaaagacacagactggcaaattggataaagagtcaagacccatcagtgtgctgtattcaggaaacccatctcacgtgcagagacccacataggctcaaaataaaaggatggaggaagatctaccaagaaaatggaaaacaaaaaaaggcaggggttgcaatcctagtctctgataaaacagactttaaaccaacaaagatcaaaagagacaaagaaggcccttacataatggtaaagggatcaattcaacgagaagagctaactatcctaaatatatatgcacccaatacaggagcacccagattcataaagcaagtcctgagtgacctacaaagagacttagactcccacacattaataatgggagactttaacaccccactgtcaacattagacagatcaatgagacagaaagtcagcaaggatacccaggaattgaactcagctctgcaccaagcagtcctaatagacatctacagaactctccagcccaaatcaagagaatatacatttttttcagcaccacaccacacctattccaaaattgaccacatacttggaagtaaagctctcctcagcaaatgtaaaagaacagagatgataacaaactatctctcagaccacagtgcaatcaaactagaactcaggattaagaatctcactcaaaaccactcaactacatggaaactgaacaacctgctcctgaatgactactggatacataacgaaatgaaggcagaaataaagatgttctttgaaaccaacgagaacaaagacacaacataccagaatctttgggatgcattcaaagcagtgtgtagagggaaatttacagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaactcttcaaaaaattaatgaatccaggagctggttttctgaaaggatcaacaaaattgatagaccgctagcaagactaataaagaaaaaaagacagaagaatcaaatagacgcaataaaaaatgataaaggggatattaccactgatcccacagaaatacaaactaccatcagagcatactacaaacacctctacacaaataaactagaaaaataaagaagaaatggataaattcctcgacacatacactctcccaagactaaaccaggaagaagttgaatctctgaatagaccaataacaggagctgaaaattgtggcaataatcaatagtttaccaaccaaaaagagtccaggaccagatggattcacagccgaattctatcagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaatgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaagcctttgataaaattcaacaacccttcatgctaaaaactctcaataaattaggtattgatgggacgtatttcaacataataagagctatctatgacaaacccacagccaatatcatactgaatgggcaaaaactggaagcattccctttgaaaactggcacaagacagggatgccctctctcaccactcctattcaacatagtgttggaagttccggccagggcaattaggcaggagaaggaaataaagggtattcaattaggaaaagaggaagtcaaattgtccctgtttgcagacgacatgactgtatatctagaaaaccccattgtctcagcccaaaatctccttaagctgataagcaatttcagcaaagtctcaggatacaaaatcaatgtacaaaaatcacaagcattcttatacaccaacaacagacaaacagagagccaaatcacgagtgaactcccattcacaattgcttcaaagagaataaaatacctaggaatccaccttacaagggatgtgaaggacctcttcaaggagaactacaaaccactgctcgaggaaataaaagaggatacaaacaaatggaagaacattccatgctcatgggtaggaagaatcaatatcatgaaaatggccatactgcccaaggtaatttacagattcaatgccatccccatcaagctaccaatgactttcttcacagaattggaaaaaactactttaaagttcatatggaaccaaaaaagagcccgcatcgccaaggcaatcctaagccaaaagaacaaagctggaggcatcacactacctgacttcaaactatactacaagcctacagtaaccaaaacagcatggtactggtaccaaaacagagatatagatcaatggaacagaacagagccctcagaaataacgccgcatatctacaactatctgatctttgacgaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcagtaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggaaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaatgaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgataaactggattaagaaaatgtggcacatatacaccatggaatactctgcagccataaaaaaggatgagttcatgtcctttgtagggacatggatgaaattggaaatcatcattctcagtaaactatcgcaagaataaaaaaccaaacaccgcatattctcactcataggtgggaattgaacaatgagatcacatggacacaggaagaggaatatcacactctggggactgtggtggggtggggggaggggggagggatagcattgggagatatacctaatgctagatgacgagttagtgggtgcagcgcaccagcatggcacatgtatacatatgtaactaacctgcacattgtgcacatgtaccctaaaacttaaagtataataaaaaaataaaaaaaataaagtgtgtgtgtgtatgactttaattaacttgatcacccacacacacacaaacactgaccaaaattaatatcaagtcaggtctgtctgaatgtaaagccaacagcaaacatccctctctccaaatggaaaagaaacagggggttatgggcagctacactgctaaatgttaaaactttatttttaaatgtggccataaaaatcactaaataaaattgataatatatgtttttgatgaataaattttatatatgtctacactggaaactatatagcaataaaaactaaccatgtacaactaaactcataaatttcataaacataataagtaaaagaagccagacaaaaagtagtgtatactgttaaattccatttatataaaagttcaaaaaagccaaaaagaaactatgctgttaaaagtaaggattatagttactattcagggaagagagtagtggctggaaagaaacataaagggggtctctgaagtggaataatgttctgttttttgatctgggtattagggtgtttaatttcggaaaattattttatctttatacttattgtattattgattttttgcttaacaaattactcaaaacttagaggtttaaaaaaaattaattattgtattaatttctctgggccaggaattggagagagcttagctgggtagttctggttcaaaatttctcatgagattaccgtcaagctgttggagggggctgcatcatctgaaggcttgaccgaggctagaggatctactttcaagatggcccactcacatggctgttggcaagaagtttcagtttctcactagcttctagcaggaggccataatttctcaccacatagatctctctatagggctactcgagtgtcctcacagcaaggtagctggctttcttcagagccaagtgactcaaaggcaaagaggaagtcactatgccatttatgacctagttttggaactcacactttgttccgaattgaccttccatcactttctagtcattaggatttaagtcactaactctgatccatagtcaaggggagtaaaatttggctttattgttggaggatggagtagcaaagaatttgttgacacattttaaaactaccatacttaaacagttcatttttctgaatatgcttcaattagaagttaaaatgatgcaattttaaaacattgtttcaaatgaacactgttagggagagaagtgcttcttctccatatctaatgtttcttccatatttagggagttccattagtttaacactttaagcctctcagcatgcaccacaacccccgcaccaccctagcatattgtctttccttcccaaggggaggcaaagtgatgcatttgatggtcagttgggtatgaataatctgggcctgcttaacttcgctcctccttttccccctttgaaagttatcatccctcttggaatacttgcttctcggtaggattttgtaatttggggagttttatctcaagactcaacatttgtacatatgctttccatactgagaaaatttggtgtagaatttgtaaataaacgtaatatgtcaagaagcttctcatagggtttgaattcatgaaccatggactttgtgtgagtagcacacacccccttttttggttggtaaaatattatattatgccaagaagtttttttaacattatgtggttggcatttaactgttatggcatgatgttggcagttgactgctgctatggccatattgtacacaggcaagtggctatttcatagaagcaggactgtacatgtgggcaactgcactcaaataatttttgggctgtgcacgtctcagctatagcatggcagtgggaagactggggatgtgtaaagaggtatacttcaaatttcaggagaggtatgtgccgctagaccattctaagcctaatggtggaggctttataatgtaggctgctgcatcttactttgcaagcatacctgaagcaaagattcaagtctaggaaaaagacaatccttccacattcgacaatggaagacagaacaatattagttgctttaaaggcaagactgctgagtcctacatacactgtagaacactggggaaataacagttgtagattgttagagacagtctctagataaccagcactcaatctgctgccccaaattccactctgaatttaggaccaaggaggaacccatggaaagactttctttgtctattttgtgttgctataatagaataccacagactgggtaatttttacagaggagaaatttatttcttacagttctggaggctgggaactccaaggttaagaagcccactctggcaagggctttcttgctgtgtcatctcatggcagagggtgaaagggcaagacaacatgcacatgtgagagtggatgtaagaggggtctgaacttgctttataacaagcccactctcacaataacaaacactcctgcaataatgacactcattcatgagagcagagtcctatggtattgtgaaatatatatttgatctttggccctgcttcctggaatataagttttaaaatccttagaaactccaaaatgatgtctttttgtatgctaaagagttgactggtggctgggagcccctaggtaactttaggatggaggctggtcattgaaaagaccaagcaggactagaaggctgggactttcagctcaccctcagcctccaggaagaagagaggggctgaaagttatcgccaatagccagtgatttaataatcatgcttatgtagtgaaactttcataaaaaccccaaaagactgggttcagagaggttctagatagctgaacatgtacattcctacaggaaggtaaataagaactcatctacatgctgggaaggtggtgcgccccaacaccaccaggatagaagcttctgtgcttgtgactcttccagatcttaccctatgtataacttcatctggctgtttacttgtatcctttacaatatcctttgcaataatctggtaagtgtgagtgttttccttagttctgtgagctgctctagcaaattaattgaacctgaggaggggattgtgtaaaccctaatttatagccagttggtcagaagcatagacaaaataacctaaggcttgcaactggcatcagaagtaagcagggagggggtgggcccaagtaagcagggagggggtgggccttgggaactgactcctcaacttttagaaactgatgctatctccaggtagatagtgtcaaaattgaattagaggacagccagctggtgtctgctgcagaattaattgcttacttattggtaggggaaaacctccacacatttgttcacagaggtcttctgtgttgattgttgttgtagagtgaggaatagaaaagtcattttgagtttgagtgagcttttccacacacagccgtcataacctaatcacccctgaaaggtcccacttctcaactttgttgcattggggattaagttgctagcacatgaacttttgggaacacattcaaattatagcaatgactaaccttgaatttgtgaggtttgtacacaggttcaagagtggaaaatatttaagaattactgggtgtgtttcaaggtgatcctgttattgtaggtagcatgcaggtgctttaaagaaatgtgcccaagaaaatttatggaattcaacagcacaggaaaaaaaaggtactagggagaataaattagttttcatggaacacccaaaagtcagtggttcttggtctcagctctatattatactcactaattaattcaaaatgtctaggggtgcaatccagggattgtattgatatatttccttgggataaaacatgaaaagtgcctagccttgagcctgacagatagctgacatctactaaataaattgattcctgtatcaatttcctcttccacataccatggtctttcattttccattgaggactggcttaattacataaggaattttaattatctttccaccttttttttttcacaagaacagataatccaacattgcaatgtaacccatcagcctaagaaaagtcttattaaatggccatttttctttgagacttagtgatctaataatttcaactgcgtttccttcttttcgcctcccctgagtgaatatcgtaagcttcccagatctttaactagcaccaacattacaatttgaccataaagatatagaataattacatatgagagtaagctgggtagtaagaaaaataaaatttctgcttccatttttcaaatatatggtgtttccaagatatttttagatcttttatggctggatgcttcccaggaaagaaagttggctcttccatcagaaaatcattcattttatctaaggatttttagatctttagatcttttgaaagtgctttccaaagccaaaaattctgaatccctgagggatacttagcgaggattaaaaaaaaggtattggggagtcagccagcatcacacagatccaggcccacagcctgtcttagaagccacagttccagcttctagacccatgagactcccttgttctcaattcaaccagtactggtcacatcctattactcattacacacatttgatacatattttatttctgagtacttactgggcttagtttgcttgacttgcttgtttctatattaaatattttttggttattaagaaaagcccaattgccagttattatggctttcagttataaacttcctaataatttcttgcttgtttataacattccagataattttcatctctattttgccatgaaccctaacctgtttcccaaaagcatgatttatgcagagaacaacatgttctattggaatcacttgaaatagtgttacaaattactcttggagatactgtgagccaggtgcaatgttgtgtttgccttagttagttgtcgctcttggcgctgccacaactgatgctcacattgtattaagtagacatgacttatttgggggtcaccttgccagcaaagctgacagagctatcactccacttgtcttgatgcatgctgtttcacattaggacgattctaaattacattccttttcatttactgtctgtcattttatgcggctctgttcctggcccactgtcccttctctgtcttttttattccactatttatatgacaactggatatcagccttggaaagagattctgagcagaagatttatccttctgggaggtgttcttgtcaaaacccatttcaaaaactcagagctttgaagatgaagttgttgatgggcctaaactttctctgaagtgtaaagaagcttcataatcaaaaacaaagtttggtaagtgtatacttaaatactaagtgtaattatttttacaataataatgatgttatagctactaacacagaatgctaactctactatatgttctaaacaatttgcatgtattgtcttatttaatctcacagcagtcctatagagatttcttttatccttggtcttcagacgaggcacagataaattaagtaacatgcccaacatcactcagcacctagatgttacagccattattttgaaccctgacaaatctgactccagattcaacagctcttaatcacctcccattgtaatagagaagattaaaatagtaactaaataaactctcatgaaaaaggacatgatattctaatctcatctcttagaattaagtcaattggtggtaaatcacaggtcttaccaacttgtatttatggatgtggcaattttattttcttttaagatacatggactattccttatcattttatccaataaacattggttgggcaaacatctgccagttaccatactgtgcatggataggtcacaaagtaaaaaaaaaaaaaaaaaaaaaaagacacatttctgaccacaagttgttcccaatcagataaaagaggcagaatggaaataaatccgaaataatatagtgggagtaatgttaggaagggagtgtacacaaaatataaggatgggtgaaaggagaccactttatttggattcatggtaacatgtcaacatactctaatgttcaagtattatcctcagcaattcagctactcaaaaaggatctaaaaccctgctttttagccaaatcaacttttccccaagagatggagaatggtattatggcttggatgtaagctgtggagctagggtagtgagatgggttcccttgaccccatggggcttgtgaagcgctggctcgcttactcagcctgcagtgctcaaaccccttgaaagagggggaagatgtaggtgagtgggtgcaggagctggggtgagtgcctttgggcaccagcaggaataaactccttaccagcccacagcagcgtctaggggctgtccacagcctctagagccccagagggcatgtgttacagtgtgctgttttagctttgctgtctacagacaacttaagtgttaaacagctcagtggagagtcagtgtgacagcctactgcacccgcaactgggtccttgtccagtgcccaagaggaatgaggtcacacggacttgaaggatggtgaatgtgaagattttattgagtggtaaatgtggctgacagcaggatggggaactgaaaaggggatagaatgtgcaggcagtcttcccctggagctcagccaaactcctctcctttcacagtttctgatgtccagcagcttcttctcttcttgatgttcagatgcttctctcttccgtgtgtgtatgagctgagtttggggtctggagttcttatcggcacaggatgggggcatgctgggccaaaaggcaacattcaggtgggaaaacagggaagtaaagttctcatttagggctgtggggcccagctttagggtggaacccttgccagggactccaccctcttctacccagtattttccagcctcctgtccatatcagtagcagagtttgaatcctggcactactaattttgagcaacttacttaacctcactgcatttcaattttcttatctgtaaaatgagcataagtttaataatagaattattgtaagaactgaatgagttaatatgcatgaattctttagaatagtgccaaacatataataagtactatgctacatgtattagttattgtaattataagtaaaatatctatattcaatggaatatctttataaaataaaaatggataccattctgcaaatgtactacgatgttaataatatatacttattgagctgctaatatattctaggtaccatgctaggctctggggtaaaagtttaattcagcagatcaggagtacctagggagtttataataaaatgcagacaacaaaaagctagccaaatatattaggataagtgatattttaatataatatgctatgaaaaacataaataaataaaaaaattaattttatcctgaatggattcagaaaagcttcatacagtaggggacatcagagctagaccttgaaggaatccaacaacataaatatgaaagtcattctgggcatagggagcaacatggcaaagatgtgaagggataagaataggaagttgaaggctcacggggtgcatatggaggagggtctgcagaagagcagggcgtattagtccattttcacactgctgataaagacatacttaagactgggaaatttacaaaagaaagaggtttaatggacttacagttccacatggctggggaggcctcacaatcatggtggaaggcaaggaggagcaagtaacatcttacacagatggtggtaagcaaagagagagcttgtgcagggaactcctgtttttaaagccatcagatcttgtgagactcattcactatcataagaacagagcaggaaagactcgcccctataattcaatcatctcccaccaggttcctcccatgatcacaggggaattgtgggagttaaaattcaagatgagatttgagtggggacatagccaaaccatatcactctgcccctggcccctcccaaatctcatgtcctcacatttcaaaaccaaccatgcctccccaacagtcccccaaagtcttaactcatttcagcattaactgaaaagtcaacagtccaacatctcatctgaagcaaagcaaatgccttgcgcctatgagcctgtcaacttagttactttctagacacaatggggatacaggcattgggtaaatacagccattccaaatgaaagaaattggccaaaacaaagggctacaggccctaggcaagtccaaaatccatcagagcagtcaaagcttaaagctccaacatgatctcctttgactccatgtcttgcatgtgggtcatgctgatgcaaaaggtgggttcccatggtcgtgcgcagctccacctctgtggctttgcagggtacagcctctttccaggctgctttcatggggtggtgttgagtgtctgcagcttttccaggcacatgatacaagctgtcagtggatctaccattctggggtctggaggatggtggccctctcctcacagctccactaggtgatgccccagtagggactctgtgtgtgggttccaaccccatattttccttcctcactgtcctagcagaggttctccaatgagagtgctgcccctgcagcaaacttctgcttggacatccagctatttccatacatcctctgaaatctaggcagaggctcccaaacctcaattcttgatttctgtgcacctgcaggcttaatgtcatgtggaagctgtcaaggtttggggcttacaccttctgaagtcacaacctgagctgtactttggccccttttagtcatagctggagcggctgggatgcagggcaccaaacacagcatgggaaccctgggcctggtccacaaaaccattttttcttcctaggtctacaggcctgtgatgagaggcgctgccatgaagacctctgatatgccctggagacattttccccattgtcttggtgattaacattcagatccttgttacttatgcaaattcctgcagccagctttaatttctcctcagaaaatgggattttattttctatcacattgttaggctgcaaattttctgaacttttatgctctgcttctgttataaaactgaatgcctttaagagcactcaaatcacttttgaatgcattgctgctcggaaatttcttccaccagataccctaaatcatttctctcaagttcaaagttccacaaatctctaggacaagagcaaaatgccaccagtctctttgctaaaacataacaagagtcacctttgctccagttcccaacaagttcctcatctccatctgagaccacctcagcctggaccttattgctcatatcactatcagcatttttgtcaaagctattcaacaagtctctaggaagttccaaaattccccacatttttctgtcttcttctgagccctcgaaactgttccaacctctgcctgttatccagttccaaagttgcttccacattacacatttttatatatcttttcagcaatgccccattctcctgatagcaatttattgtattagtccattttcatgctgctgataaagacatacctgagactgggaagaaaaacagttttaatgaacttacagttccacatggctggagaggcctcacaatcatggtggaaggcaagaaggagcaagtcatgtcttacatggatggcagtggggcaaacagagagcttgtgcagggaaactcccatttttaaaaccatcagatctcatgagactcattcactatcatgagaacagcacaggaaagacccacccccataattcaaccacctctcactcccataattcaatcacctcccactaggttcctcccatgacacgcaggaattgtgggagttacaattcaagatgagatttgggtggggacacagccaaaccatatcacagggaaaggtggagttggtgcttatgaaggacctggtagtcagtagaggagtaaccttgagagagagtaatataacacgataacatctgcattagatggatcactcctgtagcaccatgggaaatggatataaagaaggaaaaaaatgtagaaaacccatcacaagatcattgcaatgatccttcctcaggatggattgggagagagaagataggatggaagtgacaggaaagcagagcagtggacagatttgagaagcatttgccaagctttaatatacatattgtatatctaaattagtacaattgtacagtcttaagcataagataattcctacatttctgtgaaatgaaagcagcatttccatctacactgaattattaatttgatgagagtttacttttattttgttcttgctatattccttaagtaatttaatcaaatttaatatatttttaaatattgtggcttgaccttggaaacctgaaggtaaagaatgagcctattcttaaatctgagtttaatgtccttcaggagagtaaaaatttctctcataattgccttcagtacaaaaacaattaagttaaagcctaggtgaactatcataagcaaataaatgttgacatttaaaaatacagcagaaaaccaaacacatttaagaagttagtacatgcagagattctagtaatggtagggaacttacttaaatatcttttcaataacatttattatttgaagatgaggaaactgagtgacttgcaaaggatacaaaaccggcaaggagtcagagcctgatctaggaccgactccaatccaattcactttttaacacggatttcactgtctcccgacaaggatattttgttattcacatgtgtgattctctaaagcaggatctctcaatcacagcagtattgacattttagactaaataattctttgttgtgggcatgtacctgtacattgtagaaagtttagcagcattcctggcctccacccactagatactagtaacatccccctgctacccattgtagcaaccaaaatgtctccagacattgacaaatatcccctgagaggcaaaatgaccccctccagtaaagaacaactgttctaagtcctctagacccctaaaatattgtgaacttggagctaaaatagaaagaatcccaaaaactctcatataattttaaatctcagttacactttctgcaattttcatatccttttctcaaaaagttcagaatctgtttgcctactctctaactctcaatttgctattacagtcttgttaaaagaaaaatcactgacaagttaaatttaacagagcttaattgaggaaagaataattcactggagtcagagagactccagcgcagccaggtggtagaagatttatggacacaaagggaagtaatgtacagaaaatggaagtgaggtacagaaacagctggattgcttacagttctgtgtttgccttacttgaaccgagtttgaatagttggctgcctttaattggccaaaactgagtgactggcacaagagtaggttatggttggtttacacacccagttaggttacagttcactgtgcacagagaaacctttaggtaaaacttagactctgtaagaaggcatctttgggctaaacttaatctaacagtcttttctttctgtctgctctcagcccagtccttgccattctcagctctgcttcgggtcagaggaaactacattttccagggccacttgttttctggtttctaggtggcctcagtcaatggaagtctgagagaagactgaagtgggcgggagagaagccagggcacttctctctgtcctctctctcttcttctgataatgagtgctacgtctccatggctcctgttcctgttagtctttctctggaatccaagccatggttcatcttctacaacgtggccctggatcctgggctctggtaacattatctctgtttctccagtcctaagggtagtagtaactcctactgttgctaatctctggtttactttgcctcctaattgtcctcttactttttccatcacctctgtaagcagttactatggattgaattgtttccccctaaaattcgtatgttgaagcccccattgtggctgtatttggagtaagaaagtaattaatgttaaataaggtcataagggtggaaccctggactgataggattattgtctttataagaagacaaaacagagtgtacactctctctctctctctttttaccttgtgaagacacagcaagaagtagttcaactgcaagccaggaagacagcccttaccaggaactgaataggccagcaccccgatccttgacttctcagactccagaactctgagaaaaaaaattctgttatttaagctacctagtcaggtgtattttgttatgacagtccaagctaatataggagttcattgtttgaaatagctgacgtttttccatcaaccctgactaatacaagttctttatatcattgataccatataatatttgttgatcctgtaatatgtagccaacattatgcaaaagacatgttaatattcattttctcatctatcccaataacaccgtaacatatgacaaaatggtatgaagtaaaaaacatggattttgagttacttagactgcatcacaactcctccacttactagctgcatgacctacgaaaagttaaatctctctaggccctgctttccttatctgtaaattggtctagtaatagtatcaaactaagaaggttgttctgaattaaatgagttactctatgtaaagtacttagaatatatgtaggcatacagtacactctcaataaatctattatttttagctgcaatttgttaagtgcctattttatgccaagcacagcaataggtactggagaaataaagacaaataaaaaactatcaatgccttcaaagagtttgaggatgctaacagaggcaaacacatgaatgggtaattataataaaatatggcaagtttattgataaatttattatgggaaagctaacatgatcaacagtcagggattgggacacatttgacagggtttgattcccagttctgccaattactaattgactctgagcaagatatctatctcctctgagcctcaatgttcttacctgtgaaatgggaatgataatagtacctacctcataaggatatagtgattaaaaatgagataataaaagcacagatttgggtattgttcctggaagttgacatgtactcaaagaaggatagctttttttttttttttttttttgagatggagtcttgctctgtcgcccaggctggagtgcagtggtgcaatctcagctcattgcaagctccgcctcccgggttcaagcgattctcctgtctcagcctcctgagcagctgggactacaggtgcccaccaccacgcctggctaattttttgtatttttagtagagacggggtttcaccatgttagccaggatggtctcgatctcctgacctcgtgatccatccgcctcagccttccaaagtgctgggattacaggcgtgagccacctcacccagccactatttttatcattaatacggaagcatagaataagggtgcctaacccagcccaaagctcccccaagtttcctactgcttggcagccactctaatctgcttgacaagaactgctcttaatgtttctcctcctcagaagatgagactgagtctcttatacttttccagtatcagcataaattaggacaagaactttagaaaggctgggcgtggcagctcaccctgtaatcccagcactttgggaggccgaggcgggcggatcatgagttcaggagattgagaccaccctggctaacacggtgaaaccccatctctactaaaaaatacaaaaaattagccaggtgtggtggtgggcgcctgtagtcccagctactcgggaggctgaggcaggagaagggcgtgaacctgggaagtggaggttgcagtgagcagagatcctgccactgcactccaccctgggccacagagcgagactccatctcaaaaaaaaaaaaaaaagaaaaatttagaaaatttcttgacagaatctattaaagctaaacatatgtatgcaaagcagttccactcctgcatatatagccagaaatgagtacatatatgttccaaatgacatataaaagaatgtttatagaagctttactcataattgtgacaaactgaatgcaaactatatacccatcaacagaagaatggatatatacactgcgatatattcatatgcaatgaaatgctacatagcaactagaataaactacagctacatgcaacaaatagatgaatctcacactcaagatgttgagtcaaagaagccagggtgcacactttattattccatttagagaaaattcatgaacaggcaaaacgagtctatgtcacagaagtcagaaaagtggttaccttggggaggagccaagatgtccgaataggaacagctccggtctacagctcccagcgtgagcgacacagaagacgggtgatttctgcatttccatctgaggtaccgggttcatctcactagggagtgccagacagtgggcgcaggtcagtgggtgcgcgcaccgtgcgcgagccgaagcagggcgaggcattgcctcacttgggaagcacaaggggtcagggagttccctttccgagtcaaagaaaggggtgacggacgcacctggaaaatcaggtcactcccacccgaatattgcgcttttcggaccggcttaaaaaaacggcgcaccacgagattatatccggcacctggctgggagggtcctaccctcacggagtctcgatgattgctagcacagcagtctgagatcaaactgcaaggcggcaacgaggctgggggaggggcgcccgccattgcccaggcttgcttaggtaaacaaagcagccaggaagctcaaactgggtggagcccaccacagctcaaggaggcctgcctgcctctgtaggctccacctctgggggcagggcacagacaaacaaaaagacagcagtaacctctgcagacttaaatgtccctatctgacagctttgaagagagcagtggttctcccagcacgcagctggagatctgagaacgggcagactgcttcctcaagtgggtccctgacccctgacccccgagcagcctaactgggaggcaccccccagcaggggcacactgacaactcacacggcagggtattccaacagacctgcagctgagggtcctgtctgttagaaggaaaactaacaaacagaaaggacatccacaccaaaaacccatctgcacatcaccatcatcaaagaccaaaagtagataaaaccacaaagatggggataaaacagaacagaaaaactggaaactctaaaacgcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaattttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcaggctaccctcaaagggaagcccatcagactaacagcggatctcttggcagaaaccctacaagccagaagagagtgggggccaatattcaacattcttaaagaaaagaattttcaacccagaatttcatatccagccaaactaagcttcataagtgaaggagaaataaaattctttacagacaagcaaatgctgagagattttgtcaccaccaggcctgccctaaaagagctcctgaaggaagcactaaacatggaaaggaacaaccggtaccagccgctgcaaaatcatgccaaaatgtaaagaccatcgagactaggaagaaactgcatcaactaacaagcaaaataaccagctaacatcataatgacaggatcaaattcacacataacaatattaactttacatgtaaatggactaaatgctccaattaaaagacacagactggcaaattggatagagtcaagacccatcagtgtgctgtattcaggaaacccatctcacatgcagagacccacacaggctcaaaataaaaggatggaggaagatctaccaagaaaatggaaaacaaaaaaaggcaggggttgcaatccaagtctctgataaaacagactttaaaccaacaaagatcaaaagagacaaagaaggcccttacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcagcaaggatacccaggaattgaactcagctctgcaccaagcagtcctaatagacatctaaagaactctccatcccaaatcaacagaatatacatttttttcagcaccacaccacacctattccaaaattgaccacatacttggaagtaaagctctcctcagcaaatgtaaaagaacagagatgataacaaactatctctcagaccacagtgcaatcaaactagaactcaggattaagaatctcactcaaaaccactcaactacatggaaactgaacaacctgctcctgaatgactactggatacataacgaaatgaaggcagaaatgaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaatatcacaattaaaagaactagaaaagcaagagcaaacacattcaaaagctagcagaaagcaagaaataactaaaatcagagcagaactgaaggaaatagagacacaaaaaacccttcaaaaaattaatgaatccaggagctggttttttgaaaggatcaacaaaattgatagactgctagcaagactaataaagaaaaaaagagagaagaatcaaatagacacaataaaaaatgataaaggggtatcaccaccaatcccacagaaatacaaactatcatcagagaatactacaaacacctctatgcaaataaactagaaaatctagaagaaatggataaattcctcgacacatacactctcccaagactaaaccaggaagaagttgaatctctgaatagaccaataacaggagctgaaaattgtggcaataatcaatagtttaccaaccaaaaagagtccaggaccagatggattcacagccgaattctaccagaggtacaaggaggaactggtaccattccttctgaaactattccaatcaatagaaaaagagggagtcctccctaactcattttatgaggccagcatcattctgataccaaagccgggcagagacacaaccaaaaaagagaattttagaccaatatccttgacgaacattgttgcaaaaatcctcaataaaatactggcaaaacgaatccagcagcacatcaaaaagcttatccaccatgatcaagtgggcttcatccctgggatgcaaggctggtttaatatacgcaaatcaataaatgtaatccagcatataaacagagccaaagacaaaaaccacatgattatctcaatagatgcagaaaaagactttgacaaaattcaacaacccttcatgataaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagtgtattcaattaggaaaagaggaagtcaaattgtccctgtttgcagacgacatgactgtatatctagaaaaccccattgtctcagcccaaaatctccttaagttgataagcaacttcagcaaagtctcaggatacaaaatcaatgtacaaaaatcacaagcattcttatacaccaacaacagacaaacagagagccaaatcatgagtgaactcccattcacaattgcttcaaagaaaataaaatacctaggaatccaccttacaagggatgtgaaggacctcttcaaggagaactacaaaccactgctcgaggaaataaaaaaggatacaaacaaatggaagaacattccatgctcatgggtaggaagaatcaatatcatgaaaatggccatactgcccaaggtaatttacagattcaatgccatccccatcaagctaccaatgactttcttcacagaattggaaaaaactactttaaagttcatatggaaccaaaaaagagcccgcatcgccaaggcaatcctaagccaaaagaacaaagctggaggcatcacactacctgacttcaaactatactacaagcctacagtaaccaaaacagcatggtactggtaccaaaacagagatatagatcaatggaacagaacagagccctcagaaataacgccgcatatctacaactatctgatctttgacgaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcagtaccattcaggacataggcatgggcaaggacttcatgtccaaaacaccaaaagcaatggcaacaaaagacaaaattgacaaatgggatctaattagactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaatgaagacatttacgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgataaactggattaagaaaatgtggcacatatacaccatggaatactatgcagccataaaaaaggatgagttcatgtcctttgtagggacatggatgaaattggaaatcatcattctcagtaaactattgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaaaaagaaaagtggttacctttagggaaatatttacagagagggcagtatattggtaaatgtttatcaaccagctctccagaaaagaaagaaaagaaaagaaagaaaagccctgaatttacagcatttgttagtttctatggcataaatactccgagcatggtagatttcaaggtaccaatctcatgttactgaacacaaagttgggaagaactttgtgtacaaaacttttgtgtatatgtgtacaatctgcttagcaagtctgtgtgagccaaatacaccccaccactgagaggtggcatgaaggagcattctggtgtgctagaaatattctgtatcttcttttttttttttttggagatgggggtctcactttattattcaggctggtctcaaactcctggggtcaagagaccctactgtctcagcttcccaagtagctgagcttacaggcatgagccactgtgcccaactctgatcttagtccttacacagatgtacatatattaaaagagctatactttaagaattatcgactatattgtatgtatgttatacttctatacaaagcaaaaatgttaaatatttctgagaactagaaagaaaaaaaagttacaactgttgtgtctgagaggaagatccagatgggtaccagagaagcaatggctgggtgctgggcactcagacctttttgttcatacaatagatatgcagcaaaagagagacatactattagtagctttgacataaatagaaaagagatggtgactcttttacctggatcattgtcaattattttaacattagacttgattcagtcttatcaccaatggttgatacatcatataaaagagtgtcgtttctgaaaagccccagatccactgtcttaactatctatggccctgtcaccttagagatgattattccactgggtggctccagaagaacattttaagcactgtagcacctgaatacaatgatcagacatagaaaagcaccaacgtaaacagttacttttattttgagtaaaaatacacattcatatcattttcccttatatccctcaaatcttaaatgtgttcaatatgtctagaagatatctgtggtctagctagccgagacattttaaaaagacagctgctcctgacttatatagcacttacatatttaaatttacaaagccaaagcaacattttaaaggggtttgactgacgataggttgatgcatccacagattcatttgttcccgatctggcaatacaggaccatagaaaacaccaaacccagtatctagagaacaaaataacaggattaacatggaatttaagggaaaacactggacacattataaataaacagaaagaacattatatatgaaaagattttgtatattgacagttccaatcttatctaactcatctctcttgggaaattagaggttccaatgggacaaaagagcactgcaaaagctctcttgagttttttttgtgttttaatcagcttttttagctggccaatcagcctctatctaactggccccatataaactgcacagtagcagctgccaccagaggacctactcccttttctggaacacacacattcttctgcagagcgtctcctctggagcactggggatctcaggtccctgggggctaaatatacgtaatgcttccataaaaaggttatgatcatctggtttaaatcatctgcataaaaatcaagaagtctagaatttctcttgctgtagttttaggcatttccaagaggaataaaaaatgaagtaactctttttttaaaaaagcttctaaactatggggaacagcttaattcaggaatttcttttgaagtgaaaaagcacagctgaaaatctggggcataatttccatctcaagtagctctcccaagaatgagggaccccaaaatttgctctaattggctctacagttggtgacttgcatgctgtatctttgacgtagaaatgatagacaggacctgtgtgcattaccaatagaaagtttcctcccccaccagccccttttgaagggaggatggaggaaggcaaagtgacatttatgctgagtcaacttaaatgcttctactgtgttgagactttctgcttactaacactttcctggaaatgtaattcaaatgagaactgctaaccaatctttcttccttcttaaaaaggttgacaccaattctctgcaaaagtaataatttccattcaaaatgtgctacaattgaagactgaaatttagtctttttgtcttgatcctgagccttaagtctgtgggacaagtatcaagaaagaatttttttaatggggaaaaaataatgggataagacaactatcatctttcactgctacatccttgaaatagaagccgtcaatttatcagcagactagatagttaatatcacactttcttgtatttcattgtccctgaaaagaacatttatgattgttcaaaaaaaagcacataattaaaagagatttgtcattttataatgtacgccaagactcatgataaatttgctaagaggtatgcagcagtctaaaaaaatgtaaaattatcatttttcttttaactgctttatttctaggacctcctgttgggataacttttatcctacaaagtgatggctctcagtgtgtagcacttttttttttttaattaaagcaaggaaagtgctgatcatcttttgtgcttgtaagttgttatagtcaaatgaggagagtatgatagtctggctgttttaagctagagtaatgagaattccaaaaatgtctatagataaatttttcttgcagaataaggtattctgcacaatctttagcatccaatgtgagaagaatcccttaggtatatagtcttaacatagctttgaaaacaaatattggcccacctcactaaaacctatgcctaaacatactaacataaggtctaaatatggggcggtctttttttatatgatatttttctgtggagataatctgaacatattttctgcaggaagacatttgcttctgttttcttaaaagtattttttagaggagattttctgtttctgtatctttgtgtttttttgaatttgaactttggaaacaaagaagggagataggcctaagtcatagggcaataggaaacttgtactaatgactgtaagatgagctataaaatgctttgtttttggatacataatttatagactgggtgtcagaagacttttccaatctactttttgaataaaggaagatggaatataaaatgatttgtttcccttaaaaagagggagggcaggttatagactgaggaactgaacaattttaaaaagttcaaacaattatttgaaccaactatttaccatatctgcagagagtctagaaatcacaattaatttgacttctcgaattcaaaaacggttctgttttatgatagtaacgcaaaaacttcatacctataaattactgtatagaatgtttgtattaagctatttttctctgaatatgtctttagaagaacaaataaaatatttaaacatgtaattaatacatggaatataacaatttcataaaatactgaaatacattaatctttttgtaatcttattttccactagatgtatttaaattcttgaaaatgcctttgactatgacacaaaggatttcatcaacctccccaatcaagtatgtccttactttttctggttttgctaactgaggagcatctgtgatttgagctagtgatagtcaattgtcagaacttgagtctaacatgaaatataactcttatattaaatatctcatttaaagcatgctctctcattcacttaaatcattcatgtaaaatcactcttgattcatttaaatcattcatttcttactcatcttcatggccattagtccttatttctaaattagcataaacccagaatacaaagcagagaaataaaatacatcttacaaaatgcagaatcaagagaaatagacctaatccatagcaccatttgactctgaacatatatcagacctaaagaaagacagccataacctaccaacaaagaatgcttcatatttatacctattcatctggactacaagaaagtaataacccacagtttaatttgctgctaatagtccctaacctttctctaatagctgcctgggaaattccaccagcaaactaaataaccacttaggacactaaattgcttcattcccagttaaaatttctttctggcagtgatgtggcacgagtaagaggtagaaaattaccagaaagcccaaggagtaccttgcacagcattccatgagtgtgaagcacaaggcactcagctgagctaaccagctctcacaggcattaaccagggagacacttcacattcttgctaatgccctggaataggattgtgagtgaatttgatctacttgatattaaaattacccaagatctgggatgattccaaaatgcttctctgaagcagttttaattcattttcttggcaaagatttttaggccatgtgaaaagtatctttcaggttttttttttttttaaaaaaaaaacatgccaagaaagttcatcaagacaaaaatcctatgtgggatatttttccaacatcaataattaaagtgatgaaagtaatacataagcctcaattttccttgaaaatttctccaagtgagtcaatagtacttaagctgaggaaatcagagacaattacctctactttttagaacttcttggatttctctagaatgtaataagtaacaaagaaagagctcctcacactcttgagttcagtttttattttctgtttcaaaatcaagatgagaaataagaaattgtaaaggtcgtattttgctttgtttggtgctttttcttctaactttggaaaactgtaacccctgtgctagttttcagtgggaaaaatatacctggcactaagaactatgtgaaaattaattctatctttttcccggtagagaggtcattcagaagcaagaatctcaaccctgctcacttcataagactggaatctccccctcagactcaggctgatcgagggagatgatgggcctttagcatccagtgcttttctaaagcatctgcgttttttatggttgttgtggtttttttttttctgtttgtttgttcaccatcaatatttcttgaaattaatgaacaagcaagggaataaaagagtcaataatacaagattatactgtacctcaataactgccagtccaaatgatattccaataactataatcaaattttttgccaagaagtcttttatgaaagaaatacaggtctgttaaaaaaaaaaaacattaaaagttacctctcagaaaaattcgaccttatattaatcaaaatttttattaatctggttgactttttacattgctatcaagaaacacacttaacgacaaggaactgggttattccttccactccctgcttcacctttgctccaaaaggttgtaactgttgtggtttgtttatacattgaaaagcaattgaggaacaaaattttgcttgactgcctaattgttgaatctagggattaataattacaaataataatttttcaccaacatatcctcaaatgacagattttataatttatactataaattttatagctgataaagctatatattttacaacataaaagtataaatcataattttatcttaactttattcattttagagctgataccaccttgactaaggattttttaggtttgtaatctaaaacagaaaggtttctggttgagattttagataataatattgtaaattttcatttttaaaacaaggtattttctttttttctttctttctttttttttttttttctttgagacagggtctccctccagcgctgaagctggagtgcagaggcgcaatcttggctcactgcagccttgacttcctgggctcaagtgatcctcccacctaatcctcccaagtagctgagactgcaggcatgtgccaccatgcctggctaatttttgttgtgttttgtaaagacatggttttgccatattgcccaggcttgtcttgaactcccgggctcaagcaatccaccggcctcagcctctgaaaatgctgggataacaggcttgaagtcactgctgccggaaaaaacaacatattttcaaaatcccttaatatttatcagggttatttttatcttaaaaagaaaaaacttactatgtctaccactatgccattactttagataaaaaagagaaattaggaagttgcctctctgctacatttttgaaatgtatacaatccaggatgcattttcatgcttaaaacattttggactagacctaataacttcaagaattgtaaattatgtgaagaattttttaaatggaaaaagactacacagtataattgtgttatttttgtactgccctgaaatatattatccctttgatggtcatatatgtgcaaagggctaacaaagtattgctatttgttaaataaaataaaatttctccagaaggctaagtcatctttccccttcattcctgaatgtattgagtttcttcattcacatttaacccaacgtggtaaacattcaaggaaattattatgtcatttaggttaacaatgagattaatgattatatctactgagtcacattcattatgtttcaggggtttttctcttcctctttgcctaagataatgagggtatcttggcaaaaggaagaggaaaaaaaagaaatgtgaattatggccattccatattttttattttaccagacttcttgcaaatgacacatggcagatggaagtattttatgaatttacaaccttccttttgggaaactggtgtagctatcagcctatattcagctgaattatgtgtgaacttacagaaactatctaatagtttttttagaataattccaggggcttttcagaatctgtcttgaggaaaaacatctttcagttgaatttgaacaggagacaaatagcaatctgcaattgaatttacttatttcctcattatcctaagtggaaactatttttatttactctatatttatttccccttttccttgtaaatactgtgtcactaacattaggtagggaggaggggagcagggagaatataaaaagtaagaatcaaactttttttagtaatattactttgacaatgaaaaacgcaatataacctgtagtctggtagattatttattgagttactttaaatcttagcgacatactttaagtattaatgacagcaattccccttcagggcagagcctctttaattttgataagatcagtgaaaaagatcagtagtcaaggaaagggtagtttcccctgagatactttctatttccttttataaattattttcagtagcagttactaaaccaaaacatttctagattgaaaagaatcttcgggtattatagatattaatattaattcattgtgatttatagtggtttttaatgtatctgcctctcaactagattgtaatctcctagaggatccagaagcatgtctgatcctagcaagggtctgtctgacatgtagtaggcactgaagaataacagtaaataaatgaaatactaatatcaattgtaatttttgtacacatttcttctaagcagaacgaacaacttatgaagggacagatgtcatgttcttcatgaagccatatcctgaaccccacagactaagtgagatggggtcccataacaccttgcacccatctctatccaagagatactagtagaccattggattgaagttgcctaactatctttctctcttccttacttgagcatcagctccatgagcgcagacattgtgctctgttcaggaatgaattcccggtgactggtagaaagcttggcgcataggaggtggtcagtaagtatttgatgaactgatcaataagaagaactaggacatccatgtattgacattcacaagtcacataaatatgacatctacaacacataaaagattaacctatctttttcaattgacattaaatgttcaaggtaacttctcaattgcagcaataactaggtaaattggtagctgtcagtaacatagagaacctaaacccttaaatgtatttgggaaggacttggagtcctttctttaaattttgggaaagaagaaacctcatttcttgagaaaaggaaatttgattagaaaacaaaaaacattgaaaattgtagtgaaaatattgttttctagaacttatgttaaagtaggaaaaaataaaagagaataatgattaagatgaccaaagagaggataaaataaacttttatgttagtttgtactttgcctcccattgcagtagaatgtttctttgacctattaatattgggcttaaatgatgccagactcatagaagaaatgaagtctatctgcttttatctttaaataaggatttttttaatttgggaaatttctgagatttttatatcatgattcccatggtactccatgcattttaattttttgtagggactttaattgtgaaaagaaagtaacagaattgcttattgtaccaaatgtgatttagttctcacctctttgtaaacttgttttccattatagctttggcatggtctctgcttatctagacaggcacataattcaggatagtgttgaaaattatttccccaatcagcagctccattgaccaaaccgcagcatttaaactgtttgataaaaggtagaatgagaagcagtcagtaagaagattaaaaacattggcaatacattaaattataatcttctgaaatcattattaaaggttattatgctaaaataccatgtaagtcacctttcacctttctctgtgtagaagtaaaaattaaggatttttgcattttgatctttacattaatgatggaaaaatggagttgcagactcaaaaatctgaagaagttgggaagatgaaaaactcacctactaggttttttatttttatttttttgagatggagtcttgctctgtcaccaggctggagtgcagtgacgcgatctcggctcactgcaacctccaactccctggttcaagggattctcctacctcagcctcccgagtagctgggattacaggcatgctgcaccaccacgcccagctaatttttgtatttttagcagagaccgcgttttaccatgttggccaggattgtctcaatctcctgacctcgtgatctgtccacctcagcctcccaaagtgctgggattccaggcataagccacggtgcccagcctcacctactagtttttaatgacaaaagagagtcagatctctgtaatttagatattgtcaaaaaagtttccaaagaattcacaagagagtcaaagaattgttgctcaaaagagacatgaagttttaaaagtgaaatttccactccatgatctctgatcacttttgaaagacaggaggaaaaaaatgagagatattgcaaagacccaaatagatgctcaaggagcctcccataagattgaattttatgaacatctttaaaatatgggagggaacacaaatgaagaatgaagctcttagaatgtcaggaaagttacagtcccagaataaactgatccatggaaaacactaaaaaagagggtttgcagccacatttgaggaagaaaaacaaggaaatgataaccccaagaatcagggcatgtggcacatgatattattagatgggagaaagaaagataattatccctcatgttgcttccatctgctcaattaaggggaaaacacttcgtgcagaaatgggaggaaaaaaaaatggctgagaaaaacagaaccaagactgagtggttttcccagctctgatacattgcaatgccaagatattgaaagaattttcacttactgggcaggtaatcattaaatttatttattacattaataataaatgtgtaataaaatcatttattacacattagtttaacctctgtgccaaagtttgttcatctgtaaaatacagatagtaacagttgctaataatagcatttaatttgcagatttatcataaagataaacataagaaaatccatgtaaagataagaactcccaggttgaagaaagcactcaataatgcatttgcttttattgtttttgttttcattgtttgctgttggtgttgtttctgtcatgctctcacaggaacatgatctgttcagcattgttatcaatgatttgaataaatagaaaaaaatatctttccaattctgtagtttctgtagagctaggaatgacaattaatatgctggagatcagagtcaaatttcaaagatagttcaaataacagagataaactaacaaattcaactgaggcagatacgaagtcttgtacttatgtccaaagactgagttacacaaaaacattactcaacagatgtttatatgacaaagagctggaaatttcagtttgtttcaaggtcagtactagcaaggagggtgctcttgaaacaacctcctttcctgttcccatggtagacatgattaattgtttattctttctgattacataatcttgagtagtattcactgatacagataccctctgtcaaatgtaaattaaattccactataaaatttatattctcatttacagatcggttcatatttggaatattgtagacctcaggactccttagggaggcataaagtcatactcatagatgagagggtagaagttaggaaggttaaaacttgtcacgatatcaagtcactacatcagagataagagcagttaaagaagaagctggtcaggacttgttgacagtggtgtaacagctggatgaaaaaggcagtaggcactaatgatacaacgcctctagacaaataataatgagcaagaatccgaaaggggtgcattccatcagtatgttaacagggaatttgtgcgggaaatccctgaaatccaaagagaaagccactcagcatctgtagcttttgtcaatgtgttatgggactccaggtcatccagccagagtttgtggtggtaggattcttttcccaaagaagcataacttataaaagaaagcatagtggagatggaggaggaggataaggatgaggaggaggaggaggaagaagaaggaggaggaggaggaggaggaggaggtaagaagaggaggaggagaaggaagaagaagaagaaggaggagggggagggggaggtggcacagggaagaggagaaggaggaggaggaagaaggaggagaaagaagaagaagaaggaggaggaggaggaggagaaggggggacaagaagggagagcaggaggaaaacaagaggaggaggaagaaaaagaatcagcagaagaagcaggagaaaaaagaagaaggggaggcggaggagaagaaaaggaagaaggaggaggagaaggaggagaaggggaaggagaaggaaagaaggagaagaaggaggagaagaagaagactcataatggaaatttgaagaaatatagtcctaggaacacaaggaacttcaggcacaggatttctttacaagagcaagagcacttcaggagaacatgctacaacaaacagcacatttagaaacccaggattggcatggagaccttgaatccagggatacgtgcagcagatgttactaggacccaaaccagaggctcagtgattacctctagtctattttgtcctaggtcatcaccctgggaagggtctgggatgctcagccccacccagcagaggtactgaggctgcataaattcttccttctttaagcctgttttaagctgggctctagagtaagaatgatcccggaaagaagagagtcaaaggatgcagctacaggggagctaggaaaagcacatcagaaaggaagttaaacagggactgacccatatcaggtttcagctttcggaaatgatgctttaagcacaatttttacaagctggcatctacccaaataggaactagtgaatgctctgagggagaaaaaaaaaagtcacctgataaaaagtttgagaaaccaaggatgtttccacttgaaaagcaaggattttaggagtcgaacaatagccattctcaaagaaaaatctatcatatataaaagcatcaataattttttttcctctgaaactctggaaaaactagtactaaataatgtaaatcctagggaggcagattttgtttcaaattaagaaataacatactaatcatcagacttgcatataagcaggatgggcaaaaattagtaaactttcacctctttaatatttcatttgagggtagatgaccataaatataaaatatgtttatcagtgagaagtcagattaagtgacctataaaattcaagcctctcctaagattctgtgaatttccatgacatgcatatattcagaaggaaaaagtagtaagagcactccaaggatggaaactgatgcaaaggcaggaaggcagttgttcaagggaccctgagtacacaaacctggctggactagagtttactctttagagagtagtacttagtaaagttaaaatattaggtaggatccagagagtagaagaccttcaatgcctacccatattttgactttaaagaaaaaaggaggggatagtatactgatttaaaaaataacagactggtcagacagatctgggttcaaattccaacccatcacttggtagctgttagacctccctaaaacccaatatccttatctgtaaaatagggttaatgaggataatgatattacccatccacagggttgttgtgggtattaaatgagctactggatataacacctgctacatagtagcaattaatgttagctattaccatttttatgagacagagaagtggtggaggctgagaaagaaaaaaagagaggtggatgtggttgctcacgcttgcaatcccagcaatttgggaggccaaggcaggaggatcacttgaggtcaggaatttgagaccagtctaggcaacatagtaagacccctctctctacaaaaatgataattttttaaaaggtagccaggcatggtggtgtgtgcttgtggtcctaactactcaggaacctgaggtgggaagatctcttgagccctggtggtcaaaattgcagtgagctatgattatactactgcactccaggctgagtgacacagcaagaccttgtcctcaaaataattaattattttttaaaaagaagagagagaggccatgtgcggtggctcacctctgtaatcccagcactttgggaggctaaggcgggtggatcacctgaggtcaggagttcaagaccaaccttaccaacatggtgagactctgtctctactaaaaatacaaaaaatgagccgggcgtggtggcgcatgtctgtagtctcagctactcaggaggctgagacaggagaatcagttgaacccgggaggcagaggttgcagcgagccaagattgcaccactgcactccagcctgggtgacagagcaagactctgtccccccccaaaaaaaagggggagagagagagaaagagaggagattcccagacacactacccttttaaatggtaaatggaaaatattaaaactattattgatttgactcattcgaggcttaacctgtcataaatgtatcttcttaatttctctccttcaaaactgcttcagaactttgtatgaagcgagaaagtaattacaaatatcttagatttttcttattgcatggtgacagaataatcaatcaaaatctgcaaaatggagacatttttcaatctttaaggaagatgttaaaaactaaacaaacacagaagaactatgtccaactctttaaaatgaacaatgaattctaattacctcttcttgaaacacaattatggcttcctggaattgtttttcactttcccctgtggcgctcaaaagctttgtgttttcatagagagtttcattcacaatgcgatcagactgaaaattgaaaagtattttacattattcacgccacaaggtagtatttcaatttttcaaacttcttcaaaattttcaaacatctgtgcacacaccttagatttgaaaacagctcctaggatacctgtcgccacctgcaggagcaggatcagaagcaagcctatgaaaaactgaagaagagaaaaagaaatatacattatcctcagtgcattcagtaacatctggggacattctggcacagcacttctctctacagctgggattatatcacagtgagagtgtcagtcacactcttcatttattccactttttacttcaagctgaaaattttgggttcattactactcagaaaattgctccagagactgatcgaggaaagtggttcaggcaaaaaaattatcaaaacaaccattgatatctgtatgatattgactagagggaagtttgaaaacttagatgagtttatttgagtattattttactccttccctttcttcatcaaacacaacctcacacaaactcagaattggctttgaaacagcatctccactacattcagaatcacctggcatcttgttacatatatagattcctgaaatcggcttcagatatgctgaatcataagtttgaaggatgcagcccaaagacaattagctttttttttaaacaagctccttgagtaattaaattcttcaattgcaaatgaggccttattgttcaaaaagcaatcagtaggaatgttattagagtccctttaaaactctgtctctaccgtccctcacaataaacaaacagttttgaacatttttctcaggtactgatataatccttactttattagaggaataagtttagattagacctgataaacttttatgtcatatttgtatctgataaacacttgatttttttctaatatttttactatatccattttctactgtatatgttaaaagtgaatgcctgtgaattatccaaacccaatttatcctcctcaatgctctctaagagataattctgattatctcattcatttaaactttttttttagcatggcatgtagaacacctatgattttaccacaacccacacttggattcatcttccatcatttactggaaacagttttgccggtctcctgccatacccaaggcttctcagttcccaaacacaccagcactgtactgccacgttgtctttccggaaagcttttcctaccctcactcatacaaataccttattcacttctgccctggtttgaaaatcccatcccctgtcttgccctttgcttctggggccactcccactgtagctatttgcttacttattaaccttccctagtaggttctaaaggtcttatgtattatttcgcacaatatctgacacatagaggtatggcagtaatgttgaatgagtgaatgaatgaatggatgaatgattaaaatttgtctcctctcagagtatcctccagtttctaagccaaactaagccaaatctaagccatatcagcttccacaatcaaaccttctaaagagaagttggagttagagtttcatcaatcatggcacgttcttttaacagacaatagggatgggagagaatcctctggagtctgaaggttggacactgggatttgtttggagaactcaccaacagaagcatgcagcgactttcttttatagcaccgcagcatcccaggaagcccagaatcatgatgatggcacctacagcaatcaatatgtccacagcaacgtaggagctagagcctacatcttcagaaccaaaaatctgaagtaaaaaagagattaatggcagaaaatttatttccttgaagtttattttgctcattcaacaaatatccattgagtgcctcctatgtgtcaagtcctgtgccaggaccctgaaatacatcagtgatcttaaaaagtacaaatccttgccctcatggagctcacattctattgaagtgcttatatttttctaaaatgatatgatgaaagctgggtggaagaaatgtaataggtttttttaaaccgtatttttaaaagcttaggacagttacttttactcttcttgatgtaatctttggttcacatattttgtgtattctatataaagtgcattataaaagcatgtgttgttatggtttttaattctttaaaaagttcaagctctttaaactattgatagacacaacaatatgaattaatttcagagtcattatgctgagctaaagaagccatagaaaaaagtaaatactgtatgattccatttctataaagttcaatcataagcaaaactatggttataaaaatcaaagcagtgcttgactttgagcaaggcagaagggaaagcaagagttaactgaaaagggacatgagggaacttccatgggttaataaaaatgctttgtatcctcattaaaaagaaatccagttcctgatatttcatatctattttatctctttgttcccaaaagccatagtccatagagtcatctagaaactctattttgactgttagttaatgagatatgaagggaaaaaaaatcctagagccctttatagtgggtgggctacccatcaggcataattcagttctcccaacaacacacacatactcgtcttcatcaccctcataacacttagcctcagccacctcttgtcctcgataagtggatttatccagaagtaaatcacaattaaaaagtaaagccttgtgcgtgtcttatgcataaatcctatatgtagcccatttgccttctataacctctatctactgggctgtctctagatagagcactagttcctagactaactcgaaacctctgcctcccagaatgggctatatagcatgtaggtcagctcccttaacagtcaatacaaaaatgactgctatgttctaatgatatttttgtttctcaaggctttttaaatctacttattgcctagaggaaacttttattcaacagtcaataggaaggaatgtgctgaagttataaaagcattaaaacaaacatctatattttgtcagggtcctaataaataagtttgtaatcctggaacagtcacccaacctagtgggctccagtttccccatttataaaagggaattgggtcaacctctgtgatagccaaggcctcctttgtctctaaaagtctatgcttacagataatgtttcaatttacgtattttgaaagcttggttaagtcctaaagatttttgtttgttggtttttattgttttctcattaatattagagctaaaaaatcagttttgttaataaacaggcaggacattggaatcaaaataaatgtgacaaaaatagaagtgttaggaaactagctctatggacttcctgctaaatattgcttcactagaatattgtggccagtacaggcaaaccctatgagaggatggaagcctcgctagctgggttatcagaacttagaaaagatatgccagacatacaaataatagttcaaatatctacacatgaggccaagatagtgtgaccagcacttgtgcagcaggtagtgagacacttctatgaggctaacctgggcagggtgacccactgccagagactagccagaaagcagtgtgttgactgtctagtggtcattgttccaagtccagcccaacaagtggttattcttattcaagaatgaagtggaaatctgagttcagatgtttgcaccaggggaggaacagcagggtttgaaaagctgtcttgaatgaacactgtgtccctgtgtgtcttaggacaaggggagaatttctaaagacagagaaattcagctggtcctgaaagatgaggactcaggaatcctctttggatcagaagggacctcctgggacaaggatggctgctcatgtgcttttcctcatggtgctaagtttatcctgaggtagaaaaaagggtcttcatgagacacttcagcagaaagttctgtcatttccctgacatccttcttttctgtgtttatgctcatgtttttccttccaaaacagctacctctgttttttcactaacaaaaaattcagctctttgctctgtcttgattctttgtcactggcttgagaaaaatataaaccaagccaattttatataagtcaagctggttaatgttgtcctggcagacactggcttttgttcagtgtgagaggctgatgaagcgtgagtcaaaacgtaactaaagatgctgtctagctctattaattcattcttatccccagatgtggaggagcaccctctcaaggacaacagttcccctttaatacattcaatatgtgcaattttttaacagactaaacaccaaatttgtttaccagaagcactgggagggaaagaaaataccaacaggaagtaaaattaaaataaaataaattgcaggctacacacacatcttgaagaggccacagcaccctgtaagtaggtgactgttaatctctgtgcttaattatgagtcccaaagtcagacttcagattctacaggatggtaattctgcacatcttcaaatgcacttcttgggctcacacaccagagctccaggccatcaggaagtcacagttatggttatcagtagaaaacaataagtgaaatcctgatggactaggatgttactaaaaagctgccacacccatctcccacccaatttcttcaccatggtgaggcacagaatgtggaagccgctaattgccactgtgatcctctgggctccctaagggcagaaagcaattttaaaaggaaaagaacaacaggagagagagagaggaaaaaaacaaaaaaaaaaaaaacagagatagagtgagaaagaaattttcagaaaagccacccactgcagcgaagaaaacagagcagacattaattcccttttcatcttcctttccactaggctgtgttcaaaggcatttagctgcaccatggtgaaatacgttttagtagaaaatgcattgtcttaattgctggcttaataaatctctcagtaattatcaacttggaatcaaaattcttctcagagaggagaaactctctttatgtgggcaaataccttaaaaaggctctagcagtagaagaggtgatcctttagtggcaagagcccagaaaacaaagaacaaattaatggctctgaatgtgttagaataataatttgtggggatggagccccagaatagaagaagggagagaaaagaataaaagcacgggagccaggaaatggtgccagggtggtattatgttccgtaaaactgacagaacaatccccgcacactcgcccctccctcttcccccaaccctttccacatttgtgatactgtggcatggaacagataccacacgtatggggtccaatagctggagccagaattaaccatacgaaatacacttcctccagacctgtagatctgggtaagagctttggcactgggcacggaatggtgtgtgggggaggaaaatgggtcatgttcatcttatacatatagcaataatctggacatccccagagaattactgagtttcaccaagttagattagccactactggcaagtggttaccttcactgccagttgccacaggtaaataacaagtacccttgtaccttgttgcctttaaaatacagattcaaattattcttctccaagaaaacttctcattttctttccttttggaccaaccacattgggatcaactaaattattgtcaaaaccttctactataaaaattattcttcttggtgagaaggagaggtggcctatatcctcaatataggccttaaacaaatagtaaaggaggaaaatttccactttggccccttcccacctgcatctcactgaatttttttgaatttttgaataacacctcctccattctctagaaagatttttccacatctagcacagtgccagccacatagtaattttaattgattgaactgaattataaaatcacataacagcacaagtgattacatgaagcagttaagaaaaatgttttagacatgtttattactattattgttataactttcattattataaatgaaataaactacattggggaaagggtgacttgtttttgcatacttactgcttgagagtcattgcttactcgtacccatattgctaatgctaggatcaagataccacatagctgcagaaaaaaacaaacaaacaaaaagaatacaattaggatcatatgaaactctatttccacaccctcctatctatccggtgacagtagttcatcatcgactatactatcacaacctggaagacataaatgaggcatattcatatacagatcattgttgaaatgttaaattgcaatgtgtaagtttgatgagaataattctatttctcatccacaactcactcacagctctatggacaagaagttatttccattaggcctggaaagattatttttccatgtaactctagccctgtgtttctgctagattttagcatacaaaagaaaagtcacaacagtttaaagataaaatatccttatcatgcctctgggcttgtttgtgagaagctatgttggaccaggaaaaaagggaatgacggaatagtcaccattcatttaagattcgacaggaagggagatgttgggatagagggggaaaaagtaaaacatacgacaagatgtgcagttaagcaacaaggctatataataatcaacactttttgaacccaaataaactctcttaaaaacaagctcttttaggtggtaaagtttactcacagagaaggaacaatgaaagacagaacttgaagtcttaaattcctttaatgattttaccagattatttaatttggaccaatgccaacacaataaaatgtaaaacacattttactttagtgtaaggaaaactcttgtcattcagggtttaaaaaaaaaagttatgcattgtggcttcaaaaacaaaaatcaaagatctattattagatagagatgttaagagctgtgtctggtaacataccagacacagcaggccttgggggacttagtagacaattctgaccttgctgtgctctgacagacaaatgtccttggagcatcattgctttcgtgcatggttgagacatacgcctagaaccccaagacagcacttttaatggcttctcattgagtttgcaggggaaatagagtcaagggctctgttaaggaataggaagcacaatgagtagttgagtaaccatagactctgtgctccctaaaagaccttgaaaatcatctaggtctaaacctctcattttgaatggagaaattggaatcctgggcgctaattattacatcatgaaaacccggagcaattcctaaccaatctgcccttacaacatacttcagctcctacaaaataactaatgcaattaaaaaccaaagctctttaaccaccaaataacctatgcaattatctcatacacacacatagacacacacacaccataaaatacaaatgattaaaaaacacagctttcgtgtttgaaaactttccttacttctctaaccctgagatttatagcatcctttcacaaaattctaatttcatttgcaaacaaagacaaatgctcattttagcagtcctttgttaaacagtttgtgagtgataatttatgtcaaatgataatgagaccctctgggattttcagtaatttcataccaactgaattttttgtttgttgtttagtttgttcactgattatcttctttcgttttcttctcttttcacaagcagattcataatgattggcttaatagtcattctggccttcatctgtaactaatgaaccttgtagctattatgagtagcattctttcctgatatttgttaaactatcaacgaaaaaactttaagaattcttagtaagagcttagtaagaactcagtgtgatattttttaaaactttttttgttcgtgtatcactattcactttttcaaggtatttagatatcagatcattcataaatcttattaaatcaatcatatctgcccctcagatagcaacttttagtcttctcagccactgaaaattttctgtaacattaacatttaaaagaaagagtaaccagttgtttcagaagtcaaaaatattttgcccaactaatcttcagaattagacaatctttctcaggaactttgaagttggccaaagtatcatttccacccctaactcttatcttttcttcaaacttcattttaaaaatgaaacaaatgtttagagtatatcattctcatttgagtggagaaattcccatgtaaatatcagtctaatatcatgaaattattcgtaactttgttgaatgactttgaaagtcaatttattttctatcaagaatgaccatcctagagtcatgaataatactaaactatttcatcccattgttaaaagattgaccatcataatggtacttggagccctttaccaagtttagcttttagagcttttcccctaatgtttttatactattttaaacaattaaaagtataaattaataaataaatgcctgctctctactttcgttaataacattgtaaaagtaaaatgggttagtatggtggttccaggaccctgtggaactgactaggcctacctttcccctgcttctggtctctctttgagaattgttctggttttcattcagctttcatggaacagccatcattttatggaatttggatgcaattggtctggaccagcatcctaagaaattaggcaattttgatatttgcttataatggactgaattgtgtctccacaaaattcatatgttgaagccctaacctccaatgtatctgtttttgatgataggcttttagaagataattaagattaaatgaggtcatgaagatggggttataatctgatagaactggtgaccttataggagataaatctttctttctctactcatacccagggaaaggacatgtgagaacatgagaagatggccacagaaagagggtcctcaccggaaactcagttggctggcaccttaatcttagccttcctagcctccagaactataagaaaattaatttctgttgtttaagccacccagtctacagtatcttgttatgagagcccaagcagatgactaagaacaggcagatgctgaagaccataaaatatcaggaaaaaaaagggggcgggggaagataccatccagaagaaagataaatggtagaatgttgatttgtccttttctttgataatgtgtctccaatcatccctacttcttccctccaaattgtacccttttatttggtgtttattgaagtatgtttggagaatgctgaaaatgctgtgttaggaggaggagtggattttgaactacatcattattggtcccaaaatggacaccttttaggtaagcttaagaaactcttcttgtgctgctcctgagaggataaaaaagaataagaaaatatgcaagtggataactacaagatttgtttttatgataaacacagaacactagaggcgactccatgattatagggaacaaggattccgaaagccctaacatactaggactgtactgctgctgctactgttattgttcattttcaagtttcttttactaaacatttatttaaaagtcttagttcaattgtattgtggtaagagaatgcagactgtaggattgttacttgtgagtttttttgcatttccttcatcaatttctaaagattcagagatactagaaaagacaacaaagtctcaagagggtacaaagtttattagaaatttagtaaatatactttattcattaaatcatttagatcccctgtatccatgttttttcttttccttcctgagttatcaaaaactgagaggcaggttaagttgtgttaagctgaattaatggagtttgcatttactattctgtatctctaacagtgttccctccatataatccaataaatgctatttagtgtaatcagtcttgggctttagcgcagagtaaatgttactaaattgctattttctattacatctctttccaaatatccttccaatctacatttgagataataaaaaatataactatttagacatgtgacttctttatttccagacctaaaatggttagccatttaaccatgattttcccatgcttcaattatccatttttacttataccttaatcattttggatatgtttcagtaaattttacagtgtgaatacctgaagatctctttctctcttattcatttgtgaaaggctctgaatactcagcagacattgtttcattgtcttctgactttcagggttacaataggagaagaatatcaccagccttattttcgttcatgcattatttgcttgttttcttttttgtcagttgtatctagacatttgtaagatgtttatttatcttttaactaagttagtagttttcttaacatttatttaggcatagatgtcttctttcactggggtagatcaggcacttgccatctgcatacaggtatgttttcagctccacaaaatttccatatattaatttgattattatttgtgttccatttattttgtcctctttttcaggagtacagcttattttgggtttccattctctgttgtctgtatctattatcttctttcacaatattctgatttcttatttgattttcctgtgggaaagcttatcagtttgggattctatgtcactgtctttatttaatgtgatctctacagtgaagtttaattctgctattatgtttgtagtttacttgcagtccttacatattttatccatttccctttttatctcatcccgttgttttccaataaattttattttctcttatggcctccattcactgtttcatgagaggttactttctagcatcacattgtggataccaatttctacatacattttttcaggattctagaatatttatttcagggatgtgtgcttgtcctctaagtcttcagggtggcaatatctttcacttgttcaacagtattttttattaggtcttatgctaaatttccttgaaaaagatgagaccaattctgatttagagttcattcagagtagaatgtgctgaggcaggtggatcacctaaggtcaggagttcaagaccagtttggccaacatggtgaaaccttgtctctactaaaaataccaaaaaaattagccgagtgtggtggcacgtgcctgtaatcccagctactcaggaggctgaggcaggagaattgcttgaacccggcaggtggaggttgcagtgagctaagatcacgccattgcactccagcctgggcaacaagagcaaaactcttgtctcaaaaaaaaaaaaaaaaagagtagaatgtgcattccctttacaagcatggcctgatgtagttctgatctactaagcctcatgcgatattggattttctgatgctgtaaaccagcagagtaaattaaaatcttcaacttttagcagactctgcaatcatggtttttaaaaaatcttcagccccatattgttgcaggaagtcagggaccccaaacagagggactggctggagccgcggcagcggaacataaattgtgaagatttcatggacatttatcacttcctaaataatactcttataatttcttacacctgtcttactttaatctcttaatcctgttatcttcgtaagctgaggatgtacgtcacctcaggaccctgtgataattgtgttaactgtataaattgattgtaaaacatgtgcgtttgaacaatatgaaatcagtgcaccttgcaaaagaacaaaataacagtgattttagggaacaagggaagacaaccataaggtctgactgcctgtggggtcgagcaaaaagagccatatttttcttcttgcagagagcctataaacggacatgcaagtagggaagatattgctaaattcttttcctagaaaggaatattgatattaatactatggggaaagaattgcattcctgcagggaggtctataaacagcttctccgggagtgtctgtcttatgtggttgagataaggactgaaatacgccctggtctcctgcagtaccctcaggcttactaggattgggaaactccaccctggtaaatttggggtcagaccggttctctgctttcaaaccctgttttctgttgtttaagatgtttatcaagacaacacatgcaccgctgaacacagacccttatcagtaattctgcttttgccctttgccttatgatctttgcttttgccctttgccttgtgatcttttttggacccttatcaggagtttctgatttcgtccttgtcctgtttcctcagaagcatgtgatctttgttctcctttttgccctttgaagtatgtgatcttgtgacctactccctgttcttgtaccccttccccttttgaaatccttaataaaacttgctggctttatggctcaggtgggcatcacggtcctactgatatgtaatgtcacccccggcagcccagctgtaaaattcttctctttgtactgtttctctttatttctcagccagctgacacttatggaaaatagaacctacgttgaaatactgggggcacgttcccccaatactatattaatggtgtttattgtattgagtgttgacatggtttagctgtgtcctcacccaaatttcatcttgaattgtatctcccatgggacccagtgggagataactgaatcatgcgggtggttcccccatactgttcttgtggtagtgaataattctcatgagatctgatggttttataaggagaaacccctttcacttggctcccactctctcttgcctgccaccatgtaagatgggactttcatcttccaccatgattgtgaggcctccccagccacatagaactgtgagtctattaaacctctttttatttataaattaccagtctcaggtatgtctttatcagcagtgtgaaaacagactgatacaagtgttaagtgtacactcaatgtgtctccatgattgcattcacgtgcatcttatttttttttttttttgagatggagtctcactctatcacccaggctggagtgcagtggcgcgatcttggctcactacaagctccgcctcccgggttcatgccattctcctgcctcagcctcctgagtagctaggactacaggtgtcagccaccacgcccagctaattttttgtatttttagtagagatggggtttcaccgtgttagccgggatggtctcgatctcctgaccttgtgatccacccaccttggcctcccaaagtgctgggattacaggcatgagccaccgcgcctggtctcatgtgcatcttctaacaagcactcaatataactgctgcaaattctaatttttaaataactctaaatttagggaaaataaatcaaccacattgttttccttacacaaatagggcctcagtaaccactaaaagcctacattcaaaacatgtagagagagatgaatgtttggcatttaatctgtatcctgatgtttctgaatcaaaaaatgacacaaattcagtaatattcttaccatattgtttcaaaagtataacgttcatataagtaacagttgtagacctgtgcatccatttgaaaagcctgggaaaaatacaaatgacagcccacaagccacagggcattatatcaggaagttataactcaaggtaatatgcacagacaacatgtatcctatattcctaccttgacaaatgtgcccacttaatcacctggaggaaaaggtttgatttagaattctcagggcatttgagcagggaaatttgggtcctatattcaaagtggaagccagccttggggctgacatatccctctactcctgcatatgcctcaccctgtgagatgagaagaggatcagagtagggctaaaattatatttaccatttgaaagcccattatgtataaaatactgtcacagtatattctaatagttgtaaatgaaaaagcaattacgatgtttggaatcaggaaaaacatgttaattgtgctattattgatggtcagtccttggttacaggttttcataaaatagcttagttaatgtttcaaattaatcctgccaggtaaagtgatcatttttattttacaaatccaaagactggagcatgcaaaagccaagggacatgttccagaacaagaaggggtagattcaggattgaaatctcagtcagtctgtttacaaaatccactttttccccattcccttaattcatgatagaagaatttctgccttatcatattcttgctatcttatttcctcttcgttttaaaactcaacatttaaatttattcatcactatgccaaatagttacatatttctgcttcataaaaacacctataaaatactggttgaaatgtctttttcttaaacatttatctagttaattcctacttctttatatatattaacttatttaatcatcaccacaaacccatgaggtagatactactactatccccatttttacagatgaggacaaataaagcacagagaggttaaccaatttccccaaagaagcacagctactgatgaaggagctgatgtttatcctgctctatcaaccagtggactctaatgccttttggtgctgttttagctccatgctaattacatagggtcaggcaaccactgtatttacaaaattcatacacttcagccattgttaggtcttcattttgaaagattccatcaacggacacaataagatataattgtgtcctattccttttagtgtaccaccatctcagggttatgtctgctttgcctccaatcttttaattgctctcagcacatccaatctcaataaaatacaatgatgaatatcgaaatgctggatcctggactctctccaagttcagacttctttctgcgctcttcaaacctcgtcatgcactggcttccttcagttactaatacattcagctttacaatttggctcctccctatgactcatttgggattgatagtgtacctcattcttctttccctcattaagaactggcctctctatagctctctgtctctggtcattattctactgcatccacgagccaaaggccccatgtttcatacttactcagacccctaaagcaccataagcatctacgatattcctaggcttgaactatctgagaggagcattaaaaaattggggcatttcatctatttttgaaacaagactagggaaataggtttcgtacctataatttatctattatctgcagcacctccagttctctaacttgcatcaaactctagcatgagtgatcaggaataactttcacttttacatgtttttcttcaattagtgattctaacaaatggaaatcaccatatacttatggggcatatctcaagttgtcccccaaaagaacctggtctgtttagattaaatgaccacatgcatatctaagagatattttaacatcggctctactttgcaaaggctcagttttgcaagttataccagaaagaatgcatttgaaaacataaggccctgggcatctataagaaaaccacatcagtggggtcattaaaatttttacttaagtaaacattaggaatgtgacaaattgctaatttcctatgaaggattgtaaaattccaactgagagctcagagctgagcatagacgggagagtagatataggaacctttcctaacctcagagattcctcctgctgcctatatttgaatttaaaatattgatgtcacctcttggctaagaagttatcactggtttttataattgttgctctcactgaaagactccatttcaaaatctcttatgtagagattgtaaatccgaccacatatgctggtggtaggaatcaccaaggcacgttagttagaaagatctaactgaaaactacagcatcagaaagacttgtctctgttatcaaagaaacaaacagataatgtaaccataaaataatcagagctctggccaggcgcggtgcctcatccctgtaatcccagcactttaggaggcagaagtagatggatcacctgaggtcaggagtttgagaccagcctggccaacatggcaaaaccctgtctccactaaaaatacaaaaagttagctgggcatggtggtgcgtgcctgtaatcccagctactcgggaggctgaggcaggagaatcgctagaacctgggaagcagaggctgcagtgacccgagatcatgccgctgtattccagcctgggcaacagagcgagactctgtctcaaaataataataataataataataataataataataataataataatcagagctcgccaggaaagcaatgataatatctgggtgtggcatggtacagacctctacaatctaccctgaaccctatcaaggtaggtaggtaaataatcctgaatctataacctaccccttcctagactattattttgataatttagatctattccaaatttctgattagctgtttaatgaaacactgacctctgatgtcttcataatagctattagcactttccaggatgttttaatacaacaaagatatattttaactgtttcattatttgaagattgctactggtttcagtgctttggaacatctttaataaaataggagccttgcatttattagcatattaatattttggtttgtttaaatgtgccatatatattctgtattacataaggaaaacaatgactatagctctttaaagacagatatcagaacttggtggagaaatggctgattcgaggtctggacaggaaataagcaagtgatctggaacatgtcaaaccaaatactaaagaggctatcaaagttattaggatcatttcaaaagaacttgagtcaccttgaagaagctcctgatggccagagatggaacaaattgcacattaataagggtaaacattgtaatggagctgatctattgtttcataaggatacttaaagaaatactaacttatcactgttggataatattagtaacttaactcatcacttgcaatctggtaagtaaagagtgagaaagaagtattttatgccacttaaaaaatattaaaaatgggatacccaggtaattaaacagtaaatgagaagtttctccttatagaaagtgttccagctaataaagaaagaaaagttgatgaaactagaatatcatcactttgaaccacttaatgaactaatgatggattttggcacttgaccatcaatggctacgaacgtcacaaaagagggacacaatcaaacctccagtgcctcctcatgaaagaatacaaaatcacttatgattgtcgtgtgaaaaaaaaaggaccttgaattgtatcaggctgcaccacaggtatgcaaacagcaaaatccagactgtgggcaatgtgataaaacaaacaacacacaccagtgcataaaatttcagtagggagaaaaagagatgttgactgagggagaatcaacagattaaaatagacatgaaacatatattaaccaaccacacagtgtggaccttatttagatcctgattctaacaggaacatttatgaggtaatcggaaatttcagccctgaatgggctcaaatttgacagtttgattaaaattgtcaaatcaatttgacaattgatttaaaaaattcttattaaatttttaaagtgtaataatgatattgtggtaacatttttttttttctgagatggaatctcactctgtcgcccaggctggagtgcagtggtgcgagctcggctcactgcaacctccccctgccaggttcaagcaattctcctgcctcagcctcccaagtagctgggactacaggggcgtgccaccatgcccggctaatttttcatatttttagtagaggcagggtttcaccatgctggccaggctggtctcaaactcctgaccttgtgatccacccatctcggtctcccaaagtgctgggattacaggcgtgagccactgcgcctggttgtggttacattttttcaagaattattatgtttcagagatatatactaaaatgcttacagacaaaattatatatctgagatgtgcttcaaaataatatggggtgggggaagtgaatacagtaaaaatggagaaagattggccatctttctgtggccacctgggctggccaatggagttgattacctatcctatcttctttagtgaatattcaaagttctccaaaaaaaaaaaaaaaaaacaaacaaaaaaaaaactagaaacaaaacaaaaccaaagaatacaggtctttctttttttgtataacctgctcccaatgtttaatcaatttaagtatctcaagggaagaaatgtatcagaactaactaaaaaactggcatatatgtagcatgagctacattaaatatttgcaaaagcagcccatttttttaacctaaaaacagcagcccattttttttgccttctttattttacttttttaaatatttacttacttatttaaaagtcaccaatatatccatttgtactcattagcactactgatcattgaatggaaaatcagtctatacaataaagctgtattcatgtagttaagtttaattaagttcatcattattttaatagaacagaaatatagcaacacataggtatgagatgtctgtttactaaagatcaggtacaaaaacaaaaccagagttctttcatccttggagtggataaggtagcttttaatccagtatacaaaatacttttttcatttaaatactttgtgctatttccactgattgacatttaaacaatctttaattgtaccatatatgctaaaaatgataaggtcaatgtcccaacatcccagcctgctcttttcataccttgtttttccattatctattgatagatatcagttatcaatttgttggttatgtctatgtcaatggactttcaagagaaacataacaaattgctaaaatacaaatcctgtcaattaaaaggtagggtgatgacacatcaaaatactgactttaaaatgccaatacatatatatatccacggtcttagtttgattttcttatgatttaggaattttatcatttccccctcaagtttttcatgacccattttttttgtctttgaggctctgaaaatgatctttattgtcccacaccctgcgattcacctgttcaaacccagaagtgaagggcgggaatcaggacccgggctccggatggaatcagaccatgtttttaccacagagtccttaaattagggaggcctgcttgatatacaactaaggaaaattgtcctttaattaaggggcatttgtgttcctctgtgatttttttttgcagcaatatgaaaacatttatgaaatgtttatcctcacattctgaagtgcacttttttgagtccttggctcattttcaattactgaaataaccaaagaaagaacaaacaaatccaaacaagtacatggaaaatacattttcccccttctcttatttctctagtgtacagtctgttcttgtttatgatatttatatcaagatcccctttcttgcataaaattgataattaaaaggaaaacacttacccagaacaagaagttgaaggtaaacatagaatattttatacaggcactcacacctgccatttcggaaaaggattaggaatccagatgccgtgaatttaactattcgttacaggcttgtcctgcaatatgctctggagcaacttgcctgcagagatttctgtatccacggcttcagagcagaaagagaaagcaaagaagtagagggaggaataaaaagttattaaactggataaaaaaattaacccacacatttaaatatcgcaaaggctattaacccacacatttaaatatctcaaaggctattaactcacacatttaaatatcgcaaaggctatctccaggcaagtatgttcctttgcttgtcatagctcctggggcactgggccaggatatttatgatcctttctcaaaaactgcctcctctaaagtaaacagatatcaagtgaagggaatggcactggatcaggcaagagaatggcacagtgctactaagttcttggctttcagaaaccactgcctgacttccccgccctccatttcaactatggggaaataaggttgttttgttctgagttaaatggacattgtatctctactcatttttgcattgcattttctcaatactacaaaattccttctaaatgcaataaaatgcatttagaaatctgcaaaatatcaaagcttagacatagcaacctgttatcattaaacctagaatagtaaaataaccattacatgtatctgccctccaaaacatctaaatttatttcaaaagaattccagagctgccgtaaatacaccacagaaattgcagagggagaggcagccttgcctatcatgataagaccatttgctttttatctttatttctttatgatacaaagggaaagaaatcataaagtggcactgactgcaacattgttttcattttataatgcgtagtcattctgatagcttggtttgtttttaaggtggacactgtaatttccttcctctgataaattgtatctagcaacagctgttctccaccaactcagtttctggattccaggtcctcccggacaaaaaaattcaaaatgggaaggtggtcatggatcagtgaccatagattttactatttgtttctagtgctaatagaaggcagctgtctcaggtaaaggcaaaatgctccgacatcatcagggaggtgtggactgctttgtgtaaacagcctgggtcatgttagtttccacatcctgcctctcaaagggagttcttctccccctaaataaaagaaccctctactttaaaaggttgttgagaaaattattctttagaatctttgctaagttttacacgataagcaagcatgaactccttacaaaagaaaaatattatttctaattttcactggcatacaatgtttttgaaacaattctactccctgactacaaatacaatatattttaatgcattatcaacaataatatatagcgttaaaggccaaatttaggattaattccaaaaataatggcttaatatataaatcatcactaaaattgtttgtgttctctttcctactagaaaatggatagtttcacaaccttctattgagatattttgtatatagaataatccaaggctgaaagaataatttcagattgaatgaaaaccaaaattgattcatagtcccagaaatgattatttatcagaggctaaaattaaaaaaaaattacagatttaaatgctgctttgttgaaaagaatgtattgaatactaccaaattttagtttgaaatagatattttggtggatgctgaacatccttaaaaagaatactgtgtagtctttagttgaatcactcttgaactctgtaacacaaaaatcaatggatgtgtttgtacaggagaatgactgtgtaatagaacccctagtctaattcaaaacctatatgaaacagttcactcctggaaattcctattcctattaatgttataatcacacaacactctcccaggctgaatttgtacagatattttgtatttctctttctttccatccaatcactcttactggtctgtgtagctcctaaattactgtcaaaactatttcttccatctcatccttttgcatttcattattcagtcctttatcatttcttacttgagctgtgtcaatagaatgagaattaatttccctggcagtttctcccagttcctctctgccttagcactttaaaattctttttgagaaatacttattgattaggtaatgataatgatgaaaacccaatctaaggatattttccttttacctacaagataaagttcagattccttaaagtagcatttacagcacacagcaaacaagtcctccacccactttccagaattttgtccctcccctttcttcctaggcagcctccacttctaggctccataaccacagaattatttcccaggcctagaacacacctttggattttatgccttgttccttctgcctggaatatcctttcccaccttctctattgcaacatccctgtggagccttcccttcctcatcctctgcccccactctgggcagatttacttgcttctcagtcctcaagtccattattatttgaacagaccttaaatctacaattgccactatatcacatttatttgtgtctctcccccacatttgattctatatgcctgaaaagcagaaatcttaccctattcacctctgtacctacagtagctggcattagagctacagagatttgcaatggcagccaagctcctcagaaagttcaactagtgatttcctcattaggttctctagggaactaccaatatgctacctctgcctttaaaaaatctattaggtcaagaaaaacagtttattaatttcaggacttgtcagagccttcaactttctaatattcaaggaggtgatatatagcaattctgaaatgaatataatctcagaacatatttttgaatgacatattcaggactggtgttacagaacacacatacgcacttacagaagcactgttctagacaaactctcactcttacacctgagaaaagagcagcataggcagattgagtagcccaagttcacaaaactggttagatctccttctagaaacaaggtcacaggattatcagatcagtattctgtctactggcgtcaacaatctcttgagttctgtagtatgagaatgagtcatttactcattactcatttaacgtgtcttagatattgagaaattttcatataacagatattttaacagtggtgggaggttgcaggggttggagattgtcagtaataaatcttagaccctgtgaaagaccgggccagtaaggaaagaaatggagagtgaaatattataagaagaaatgacaatcgagggaaagaacagagggaaagtctaagtaaatttagataaagtttttctaatgttgccatcatgccaattactattcattgcagcaaatgcacagagtaaggcaggataatgattccaatttgattaattgtgaaaagtctccatgaggcagtcatcagtgaactagattttgatagcagtatgggaacccatgcaggggaaagaaagagagagagagattccttatgctcagggcagaggaaagtgcatgagtagtaccatcaaataccccacagaaaatatggcattttctctaagtcatcaggcaaaccaggcctacgtttgggacttggaccagaaattaagcatagatagttcatattttcatcatgatatcatcttctcctccataagataatattcaaaaatttattcaactgatgtattgaatccttaccatattccaggaatgagactaagtgctggaaacatagtaatttatgaaacaagataaaaatccctgccttcctaggccttacaccatggtgaaaaggtaacttctttgcctttttgtttccaacatctcgttacccgatatatttgtccatggaatagacagtaaaaaagcaattcatgtgtggtagagaaaagattatttttttctcttgtcttttatactctcccattatcactgtccctctatactatttgtttttcatgacgttgttaataatcaattcatgttctcaaaggctaacagcagcaataaaaacataatgttgagatttctcttccttatgactgtactgaggggtgtgtatgtaaggacatgagatcatacactctgaacaatttgagtgaagagattctggtgcttttagcatgtctcattttgaaaaaccttttttatttttggaaagttggagttctcacttaggggttttatggtctcttttacaggagcagagccttggctcttgtgttctagtcccattctagccttcctgagaccaatattcttcttctgctttcatgtgatcccaatgctctgtttcctaccctctgtgcttatggagcctggctcataaaaacctttcatgtattcccactggaaatgcaccagataggaagcatccggtatgggaaagatgcctctcctctctttgcaggacattttaaagcaactgtctctacttgagagtattaattccagctcagaactaaagtaggggttagaattgtcattgtgaagtagcaatacagtgtttacagaaaatggatacccagtattcaacattcttcctcttctatagatactttattctaaaatattaatgacttgcacctggacataaatttaccatataggacacataaggaaaaatatggaaatgtgtatgaaagaaacagactttagctcaccaaaatatgtgtgtataaggaaaattgaggcaaaatggtgcagtgattaaaaatgcagtttataaccatggcagattagagatgctgtggattcttattaagcctcactatggcatttatactccttttacagcaggttaagagaccagctgctgggtgggaaccagggtcaggtccttggcttggcagccctgaagctccactttgccagcttttccaggggtgatctgcttcttgggaaagattcaccttaaaagctctcacaggagccagaatgtcaatttcctactttatcatgagaaatgcacccatcagactatccatccagcataagacagtagctgatcagaaaactctctccctgaaaaaaaaaaaaaaacagcacagaagccagagccatacacagatggtgtcttggggcatacatttggcaaaggggtcagtgttgccaagatatgatacgctgacaagtctagaaccaccccagggatccaacagtcaaaccttccagaggagttcagtggtcttagcatcctctccctacaattgctgtgatacaccaccaaattcgttcttcttgaggttgccttctctgtactccattcagtccctgccccctctgtggccacatctatctccagataagagtccatgataactgactaggtttccatttgccagactgtaaatacaattcagtcctgcttccaaggtcacattttaattgcattttagatacttctaaaattcttcactcacacaaaattgatcacttggttcatgcctatagattttactagttgatttgtcagaagtcgatcttatttttcttctctctaaaccaggactcgtgccaatgcacaggctgcaatactcaacaagaaaacggagaatacaaagcagggctttgtaatcaaccacgtcaggatcattgaacagcctatttttgtgctttattatttgcctggttgtttgctttttgggtttaaagtttaaatgctggcctgcttttctctgagttctctctgaatcagttctttgtttgccaagttcacaaggtacacattaactattaaacatgattaggttctaatctggcttaacactacctaacagtggttaagaggtaggaaggtgagtggaacccaccaatacagaagaaaaaaaaatagactagggtggcgatattaaacacttgtatgagacaccagcttctcaaactgcaggagccaacaaaatattacactgaatttaacacagccttgtcccatgactggtcagaaatagacactttactcaaaatgctaattaggatctcacaagtgactaattccgaattacaaacatttattcagtctcacacagtgggtatgtattgcatggctatcctagttcccaaggaaaaataaaataacaggaaatcattgttaagaggtcatttatgaggaaatcccaaacctccatttcacacctttgtaagaagcaacaaaatatcccaaataagctcaggtagaaaataactcaatctctggtttgaaggaatttctctgtagccacaaagagggatattttaggtttttcttgagtacttggaagacctgatttgcccttaatgtgagaagaaaatggaagatatggatatcccaggaaacctgtggctgaatgcctgaaccatggttccctaaaagagagagcaatggcctgactccattttcctccactgttgtcccagatgaatggaccatcccaattttaatcatatcaaataaaagtgcatgtctttaaacatacaatatccaaatgcagtctttccggaattcaaggatggaatacaccattcctctgagaattctcttttggttcgtttctccatttatgatcaggcattaaagagtccctcctagtaattatttacttattaatatcctggttgattcagaaattgcctcacccacaaagcccaaacatgtgagaaagtcagattttttttttatttttttaattaggctagccttgagggttattcaagtgcctttaggtcaaacaaagcccagagattgttttgctttacacggagtcacattgatcttttatgtacacgaatcattcaaccctcagaaactattccaaaggagtccttactggtttggagcgtttttcttaattatggaaaaggcccaaactctttctgcatgctaatttatttatatcatatttctacttgaggcttcagagagccagggaattcctgtaagtgctccgctgtctttcctcctcactcttcatgctttcttgaatacatgagcgtgaataagtagtgttaagccagaaagactgccctagccaagacccctcaagaaggaatgtgcaaatctgggaacacgttccagaatttcttgctaccagcacagagcctgatgtataagaagtatcagccagaaatttcaagtttctcaagaatcactgtattctcaaccaatctcctaaggagctctctgagaaggaaatagttcataaagcaattctctgtgcagtaaaagattacgtcactccctacctttgaaccctctaatggattcccatcacaattagaataaaatccaaagccacacaagatgagcccttggctgactcatcaacctcattttcccctgttctctcccttactcatgctgctgcagccacagtggacaccttgctgctccttggacttgccaagcgtattcctaacttaggggcttcccatttcctctgtcttccccaccaaatcctcttgtgtctagaattggtgggttcttggtctcactgacttcaagaatgaagccgccgaccctcgcggtgagtgttacagttcttaaaggcggcatgtccagagtttgttccttctgatgttcggatgtgttctgagtttcttccctctggtgggttcgtggtcttgctggctcaggtgtgaagctgcagaccttcgccatgagttttacagctcttaaggcggcgcctctggagttgttcattcctcctggtgggttcgtggtctcgatggcttcaggagtgaagctgaagaccttcatggtgagtcttacagctcataaaggcagtgtggacccaaagagtgaacagtatcaagatttatcgcaaacagctaaataacaaagcttcctggggcggcctgcttttgttcccttatctggctccacccacatcctgctgatgggtccactttacagagagctgattggtccgctttgacagggtgctgattggtgcatttacaaaccttgagctacacacaaaagttctccaagtccccactagattcgctagacacagagcactgattggtgcatttacaaaccctgagctagacacagagtgctgattggtgcattcacaatcccttaactagacataaaggttctccaagtccccaccagatcagctagacacagagcgcagattggtgcatttataaaccttgaactagacacagggtgctgattgatgtatttacaatcccttagctaaacataaaggttctccaagtcccccagatcagctagacacagagcgctgattggtgtatccataaaccctgagctagacacagggtgctgattggtgtgtttacaaaccttgagctagatacagagtgctgatcggtgtatttacactcccttagctagccataaaggttctccaagtccccactagactcaggagcccagctggcttcacccagtggatcccacaccggagccgcaggtggagctgcctgccagtcccgtgccgtgcgcctgcactcctcagcccttgggcggtagatgggaccaggcgccttggagaagggggcggcactcgtcggggagtctctggcagccagcgcaggagcccacggcggggggacgcggggaggctcaggcatggcgggctgcaggtcccgagccctgccccacggaaggcatctaaggcccggtgagaaattgagcgcagcgccggtttgcccgcactgctgggggacccggcgcaccctctgcagctgctggcccgggtgcaaagcccctcactgccaggggccggcggggccggcccggccactccgagtgtggggcccaccaagcccacacccatccggaactcttgctggcccgcaagcactgcgcagccccggttctcgcccgcgcctctcccgccacacctccccgcaggctgagggagccggctttggcctcggccatcccaggaaggggctcccacagtgcagcggcgggctgaagggctcctcaagcgcggccagaatgggcgcccgaagctgaggaggcgtccagagcaagcgagggctgcgagggctgccagcatgctgtcacctctcactcttagtttgaagagctaaacagttcatcctcttcattgtatttcatatctctttatgtgttgtttccttttcttctttctttctggaatgtctacttcagaaggtcaagggcactttttgtgttgttcactgccatatccccaaggcttggaatatagtaagctcttaataaatatttcttgaatgaataactgaataacaagttatctaaatatactaattcatttttaaataacaagagagcccctgtttgtgttcaccattgcattcctgctgcctagaagaatgactggcaaattataatcatcactatgtgctgggagataacgttgcaaaagaaaaacaaagttcacacggctcctacaagcattatattcaaccaacttgagatggcaaacaaataaatacataagtaaatatgcaaaaaaaaaaaaaacagaaagagaagaatggcagtatcctgtgctagaaagtgaggaaactacttcacattaggtgtaactctgataaggtaacatttaagctaagtcctgtctgataagaaggcataagccgtgctgagatctatgatgagagcattccagacagacaaaggcaatagcacaaagcctctaaggtgagcagatactgagtatgctggagaaagaaggagagcatgtacgtagcatagttatggagagcatggtatgagatgagtttcagagaggaagttcttcaggccagatcctgtagagaggtgtaagccaaggaaaagataataaagttgatttaagtggtattggaggtgcaggcagattttaagcaatgaagtgacacaacccagtgttctaggcagaagatgattgtgagtggtctagggtgaatgtagtgtagaggaagagaagtgaatggattcaggatatgctttagaggtgaaatcaacagagagtgagggaaagagaggaacatggataccacccaaattttaacttcaacaacttggttgatagaaaactgggggaggagcataggttctgttttgaatattttggattcaagatacctattagatatgcaagtgaagatatcacatggacagttcaatatatgaatatagaatacagggaaaatttcagggccggagatacagatttgggtgtcctcactgataaaagaaaaacttcagccaaattaaacttaaaggagtttaattgagcaatgaaaaattcacgaatcgggcagccctcagaatcatagcagattcacagagactctttatatacatatatttttaaatatatatatactttaagttctgggatacacgtgcagaatgtgcaggtttgttacataggtatacatgtaccatggtggcttgctgcacccatcaacccatcatttacattaggtatttctcctaatgctatccttcccacagtccaccccccagcaggctccggtgttcccctccatgtgtccatgcgttctcattattcaactcccacttatgagtgagaacatgcagtgtttggttttctgttcctgtgttagtttgctaaaaatgatggtttccagcttcatccatatccctgtgaaggacacgaactcatccttttttatggctgcatagtattccatggtgtataagggccacattttctttatccagtctatcattgatgtacatttgggttggttccaagtctttgctattgtgaacagtgctgcaataaagcactgtgtgctgcaataaagcactgcaataaagacatatgcatgtgcatgtgtctttatagtagaattatttttaatcctttgagtatatacccagtaatgggattgctgggtcaaatcgtatttctggttctagctccttgaggaatcaccacactgccttccacagtggttgaactattgcactcccaccaacagtgtaaaagcattcctatttctccacatcctctccagcatctgttgtttcttgactttttaatgatcaccattctaacaggcgtgagatggtatctcattgtggttttgatttgcatttctctaatgaccagtgatgatgaacttttttcatgtttgttggctgcataaatgtcttcttttgagaagtgtctgttcatatcctttgtccactttttgatggggttgtttgtgcagcctcatggtggaagaagatttatagacaaaaaaagggaaatgatgtatagaaattggaagtgaggtacagaatggctggattggttacaggttgcatttgccttatttgaatatagtctgaacactcagcagtgtatgaatggttgaggtacagccgccgggattggccaagactcagttattgttataggcacatactcctaagttaggttttcagtcttgtctacctatgaagctaggctgcagttagtcataaggattcaaatatagaagtacagagtcctcaggccacatttagttcactttcacattaccatatagaagttatttagaagctaagtactagataaaattacctaaggagaaggcatagatagatcacatcagaaccctgaccctatccctggagcataccaatatttaaatttgaagaaagtgggaataaatacatatcactgaaaagcagttaagaggaaaaccatcagggtaatgtccaggaagtcagaaaaagaatgtctcagagagagtgaggcagctgccaagtgctgctgagaagtctagtaagatgaaaactcccaatcccactggttttggcagcatgggattactgctgtctttgagagaagaccatccttagtcacatagtggagacagagcccaaatggaaaagactgaagaaagaatgagaggaatgaaagtgaaattatttattttagacaattatttcaagttttgttgtaaagggaagcactcaatatatggaaactaggataatatgagtttatatagttccactgtccactgggaatttcagagggatgtgaaaatttgttcccgtataaaatgaattgatgagtttcttaccctatggacaattaagattacaaggttgttcatgtagaattaaactctttattaattatatcaaagcctgtaggaaatcatgaatgcagatcacaactaagttaattgtaatatgcaatagaaaaatagaaatgtaaagcttcttggataataacttcctataggctctcagatgaaacgctttcaaaacctacagtaactcggaattgtaccttacataatagtagtaaggaacattatatatcaattgaattaataaatccaatcaaatattaaaagtattgtatgggaaatcaagggaaacctatggtgagaattttaatagctatattatgcgatgctccagaaagaatcttcggcaacttagaaaaagatacacatagttataatggttatcagtggctgggaaggtgattgaggggttgcagggagaggtggggatggtcaatgggaaaaaaaaacagaaagaataaatagacctattatttgatagcacaacagggagactatagtcgataataacttaattgtacattttaaagtaacttgaagaatgtaattggattgtttataactcaaagagtaaatgcttgagggggatggattcaaaaatacataaataaacaagaaaatttaaagtgaaagaatagatggggaataggtggaaacaagacttctcacagtatatgtttttatttccttttaattttgaagtatgcaaatatattaattatgaagaaaattaaattttttaagagtgcagtggtttgatccaaagctgaagagacaggttactgaacaggtcttagcaatcaggctggagtggtgttttaggtctgctgtgggtcatatcgaatggaaaacagtaagataggagctctatgttggctgggtggaggcaaagcctaaataaataaagggaaagccagtgaccaggggccaaatctaacatttcagagaactttcagtatggggaaattgggcataattattatgatgtgatacaagcaggcagatatatattcaagaacactcttctctgaggatccattctaggacaggggctttgtttcatgctttgattttttatttcaaatatttctgagtaaaaaggccaatttggtgcatgttagactgttatccagaaggaaaaagatctggaaaaaaagtcggttctgctgaagctagaagccaatgtgaacagcaaagggagagagttagttcttcttaaggatccttcgggtttgagccccagcatttttctgtctttcctgaggtttaacagccagacacaggcagtactttgaatgtgggtggtccctcaattcccaccagggtaggtaactgttctcaattttgacgctgttttgcccaatgttttgttggccttcctactgagtcactttttcctctgtttaatttatgtgccatactagtatcttcatatcttgcaggacctcagacccaaggctatcaaattagattgatttgtttctccaaataactgagcatcacctcctatctgtcctatttttttaattaatgacttcagtttttagagcagttgcaggttttcaggaaaattgggcagaaagagagttcccatatattctctcccccacctcccaccacagtttccccagttattagcatcttgaattactgcggtacatgtgttcttattaatgagctaatattgatatattagtgctaaataaagtttacattaaagttcattctttgtgttgtacattctatggatactgacagctgtttaagacacttgccctccttagagtatcatacagtttcattgccctaaaaatcccctgtgctccattgattcatccctctctctctcttccttccactcccaacctccacccactgatctttttatctgtctccacagtattgccttttttttttttttttttttttgagacggagtctcgccctgttgcccaggctggagtgcaatggagtaatcttggcttacggcaacctctgcctcccgggttcaaacaattctctgcctcagcctctggagtagctgggattacaggcacccgccaccacgcccagctaatttttgtatttttaatagagatgtggtttcaccaggttggccaggctggtctcaactcctgaactcgtgatccgcccgcctcggcctcccaaaatgctggaattacaggcatgagccaccgtgtccggcccatagtattgcctcttacaaaatgtcatacaattggaatctcatagtgtataatttttcatattggcttctttcacttagtaatgtgcctttaagtttcatccatgtgtttttagctcaggagtttatttttaatgttgaataatatctcattgtatggatgcactgtaatttgtttatccagtcacatattgaaggctatctttgttatttccaagttttggccagtatgaataaagttgctataaacagtcatgtgaaggtttttatacagtcatagtttttaacacatttaggtaaatagcaaataacacaattgctggattgtatgttaagactatgtttagttttgtaagaaactgtcaaacgatcttccaaagtggttgcatccttttacattcctaccagcaataagtaggtgttcttaatgatccacatccttattggcatttggtattgtcagtattttttattttaaccattctagtagtatttcattgttgttttaactcacaattccctaataatatatgatgttgaacaccttttcatatgtttacttgtcatctgtatatcttcttttgtgaggtgttttcagatcttttgtccagtttttaattggattgtttgttttattctttctgagtttcaagagttctttgtatattttggaggccagtcctttaccagataggtgtttttacaaatattttatccttctgtggcttgtcttttcattatcttaatctaatttatttttaatgagacaaacatcatctcatgtgaaatcgacacccaaaaactgtttttcttgaccagtttattttcccattttcccagtttacagacacatgttgttacttctggaacaagtttagcatcatatacaccattaatactttactgtgccttactgaatttctataatcactgattccttgaactttaagatttcactctgttgaaaactgtgaaggctctgaggtttatcctactcgcagactaacaagttaactccccatagtttgatggttgccatcaaaagacatgagactcctgggtaagacagaaatgactttacaactcatggcacagcaagctttacaagcttcatgtttgtgcaggttctctttgtttcccaagtcccactggggagatgccgagaagcccaggtggatggtgagtatgcaataaatttgtatcacacagagggactctgagcttagaaaactccaatcttttaaaggggtgctttttcctctcctataagggagacttccaagactgtttgctatataaacattcttgaaaagatagtctggaacaaaatctgtcaattcctctgctcagaagatatgtagaaatgtgagagacccatggagaattttcttccaaagtaatctttcatctctccaggtcatggtaaactgccaaaatagtattatattttaaaaaacctccttatacttagcaaaaatacctgtaattgttctctattagctagacaaaatataaactccttagcagagcatcaagaagattaaatatcggtttcccaactaacctttataatcttaatcctaaaacttcccaacatgtatcattcataccaaccaatacaaacctttgtgctctttttcttgtttaactagttctatatttcattccttccagcctctctgtctcaaatgctatgcccatattaacaacttcattgatacaatgagacctatttgttcaggcattaaaccaaatggtacctctcacataagacatttttaaatgaatcccttccttctccagaactcttctagcacttttttttcccataactcaatttaagtatactttataaagttgtctatttgcattttctctctattagtgtgcaaaaaactagggcctatatctcaattttgtttttcttacactaagaactatgtctagcaaatattgagtgaatgaaagaatacataaatattgtgatttttgtattttcctaaggaatttctagagagagaagatggtataattttaataaacaatcatcttctatcaataaaacaactgtttctcaactctccaactttttttcatcactacaataatcagagatttttttagaccttcctggtattttaggacacaacccagtgcttccttttattaaacctgctgcaacattttaactgaatgtgaaagtagaaaagcaaaataaaaaactgcattctggcttgtcaacatccctcattttatctcttttatctccactaaaatccttcctcaactttcctaactgtttgacatcctttgagtgctttcatataagcattgcttgtcatgaagtcaccttgcacaacccagccctcccaagaagagggcaggtttcaattaagctaacagacagcagggtgataacagtgtccactgggatcagaataacacaatgttttcaagaatgaagggtttataactttctccagaaactaacaagcaaggcagctcggcttgcaaggaagacaagatggctccatcacagagactgtaaaggggcaaaacaagggttaaaactagctactcagagatgcaaaccaaaggcttttggcaaaagcatggactttattttcacaaaattctgggttttaaagtatttgctttttaccagctcagagaaatttgttattttgtctcttcaacaaatatcttttaaatccctaataagacaatagtcaacagagcaaaagcaatctcagtcctggtagattttgcagtctagcagggcatagatggaaagcaaataagcaagcaaatcaatttatatttatgaattaagtgccatgaaggaaaagcacaaggtgtcaggaaagttgtttgtaaaaagctacctagattgcatggtctagaaagcctcctattgggaggtagctttacttgataagaaaaataagaagccagtcatgcaaagagcatggagggactgggaggaggagggaacaattaatcagggaaagtaaaagtattttacctcatcagcaaaatgggtgttcttatgagagtttacatataaagggtttggcacagttctgatgcattgtaaatgctcagcaagtgatggttcttgttattgctatggctattgaccttatatactttttaaccaatctttaaaagcctacagatcactgatcaatcttttaaacaccaatagacacttaaataataagcatcagcagttacatctttaaaaaagagggaaatatgtagaacattatatacaacatagagaaaatctcataagaaactcagtatcctcactaatgtatatgctgataattaggaattttacatttgttctctgaagcaagtgaaaatgtaattgaaatgtaagcaggcaaaatgtttaatttaatgaagaaaacctgttgtttttgagcagctttaaccatgtacacttgcatacaattaatgtgttgattacaaatgacttgagttttattttatcattaaagcatggcaagtaagaccttattctgtaacacttgacctttgcaaatttgcatttcttgacaaagtttgccatacataaataatgccactaacttagactgattattttcttcagttagtccaaattagaggtttttttgtgtggtcagttctaaatttacctgctttcctttagtagctttttataatttatactttatcattttccagaaggtaatggatccaattaaggtggacttttcatggttaaacgacctttgtaatagttataatttgataaagattgaaaagctgttcaagatataattttctttactttattattctgccaaatcttcctttctataatccttaagactatccctacatttctgattccatatgcgcagagctccataagggccccatatgattctctacatacttaaaaagatttttgtctttgttgtctgcctcatgggaggagataagttgttataaaagttgtgcaaattttagcacaaaatacctagaaaccagcctcccattagacaaaaagccccaaacttggccttacatgactaatgtgttttattaattttgaatgataatcttgatgtcccacagaaaggatggtttcagatcacgtctagagtgtgtcctttacagtttgtcatgtaaaatattttgaaatgtataagatcgtcatgagataagtgtcgagcaatgttaaagggtaattttcaaaataaggataatatcatggatttcatacagatgtcaagtgagtttgtattagagattttatttaactcattattagtgagggcattggtaagaggttacaagcaattcaaaggagaattcaaagaaaaacaatttgtaggtcaagtttattgaaatggaggcaaaagtcttgctacttccataataagtaaaaaaggcaattgaatctctactgggctgaatctagttgaatgtccaaaacaacaattatcattcatttctatcaattatctacagtttacagaattgtaaaatagctcaaagtcaatgaaagcccagagcctccataaaatcagaatcagataacctagaagagattgttttaaccaattcagttttccaatgaagcacaaaattttccctacaacataaatagtacatatactttccactgttgttaacaaactcattcatccacaaacatatactgatatcttcctatatgcaacacagaaggctagtctctggggacacagaagtgaatcatatataatctctatcctcgaaaagcctaaaataccacaaggagagacatatgcaaacaaatgagggtaaaaagtgtcagaggagttataataaaggtttatacagaacagagtagtaaaaggaataatgaataagcttcagtatgtgctttatgcctgtaattgttctaaatgcttctcatacggttgtttcctttaaacttcatagctccatgtggtaagttcaatttcaaacccattttacaaataaggaatctgaggcacaagggaattaaataaatacatccaagatcccacatatcctacatggtagagccagaatttaggcctaaatctgattctagagcccatactccaatctctgtactgtactatcctcccataaaagatagagtacttcattttaccttgggtgaggggtgggggtaggaaactggaggagaaatctaagatgaattttaaaagatgactgatgtgcatctacaggttggaacaggggctttccagaaagagagccacatgggccaatgtaccaagacctgccttgctctgaaaggtcacagagcacctttcaggccaaactaaaaatgtttatatgtatgatgaatgaaaaactgacaaagaatttaaagctagagagaaacatgatccattttgctttttaaaaagaactatggtttgattgttgtttttttccccccaagatggtagatgggaggcattgttagtatgcctctcccacttgcaaagacaaaatagagtgtagagattcacactgtgagctttttttccaagaagcaacacaggaacttaacaggaaaactgaaagaaagcacagatgctttgaaagaagctccctacatggagcatcaacattcttgcagatgaaaaaagggtctttctgatctgaatacccagaacactgggtcaggagtatgaatgacaggtggatgactatctagctggcctggcaggggagctgaggtggctccctcccttccccatgaaagctccccagccacctctgttaaggctgcaacatctgccaaccattgggtattgcatttacccacctgctttagccacaactggctttaaccaatggacatctcccctactggcctgaagcctgaaccattcaaccacattagtaaaatcctgagggaaaaataacaaataaataaatgtacaccactggagaagaagataaacatatcaagatacctctgcaattccaaccccacaggagacagtgaacctgctcacacacctaccacgttgccactgtcaccagaatctgagaaagacatcatacaaagactctctataaccaagaaactcatacagagtctttacaaccctgcaagcaccaagagccaaattaggccacattaaattataaacaataaggtcacatcctcaaagggaaaaaatagtgaaaaaactacagccaaataaaaaataaaatcaggaataactagaaatagtctacccaaatgaggagtcagaaaaataattctggtaggagacagattatccagacacaaagtcaacaaagaaacactagagttaaactaaactctagcaaacagacctaatcaatatttacagaacattctacccaagatctgcaaagcatactttcatctcatcagcatatggaacattctccaagatagatcacacattctaggacacaaaacaagtctcaataaatttttaaaaatgaaagtcatatcaagtatcttctaagacccagtggaataaaactagaaatcaacaccaaaaggagccctcaaaactatacaaatacatagaaattaaacaatctgctcctgaatgattttagggttaacaatgaaatcaagatgaaaattgaaaaattcttctaaataaatgataatgtgtcacaagttatcaaacctctgggatacagcaaaagcagtgctaagaggaaagtttatagtgctaagtacctacatcaaaaagttcaaaagggccaggtgcaatggctcacgtctgtaatcccagcactttgggaggctgaggcgagtggatcacgaggtcaggagttcaagaccagcctgtccaagatggtgaaaccccgtctctctaaaaatacaaaaattagccaggtgcagtggcaggcacctgtaatcccagctactcaggaggctgaggcaggagaatcgcttgaacccagggaacagaggctgcagtgagccaagattgtgccactacactccagcctgggagacagagtaagactctgtctcaaaaaaaaaaaaaaaggttcaaaagatcacagattcacaacctaatgtcatgcctcaaggaactagagaaacaagaacaaaccaaactgaaagctagcagaagaaaagaaataacaaagatcagagcagaacaaaattaatttgaaacaaaaagtacaaaagatcaatgaaacaaaaagttggttctttgaaaaaataaactaaatttgatagattaacaaagaaaagagagaagattcaaataagttcaactagaaatgaaaatggagacattaaaaccaacaccacaggaaaaaaaaatacaaatattattgaagtctactatgaacacttctatgtatacaaactagaaaatctaaagggaatggataaattcttggaaacacaactcttcttgattgaagcaggaagatatggaaatcctgaacagacaaaaatgagtagtgagattgaatcagtaataataataataataataataaaaagttgccaacaacaaccaaaaaacccagggccagatggattcacagctgaattctaccagatattgaagggagaattagtaccaatcccactgaaactactccaaaagagtgagaaaaagggaatcctccctaactaagtctatcaagtcagtgtcactctgataccaaaactaggaaaggacattacaaaaaaaaagaaagctatagaccaatttccctgatgaacatcggtacaaaaattctcaacacaatactaacacatcgaatccaacatcacattaaaaagataatataccataatcaagcacgtttcatcccagggatgcagggatgttttaacatacacaagtcaataaatgcaatatatcacaaaaacagaattaaaaccaaactatatgaccatctcactagattcagaaaaagcatttgataaaagccatcatccattcatgataaaaaaaaaaacctcaacaaactaggcacagaaagaacatacctcaaagtaataaaaactctgtatgacaagcataaagccaacatcatactgaatgggaaaaagttgaaagcattccccctaagaactaaaataagacaaggacacctacattcacttctattcaacagaatactggaagtcctagccagagcaatcagacaagagaaagaaattaaaggtgttcaaattggaaaagagggagtcaaactatctctgttggctgatgatattctcatatatctagaaaaccctaaagacttgtccaaaagacttctagatttgataaatgaattcagcaaagtctcaggttacaaaatcaatgtacataaataggtagcacttctatacaccaaaaatgaccaagctgagaatcaaatcaataactcaatcccttttctgatagctgcaaaacataaaataaaatacctaggaatatacttaaccaaggaggtgaaagatctctacaaagagaactataaaacactgctgaaagaaatcatagatgacacaaacaaatactttcatctcatcagcatatggaacattctccaagataaatcatacactctaggacacaaaacaagtctcaataaatttttaaaaatcaaagtctcaataaatttttaaaaatgaaagcatgggaaatacatcccatgctcatggattagaagaatcaatattgtgcaaatgtactattcaaagcaatctacaaattcaaagcatttcctatcaaaataccaacatcattttttcacagaattagaaaaaacaatcataaaatgcatatggaatcaaaaaagagctcaaatagccaaaacgatcccaagccaaaacaacaacaacaacaacaacaacaaagcaaatttagaggcatcacattatcacattacctgacttcaaattatactacaaggctatagttaccaagacagcatggcactggtataaaagtagatacatagaccaatggaacagaataggaacacagaaataaagccaaatactgcaaccaactgatcttcaataaagcatacaaaaacacaaattggggaaagcacatcctattcaataaatggttctgggaaaactgaatagccatatatacgagaattacactagacccctatctctcactacatacaaaaatcaactccaggtgtatcaaagacttaaatctatgaccagaaagcataaaaattctagaagaaaacctagaaaaaactcttctggacattggccagaaaggaatttatgactaaggccccaaaagcaaatgcaacaaaaacaaaaataaagaaatgggacccatttaaattaaaaagcctctttgcatggcaaaacaaataatcaccagagtgaaccatcaacccagcaagtgggagaaaaggtttgcaaactatgcgtctgacaaaagactaatatccagaatctacaaggaactcaaacaaatcagtgagaagaaaataatcccaccaaaaagtgggcaaatgacatacatagatttctcaaaagaagacataaaataggccaacaaatatatgaaaaaatgctcaacaccatttgtcatcagggaattgcaaattaaaaccacaatgcaataccaccttacctcagccaaaagggccattattaaaaactaaaaaaaaaaaaaaaaaaaaaaaaaagatcttggtgtggatgtggtgaaaagggaacacttacacactgctggtgggaatgcaaattagtacaacctctatagaaaactgtatggagatttcttaaataactaaaaataaatctactattcaatgcagcaatccctctactgggtaattagccaaagggggaaaaaaagtcattatatcaaaaagacacctgaatgtgtatgtttatcacaacacaattcacaattgcaaatatatggaaccaacttaagtgcccatccactgatgagcagattaagaaaatatggtgtagataaccatggattactactcagccacaaaaaaagaataaaataatgtcttttgcagcaacttgaatggaactggatgccattattctaagtgaaggaactcagaaagggaaaattaaatattgtataatctcgcttataattgggagctaagctatgggtacacaaaggcatacagagtggtataatgtactttggagacttaggatgggggagggtgggaggagagtaaagaataaatatatacctgttggatacaatgtacactactcaggtgatagatgcaataaaatctcagactttatcactgtacaattaatctatgtaaccaaaaatcacttctaccctaaaagctatttaaataaataatttgaactatggtctttattcttaaaatggcaatatggatgatggattacagactacagagagaactgtaaaacactgctgaaagaaatcatagatgacacaaacaaatggaaatacatcctatgctcatgaattagaagaatcactatcatgcaaatgaccatactatctaaagcaatctacagattcaatgcattaagaattgcattgggataatcattaagaaactatgggaatagggcagataatgacctaaaccaaggcagtaatactggagaggtagaggagcaatacgcacacacacacatatgcacacacacacacacacattgacacacacagaacatgaaggaagtgaaggaagtatagtttatagaactcagatatagggctatcatagaccactgattttaaaatgacatataataagctttctattttaagttataggagatgccatactattcattgaggttgaaaaaaaaaagtaagaagaaacagatttgttggaaatatgagcttgattacggacgcgttgagtttgaagtgaaaacatccagaagaaagttggatattaagcagaagagcccaagcaaaaagtctaaacactgatgaagattcacgaatcttgaataccaagggggtagatgaagccataaaaagaaatcaaattaccctaggcaggcagaaaagtcagaagagaaaagagagaacattgaggcacatcaacaataaaagtatagaccaagaaagacctgtgatgagaccaggaaggaagagaagtaggggattcgaaagcaagtgagttatgaatcatagggaggaaaatggttttcaaggaagatggaaattattagtttcaaataccacagataagacaagtcctgtggaggcctgagtcatcagttcccttgccagagtggtttcagcagtatgaagtgcagttggagaagttacctgaaaagtgagtgggcataggtgggtaaaggtagcagaatgaaaccattcatttacccatcctctcttctatatccacccacctaacagtaaaggaatttttaaaacccttaccctgtgatggacaaagcaaacaggagaggaaaacaatttttggaagctggaaaactgacagatgagtggtagatgatttaacaaagtgaagaaagttgtattctcaaccaacaatgaggaaagctaagcaaccaatttgcaccccagatctcccacccaactcttctggaaataatggcaccagatgttgatgccactgggattttgatggaagacaggattaaaaacagaaggattatttgaaagtttatttaaaaagcactcagactccaaatggcctctcttctccagtagacaggcttccactttatggaaaactagagatttatagtcagcagaaaatgaaaaaaaaataattacgtgagaagacacagtccttggttgtgtatcatactgaattcagtgagttttaaaggaaattttcatactcaatgttgaaaccttcagccctcttcctatctctgtcccagaaagtggtatccagaattacagcttccaggcaggagactaaaagagtcttcaccagtgattctgatcagcctaaggaaaaaagacctaaaaatactgatatctgggattccccaaaaaacagctgaaacagccaaaacctgaccacaaaaatcaagcccatagttcacaagccagaactcacccactcttacagagctttccatcagctttacagtgttacaacctgaaacataaacagatagtcacagatcaccagacaactaaagaaaacatctaacatgcaaggcagaaaacaaaacaagcagcaaataatcatccatgcagggaggtgaaaactacaaaaaactaccattaacatagtcagagataaggttgattacatctgaaatagaagcagaatattataagtaaataaagggaataatcaagaataacaaagagctcttggaaaaataaaaatatatttgtagtaataaaaatctcagaaaaggggtttgaagatatgggggacctctcctataaagtagggcaaaagacagagatcaaaaatagagaaaagaggatgagtgtggtggctcatgcctataattcctgcactttaggacaccaaagtgggggcatcactcaagcctaagagttcaagaccagcctgagcaacatagtaagaccctgtttctacaaaattaaaaaaaaaaattatccaggcatggtgatgcatgcctgtagccccagctacgtctactcaggaggctgaggaaggaggattgcgtgagcccaggaggtcaaagctgaagtgcaccagcaccagcctgggccacagagtgagatcacagaatgaaaccctgtttcacacacacacacacacacacacacaaaagagagtgatagagggagaaagaaaagaaaagagaaaagaaaaaaaaaagaaaagaaaattagagaatcaaaggtgtccaatattcaaatagtagaagtttcagaaagaataaatagagaaaatggagaaaaggaaagcattaaagaacaaatccaagaacaattcctacattgaaagcatacactgattgcccagaacaacagataaaaatgtacccacatcaaggcagatcctgagaagtttcagaacacttgtatgaatatttaaaacataagtaaagtcacataaaatagagcggccttagattttatttcagctttattgaagtgtatttaacaaataaaaattgtatgtatttaagatgtacaacatgatgttttgatatatgtatacattgtcaaatgattaccacaatcaagcaaattaacacatctcccttttcacatagttataatttttatgtgtggtaacaatacttaagatcaattttcttagcaaatttcaagtatgcaatacagtagtattattaactatagtcatcatgctatacagtagatcttcagaatatatttatcctgcataactaaatcttcgtaccctttgacatctccctattttacctgctcacccacctgtccctggaaatcacaattctactctgcttctatgggttcaactttttaagattccacatataagtaagatcctgcagtgtctttctgtgtctggcttatttcacttagcattatatcctccaggtttattcatgctatctcaaatgacagaatttccttttttaaaggctgaatgatattccactaaataaagttccatagatataatctcacattttctttattcattcatccagcaacagacacttaggttgttttcatatcttgattattgtgactaatgcagcaatgaacatggaagttcaaaaaactctttgacatattgatttcctttgctctggatatatacccagaagtgggattgctggatctatttttcaaattttgaggaacttccatactatttttcatactggctgtactaatcattcccaccaatgtataaaagggttctcttttcttcacaccttcaccaaaactgatttttgtccttttaataatagccattctaacagtagtaagatgataactcattgtggttttgatatgttttcctgatgattaattatattgagcactttttcatatatctattggccatttgcatgtcttctttggaaaaatatcttttcagattctttccccacttttagtttttttttgagacaaggtctcactctatttcccaggctggagtgcagtggtgtgatcatagcttactgcagcctcaaactcctggctcaagggatcctcctgcctcagcctcccatgtagctgggattacaagtacgtgccaccacaccacacctggctaatttttttttttttaatagaaaagatcttgttatgttgcccaggctggtcttgaactcctggactcaagcgatcctcccaccttggcctcccaaagtgctgggattacaggcctgagctgctatgcccagcccactttttaattagattatgtattttttgctcttgagttatttgagttcctcatgtactttggatattaatccttcattaggtgtacagtttggaaatattttctcccattccataggttgatttttttccttttctgtgcagaaacttttcagtctgatgcagtttcatttgtctgtttttgctttttttttttgcctgtgcttttgctgtcacatacaaagcatcattgctcagaacaatgacaagaagctttatccttatgttttattcttagtgttttacagtttcaggtcttacatttaactatttaatcaattttgatatattcaggagagagaagatggcagataggaggcaggactaacttgcagctcctgctcagacagagcagtatgtggggacttgcatcatgaacttgctccagaactactgcagaaatatatcagggaagccaagaaaacccacaggccctctgaaggaagtggattgctcctgcaggacctgggagacagcccaaattctgtgagtgcccaagctgtgacagtgagaaagggggatcatccgcacctgaacacacactcttactggggaacctggaggtatagatcacaggagaaggatttgaccttacctggagctgagtcaatttagagagccaagtgaaatacggggtagagaaagcagcaggagaagccctgtgggctctccaggtccccagggaaaccatttctgatttgtctcacgtgagtacttgggcagggctgccagaggaactgggaaaagaccacagggagaaggaaaccttcagctgaactttgtaacaattccaactgaatacgaagtctcctggccagaacttgagggagggcatgaatccagtgtacagactcaacaggccaggaggcacagaagttctgcttgctttctcagctggtaggcgggtagcctggggcaagttctcagccctgctcacccactgcctggaaacaaacttggtgctgttgtggggggcacagtgggattgaaaatagcctttttggctgtgtgggagctggatgaggcctgtaactgccagctttccttaacttccctcacaacctacatgacacaacagaggcagccataatcctcctggaaacataacttcattgaacctggaaaccacacccccatctcccacagcagccacagcaagccccacccaagaagaatctgagctcagacacacctagcactgcccccacctgatgatccttccccacccacccgggacaaagggctgaggacaaagagcatagtctcttgggagttctagggccccacgcactgcctgatcccccctatactaccacagctgatgctctcttaaaagccccacctcctggtagaggacgaccagcacaaaaatagtgtattaaacaaccaaaactaaggacctcacagagtctacttcactcccctgccacctccactggagcagaagctgatacacatggctgagagacctgaagatggttcacatcataggactctgcagacagccaccagtgccagcccagagcctggtagccctgctgggtggccagattcagaacagaaataacaatcactacagtatagctctcaggaagccacacccctaggaaaaagggaagaatactacattggggggatacaaatgagacaaaagaatctgaatagcagccttgagccccagatcttccctctgacatagcctacacaaataagaaggaaccagaaaaacaattctggtgatatgataaaacaaggttatttaacaccccccaaaaatcacactagctcaagagcaatggatccaaactaagaagacatccctgatttacctaaaaaagaattcagaaggtcgattattaagctaatcaaggagacaccagagaaaggtaaagtccaatttaaggaaataaaaaaaaaaagatacaagatatgagagacgaaatcttcagtgaaacagatagcataaattaaaaaaatcataacttcaggaaataaggaacacacttagagaaatgcaaaatgtactggaaagtctcagcaatagaatcgaacaagaagaggaaagaacttcacagctcgaaaacaaggcttttgaattgacctaatccaacaaagacaaagaaaaaataatttaaaaaaaaatgaacaaagcctccaagaagtttgggattatgttaaatgaccaaacctaagaataattggtgtttctgaggaagaagagaaatccgaaagcttggaaaacatatttgggggaataatcaaggaaaacttccctagccttgctagcaacctagacatccaaatacaagaagctcaaagaacacccaggaaatccatcacaaaaagaccatcacctaggcacattgtcttcaggttatatctaaagtcaagatgaaggaaagaatctcaagagctgtgaggcaaaactaccaggtaacctaaaaggaaaacttaccagattaacagcagatttctcagcagaaaccctacaatcaagaggggattgaggggggtctatcttcagcctctttaaacaaaacaattatcagccaagaattctgtatccagggaaataagctccataaatgaaggaaagatacagtcttctttcctttaaacaaatgctgagagaatttgccactaccaacccagcacaataagcactgctaaaaaggagttctaaatcttgaaacaaatcctggaaacacttcaaaacaaaacctctttaaagaataaatctcacagaacctataaaacaaaaatgtaattttaaaaacagtcatacaggcaaaaaatcatatgcatgaatggaatagtacttcacatctcaatactaatgtggaaggtaagtggcgttaatgctccacttaaaagatacagaattgcagaatgggtaagaattcatccaacaagtatctgctgcattcaagagactcacctaacataaggattcacataaactgaaggtaaaggggtagaaaaggagattccatgcaaatggacaccagaagcaagcactccggagtagctattcttatgtcagaaaaatcaaactttaaagcaatagcagttcaaacagacaaagagggacattacataatgataaaaggccttgtcaaacaggaaaatatcacaatcctaaatagatatgcacctaacactggagctccaaaatttataaaacaattactactagacctaagaaatgagataaacagcaacacaataatagtggggcacttcaatactccactgacagcactagacaggtcatcaagacagaaagtcaacaacaacaacaacaaaaaacaatgaatttaaactataccctaaaacaagtggactcaacagatatttacagaatattctacccaacaactgcagaatatgcattctattcatcagcacatggaaccttctccaagatggaccatatgataggccacaaaacaagtgtcaatacatttaagaaaattgaaattatatcaagtgcttgctcaggccacagtggaataaaattggaaaccaactccaaaaggaaccttcaaaaccacacaaacaaatgaaaatcaaataacctcctcctgaatgatcattgggtcaacaatgaaatcaagatggaaatttaaaaatcctttgaactgaacaataacacaacctatcaaaacctctgggatatggcaaaggtggtgataacaggaaagttcatagccttaaatgcctttaccaaacagtctgaaagagcacaaatggacaatctaatgtcacacctcaaggaactagaaaacaagaacgaaacaaatccaaacccagcagaagaaaggaaataaccaagatcagagtataactaaatgaaattgaaacaaaaaagatacaaaagataaatgaaacaaaaagctggttcccagtacagatggatgtggctcctcccaggttccttggtaaatggggctggatttagtaccatggccatatgcagctggagctagtccataataagttggtgtcacttttggtctgtagccaggactatgttcatgaagtctgccactgtggtccaggtctgccttctcaaagtggctctccttggtcttgggcttaacttgggttttgcaacctcacacctgaatctcaaagttctcacaatggcatatttgtccatgaatggcttccaggtaactgggtggaagaacatgagctgggaacctcctattttgccatcttgctgacctgaatttcttaacaacactgtaacaatgacattcaaaattctataggaaagtgccctcccactcagaattcaatatacaaccacactacaattaagtgtgatgatagattgtacatggtgatatagaccacacatgacaatgatagacatacaaggagtcaaaatatttacacacatacactgtctttgcagcctttcatgagaaattactgaaagggatattctgccaaatgagggtgtagtaacaggaagcaaatcataactcacttgcttttgaatcccctacttctcttccttcctggtctcgtcacaggtctttcttggtctatactttatacttttattgttgacatccttcctgaatactttagggtttgaatacaagtgtggtgtgagttcacatgccaggaactatttatatattatcttatcatatctgacaacaccatcatgagttatacattattatccccgttttacggaaaaggagattgagattcagaggggctaagggacatgcccttctttgaatggcttgacactgccaggcctgagagtgagcgaaacaaatgcaaccatagaatcatctttttaacagagctgtaagctctgcagctgggaataacagtatgtatggatgtattctccctctcagttgcttttcagtatatgacccaatggtgatggagatatgtaaatgtttttattaattttaaaaagcatctttttgacagcatccatttaggaatatgggagatatataatacatacgatacatatgcatgatattattgtatatataattgcattatagtaatatatgtttgggaaatcctatatttataagattatacaagaacacacaaaaaatgcattctaatccccatgtggtttaaatgtagcaattgagagttttttaagcacagctaattattttttatgatacaggaacagtccaaggatgttcattgcacataaatataagatcatgcaacaattattccttcatagggcttgtgttgtacaactcaaggtttaacaatcccatctggatgctgcaaacagatgtgcctggtccttttaaaagacaaaggcatttccctgaacgacttcatttatttcctgctaaagcagtcatgctaatcatgagttccccttgccttgcaatattcaaaggacagtctcttctcacgatgaaccaggaagcaatatgttgtatggaaaattcgcctgatcaaattatcctaaccttgagatgtttttaaagtagaatcagtgtgaaaactgcctgtcggcattcctccaagtttcctgagaaatttccaccacctgaactgtttaatcatgactttactttccttgcatcttattttttggccactgaaaggacctttgtttatttcagctgtagcaaacagaaggattggcataacaccggggcattttaataataaaccatatcctccagagtcagcaaatgataatttatttctgtttctttaaatatcttggttttttttttagagcaattttaagttcacagtaaaattgagaagtactgatttcccatatactcccttcccccatacatgcataacctccccgacagaagtggtatgtttgttacaattgatgaacctacactgatacaccattgccacccaaagacaatagtctacattagggttcactcttggtattgtacattctatgaatttggacaaatatatactcacatgtattcaccattataatatcatatagtttcagtgccctaaaaatcctctgttctccacctattcattgttggtcatttcttttaaaaatcatataaagtcaaattttccttttaaagaacccagatgtattaaggaaatcaaaaatagagtatatgtgtgcatgctatatgcaccatcttcagagagttctgcctactttacagacttttttctttatacaaggaagattctagaagttgtctaagtttattttgttagaaagtaaataagaacaaatttgcacacagatgccagctaaacccacagcagactttaaaatacaaaacagttccacatttgtaattatgcaaaacatcacaaatatgagaccgttacacccaagggaaacacacaaatttaaaaatctcatcactttcgtgactttcagagacttgcactcttcttccatttcatgctacatcatgtgttactgtttcatcaaagcaaacagtttgtttcatttaaaatttcttcaatgagcttagtgagaacagctgcaatgcagttctctcccctcacattgatactactgagtattctatcttgttctgtttccactctaaacttgattaaccatatttgcaaaactctgcttagctacctgtctccataactaattgttgtttcccccaggtgagtagaatagtggataaacaacatcagtatactttttataggaagaacaaataagctactaattacaaaggagggaaggaaggaaggaaggaaggaaggaaggaaggaaggaaggaaggaaggaaggaaggaagagagggagggagggagggaggggaggggggcagaagaaaggaaaagaactttacccggatcattttttttccttttttggcatgacccatcaacataatagttagattgtcattagcataaatcagttactctgggacagcagtcaaggcagaggcaagaagtatctattaatatttgtctcccctggctttagtatataaactatagtgatgaatcttacagatgttactaatcatgacattatctggccaaggtacatactccccaagatggaagggataaagcaccccattccctgacctcttgctgccatcgttttaataattgacttcactacactatgtttcaaactggttacaattcaacaaactctttttcttcaagaaacaaagatgtatggacaaaagtcaaagaataattaaataacacatttaagccataatataaatgcactctgctttaatagactaatcagatgctcatccatacattgcacatagaattaccattaatgaagtagaactgccaagactgaatcctggaaatcaattaaaggaaatgccaacactaaatttacacacagtttggatgtatagaattaatcccttaattctctttaatttcacacatctggtactctttattcctgtgaatttccatatacaaagaattactaaagactaaactttgcattgttctctaaaacaatatggtttctttggagttgcctaagatgcaactttgcaaacatgcctctttgttagggtaacatgttaagaagagtagaaattcatcacctctaaaagatatggttataaaaatccagcaatgcagaaacttcagtgtcaaaagccgttaactctaatacacactgccaaaccactggtagcaaactatatatacatgacacccttgatcagaggtatgttaccacctaagcacatcttatgttgtaaaagggtcctttctctggaaaaaaaattctgtatagaacagaaatgtatgcatttgggatccaataattatgaatggaaatctaggggcaatagatgcattcaatattaattccaagcttcatctaataataaccctgtcctcccaagtgaaagagatgaaaaaagttcctccaagatcctgttaattttactgcctactgatgaaaaaagggaatacattagatccgatttaattagctaaatgcccttacttagtttttccaggaaaatgagtaaaaagagcccctacctgaaatctgtaagactactcttcataacatcatatgcatggcagtctcattactaagaagcaaaataatgaaataaggtattgggatacctggtgtctagtcctagttttgccattcagtagctatatgataagaaacttgtttaatttctctgggttttcatttgtttacattttgctaatggatgggaattatatctgtctgtcttgctttattctgtctttcattatttataatggtttctaaactcagttacaaaactgtataaagggcagaaaaattatattatagaactaataatgttatcaacttccattacatttatttctatttctattccattatttccttaaggtcactggtgacacacaaccattactaagcaacatagacagcttgtcaggatcacaggcaaatgtgagccagattgtccagtatgaatatctactgatgcaattaatcaagctggcagaccttcctgggaaaacaagtgcctacatcgagaaaatggcatgtatgcgtttaacagtgatttccaggcagctctcctggttgatatcagatgagtgactaaattagggttaagcaaactttttctgtaaaagtctagataacaaatactttaggctttgcaggtctttgtcacagcaactcaacatagccactgtagtacaaaagcagctatagacaatacataaatgaataagcaatgaataaagtgttccaataaaactttatttgtggtcactgatatttgaatttcatatacttttcacacgtcatgaaatattctgcttctttttatattttctgactttaaaaaatataaaaaccattcttagccattgggcatacaaaagcaagtgttagccttgatttagcccaagggccttagtttgccaatccttagatgaatattaagaaattatagagattatctatgtgcaatctgttgagatttctgctcgggttatattgcttgattattaattgttctcagcactgattaccctttgtaatgcatgatgatttgatctgtggattggggacactgcatgaggtgaatacatgagagagaaaggaaatctcccctgtggcactgagggagagagactagcagtggagtgcattgagtcctaaaccaggtggcaggtgctctgatacacagaaccaccatgagactacggaaagataaaggcaggagcccagacacaatcaaggcaatgccacaccatctgcaaataaagcacatcattctctcatcttacagagcttatctaatacattaactgtcacttctttccaaactggcttgacaggttttgggggctccctgactacagccaacagtaacattctaacatgaacactctgtcttgtctctaacaccctttggaaattgcgaatacttctcaaagaggtaactctgtaagtcgccaatgttagttttgaccaggttgttttacttggtgcttggagcaaacgggaacagcaggtagaggtggaaggtgatccgtcattcagggaggagaaagaaggtcaaaaacaggaaggaggcacctaagctttgtcagtttcagagtttaagctaactggattcctaccattcattctacagtatttactgggctcctgctgaattcaaagtgtttggcaagtggagcctttaccttcactatgcttacaaacatgtaaacatggctaaggcattctttctgtgttcctaacagctaacgtcaaataaagtcaattgtactctagtaagaaaaccaaagttaattaataatttctgaagtatacatttgcattcaaagcaacccataatgaaacctgtagtgtaatgatatacttagctgagtgcctaacagatgatttttctacatttgtaaccagaataccttggttattcaatactaatataatggttgtaatggttcatcaatcttgtacaaggaaaatacataagaggaataatcccaatcttagtttggcaggaattcctactatttgcttcactaatattttgtagtaggaataaagcttaacacattctctgtggaacactcaactcattaaaatacacaacaattaccatgttgccactaacagtggaaagacagatcagtcggaaatgcctaaaaatttagggtaacaccaggtatgaaataaactttagagtcagatgggcccagatatgagtcccagctcagtggtctaagaacagtgagaccttgggcaaatgatgtccacttcccagacctcagtttcctcatctgcaaaacaagggtaagaattcttacccataggtggttgtgagcattccatgacatgttgtctatatgagtgcttaggacagtgtctagcacagagaaggcttccaatcaatgtcaattcttcttaagagactatattatgctatgttctataggaaagccttgaaaataggactagaactcatagtcactggcttttgggttaacagaggttatatagcaatcctctttcccctgcttcaagtaagcaggcctagagaaacaaatttaggtattttttttttttttttgtaactgaggacctagcaatgattctgtctatatttgaatactgtcacttactatagctatttgaccttgcaagtataaaaaataaaaccctttttatgcttcagtcttatctttcaaaccaaaataatagtagtatctaactcttagacccttagggttattgtgtagaaatatttatatatccacatatatatagtttggtaacaataataatcctaagtaagtatgtgttagccattatgattaactttgacatgctggacattaataataagtatatataaaaagtataatgatgctaaaagattgagaaggtataggggagtcagcccagtatataaagaaagatttattcacttaagatttattcacttaagaaatcattattaagtattgccatgtgccagagcgtgtgtgtgtgtgtgtgtgtgtgtgtgtgtgtatgtgtgtgtgtgtgtttgcccttcaaggttaggggatacacatataatatacacctataaagttatttgcttggcttttgaattttaaataactctgttataaagttacactatttatagtataaataaagacaccttttgcctctttctcttaaaatctgaaggcagagaaaaacaactgagtttattgagtcatgttttcttagtcatagtaccatcatagatatgttcctttagttagttctgtaggagtcctccctcttccatgtctcaccttagctttggatggaggttgtaccatccctttctcactgtgtcatataggatgtagctcattgaagaagtccctatacttggaaactacacttaaatgtaccttctataaaggatctaaagttccatataagacaatgggtagctataggccaagaggaaactgaaataattcttaaaaacccaaacctaacatactatgacagactcagatttcggaagtgtaagctccagtttatagtaaataatgaaagcagattgcccttaaagaagctgtcactttggttattgtttttcagggctggggagtggtaaggtggacttgtaatatgttttattcaagtcatcacttaagacttaaaatatctttttgctaaagatgactaataaaaatgaaatatgaaagctaatgttcggatgccaggtgcagtggctcacacctgtaatcccagcaatttgggaggccgaggcaggaagatcacttgaggccaagagttcaagaccagcctgagaaacatagtgagatcctatctctacaaaaagtttaaaaattagccaggggtggtggcacatgcctgtaatcccagctactctggaggctgaagtgataagatagcttgagctcaggagtttgaggttttagtgggccatgattaaagcactgcattccagcctgggcaacagagtgagaccctgtctcttaaaaacagaaacaataacaaaaacctaagtttcggagtcaaggtggcaattgatcaaagtggcactatagtgaatccaattcaatctgtgcactcacttgattacagcagctgtgctccctctcattactttccagatgaagtccagagctctcttagacttctttggatgtgaggctcaggggacagtgaaagctacctacctagggttccactgcttgaagaacccttcatcctaacttgccctgtggtagcagcagaagcagaaggtcctagctctcccagatcacagacaatcactttctggtgacctgcacagccacttcccagaggactgatcctttccttcaccacatgacaccaagatgctacttgagcccactttctcccttaggctaaaggaagctttcctagattgtagtttgaaactgtcaacacataaaagaactaattacatgcttccatcaggaaaacacttcctactttctcacagttataggaggtaaactaattaaatattttctacagaataaagtagttttgtttgtctttcttgcaaataacacattctctgcaaagaagaaaaaaacagtcatctctagagaagctctctctgtttagacatttgctcacagcaattaaaaggggcctctggctgaccaggaagaatccaacttgggaaaattacaaaccacatattaactacagtggtgtcagtgcattttggcatccttgtttcaaaagcaaaaaccaaaaagccactctttttgtttttttgtttttgtttttccttgaaaagcttgcattaattcaggagggtaacttaatatccatgacatcctaacagtgagagaaaacagtagagaatcttttcctaaagtccgaacagaaatcagattgtgaatatgtgcttatgtgcaaaggacttcatctggaaagtaatgagagggagcacagctgctgtaagcaagtgagtgcatagattgaattggattcaccatagcaattagtcaaaactagtacagaggaaggactagaaagaagcaggaggcaaaaactaaggtcagcatttagaggatctatttctctgggacagaaaaagtcagaacaaatcccagagacatttcagaatggaacctccaatatgcagttgtcattctgatgtaggccacggttgtgaggaaggggataggcacatgatgaaagccttattgatcctattactcagtcctggaacttgcagggagaagaatgattggccttcttgagtatattctcaagaagtagctcatattcaagggtaggtaagctgtgatgaaagagaggaaataaggcaatacaactgaaacattctgtgttcacatcttaagttagatggaggaggtggttaaagcaaggccccttttgttatgtgcgggacccctcaccaaccaatgcccaggctctgctgcaacttagcactgtctctcaactgattttcactgttatctgaacctgtctatctctcttttaaggccatattaatttatcatcataaaaaacaattatccacctatggtcacagtgctgacttttgggggaaaagctacaaggcccactgataggattaggagcaacccaactcagtaagagttagtcaggcagatacagatgatgtttcagaagagaaattccaacaagaaggagctcaattcccatggtttggcaaaaggcagcaaacaaaatgatcctcatattttcttgattcgatgaggccatgaattgtgaaatgtgccatattaatatcagattttcaggatagcagggtgaaggggagggagccacccaattaaaaatatacatcatttgtaacatattttctaatttcataaatatttttaaaaatatgcatcttagaatgagaaaataaagtacagttgacccatgaataaagcaggtttgaactgtgtgggttcacctattcactgatttttttttcaataaatacattggaaaattttttagagatatgtgacaatttgaaaaaaacagacaactgtatagcctagaaatactgaaaaattaagaaaaagatatgttgtgaatgcataaaatatgtctattttatcattaaatactataaaatatatacaaattttttaaagttaaaatttatcaaaacttacacacacaaacacagaccttacacagggtctgtgtgtcatttgcagtttagagaaatgtaaacaaatgtaaagatgcagtattaactcacagttgcataaaattaactgtagtacatactgcacaactgtaataatttcatagccacctcccattgctactggggtgaactcaaatgttgcaagcattggcttaaaatgcggagtgaccttgagcagtgcatctctccagtaaactgtatattgcagtaaaaagtgatctcttgcagttctcacatatttttcatcatttagtacagtatcttaaatcttgaataacaacaccatggttcccatatgtagtgctactagtgatgctggaagtgttcccaagaagtggaaaacagtcatggcattacaagaaaaagctgaatttcttgatatgtaccatagagtgaggtctgcagctgcagtcgccctccatttcagacagataattcatcttgtaaacagatagcataaactcacaattgataaatacagtacattactataaatgtattattttaaataattttcttaacattttcttctctttatcttactttattgtaagaatatagtatataatgcacataacatacagaacatgtgttactctattatttatgtatgtatcggtaaggcttccagtcaacagtaggctattagtggttaagtttttggatactcaaaaggtatatgcaaatttttgactgcatgaggtaacagtgtccctaatcccctctttgttcaagggccaactgtaattacaaccacaaaataaaagattaagtacaatagccaagggaaattgggttcattctctcatttatttacttttcttatatgccaggctcatgctgtgttctggaattacaaagctgaacaaagcaaaaaatccctcagcctgaggtgaagacagacatgtaaacaaatttaaaagggacctctgagagacagtgcaactcagtggttcaaaacctgactggctatgttcaggttctaggtgtgccatttattagctgggcttcagggtgttactaaacctgtatgctcctgtttcatcagctataaaatgaaggggtaataactgtacttatccttgtaaagtagtaggaagaattaaatcagttaacgtatgtaaaatgcttaatggttttggacacataataaaagttgtctcaatattgctatgtaaaggatgcaataggattagagcctgtaactgtgcatggaaagagtccagggaaggccttgcaaagaggtgtgaagaaggactgaaggaatatgaattcattaggcagatgagagagagaaagattttattgttgggatgccatgagaaagcatgtcacattttaggaacctaaaagagaagatgggatccagcaaatgagacaaactagataaagttactttggatcatgagatgattttgcatcagagtagtttggatgtagacaacaaaaccaaattcttgccaacttaagccaaagagtagaggaacaaggaaaagatgctttatgagaaggaagtggatggcatacagaagcaaagaaaacattgaatgagcatgtttttgaaaaaatcaaggatagttaaaggaatttagataaaacagtaatcctccctttacccttgagagatacatccatctgaagaccccaggtggatgactaataccacggatagtaccaaacactatttatgctatgtttattcttatacatgcatacctatgttaaggtttatatatatatatatatatatatatatatatatatatatatacacacacacacacatattttttttttcaagacagcagattgaagtcattgttagcatacctctcccacttggaaagacaaaatagtaagaagagattcacattgtgaacttttttccaagaagcaacacaggaacttaacaggaaaactgaaagaaatcacacgtttgaaagaagcagtgggctgcagcctacaccgtgagccagtcaaaaaactaggagtcctgagagtatgacaggggaataaactgcctctgggatatacattcccatcagagaacctggcagtccaggccatggggaggccttaaccctgcccagcataggagctgatttagtgagcggtggggagtatgtgaggagtggcattgggacatgctttgcatgtactcccagtctctagtggggatggagggaagccattcctgatcctacctcataggtaatctcccagaaattggttaggtagcataggcggtagtcacaggttgagagaagctctcaactgagattcacaatattatctcaggtggggagaaacttccttggccagaactgaagggcaagtgagaagtgtgctacagccacaaatgcaaaagctgggtggcagaccaagaggtgcatggcctgaaagccccagttgctgtctccctagggaggatttatggcatggggcacttttgggttctgagcacacactgcctggagcctagctagctgctgctggtagaatgctgctggagtaagaactgccttgctacatatgtgggagctaaccaggaggttgtgagtctgtccataggacctgttcattactactatacctggcatttgagaaagtaaacacgttaaggctatttataaccaaggaattttgcaaagtctatgtcactccctgccaccccatcacagctggtgctgttacccactgcttggagacttgaggacaggtcatattactggccttgctagagatttagatatccaaacagaagaagctcaaagaactcctgggagataaattgctaaaaggatatcaccagggtatatattcatcaggctatctaaaatcaacatgaaagaaagaattctaagagcagtgagacaaaagcatcatgtaacctataaaggaaaacttatcagactaacagcagaattctcagcagaaacattacaaagcagaagggcttggggtcctatatttagcctcattaaacagaattactgtaagcccaaaattttgtatccagcaaaactaagttttataaatgaagaaataagatctttctcagacaagcaaatgctgaggaaatttgtcactaccagaccaattctattagaaatgctgaaaggagttctaaatcttgaaacaaaaggtcaatattcaccagaatggaactcttgaaagcatcaaacccatatggcctagaaaacaataacaaaatgaaacaaaaaaaacaacaacaaagtatctaggtaacaatcaacataacgactggcacagtaccttgcatctcaatattagtgttgaacataaatggtctaaatgctccacttaatagatacagattggtaaaatggattaaaaaatcacaagccaaatatctgctatcttcaagagactcacctaacacgtaaggattcttatagattcaaggtaaaggagaggaaaaagatattccatccaaatagaaaccaaagcaaggaggagtcacttactttaaagcaataatagtaaaaaaaaaaagaagcaaagaagattattacattacataacgatagaatataatgatagaatgattcctgcaacaagaagatattacaatccaaaatgcatatgcatctaattctggagatctcaaattaccactagacctgagaagagagatagagagccacacaataatagtgggggacttcagcattcactgacagcactagaaagattatccaggcagaaagtcagcaaagaaacaatgaacttaaacttcactctagaacaaatggatgtaacagatatttacagaacattctatccaagaactgcaaaatatacattcttctcatcagtatataaaacattctccaagatagagcatacaataggacacaaaacaagtcttaataaatttttaaaattgaaattataccaatatgattttatggaagctgcaaaaaaataaaatattaataccaaggaatatacttaaccaagaaaatgaaagattgctacaaggagaactacaaaacactgctgaaagaaatcgtagataacagaaaaaaatggaaatacatcccatgcttatggagcagaaagaaaaatatcatgcaaatgaccatactatgcaaagcactctgtagattcaatggaattcctatcaaactaccaacatcatttttcagagaattagaaaaaacaaccatgaaattcatatggaatcaaagaagagcccaaataaccaaaacaatcctaagcaaaaagaacaaatctggaggcatcacattacctgacttcaaattatatcacaagactacagttaccaaaacagcacggtactggtataaagcagatacatagaccaatggaacagaacagagaaccagaaataaagccaaatacttacaaccaactgttcatcaacaaagcatataaaatataaattggggaaaggacactctatttaataaatggttctggaaaactggatagccacatgtagaaaaatgaaactcaattcctatattttaccatattaaaaaaatcaactgaagatggattgtagacttaaatctatgacctaaaaacataagaattctagaagacaacctgggaaaaactcttcttggcattggcctgttaaagcaaactaaacatggcctgagaaggactctgtatttctatatctgagcccttgtggatgaactgcaacctagcttttaataggtagacaagactgaaaacctaacttaggagtatgtgcctgtaacaatagctgagttttggccaatcctagcagctgtactttaaccattcatacactgctgagtgttcaaactgtgttgaaataaggcaaacaccgagctataaccaatccagccattctgtagctcacttctgatttctgtacatcatttccttttttttggtctataaatcttcttccaccacgtggctgcactggagtctctgtgaatctgctgtgattctggagctgcccaattcaccaattgttcattgctcaattaaattcctttaaatttcatttggccaaagtttttctttaatcagatggtgtcagaagcagcaactgaagtagagcttctggcgacccccaggagcactgagtgaacaagcaaggtacctgcaggacccatttgtgtccactgatgtctcagagtagctggggatcatgagtaagtgctctctcggatttcagagccacatatttgtgttttgagccattggagtttctttgagtaaatttctgatccaaactgggtttgaaagttgtgacagcaactgggctgggtccaggaatggatttgatctgggaattaactggcttggatccaattagagacctcttacatctgactgggtcagaaaggaactggcagttagcagtaatattgcaggagtcataaaatacggcttttgaaaattcacagggatttttgtgtcctacccctttgtttcatttttcttgcatgcctaagtaggaaaaattattggctaagttaatcgggagaacctaagagtaaagccaatattttaggtaaaatgggatccttaatctcttgaaaactgagttccttctggtctatgcattaggtcttggatgcagtgaagtcttacagaaatggtaaaatcttactaaagataacttacagtgtaacattctgaatgaattacaatgcattgaagtacatctaaaaataagggctcttggtaaagtcccctttggctaagaacgggtttggccctatgggatgttaactgttattctctttggattaatctgccttccactctttgctgatggctaacggtgacaggattaggcatgtacaggattacaggacatggtgagctttttccttcctaaaaggggaaacttgagagctgatgggattgctggaaaagatcctgtcacaaccaacaagcagccaccggaacttttcagtgtcgctgcaatgggtgggtctttctctggcctccctgaggtcttcacttccccttcctgccacaggtaatgcttttttttctctctctctcttatcttttttttattactcagggcaaccatgttgcccagagaccacatgttgaaactcctagtcagaggttggattaaagatggcagggcccatctgagggtaaatttaagccttgccatttgatattgggtgctaagcaaagtgacaaatgtctatgtcttgtcaaatgtattttgctctggccagaatgaaaaaagataattttgttttatgatgtagcttggccccccaggggatggtgcagcaagtcaggtcattagggctgctcagggaaagaaaacccagaagcctggcatgctggcaaaagggtaagaatttcttaccagtcagacttctggcctctgactctctctctgtgcaaaccagttgaatgaatggtaaaaatcactgtttatctcttctgtacagtttggattaatacaaaaaaaaatctgagtctggtcttaagctatagtgaatctggtgtgctttgtgtggctttctgtattgttctgtcacaaagaggggtgggtaccttgggataaaatgtgtgcctaaaaccccatgtgcctgctgttcaagacagcccaacaaactggtcagttatgtccttgggagcttgaccttgtaactatgtggctgtgctttctcttttcacaatggtggcctgggttcaggtttcaatccctagcttaggggatgaaactttctaattgatatttgggtgacctttgccattttaaaattatagtcccctctacaaactgtcttgaatttccctgtctcaaagcacctgtgaggttactttcaataaagttaaaaagccagaaatattggccatttggcctgggtaaagtcaagtaataagaatgtttaaaaggactttattaaagagtgttatggttaaaagtcagcttaattaaaagtagatattcaggctctaacagcctgagactccttggaaaaaacaggaggcaccagagaccctttcctggacctgtttttccaaggactccatctgaaagccaataatccaattaagaaaattaataactggcaaatgaaaaattttacaactactgtagtaatcttctgtctgtctaggtagttttatatacgtattgtgtgtgtaatgtttatatgtgaaagagttttaactaattggtttaataataataagtgcttaaatcaaatattttgtcagaaatgtaaaaagtataatgccttttatttagttcatgtaactttagtattctttggtaagtaaagacagtttaaaagattattggtaaaattaaaatgtcttcaaaagtgtaaatatttggtttaaattatgcaggtcagatgttaagtttgctaaatgctttaaggtcataaactgcttctttgacttttgaaaattgttgaatttattttggagacattaaattctaagtaagccctggggacacgtgaaattagccatgccccttagctatgcaaagaaggcataaaagaaaagagattgtgtataaggaaggatctttatggtaaattctggtcctaaagctaaagtaaaatgactgtttgtttaaaagagagatgtttaggacaagtcagaaagtccaaacatgtcatagatggtcaatgtaagcccatttataaaaggatttataaaattacatttatgcaccaaaagtgaaagttactaagcattatcattataacatgtaattgggactactgaaaaaataggtttacatgcatggtgtatgaggagaatcaaatgtgtttttggtaagagattataagaaggcatgagaatgtaaatttttgcctagtttaaagggttaaatgattgtgttaaattaaataaagctgaaggttaaaacaagttgtggaaggtttgtaaaaattaaccttgtaaaaggaattctatgtgtgaaaatattgactaaatttaaaagggtattatttggttttactgtaaattgaacatcaaaataaaagcacaagagagttttcttaaagcactaatctgctctttaacaaaaatttataaagggttataaaaggtttataaaaatcttgccatatgatcaaactgattaagattgggtagacttgtctatgaggttttattaaaaattgggattgacattaatagtctgctaatgcaagggtgaaatttggctttctttcttaaacaagattttcaagtaatattaaaagataagataatgaaagagttttgtttgccttttaaatatactatgaaagagaaaagaaaaagaagggaaagacaaaagacagattgtgtggaaagctaagtcttccttctatcaatgagtaaaggtttttgcctttttaaacatttctgagtcatcattttgattaaatgaatgacttatggtgacctggaattctatttcataatatcaagtgttttaaatctttaacatatttaataggtttcccaaaatcaaatttcagcttcaaaatggtcttttctgaccccttaactttgtaatgctacagacggcatccaaaagagaggtaaacagaattatttaacatgttaagttacatgggaagcattgtcaaaataaaaataatgtttaatcttcaagttatattttagtgaatgatattaatatgtgttccaaaattgtatgggatttctaaaatcctaatatgcctgagtatatgctatcagtcataatcatggttattatgttaagttattgtgcaccacagaaataaccaaatttccttgtataaaactgctaacccaagtagaacaaaaaaattaactaaatgtcaagaaaacactttgccagattttcacgttaaaccaggcaatactgaaattgtttacatatacaatttgaactccatgttctaagtcaacttacctataatgacccactagttatcaatgctatgcacctaaattggagaaacaacaagtattcaagaggacataagtccagtgttaagtatggactcatggagaaccagggcaccctccttgtccttcctgagtccttaaaacttgtgttattaaaggttctgcattccacaattcatcatggagaaaaataaaatgatttaaattgaatatattgatatggtgacttacaaattgtgaaagtagtttaaaaccaatgtttggttctatattcctgggaagacaatcaaaccttcaggtatatttggctgcctgatgggtcatttaaacatttataaagatattttgttcaattgtcattttcaatcatgttttttgttataaaagttaattattatgtcacagtatattttcaccaggtaaataaagctttttatggttcactgaggacaatcaattccttcacaatctagaacctgaagattgaatattctgtgaccatcagagaaagactctccttgccatccacactgcaacaaaactttggaaccttgtacgttggattcataaccaaacaactgagaagggtccctccatactcttggaattgtacacccattggaacccttaaggtaaaatgaaccaagaaagtttctccccagaggaagatggaatacttgatgtgaacagcttttcccaagatcacgaatcaagacttctactatcatgagactcttatctttgaatattttttacttgtttatgcttctatgaataatagaaatggaaaggaggtctattatgtgcacttagagggtatatttttatttgtgaaggattttgcacccagccttatacatgaataaccttatactttgatagataaaagatgaaggccccatgtaggtgagaaactttagtggtacatacattgcctcataatcagtcaaaactcctcttaacccacatcatgggttaaagagaacattgcaagaagccctttattcttctagaaggacaccatttattaggtcctttttccatggtttaaaataaaagaggcaataattagaaatgcatccctcataagaggctctatagcagattctactataaaggctatcattacacaacagactttatcttgtgaaagttatgctaataatagagttggctaaaaagaaaaatacttgtgcagttgttggcacttgtggcttatggagaaataacatcaaatgtagattataaaaattcagttgtaggggattaatgaaaagaccacttagtcaagcaagtagactcttcatccagctccttctttaatctatttaattttaggtggtttgctttatggggaccctggctaaggagcataccccaaactcttggtattattatcttcccaatagtctaataatagtctccctgatgtgctatattctcttaaagattttaaatgtttgcatgcagccatcagtagaatgtcaaatggtctctcttcaactggaatgataagagctgaaaggaatatgtgcccataagggcaccataacctatgaatgatgtgctgagactggaaacccaaaataatggcaacagagagtggtgctaaggccctaaattttggtcacactctcacctaagtaagaacccaaccaaaaaaggtgaacttttaaaacaaaattataggaggccattgttttggactaagctcatgcactaggacccaacaggccaaactgaactaaaatagagttactcatgctaaacgtgacataatcaaactaagactttaaggaaacatgtagatcctagaacagacttggttttgtttttcttctgtaaatagaacgtttcagcaaaaaagttaccctctactcagcccttgttcttaccttttgcaaaactcactgttctactatttcccagtgggtttcaagaccaaataagtacatttacaatggtgatagtgacatcaataactgaagtttttgtgaatctctcaaaaccgagaaaatgaccaaaaaaggggaattgttaaagagaactaaatatggcctgagaagggctctgtacttctatatttgagtccttgtggatgaaccgcaacctagcttaataggtagataagattgaaaacgtaacttaggagtatgtgcctgtaacaatagctgagtcttggcccatcctagcagccatacctcaaccattcatacactgctgagtgtttaaactgtgttgaaataaggcaaacaccaagctgtaaccaatccagccattctgcacctcgcttctaatttctgtacgtcatttcccttttttttgtctataaatcttccaccacatagtggcacgggagtctctgtgaatctgctgtgattcttggggctgcctaatttgtgaatcattcattgcccaattaaactcctttaaatttaatttggctgaagtttttttttgtttgttttttgttttttttttactcaggcctaggcaaaaaatttgactaaggccccaaaagtaaatgcaacaaaaacaaaaataaatatataggatcttattaaactcaaattaagccaaattccatacgttctcacttataagtgggagctaagctatgggtacacaaagacataagtggtatgatggaatttggagactcaggatgggggagaaagataggggagtgagggataaaaaaaactacatattgtgtgcaatgtacactactcaggtgatacatacactaaaactcagacttcacctttatacaattcatccatgtaaccaaaaccaccagtatcccagttcatccatataaccaaaaaccaccagtatcccaaaaaccattgaaattaaagtatatgtttatattttttacatatatgtttcatatatataaactttacatatgtataaagttcaatttatacattacacacagtaaaaggttaacagctattaataaagtacaacaattatattaataataatatgctataataaaacttacatgaatgtggtctctctctcaaaatacctttttgtactgtattcacccttcttgtgataatgaagtaaactgaataatataggtattgtgctgcagcattaggctactactaccttctgaagcaacctgagaggaaggtttatttgcttctaatgaccctggttcattgagccatgatgatgttaatggttggacattagtagcagacaacgtttatgaccattaggcagacagcatctacatcatggaatcactggatgaaggaatgattcacatctgaggggtttcagcagaaggacacaaggtttcatcactctactgagaactacacacaagttaaaacttattaattgtttacatttgtaattttccactgaatattttcagaccatgactgaccataagaaactgaaaccacagaaaatgaaaccacaaataaggatgggctactgtaggaataaatggacaaaccccttagagtgcctgaatctacaatatgtcagcaaaagaacctacaatatatgcctgaagtaaatcaccttcaagtatgttcaatcattccttctctttattcaaaattgaaatttccaaaattcaatttggaattgaattttgccctaactttgtcagggcagggaagaacatcttaaaaaacagtcccccaaacctgctgatgttcccccaatgtaacatctgttgtttggcttccaagataactgaggatagataccccacaagcaaagagacccagaagagtgttggatgcttggccaaggagtttggtcttcatcttataggcagaggaaagtcattggaaaaataaagaatggagataatccacacttctgttctctttgggaacatgatacactctgggaactgtcaacaaataaaatcataaatgaatgcaatatacaaatatgatatacaattctcatgacatttattggtgagcaatctggatgttagaaagaggaatgaagttagaagtgattcgttgaatacaatttcattttgtaggtaactatgcagagaagcaacatctgtagctttcccttggtcacaagtttacctactggcattcaagatttaggactaactttctttggttattatatgacaccatcatgctgagccattgtgataaaagcctgtgttaatgtacctttcttcagtaaaatactgctaacagatcctattgtgacttggatcatgtctacagtattcataatgttgggcatttctctcactattacttcaaatgctgaagatgtaatgtttcatctttcatttcctcatttattcagcaaggacctagtgagcatcagatgctatgttggctgagggtacaaagataatagtaatggtattgataataataatatcaacaataataatagagaacacttacaaggtgccagacaatattctgagtgcttttcatgtgtcaattcatttaatcctcataaaaaactgtgagcagggatggagagtgactgctgatgggttcaaggtttctttgggggatgatgaaaatgttctaaaattagattgtggggttggttgcacaaatctgtaaatacacgagaaaacactgagttgaacactctaaatgggtgaattttataccatgtgaattatatttcagtaaagctcttaataaataaaattaaacccagaagatagattattggccccacaatgcagataagtaatgtaaggcacagagaggttccatcatttgtccaaggtcaaaaagctgctaagacacagtgctgggatttaaatccaggcagactcagagtctatacaatatatatacagtcctttacctgaaagaattcaaaatatggggcatctttacagaaaatgaagcatacatatatagcccttgtatttcagtttgcagttccattaaatacacatttggagaaaaagaaaaagtatataaaagaaagccaatggatcgcagagtactgaatatcagggcatgtgccattatgtccaaagcctgattctcctcctgaagacagtgtgatcaggaaaaagtttcataaaatcagttgaagaaaagaaggtaaagagagcagtttactcagtgagggttaacatgacaagcataagctggcctgtgtgtggacacccttctccaggaagtcctagcacctggaggaacacacaggaaacaaacggataactgtcggtgaatgacactcagctagttaaacagtagcttaggttgaattccaactttctatactttagattgactcaactttaggccagaaaagaaggcaaaagagccgcacaagataatctgagatatgcaggcattaaatgatttggtgagcacctggtgttaatgaggccacagctccaggcttctacaggtcaactagttcttacacaaaatctttttcaagaacacagactctggctgtcttgaaaatatatttaagtggttaaaaaaaagaactgaataagagaaaacgggtggctgagctcgaattcttttcaactctaggaaaaactcacagtgcattcctactgatggtgagctaaggacaaagcattccctaaatagtatgcattcaaccattaacagattgttaacaccacaatgtagcagacataggaaatacttaaaccagaatgcagtaaccaaatttcagttctataaacttgcagtctgcttcaaattctactcaactgtatttatgcaccaagcaatgcactaatcgttggataaataaggcatatgaccttttgtgccaaaaaagtacacagtatgtttctaaactcctcaaaatttttagcatgactgtattattacttagttgaatatttttctcatttggtaatgaattatgagtgtgatattcattaggtcccaaatagtgctcttcttatccactaaaagagctacataaaaaatacaaaagttgtagcactattcacaatagccaagatatggaatcagcctaagtgctcattaacagataaacagataaagaaaatgtggtatatatacacaatggaatattatttcaccataaaaagaatgaaatacagtcatttgcaacaacattaatggaactggaagacattatgttaagtgaaataagccaaagacacaaaggcaaatggcatatgttcttactcatatgtgggagccaaaaaataggctgggaagaatagtggagaggaagggataaagagaggttgcttaatgggtacaaaaatacagttagaaagaaggaatatgatctagtatttggtagcacaaacacttagggcgactttagctgacaatagttcattgtatatttcaaaataactagaagagtagaattggaatgttcccaacacaaagtaatgataagtgtttgaggtgatgggtatcccgactacccatatttgatgattatacattgtatgcttgcatcaaagtgtcacatatgtttcaaaacatgtacaactataatgtgtccatacaaattaaaaataaattagttaaaaatgtaaaggcagattttcttactaaaattcaaaaactgcctttatataaattacagaagaaaataaattttaaatagggtgataaatcccaaataatttatatttagtttgtgaatgttcaaagcacacacacacacacacacacacacacacacacacagagatgttctaattcagatatgagccctctctgagtccaatttctctatccaccacaaactttacactttcttctgttagcctacttatatatgcatacaactagttgacctgtagaggcctggagctgtggactcatcaacaccaggtgcccaccaaatcacataatgcctgcatatctctaatatattagaggaaggagaactaagtagataaaagctcaggtatccataaaatgtaatatctaaactaggacaatgttgaaaatgaagaaagccataatgattacagtgggacaatagaaggaaactggggctatactgggcaaattgagacattagagtcaccctgttaaaagtctgtgctgagttctgaggtcacactctgctagtagttacagagaaacagctgaaggcttttcagtagtgttgttaaatgaccagaacttcaggaagcttagcatagaagtgggttatggctcgattggagcagagagagactgaggctaggaaagcccatgaacatttttatgacaccagtgaagacataaggaaaggccaagccacgatggcagcaataaaaagagaaaacctatatgagacattatctaaaatcacagttaaagcagttaaagaagatatacaagttgtgacactggtccaagtagttataaacttttgaacacatctcaagggacttgataggtaaaggtcaggcatggtagagcaattgccagcaggagaaaccaaggtgagatcagattccagggccaaagctgtttgcttcatactcatttttttcatacttcctgttcatctgagtgccaggatcacaggtgtgtgcttcactccacggagaactccacggggggtagtaaacatccccattctgtttactaccatggaaggcataggtaagccaagaggttctgtcactagtggggtaataaaatgccaccaacaattgctccagacaccacttggtggcaccagtaccctgaaatgattgaatgcaacctgcttatcttgttcttccatgggaaattcatataaaccttcagccaaccctcaagttcagttttttccaggattatttgagtttgtcggaactgtcacatcctcctttattgttatccatggagattctggtagaagatgagaatgtctttattttaatgatctcttattatttcaagtattcctttgaatgtacacacacagaattttgcataaatatgaccatttcttactggattttgcctatattagattcttccctttttgtttagcttcctcacctaccatcaccacaattcccccaaccccttccagaaaacccaccttaacaacctggtatgtatctgttcatattttttccatcatataaccttatacaaatggatagatagactatagagagacaaatgaatacatacaaaagttgttttggtcattgattcataatgtagactcacatgttcttctatacatgttacttttctatctcaacaataccaggtggtaattcttcaaagtcaactggtattgctccattttgctcttttgagtggctatattatattctatggtataaatatgccttaatttattcaccaacagtccctattgaagggcattcacttggttttacttttgccacattaaataatgctgctgttgtctatatccttatgcactggtacggacataagtatatatttttttaatttatgaaatgttgccaaatttactttcaaaaagctgcttaaaattcccatttccccagcaacgtatgaaagtactccttccctcacatcttcacttgctatgtacagttttgctttttactttttctcagcttgatgggtgtaaaatgataacttattattatttactttttgtttttctgactgtttgtgatttttttttagcatcttttcaggttgttgggctattttgatttgattcttcacagcatttgcccaaagcagagatttttttaaaagacctctacttaataaagaagctagaagaatattgctaaaatatattttagaaagtagaaaatatgatttattatagtcactaatatccatatgaaatatctaacacacactaaaagcattggaatgccagaaaataatcttgtaagtactatttaatttgaaatgtctcctctgaagacagaatgtgcctatttttctcttcataaggaattgtctctttcatagtgttttacttctgatcggacaatgtactttgctgtgtatgcttaagtaggattaggtattaaatagaaccagttccatttatttgattgccattccaaatacttgctttaaaaaagaaagaaagaacaaaaaatcagtagggaaagaaattgtatttttaagcttctaagaagattttataaacaatagagcccagagaacaaaaaaaaaaaagccataaaatgacttgacagtgtccttttaagtgaacatatgtgagttttatgcatccatatgtgttcacatatgccctacatatgcacagccagctgctagccggccagattgttcagtgtgtatgtttactggaaaacaagcccaaagtgtttggtctctttgttagagaaacagctcataatttcaagtatacaaatgtcagttgtttctcatttctttttcttccaagccaaatgagctgttgatgctcaatttggcaagaatctaactgaggctgactatcagccagccacaggaacccagccctgaaagtttgagaaatttttacaagaataagaagctttttcctaatggctccctaaaccatagaaagtttccttagagcctcagccagttctctcccactcaatatcccaaagtataaccgctaacattgtttggatactaatggattaagttagggtgtgaaatgggaatattaagtcctcccatactttggccaaatactctttagaaaccctcttaacagagaagagcccgagggtgtagagattttatttgtgatagcaacctgagctatgagccctaacatctctccttttatttcatcttttatgactgtcccacagcttaaaatgatgaagtaacatttggaccaatttccaattgaagattaagcctttagatcaattatatatctgcttccacaattaaggtattaaacccaattatcactgttatctctgcagcctgaatagaggaaggaaaagcatgtggaagctggatagagtgaaagaacttgtgctttggggcgagagagtctgtgtcccatcctggatcattccctgaccacatggccttaggtaagcagcttcacacttccaacttcagtgtccttatcagctagatgaaaatatgccgatttcctaacattctgatgaaaatgaaatgagaaaacctacgtaaagaacaatgcacagtactggagataggataagtgctcaataaatttaagttctattcccccttctttacatttttctcaccctagtccctgcaaaaagagagagacatgagaaccaggaatatttcttgatcaacgacataatccaaaggtccccaatcctaatggcagggaggaaaagggctgaattaaacaaacaaaattcatttaaaatgttggtttttcatatcataaacagagtcagaactgataagttgtatttatgtgtgaacatattcataaaaacatactcatttatttagcacctattgtgtctctataacagtacctgacatgtactagtagccacaaatatttcttaaataaatgaataaaaaccaagtcattagagcaccatcataattttttcctaagtgctcagtttcctgggatttgtttgttagtgatggctccttgctttccaaggtgaatggaaaggaaggaaggtaaggaagaactacaagtatccattgtcacagacatatgcagccactgaagaataactagaattatcttatccaccttctggcttaccaacacaggctccttctgtatctaatcacttctcattccttctttcccttactccattcaaccttcatgaagctgtccaacatttcctcacaactgaaaaatacaattcctattgctgcaggtgtccatgtgtttggggcaaaaatgagccactgctaacaattgtaaagaaagagagaacagctgtttgcatctggatatggggtaagaaagaacagctgctggcagcggtggcagacaagaaagtgagcaaatgagcagctgttggtaattcagaatctcatcagccacacagaataattgaaatccagaaccatgcagggctcgacttaacagctttattgcatcctgctgttcattagatcctgcctgtcctccattagagattcctgtgatagctacatgaggactctcaacaggaatatccaccccgacatccccatccacaaccctttgaagaagcaacccaagagaggtaaaaaggcacagacttttcttccagtaagtccatacctatttttacacaaaggaagacaagggaagggatattaacacacatgggaatgatcacaagattggccaaaaataattatttctgtattataagaaattatagccattttaatgatgaactcacatttcagaattccagcaagccagcataaatatgtgataagtataacttaaacttgaaaaaatatattttgaaatactgtcagtggtttcaatgtctcttttcatgtatatgtaatcctatgactatatatatatatatatacacacatacatccctctttttttttacttttaataaaaagaagagaaaaacatgtttgcatcacgcattacaaaatgtgtttggtttccttttgggcttcatactagttcttctagccaactggaattctaggataaatctagaatagattggataggataaatttgagtgaccccaaaatatcagtccatctctcaccttgcttaatacagaagaaaaacatctcattactctcatatatagaattccaattctttagtcactgaaagaaacagtagaagagaagaaaaaagaaaccaaccccaatgttatttattgctgaactatatacaactaaatgtccccaaataaaagcatatttaattatatggcaagttatctgtatttataaaggtgatcgttttgaagatgttaataggggaaatacttgtgacacaacacttatggagaagagtctgcaaagatcatttagacaggaaaagttgaatgcaaaatgtgcaccataattaacattatggtttaaaggtaggcataagacaattacatgaaagaaatatttttaaatggaggaagtcaaaataagagagcagaagggaaattttaaatttcatttcttttgctatttttctcattctgctgttattataaaacgtaaaagatctaaataataattagattataatggaaattactgataaaatcctaaactgttagtaacgtaaggacagggtccttctttgtttttgatcaccttttgtttccactgccagacacagtgttcagacatttaacacatatttgttaaatgaagaagtaaatgaaatgagtaaatcctctatgttttaaaactgccattgcagaagaaagaatgaaaccacttctaccaatggcatatatgtgactgagaaaatacttcctctactgaaaggatcaattagaaacatccctgaagttttacactcacagcatcttaaaatggagactcccatgatgagatatgtggcccaaccagatctaatgaacccacgaattatgaataatgagaggcagagaaactagccaacctctgaatgtgttttcaactgtaagatataattctatgactcggattaagagaagaaggagaaagattgattgccaaaaattaatttcacagcatctgactcttaatttgccaactagaatggccaagacaaagttctagtagttttgtgctccaggtggataacttttgccaaagtgaaattgtttagtgtagctattcacagctcccctctcaggtccagggtttgttccctggtatgacactagaagaagcgtttgaactttaagcaagttggtaagaacacagatgctgtccacccttgattttactgccccacattcctgcaacagtagactccaaggtttaaagacttccattatgtcaagagctgcctctgaatcaaccttgtctactaaaccatttcctgggaaaactgtgatatactcatcattctggtataaacatcttaatataaagtctgttttccagatattttaaaacttccccaagccctgcttgcataaagtgtaaatgttccgtgttaacataaggtacgcctgcattttgagtgttgagtaactcaagaccctgacaaacttgtatgttatccaaaatatgtttgcagacttttccccgttgcctataaaatagcattaaaggaagtatctcactccataaataaaactgtcgagtatttaagtgacttacacttcatcatcatcatcaccaaaactgtaaagtgccctttctctccagggctgggatcataatatactgggcatattcaacagatatttgagtaacccactgagaagatgcagtactaagttttttttcatctttcttttctttgattccttgacagcaggaatcatgccacctactaatctccagatataatttctgtattacaaatgtaaagcttaattttatgtgataacttcactgggccgtggggtactcagatattttgtcaaacattattttgggtgtttacatcagagcatttttgagtgagaccaaaatttaaatcagaagactgaataaagcaaattaacctctataatgttggtgggactaatctaatcagttgaaggcctggatagaacaaaatggctaactctcccccaggtaagacagcaatcttcttacctgatgacctgtgaactgggcattggcttttattcctgcctttggactccaactgaaacatcaggtcttcctgggtctcaagcctacccacctttgaattggagctatgccatctgctcttctggttctcaggccatcagatttagactggaactaatttgtcagctctctcaggtctccagcttgctgactcatcctgcagatcctgggacttgccagccttcctaaccaatcatgtgagccaatttctgatcatttctttctgtataggaaatatacacacatatctacacatacaaactgttggtactgtttctctggaaatcctttactgacacaataagtaagtcagcaaataacatccagtccactgaaataatcaagtaaaaccattctgcaatgtatatatatacttcaaaactttatattatacataataaatacatacaattttatgtcagttaaatcttttttaacattttgaaaaaaaaattctttcatggttactttccataatggcagagaaaagttggaagtgggctccagattccaggtagtggggtagaaaagactgggattaaaaagagtctggtgggggcaaaataaatactctatggattagatattgagagagtttgtaatgtccctaccttgggtattcctactgaatgatccctaaattctaagtcaggtggtgtgaaggaaaaagcctggattttagtaacgtagtagactggggtgaattgtattctaccatttctcactgcatgatattggaagtatctttgagtctcacgtcttcactcgaacaacaacaataatgcccacccgaagaattgtaaagattaaattacatggcatgcaaaagtcccagtcacaccataaactgataaaacatagcttaatttcctttccttccatacttaaccataagttctgggcagagagtaaccttattttaagcatctttatatttcccatagatctgtcccaattgtagatctttaagaatatttgttaagcaaagcaaccaataaagctagtaaagttagagccatcatccttttatttctagcacagaattaatgactccatctgtaaaaacagcccagcactatgccttctaaaggcatttttcaaaatcgtgaattcattttggatgtcttgacacgtaagatttcagttagacattcaagtgtatacaggtctagtgcttaggagaacaatctagactagagatgtggagctgggagccattggcacctaactgaaataacaggaaagcaattgtgtagagcaagaagactaacaggtcatgtcaggatcctacaaggtatcaacattgaagtcagcccccaaaggagcatccagagaaaaagaagaaatacaaacaagtgtggtatcacagtagtcatgacacaagaatttttcaaagagggaatgaatgctcaataatgccaaatgttgctgagaagtctaggaagataaagtctgaaggaatggagtaggtagtcaggcttagtcactgctgaagtcacttctaactggtccttcacctctggtctcaccttcaatccatcttccctggaataattatttatctaaaacaccagcctgattctgtttttctcttcttaaagctctcccacgc
